United States Patent 9,328,346 (POLYCOMB-ASSOCIATED NON-CODING RNAS) - sequence listing, part 14

SEQ ID NO: 2073 - RNA, 43089 nt, Mus musculus
uggguugguugacuaugggcucugugaggcugcgcagagucagacuuuaaaggaggcggagcucugucuuucgcccucaagaaagacagugggaucggcgaguggcgacaacagcaaucgggccugagcccugcuagggcuuuaggcuccaggugagagccaucggguuuuggauuccccaagggguugaugcugccaaaacccuuggccgugagcuccagugggggaggguggugaggugggucuuucugugcucugugaucgacaugggguuugagcaauagagaaaggagcuucuaaaauaaguuuugcgauugguucuuuccaaucucuaguggccaaugggcgucgggagaggggggcgggcccacugggccuuauuuucuucuuccugcggccgggccucccucgccuaggcgguggggccgggaggggcagugucuguaagugguguguggggacacugggaaccgggcugccuuuggagggaugccgcggggguggcugcgggggcggagagugcgggaguuucaggucacuguuagcaacagcugccuuuauggagugcuuaccgggccuagcguuuagggcucgcuugcaucaucuaaguuaaucauacgauccaucaaggcagggguuugggguccccauuuugcagguggagaaacugagacucauccaguccauucacacagccaagguguuaaaaagugacagagaucagaccgguauucagaguuuucacucuagagccgaagguuuagcucccgguacucuuugcuuuguugcugaaggcggacgggaaggugccccagaccagauuuccccaagggaauagaucgcgggaauggaacccuagaguuaaaguaaugggaugauccgcuaaagugagcagaggauaugaguuauucagcaguuacugagugccuacuuuguggcgagcauuguucuagcuucuggacacacaaagauaaacagagcuagaggcagaugaagcaacauugugaccaccuuugaagcccaggggaggagccccagucugauauuuaugauaccuuuuuguaaaaauuucaaaaguagaauauauugaaaauuuccuuuuaaaaggaaaagucuccuaaauugaauaggcuucaaguuccuccacacuuucagagaagucuuaguucauguaaguauuagagcugagguagcagaaagugguagaagaugcuuuagagggggcacuuuggauacauuuccugguauguaaagcagggauaacaguauaucuuuuaugcaaaguuaaugaaaaaugccuagccagaaaucccucccuuggaguggaauggaaacccaagaguuaccaugacaggguuucuguuuaaugcccuggaguuugccuccaugcugcuucccaaaacccaugcuagguugugggcagguuguaggcagcuuucuccuguauagugaguaggacugccaguggcuuugaggaaacagaacuccugggcugugagugaggagguccagugaaggacauaccaguuuugcuucuaaacuggcuccuuuuuagcaugcauugucuuuuucugguuguggcgauuguggcgaucuguuguauuaccaacacuggguuuaggcucugcccacuuacuugaggaccucauccaaaaaugucuauguauuuucucccggcaguuggggagugugcccuguauugccagcucauugccugcuuucagugcaguugagccaucggaguucauugaguacugcugaaaccauuuugauuuagauagaagaguuucccuucaguguuuuaaacuccuaacauacuguuacuaucaaaguacuuuuaaaacuugaacccccugaagccuuagagucugcagcuaagugacuucucagugguuuagaaucuugugaugccgugcuccagaaaacagcccauaggaagcuuuuuagaagcucuggcuguccuagaacucauucuguaaaccagguugaccugccucugccuccugaguacugggauuaaaggaguguuaccaccaccacauuauuccccuugaccagguguacucauuguagauguuggauuacuaacucuacauccugccuucuuucucccucgugcugggcugcugggcaucuucugguuuccucggguucuuuuuuuuuuuuuuuuuuuuuuaaagauuuauuuauuuauuauauguaaguacacuguagcugucuucaaacaauccagaagagggagucagauuuuguuacggaugguugugagccaccaugugguugcugggauuugaacuccgaaccuucggaagagcggucgggugcucuuacccacugagccaucucaccagcccccucggguucuuuuuaaacggaacagauucugcuuguccaucuaguccauuuaaauaagcauuguaguagggggcaguuccuugucacuuacuuuuguucucuuaacacuucagguuuuuauccuagcaaaaucggccucaaaaacagagaagacaagauggcuucugaaucagaaacuuugaaccccagugcucggaucaugaccuuuuaccccaccauggaagaguuccggaacuucagccgcuacauugccuacauugaaucccaaggagcucaucgggcugggcuagccaagguagggagcaggaaugugaaccugcuucggcagccgcuaugagaauauuucuggccucuguaauuggaaauuaguggcgggcuuguacuuauuugcauugaauuacugaugcuccucucucuccaguccagucuuccuuucacacagccuguggcaaucauguuuccugagucccuaaagaggaaauggacaguggugcuauuuuuuuuuuuucuaagugaacaccaggaaaaaaccugaguaguccugauccuugcugauaggaugguaugcaggugggacaggaaagggacauacagagccaguguccccaggccuggccuggggcuccaugguuuacagcuuuuaccugccacuggcauucccaacaccugccccucucauuuugguccccccugcacugauacaguucgguuucccucagggacuuucuucaagggagagacucacuggccaggccacauaaggguucuggucucuguaguuuggaguugguuucuauucuuccuaugcacugaaguagggccgcccucccgaccccuagucaaccaacccuuucuauguucagucacucacgagguuuucugagucccccacgguaacgcgauugcauuucggaaggaacccuuucagacugaugcggaagacuuccucugagccaaggggagcugucccgccguuucaguuugaauucccugcuguauguguguacggguucacuuuuuguuuuuguuuaucaugggacugaagauucagaucuaacacucuauaccucugaguuaguuaccuuuuuuguuuuguuuuguuuugcuuuugcuuuuguuuuuguuuuagagccaggguuucucuguagcucuggcaggcuggucucagacuuagauccaccugccucugccacccagugcugggauuaaaggugugugccaccacguccgacucugaccuuuuuuucccuagcccguuacucuuuugauauagaaaaagaaaaagaaaaaaagaaaaaaauauauacacaaaauccaaggauuucaguuccaaaguugaggacuagucuuagacuuuggugucuuucuucucugaggcucccgucagcugucucagagaaaauggcucguucacacaguaguaggcccugcagggcccacaguauagcuuuacaacacauggugaggguauaaauugauauacguauuagauuuuauauaaaagcuguuuggguuuuuaugaugcauauccauuauuuucuuucauaagagccauaauaauuacuguuuucucaguuuuauguuagccuaggcgaguuuagaguggacuagguagucauguuggucucaaauaggagauagccuggaguacuaguacaaugggugucgcccagcacuucugcuuccguugcuuuguuugcaaaagaacucugggcuguucaagaacccacucuucaaucagauaaggcgccuagguuuacaaguucuguuuugcuuaggucacugagauuauggggugggcaguguucucgugacagcgugacuuccuggguuugggggaguguaagugaaucagaguuacuuucugguaaaauggaccgcuagucuggacaguggccuacacacuugugggauucugacuugcccguuucucaucugcccccuucuccaugccuuguaggucguuccucccaaagaguggaagccucgaacauccuacgacgauauugaugaucuagucaucccugcgcccauccagcagcuggugacuggccagucuggccucuucacucaguacaacauacagaagaaagccaugaccguucgugaguuccgcaagaucgccaauagcgacaagugaguggagaugcuuuggcggggaggcgggggcguuccauuuuguucugcuuugguuuggagacgggguuuggcuguggagccuaagcugcccucauccuucaagcgcagcaguuaaggcucagccaguagaaauacaucgcccucccucgcccccccgccccccgacuuaacuucuaauaaguuuuuaaacuuuaaguuugagagaggguuucacuagguagcccuggccagccuggaacuggguauacaaaccaggcuggcguugaacucaugccaaugcuucugagcccugggauuaaacgcguguaccaccacuucuggacguuuuuauucacauguaaguauguuuaggugcaugugugccgcacaugaguauagaggucagaggacagcuuucagaagucaguugccuccacucucuugucacggguuauggcggucaaccucaacucaucaggcuugucgaggaagcccuuugacccucugaggcgucucuggcccuagcauugcuucuucaucguugucucacggaagaaggcugacgcucaggcauccguccccccuucugcucuuuguguggaagacuuucuccucacagugcuaugugcucugccacaaucuaaacuucuuuguauuauguuuuaaauauuuaauuaauuuauuuuaauucauuuaauuauugugguuuuucgagacaggguuucucuguauaacucuggccuggaacucucugugucccaggcaugccucugccuccugagaucugggauuauauaagugugucuuuuguuuguuuuuugagacauuguaucucuguguagcccuggcuguccuggaacucacuguguagaucaggcuagccuccaacuuagaaaucugccugccucugcuucccaagugcugggauuaaaggcuagguguuucuuauaauauccugggcuagccucugcuucauuguauagccgagaauaauguccuggucccucggccucuacuucccagugcuggaauuacucuaucugugcccuuuuuuaaauguacauuucauuacguauuugugugggaguauguaagcauacgugcauggcccuugugugaaaaucaaaagaacagcuguggggucacuucucuuucucugguguaggggucccagggaucaaauucaggucaucagacucagggguagugacuuuuaccugccagacagcgugccagccuuuguuguuauucuucuuuuuaaaaauguuuuauuauuuucuuuuucucuaaagugcacugguguuuuaucugcuuguauaucuuugugaggauguuggauccuggagguacagacaauugugguugcugggauuugaacucaggaccucuggaagagcagucagugugcucuuaaccgcugagccaccucuccagccucagccggcccuugcucuuauauaaagugacccugcuguuuucucauugcaaguaguaauuuuuuuucuuuuaauuuuaguguguagguguucugucugcauguaugucuguccaccaugugcaugccuugugcauguggggcagagaggagaggaugugggacccccugacacuggaguuacagguaguagugagucacuuguucaggagcugggaauuuaccccaggucuucggcaagaacaagcgcuccucaaccacugagccauucauuucucugguaccaguaauuuucuuuuaaagacuuguuuugccagcaugguagcacacaccuuuaaaauugaggcagacacaguaagaucucugugaguuuuaggucacacuggucuagagagcaaguucaggucagcuucaacuaugugucauauaucuuaaaacaugaucuuauguuuauugauaugugugugucugucuguauccauacuagcauguagggacccucaaggcugggagagggugucagacccauccaggggagcuggagaaucacugugggugacccagugugggugcugggaacuaaacucaaguccucagcaagaucaggacgcccucucgggcugagcaucucccugccccagcugcaguaugucuuuguuuuugucuuuuguuguuauuguuguuaauguuucuuuuugguguuuuguuuguuuguuuguuuuuuucuaaauuaaaaaaaauguugguguugaugguacccaaggccucuuguauagacacagucuauguagcuccugccccagcagucuggugcguuuuugacuauggaaaauugcauagucguagaggagagagucggagggaggccacgggagcugcuuugggaucuaucugucccacucgcucguagguaaguggcgcugcucauuuccauuccccuucugccugccacagcgcagccggcucugucucaccgcugucagggcacuuggaaugugaaugagcaauuaucacgccgguuacagugugccagcccuccccaugccgucuugcccuguucucuucuuggugucucugcuuguucgguggcuugccgccauucuguucuuggcucaucucauccaccccgcauugaacggagggccucuugcuccgggcauugugcucugcucuccuacucauccuccccgagucuccccagccugaggggccacggggaucccuuccuuuccccuuccucacucccugagucuugcugguucaccuauucugaucucagccuggcagcuggagcggaaccuccauugcaagccccugggcaggugcagcguacuuuacugucauaucccuccuccguguccucugcucuucugccuucucuuguuucuugucacuagacuaaccgagaucuuacggguguguucauaacccuuaaaacaccugcagcgcuggccagcgagugaauuuaugcaaaugucugucuguggaagugugacgugcucuguggaugaaagucugagccauccuuuuacggcugcucucagcugugcccuguaccaagcuugccugcuuguuuuccgagugggggcccccucagggcuucaucauccucucucaucucucucuuugagaaaacuuuuguuauuuucggagguauguauaugcaguacacgcauagcuggugccugcggagaccaaaagaggacaucagaacgcuugagacuagagcuacaggcaugagcgaccaugugggugcugggaaucuagaagaguagccagugcucuuaauuguugagccaugucuccagccuccugucuucucugcugugagcacguuaguuuuuuuccuuguuuguuuguuuguuugguugguuguuucugagacaggguuucucuguguagcccuggcuguccuggaacucacugaaauccacugccucugcugcucuaguguugggauucaaggugugggccaccccugacccaacuuacucuuuuccuuuuuuauauaauuuuuauguuaaaucacacagauuauccccuccacccugguauccuuuuuaaaaaaauacuauuuaucuacuuuuuuugugugcauguagggccucaugcaagccauuacuaaaaugagcuccauugccacccaccacccugauauauaaaaagcuuuuuuugccccuaauuucuguuguugcuaaguauuuuucuccaaauacuguuuucagccccacuaauuaucuguugagugugagucucugagaggaugcugggaacgaggcauugaugugugagggguguggagccccguccuugccauaagugagggacgcagguccugcuccgugccucgaccccuuacaucccggagggguuggugucaggguguggcuggguucgaaucuuuggcuuuuguguuuggaagccuggccucccacgucacuccaggaccugcagggugcaguaaccucuccagagaggggaggguacgggguuccucagggagaagggguucacaccugugccugugaccuuccccaggcuuccuccuguccaaggccuccagagggagaaacuguauuagaucugccaggaauucacuguguaacccagguaacccaggcuggcuuugacucacacggugauucuaucucaccuccucaguaugcaggcgagacuuuacuagggcuuggaaggccaagauggcuggcuuguuuuaccaggcaggacaaauacagacuuauuaaagaaaagugaagggggcgggggaagacucuuuaaagugagagguucaaagggggggggaauaccuuuuuuuaaguuuuaaauuuuuuauuuuaugugugagaggaugcuugccugcgugucugcuuguagauagcagguacucaaaguacucccaguggccacuagagggcaucaggucucccgccuugugagcccccguggaggugcugggaaccacgggaggagccgccacugcucuuaguuaaaaaaauaaaaucaaaauuguuuaucacauuugucggguggaggauggggagggagcauugcacgugccuuggcccaugucuggugcucagagggccacacugcggagucaguuuucuccugcuuauguagagaaugggcauugauuuaggcuugcaaauugagaaccuuucuuauuaagccauauggucaggcccccuccuccccucccacaguugucuuuuuuuuuuuuuuuuuuuuuuuccgagacaggguuucucuguguagcccuggcuguccuggaacucacuuuguaggccaggcuggccucaaacucagaaauccaccugcuucugccuccugagugcugggauuaaaggcaugagccaccacacccagcucacaguugucuuuuuaaaaguauauuuuauuuuuaguuagugugucuguggcuauauacacaaauccuggaaacccgcugaggccagaguccuuuggaacuagaauuacaggcagguuugagcugcccauacaggugcugggaacuaaugucagguccuguccuagagcagcauggcccacgcucuuaacugcugagccaucucuccagcccuugcuuuguuuucugagacagugucucguguagcagaugaccgugcccugauucuugauucccagguccugggguuguaggcauguuccaccacgccuggcuugaaccccagagcuuugugugugcuaggcaagcacuguuaucaggugagccauggucccagccuugugucuuguucuuuugaaaaguuuuguugucccuggaauaguggcuuguaucuuauaugccucauaaugccuaauaaacauauucuguugcugugauaaagcaccaugaccaaggcaacuuauaaaagaaacauuuaacuggacucaagguuucagagggugagaguccgugguagccgagugaaggcaugguggcaggaacagcugagcacucacauccuaaauggcaggcgggacagaguacaccccuucccaguucuaccaacuggugaccaaguauucaaagacaggcuuaugggggucauucucaagccaucuguaaaggacuaacaucguuauuucauguuugaaagguacugcaccccgcgauacagugaauuugaagaacuugagcguaaauacuggaaaaaccucacauucaauccucccaucuauggagcagacgugaaugguacucucuaugaacaggugagaccacugagaauccugcagugugugccaagcacacaguaggcacuuaaaaagcugguuggugaaugggcagaugaacaacagauguucuccugccgaugcacuguucugacuuccuuguuggcaguugugcaugugacuggaguuuguaucuuccacggugcacaugagccgggugcugugguguccuuuucaaggcugcgcccauaguguguaggugguagaugaucaguuccugagaggguggcauagaucacagaaagugaggcauugcuagggggagagggaacgggcggucucugcaggaagcagcucucugacuaaucaaauggaagggugggggcuuaagagaagcauagucagauuucacggcucuccagugagccgcugugacaggagccauuuuaaccacuuuuacugacuugggaucuugugcuuuuuugagcuaagaaauugcuuuacuaucgugguagaagggggaauauuugggucugucuuugguugacuaaagaaacauauaaggcuguccaggguuuaucucucagauuggcuuuaauaguggcaucaguuauugaaagggaagaguuuaaaagugaauucugaguuugucgaugucaguucggggguaggaaguuacucguggauggauggguggcaggguggugaaggaaaaggucagagggcaagaaguaggucccaagguccacauggaagggugcacagguaggcagagaguggagaagccuuagagggugacagaaggugucggcugugagauggaggcagaaaagcagggcgccgcgcacacuucagaaccugcuuccagagagccccuagauggcuacuggaacucagggaauggacaugguguggucaguugucuccuucuaccacauggguucugagcauugaacucaggcuugauggcccgugcauuucuuuacccacuacaccauuuugcuagcccuuucuuaaauauuuuuaaaguuuacuucauauucuuucaacuuuuuuauuuucuaauuuuaccugcauaccuuccaucucucugucuguccgccugucauccuucauccuuucuuuuuuugagacagggucucauaguguagaccuggcugcccagaacuuauuguauagaccagacugguauugaaugcauagcgauccaccugccucugacuccuggaugcaggggcugaagacgugugcuuccgugccaggccacuuccuuguuuuggaugcuguggcuuugacaggucacacuguaguccacagugacaacugaccugaggccgccguguuuacuuacauacguguccuggguugcuguuuccuggcagcacguugaugaguggaauaucggccggcugaagaccauccuggaccugguggagaaggagagcgggaucaccauugagggggugaacacccccuaccuuuacuucggcauguggaagacguccuucgccuggcacacggaagacauggaucuauacagcaucaacuaucugcacuucggagagccaaagucuugguaaagucagccugcacuuagcagcgggcguccauuggcacagggcuucuggccuuucuuuuuuuuuuuuuuuuuuuuuaaaagauuuauuuauuuauuuauuuuauguaaguacacuguagcugucuucagacacuccagaagagggagucagaucuuguuauggaugguugugagccaccauguggcugcugggauuugaacucuggaccuucggaagagcaguuggcugcucuuacccacugagccaucuuaccagcccgcuucuggccuuucuuacaugugggaauugcagggucugggcacuggguuugaggaggaacccacaaucugccuugaguccagaaugccuuugaggagcaaguuuuauuuuuguuguucuuuguugugugagacaggaucuugacccuguaguccagguuggccuuaaacugcuucucaauuucccagauucuggaaauaguagguacaugccgccacacauggcugaguagaggggcucagagacuagagugcucuacacuacguacggaacuucgcuuccugugacaguggagucacucagagucaugggacuguuccagggggcucugcugccggcggauucccucuucucaggaggccugccauuuccuuuccuuuucuuuuucuuuuuucuuuugcuuuuugagacagauuuguguguauggcuauuuuggaacucacuguacuguagaccaguaaagugucugggcugagaucugugaaggacagagcugggcggauggcggcaggcauggcgggaugggagggaaacaccuccccgggucugaacugcaugugcagggcucuuggauugucaggcacauguccuucgguccugcgaaguccgccggugugugcagaaggagacaguccugggucagugcugccugucuggugccagggccacagccgugucccauugugcugaguugaaauagccuccaguauaagccgugaagguuaaaaugagguagcugaauuuaaagcuuggcaguuuuguagacgguuuaaauagucccuggugucuccauuuccuuuguuuuuccacaaagagcagcagacaccacagugcauggaggaguaauuaaaucuacuggguaaucaguguagcuuguacgggagaaaaaugggcucaucagugucaagguguccagugcuuggucgccguguuuugcacuccuccagccucugcuaggccucucccguccuuccggagcagggugaaaaccuucacagcggugugaugccccucccacaucgggaaacaguguucuuacaggagccccuuaguaaggagagagacucuguuuguagguucucgcucggucaccgucgugcagagugagcgagcaugaaaggaauacauuccugcugcuguguaggcucuccacuccucugucuuaaagucugcuauuuccauagauugcucuucaguguccuucccucuauauagcucaggcugcccuugaauucuuuauccuccuuucucagccuuccuagguuugcuuugcuccagauguucuuagggaauacauuuuucagcccagugugguggaacacaccuuuaagcccagcaccagggaggcagaggcuggcagcucucugaauuccaggcuaaccuggucuacauauugaguuccaggcaagauggugcuguauagugagaccuggggccccaaaguaguuucaccuugcauguaguggguguacauacucaugagcuaucguaccauaugucaguacaugugugugauguguaacaaucagguugggguauuuggugcagcccucaugucagacguuugucgagucuuugagccgggaacccucaggaucuuuuuccuucaggguguuugugagggagagcaggucucucgauccuuuccucguccucugcuggugucugacauucucacgugauugcagguacucuguuccaccugagcaugggaaacgccuggagcgucuugccaaagguacuguauccccuccagguucagggucagccaucuccucgucuaacuccuugcucugagauguucauucuccgugguuagaugaccugugacccuucacaggcugcagaucuggugggaugugugagcucagcugccagaucccaucccuuaguggaacaggcccugccugagccuucccuauuccgucugugaaugggcuuacuccuuucccugcucucucugccuacaucccugcagcccucccucaacuaggaagagacuuggucagauucuucucccaagugucaagugugaaagccagauugagugacucucugugugugugugugugugugugugugugugugugugcguguuuaggcaacuuuaagugaacuuugguagguuugugccucuagagagucuuuccucuuucaagagaugcuggguagaucaaacuauagaugugcuaccuucaaaaggcuggggguacaggcgcgguguucagggccuggagaagauaauacuuaguucucagguuuuuaagagcaggaacagcuugaguaucagagucugggagagcuggaggcucacccaggucccagacuucuugugacuggaccaucgucagcaccaccuuuuuuuuuucugcccaggcuagguugcucaugucuuuaaucucagaagagucaggcugaucuuuuaguguuuuuuuguuuuuguuuguuuguuuuuugaggauuucucuguguagaccaggcuggccuugaacucagaaaucucccugccucugccucccaauugcugggauuaaaggcgugggccaccauugcccagccaguuuuuuuuaaagauuuguuuauuuuaugcauaugaaugcacuguagcugucuucagccacagcagaaggcaucaguucccauuacagaugguugugagccaccaugugguugcugggauuugaacucgggaccucuggaagagaagucagugcucuuaaccacugagccaucucuccagucuuggucuucauaguuccaggcaaacccugggugcauagugacaauucccaucccccccccaaaguuuauuuuuaauuauaauuuuauuuauuuauuuauaauuuuuaauuuacaugcuugagugucugucgauguuugugaguaccauuugaggaggccagaaagaggauguuggauuccuuggaacuggaauuauaggugguugugagcugcccaccgugggugcugggaaccaaaccuagguccucuguaagagcaguaagcgaaacgcucuuaacugucgagccaucuuccuggccccguuagcaucgcuuuggugaccguccuucaguaaucaccccugagaucugcaggugggaaguaaccccagcaucagcgcacuugggcagagccucccucacuaacucagaccugccauccuuucaaacaggcuuuuucccaggaagugcucaaagcugugaggcuuuucuccgccacaagaugacccugaucuccccauuaaugcugaagaaguauggcauucccuuugacaaggugagcuggcugcgguccccacagaaggccuugggcuuacgcagaaguaccccuuguggucuugguuuggcagaguuuugcggucuguuguucuugucucuaggguggcguuugauaacagcagguggcuaauguguuuuccuggugcugagaggauuggcuaauuagucucuuagcauacaugaucuguuaagcgacaguucaagaccuggcagucuccacuuaccccugguugaccaucuaagugguagcaaagaaacaugcaggagcccaggucucugcuaggccccugccaggcguggcaguugugucauaucugcucuucuucaggugacccaagaagcuggcgaguuuaugaucacuuuuccguaugguuaccaugcuggcuucaaccauggcuucaacugugcagagucaaccaauuuugcuacccgucgguggauugaguauggcaagcaggcugugcugguaaguucucccagaacaccaugggcagacgugucugguuaaggacauucuggucagaacauuuuuuuuaacuguugggacaugauguccuggccagugugagacaugaccaacuugccguggggcuucacaaagguaucuuguguacauaucaagagcauacauuagguacaacauuuaggugaaaacaugacuaagccucccaagguccucuagggcgacccauuuaaggaacacuuccaaggaggcugcuauuugcagccacugcagaccaggaccugguuaacuuaauuagcugaagacagaaaaguccucacugugugcacgcguguauuugaguugcugacgggacugaggauugacccuaggcauuuugaauguuagacaacguuuaacauugagcaguggccucagccguuuuuuuaauaaaaacaggaucucaguacaccagacugcccuucaacucacaggcgaucgaucugccugccucugccucugccugaccacggugguccaaguccugcaccaccacucccagucucaacuccccuuacaagguuuuauuuggagccggggucuugcucuguagacuaggcucuccuugagcuugugauggucuguccuggaccucucggguugcugggguacuguuacuuagcucggcaucucccaugcaggagucuuagggcaagcagcggggccuagacuguugaucuaaaggaguaaacuugccuguuuggucccagcgugggcagguagcagcucgccguuggggaagcguuugcagauuuugucucguccuguucuccuuagacccaugugguuggguugguugagccucgugcugugcacucugccuuuggauuuuccuguuugcugggauuugaagguucuccaggacagugaacccugagucugggaacuucagcaucagcuaaaauuggucuuuuuuuuuuuuuuuuuuuuuuuuuuuuuuuuuuuuuugguuuuuucgagacaggguuucucuguguagcccuggcuguccuggaacucacuuuguagaccaggcuggccucgaacucagaaaucgccugccuuugccucccaagugcugggauuaaaggcgugugccaccaccgccuggcuaaaauuggucuauuaaauguggcccauaucauacaaaaugaugcauuccauccugucacaucaucuuuuuuuucccucccucccucccucccucccucccucccucccucccucccuuccucccuuccauccuuccuuccuuccucucuuucucccucucucucccccucccucucucucucccucucuuucucucccauucucucucccccucucucccucucucuuucugucccucucccucccucccccccuucuuucuuuuuuauauauuugaaacagucucacuauguagcucuggcugugcuuggaaccuauuauguagaccaggcuggccucagacucaccagagauccaccugccucugccucccgagcgcugggauuaaaggcacgcacugucucaugucauuuuuauauauguuaaaauguacuagguuuuacccccgccccaaaauaauccucucuugugcccugccccaacaaugugauuuuaaaccuucuaaugcuugaaucacacuuagaggauggaggugggacacgggugugugugugugugugugugugugugugugaccagguguccucacugucgcucuccucuggcagugcuccugcagaaaagauauggugaagaucuccauggacguguucgugaggagguuccagccggaacgcuacaaacuuuggaaagcugggaaggacagcaugguuauugaccacacucugcccacaccggaagcagccgaguuccugaaggacagcggcggacuaaccccgagagcagggagugaggagugcccagaggaggacguggaagcagcggaucagggagaggagggggaugugaagagaagguacagggugggcugugggcuuagcucuggggaaggaagggguggaggcaccacaguuucaguuugaguguuugcguuguuugcacugcgcacagcaggcuucagaaacagcccuggaagccacagcgcugaugacccgguagcuuccugugguucuuggugaggguagggagccugugcuguuguacgcagagucaguuucccccagcaccacauaaauaauuuuugaaagaaauauggugguaggagcuagacuuauccauucugggggaauaaggaauuauaucuggcuucauuggggcgugaaccagaggaucugugcacauuggggaaagacuggggcggcuguaugauucaccucagugcucauguccagggugggcagcagggcagcacuguucagaugauggaaugaaugacugggauguguugaggcagccuggccguuugcuuuggguugugcauggcgugcagggcagcauucuggugaacggugagucggugaccauacgugcucuuagguuuguugucuccuugcagccuggccaagcaucggaucgggacaaagagacacagagucugucuggaaauaccccaggaggucagucagagcgagcucuuccccaaggaagagcuaaguucuggacaguaugagaugacagagugcccggccacccucgccccagugaggcccacccacagcuccgugcggcaaguugaggacagucuucccuucccaggugagcugacagacugguugguccacagcccugacugacaacugucugucggaggcucagugcuguacugaguugcaaggugaccugucugugggcagcccuguauuggagugugagaagcacuuugcuuggggacauguagggcagccagacacagaggaaacggcuuguuccacugcuugguggggacucggggacaccagugaccaaaggcuucugugaaggauucaguccuagaagguggguggguugcagcaggggcgucugaacgaggaagaccagaaagagccugagaugggaaguaccaucuccuggagcccucggggauucccucugaaucugauguuggguugagaaggauggaugcagucuguggccaggcuggacgagaggggcaaggcuugccucaggcuccugauguugggaugauaggcuugugccgcugcuggccuuaguuuguuuguuuuaagucacugucucgcucuguagcccugacuggccuucaacuggcucuccucugccucuccaguucugggaucacaggcaagcacuaccuuguccaguguuggaggagcacagugugagaucagggccggcccggccguugugguguuuguucucugggaggcuggaggaccuggguuggaggagacgugucuugggagcagccacucagauaagcaccaagucuggauuuacuagguucaggcuuauuuuggacuugaagaaaucuguuuacuaugccaacuguaugucugaugguuagauagcacuguggccacgcgcuuuggggcuuggcuagcucuuagcagauuucuuuuaacuuuggccgcugagcuucagcugcaugagggaaugacagcaucuacuugcucauaacccugucauaggugaauuaugacaccuuaugcccgggacuugcguuuaagacuccugaaaaugaaugguagauuucuuacauagcaaggagagggagaaauugggggcccuagaaggugcacaguugguuccaaccacgugguggccuugucggugagagcuaguuauaggaagccaguucucaccuagaaccugugcguguuguaguuuaccaaccuuccuucaucaaguuuuccugccugaaucuaucugaucagcaccuauguuucagauuacucugaccccacugaagucaaauuugaagagcugaagaaugucaaacuagaagaggaagaugaggaggaugagcccgaagcagccgcacuggaccuuucugugaauccugcgucuguaggaggacgccucgucuucucggguuccaaaaagaaaucaucuuccagccugggcuccacuucaucucaggauucaguuucuucagauucugaaaccgccgagucugucucuugccagggccaagagaaaacgggaguucucaccgugcacagcuaugccagaggggacggcaaggcugccacaggagagccgagugugaagaagaagcgcagugcuccccgcagcaucagcgagcaggagcuggcagagguacaggcccugcaaagcauccggugaaggagggggccugugagggugaaggugcugugggcugugggagggcaggagaccccccccccccccacugcugcaucuguugugucggaaugccaggccauauuucccgucuucccaguuugcucuucacuggcucuuaaccuuugcucugugugucuuucaaugcagaggcucacaccucagcagcagcucagggacugugccguguaaaacgcaagcuuggcuggcuggaugcucugcuauggugggagcucuuccucugacucguugccuagagacuggaagguuugaguggcaguuguugcagcccagauguuuugagauuugagaugagguggcagucuuagucacuguccuauugcugugacaagacagggugaccaaggcaacucuuacaaauacuuacaagagauaauuacaauauuuacaagagauacuuagaaacacuuguaaguauuuaauugagggcuggcuuacaguuugagaggcuuaguccuucaccaucauggcgggaagcauggcagacaugcgcuggagaaguaguugcuucguccauccugaucugcaggcagaaagggagauagcuaggcuuggcaugggcuuuuaaaacuacgaagugacacauuucuaccaacaaggccacacccccucauccuuagaaguguuggcucucccugguaaccaaguguuccaacaucugagccaugggaccauuuuagucaaaccccaauauucaaggggcauuugcuucguaggaguccucgcugcucuguggaguccucgcugcucuguggaguccuagcuugucauugauauaccagugugaauucccaaaacugugcacagcugugccuguucaggcuucccccuugugcccacugucaccagaagccaguucacuuuguauaucaugguucccggcaggucugccgugccgagaaggacaugaaugggccgcagcugauucaccucucccacauaaccuuacucccuggcuucccagauuccagucagggccaagugggcaagcuagacaugaugcuaccuacacaccuguaaucccagcacuugggaggacgaggucggacuaggaguccauccuuggcuacauaauaguuugaggccaacccagggcuacaguagacccaguauuaagaaaauuguaaaaaggggcuggugagauuggucaguagggauaggugccugccaacaggccuaaugaccugauuuccguuucugaaccuacaugguaggaggggggauccagccccugaaguuguuucugaucuccacuccacaugcacgcuucgguggcagcaacugagggcgcagaccccaagugucuacauuccuuugccuagacuuuggauguugguuguuugagacaagaucucgcuguguaccuuuggcuggccuugaacucacagagaccuacguggcuuucuuuuucccuucauauuaaguaacuuguuugguugguuauauuugaaaaccaggaaugcuucgugaguucgcugcacccuugcagaagggcccuguggaccuuccuucccuaugcggccugguagacguguugcuggcuugccucucuuccucacucguccucaccgguuugcucagugcuugcugccucucaccccaucucagcuuccuuuacccccuuauguuuuuuuuaaaaaaaauacuuacuuugaauuauguguaugugugugcucuguguguguguuuguuuguacaccuucagcugugaacucgcaucucuagcaccuugggguguuuuguuuuguuuucuuucuuuucuuuucuuuucuuuucuuuuucuuuuuuuuuuuuuuuuuuuuuuuuggcuaggaucuugcuauguaauuuuuuuuuuuucaggauuugaggggagaggguuguuuguguauguaugcaugugauauguggguacuugcauacaugacacuugggggucagaggacaacuuucaggagucaguucucuacuuccaccguguuaggguggggccucuugcugcugcugcugcuguaguacaguaugcuccuggcuacgcggccugagaacuuuugguuaguccugccuccugucuugccuuaguccuggaucgccagcacaucuagcuuuuccuauggguuacugggacagaacucaaguuagcagguuuguguggcaagugcuuuuaccugauuggucaucugacuggcucuggaccuugcuauuugauacagcccaggcugaccuugaacuuuucugcucccuaauucuggcuccugccucauacacagcaccucaucuauuuggaacucaaucaaaucuuguuauuaagguucucagaaaguugccucaguugaccuggaacucacuauguagccuugaucuaaaaauccuccagcccuggcccaagugcugggacuacagcucucacuguauauugggaaucagcucuccucuuccauuguguggaucccauggaucaaacucacaggucgucggucuuguggguggguagugccccuccacguugagccauucauggcucucccuccucuugucuuuaguacccagaucauucucuccacuuccucugagugucaggacucaguuucuguagacuuccucugugcaccuuggagugguggcacgcuaaugaacugauaaccccaugcuuccucuggaugccauggucgcucucuaugacccuuagugcagggccuucggcuuggagaccaucuuaccccuugcagcugcuaccucguucuuucucacaagcccucgggugccagccugcccugcuguggcacggcgguuuaccccgugugucuugugcuugcagaauccugacuuccugcuucgaguugcaaucacaguccaaaaacuagcuagcaaacagcaaagauguaauggauccuaaauauuuuaugaacauuguucaguccauuacuauaaauuaauguuacuggaguuuuuuggugugauuuuuauuuuauauuuggagagcuuccaguaagucaauaaauaccagucgucuccuuuucuuccuauauuugauaucaguuaagugauggauuaaaaaaaugggcauauggggacuaggugucaucuuuuuaucaguaaauacuauggaacaaagugacuuuucuuuaaccugucgguaaauaguccuacuccucuuuugcuuucaaauagauggaugaccuagggacaggcuguccuggguguccacgggcucugggaagggacaaagccuugcccaagcucucgcauagaaaggcugcagacuaguguguacucugccgcaggcagauugcagcucgcugcugcacacugagcauccauggcguggacagaagccaggacgccuucgccaugguaacccgcaggguagggaggcuucucuucagaugccucuccguccugcugcaaagcccggugcgcucggccuccuuuccauuucuuugugaauucucauucucgguaauucuucucuguccuucgucagugugugcuggcagcuuugagcuacuuaaguucuccaaagaggucuuguccgauuggccugcuugcuguccuguggagucguuagggccuguguucuguaugccagaacugccuuccaggaccuccuugagagcucuaaguacagacagauaggagcaucagucccagcacuggguggugauggguaaugaagcucccacugaaagagcugaaaguuccccauugauguggaaaaggagacuuuuggcucaaucuugaaguuuggaggaauguaccggguagauagaaggugauuggaaugggagucugggaagaggagaguguucucuucuucagaguucugguagcccacacugaggucagagcaugauacgugugcucugcaggcugugcuuggagacucugaccuguacagagauggaacgugagugccguggggagugugggugccugucaugcagaucugaccucaggcucuugugcgcaauucuccauucggcuuuuacuacuuuaaacccagaugccucacaacuuccuuauccuuugggucucacugugugucacuggcuauuguggaauucacuuugugagcaaggcuguccuugaacaaacaaugcauaaacacauagccuccuccacucagcgucccugcucagcagcacugggcagauccucccagcuuggcccaugagcuuuccauacuuguggagcgagugacugaagggcaggcuuguuuuagugagaagccagcauggaggcguaacagcuuugccuguccccacagaucugacagcaccaacuguguguuuggaaagacgaggguuucugagaggacugugugucucagguacucacacccugccccuggcauccucuagcuguaaccgggccacuugcuuucaguguguaugcuacuuguccacacccaagcucuguccagagccaccugguaggcuagcuuuagugacggugcccugcggaaguaccagggcagugggguucccauggcucaggaggccacggagauacaucugcugcagaccugcuuguucaggcaaggcugggaacagaugcuucugugcaagacaagccucacuggcagcguugacuauaacucuguaggccacauguuagagaggaaacagaaauuucuggaaccuggggcgcugcgcuauugaaggcaggggccuggaacauucugcacaagauuccuggccuucuuuagugcuguugcuguauuugccuuagggacucuaucgguccugcccagaucguacagcauggucccccuguuuuacagccgccugcuucucagucuuaggucuccauugucauaugaacauaacacguuguucacaggguuaggucaugggcauucugucugccacaugucuugcugucuccauuuuacugacuucuuucucucuggcuguagaccaugcuucgguggccuauccuggaggccgcucuguccucagacuaaucuaacuucucuugaggugugguuccuuccuguuccugcugucuucugggauaaguagacauuaggucuagauauucggguugccauguguucugggcaccucucugcuucaugagcagcuuugugggacuccauacuacuuuuuggaguccuggggagccuucccagcuguguggagcuccucacuuguauccgcugaggggccuuuuuauguacauuggucacuugaugaugcagaggguuaagccuggccuggacaugcacagcauggguagugccccuuaacuacaccauggugccccauuguacauuagagaaacacugcuuuggguauaccaugugggcagggucucuuuggaagucugguuguaugucacaggcagugccuaccaaagauccuuacucugucucguucugguacgguccauggauugaucuuucacucaggagaucuagauccuguccugucagucuguugcuucacaccuccuccguuccugaggggccuuugcacaucgaagguauugagucaacauuuguugacuggguggucucauggaccuauugguacacuuguauucgcaggaacaggcucucugccugaauguggccgauacagaacuauuuucucuugagaugccaagcgccguccugaagcuccgagaugcucuguauuccauggguccaggagaccucuaaaguggccuguagugccuccacuuuuccguagacccgaggcauaagugucgaaaaguggcuagcuucuaggccucauuuccucccuuaaugguuuugccaagucugugucuuguaaugucaguauaaccaauuuuuaagcaugcugauuaaaaagaaacucuggaguauuaaucaguccuguacgucuuaaaccuaauuauguuugcucaggcaugaugcaaaugcaguguuaaacaacuuucccaugucaccugggccagagggcagacacccuguguuggcugacauucuuucuuggaggaaaggaagcucagaucaccaagggugcuagcaguggccacaagagcccagucuccacaggguggaagguggaguuggagcugggcugcuauccuugcaauggcuuaggugccaccucccuuugucugucgucuaaguucucaguauagagggcccagcggcccagcacugaacagaugcugaccuccaaaggacagggccgcuuggacuccucugauguccugauguguuucauggcagggaccuuaaagugggagagucccugccuuguuuagguggcuucugagaaguccaagaagcaagacauacacagauuuuugcccuaaguucuaaagugugccaguauagacuagugugcauggcacuauggcuucugcuuuucugagacauguuuuuuagauuugucuaaauuuuuauuugugcgugaguacguggcaccaguauaugucugugcacucauguguacagugccugagaacuacagaagagggcguugaacuuccuggaaauggggcuuaagaugguugugagcugccgggugggugucaggaagagcagcuuaaccacugagccauccaucucuccagcccccaaauugaccuuuuguucauuucuacauuauuuguucccugggccccucuucuccccucagcucuccugccuucccucccuuccuccuguuucugagacuuuguaucccacacguggcccuucaagccuuuguccucuaagcucagccucccgagagaggggaggcucucggguguuugcccugcggugucaucaccugcugaucggcccugcuuugcucagguugcagaugaguacaugcuuucccuggaggagaauaagaagaccaagggucgccgccagcccuugagcaagcucccacgccaccacccacucgugcugcaggagugcggcagcgaugacgguaagucgucuccucucuucacuagacggaaagcggguccccacagcgagccuugcccucaccgggcgucagaggucaggggugggcgugggcccagggcccaggacaguucagagcuggugggcugugugauuguacgcagccucuuucuuuucucuuccuaggagguacaagguugguuuuucaggauaguaaguugcgucagugauaccaagcucugugcaugcacagcuggcuaagauaugugccugcccucaaggugcccaccgaggagugggguugccagcuaaagggauguaaagaaaggagcccuauccaagcugaggggacagcaggaaugagacggggaaugggggugcaggcaggggagcugccgggcagugcugccuagcucaagcuggaggacaccgcugccgccugaacugagcugaggggcaaggcaggcguggggcuggccguccacagcuccucucacgagccuacugaggcuguccucacacgcaauagggaaccguggagguguguuugaagaaggggagcaccacagugggguuggcauuggaaggacugcucccagacaccacugggcccggaugcugguggggugggagaagcggaaguagugaagacggcgccagccggauugggcagcagucugcagagcuggaaggguagaccacagggaagaagaugaguugauggccucaucuuuguguccuaaggcuuuuggcuucagaaacccaagguuacuguggauagagaaaauugaugugggaagacaucgauguggaggaguauuuuuaaaugaaagggucucacucaucaagaaugccuagaagcuugagcaggggcuggaggugggacagaggagcagaagagccuggggaggagacagaaaggggaacuaagagaucugugcaagaagaacuaggaaguguagcuucgaagcgcaucuugacaacagcagggaguggucaucucaguugccuggagcagcaggcuggugcuggcaggccucccagguacuggcucgugcaugcuuguggaaccagagccacuuggacugcugacucuccagugcggagccccucuccuccucuccucuccugugacaugcugucacagcucaucucucaguuuuccucuuagaaaguaugggacagccugggcacagggacagccuacaggcccugggaucagaaguggccagacucugagucuugucccagcugucccucugagucugugcucagagagcuucugccucuuguaugauuucuucccuugaugcuuuaaaacgacccagguuagccaggcaggugugccacacgccuuuaauccuagcacuugggaggcagaggcaggcagauuucugaguuccaggccagccuggucuacagagugaguuauuuuuuuuuuuuuaagauuuauuuauuuauuuuauguaauguauaugaguacacuguagcuguacaaaugguugugagccuucaugugguuguugggaauugaauucuuuaggaccucugcucgcuccggucaacuccacucucucagucccugacugcuccggcccaaagauuuauuuauuauuauacauaaguacacuguagcugacuucaaacgcaccagaggaggggucauacgggugguugugagcuaguucuuagacagccaagauuacacagaauaaaaaacccuguuucaaaaaggcaaaaacuaaccaaucagacaaaaagacacagaccguagggaaaaaaaguuuccaagaggcaaaagaaaaauuauccaaagaggaguuugugaauacugagagcacacacuuccagcccaggugugaauuguugucugaguaugucuuuuuggaauuauguaacugaugucaucugucucuacuuuuugugauaagcaguguucagucauggcaaagugaaaggagacucuguguggucccccccauguguucauugcuaucagaacuuuuacugugaguuugucugcuuucuuucugcugguacauuauggacacaggguauaguauagcccaggcugugguauagcccaggcugugguauagcccaggcucgccuugagcuccuccugaucuucuucccuccgcuuucaggugcugcucuggcagcuucggcuucuccuggacaccugcugugucccugagaggaggaugugguuaucuggucucuucacuguucucauuuauuuuugagacaggguuucucgguuuagcccuggcuguccuggaacucuguagaccaggcuggcuuugaacucagauccaccugccucugucucccaagugcgugcuggcucgcgcucucucucucucucccucucucucucugucugucugucugucucucucuccucucucuuuuucuggcuuuuuaaaaaggcauuuuuaucugaauaacaacauuuucagugcgaugcacacgucuugacuauaaggcuccgugaagcuuuacauauguaaacuguuagaauucugaucucugcaauuuucacuuaacacaguggaagucuccccuuggcauucaguguucacauaugucaugguuugggccacuuuuggcuucgugaguagagcagaugucaguaugugaagacgggucuaugagcuugucuauuucugucccugcuguacuaucuuggucccucauguuggggucaggcacucugggcucuuagaggcugucuggcucguucacacugaccuccuuacgcuacaguggcccuucacaggggcuggcugugcacaguggcagcugccaggucccuguagaugaaaccugacuaugguagguggaggaagaaauggcuucucugcauuaugcuagaguugccuagagcgagcaugugggcaccuacaauaggugugcccaccacagcuuacgcuaggcuucuuugcagagaccucgggccucugggggaaggaguguuuuuaucguagccaguagcacugcagugguuugcaaauccacaguccccugggcaguagccucauggcgaugccugaugggcgcacugucaaagccaauuuccugucagccacugaaugcauggccagagggauagacaacaggggcuucucaucuccacaugcaacagcacuuccuacaggcuugcgccuccucaucuguuuauugcaucaaucugucccgacguuugcuccugcuucuaucagaguucucuccagcguucaaaauuguuaagguucugcccugcuccuugaccuugugugugccaggaacuagugggcuuugcaccuuucuugcuuugugagaauaguuccacuguguuccacucugcagugagucucacucuuguggaaagaugaacccagaggaggauuuuuccuuggucgugguuaagggugccugaguugugaggccugcugcugcugcccagcacacugaagagagaugaggagucuauggcccggggcucugaggaaggccagcaaguugcugguugaggcuuuauaauacuugaugcucuucaggaucagcauuuuccucccucucucccagucuuugaacaugcaguagccaguuuuauuuccuggcuacuggauuaugccugugaguucuccacucacaagcuccugguugacauagacauuuaguggccaggaagaagauucaucuccugagauccugggaugccucccccccccccccccggcgccccccaccaggcagauuguucuucccccacgaccuggacuuuccagagugagcggggaaaguccugaccaagggccaugauguaacaccuuucauccuuacuaguccugucuuggccuguuuccccaggacaacugaagggaaagcccagaggagaacggacuugacucgcuggcauuuuggaggcagcaaaccgcauaguuccugacugucugcugcuuuauucugcugcccacagagggcagaggguugaauguggcagcuguuacaggggacagagugggaugagcacccagaacaugaggaagaauagagaccuugagccagucugacaacagaaagcaguugcgacagccacccuagucccccauguccccguucacaucccagcuaagucucccgggcuagucccccauguccccacucacaucccaguuaagucacccuggccuaaaaggagucuguugguaauuguuuggccuuugccuuuuaucauccucuggaauccugaguuuaguccuaaccuggagccagggccacuggcugaacuccuccgcacuguaggcagaccuccugugugcaggcuggugcuaacucacacuucuguuuccuccucuagagacuucugagcagcugacccccgaggaggaggcugaggagacagaggcuugggccaagccucugagccagcuguggcagaaccgacccccgaacuuugaggcugaaaaggaauucaaugagaucauggcccaacaggccccucacugugcuguguguaugaucuuccagaccuaccaucaggugagcgugcuuugcugccgccagauauccugggccagcaauuggaggaagcgggguuuaauugugggugcgagguuugucacugcuugucuuaggaggccuuuccccuaguauccucguucuguuaaugcucgcguggcuaugccaggcagauaacacuuaagaaugcuuugaucuggugacccuuguuugugacacagaucucgauguuugcagagcauguuucuucuuaucuuucuggaccagggcucuuucuucucgauccuaugcaguccugaucaauuaggguacaagaaugcaguuucuuucccauuugacauuagccuugggccaggagcccggucuucucaugccauuuucuuuuuuccccuccucauugucauagugagugcugccugagcagaaggcagcuggggccagggaggcgggagggcagaggcucugccacagugaaggcugggcucaacugugggcuucccaugccgguccacugaugaccucacaguguggaucgcuuugggucgagcuccagaaggucagacaggaauucacagcagucaggugccgaguaaccaacucaggcucaaauggguccuacgccguguggcaguagguaggcaguuucccuauggcaguuaaaguggcccagcugcccugagcuuggcagggcccaggcucaugcaugcagaaggauggcaucuagacccacaugcuggaucaacagcuacuucuuuguauuaacuggcagcaaagcagagaacuguuugugccguguuugugagggacgugacugccugauuguuacugucagcagcucucuuaggugggggccagaguuucuugaauggcauaggcucagagggugacgcgcuucccggcucuguccuuggaauaaggaucauggugccauccagcggcagagccagaggauauuuguagugacuauaguuugccaagaggacuaugaaacauaauguucuuucuagagagcccucaagccaggaaucacagguggggacccagccaugugacagugccacaguucaggugaccugcugacguggcccggcagaggcagucagcgcugguccguuaggagcacggacucugggugcuguccccgaguggggcugccauguggcauagcaccugggggacaggcagugccuggcugcuggugucucugugaauuuuauuaucacuugguuugggaagacucaagucccaggugccucuuacuuguucccuuuucucaguugucccccagggcccuuuguuugaugcugcugugagaaauugaauuugagucauuagagguaacuucaauuaguagcuucaggauaauggcugugcacccgggagcuauagcugcagucauacccguaagaggcccagcuuucugcugauggagcagguggagggcuaggagcacagccgcgugcucaccacccugcccccguucguucuccgccguucacuuagguggaauuuggagccuucagucagagcuguggggaugcuucagagccggcugcccagacucagaggaccaagccacugauccccgaaaugugcuuuaccaccacuggcugcagcacagacaucaaucuguccaccccguaccuagaggaggauggcaccagcaugcuaguguccugcaagaagugcaguguccggguccacgccagugaguaccucucaccuccucucacgggagcuagaaguugucaccgaauggccuucccagucuccugcugcaaaagaugcuuaugucuucuugggaaguugguggcugguggaugaguugccuuguggcuccagcauccaucccagugccugucaacuuggggucucuagauacauacuagggagcuguaccagugaauccacaguuucugacuuuccugggucuccgggccacacuguaugguugagcccuggggacucugggauuucuguaugauuuacugucuuugggagagcacugugcaucugcauucuaacggcagccucuggguuggguugcauuugcucuccugcuguccuuagguugcuauggcgucccuccugccaaggcuucugaagaauggaugugcucucgauguucagccaaugcccuggaggaagugaguagccccaugcuuuucccaucgucuucagagaucgggguggcuuuggggcuagccucuuuccaugcuggacacaauuuauguccagagcagcuggcuuaggauuugguacucggagaugucagagccaguggaucugagagcugugagggcagaucagguagcugucccuggagcagccaucacucccuuugaagaauucgacucuugguuuggagucucagaauggggcucaagugguucauucuguaguucuaauuaugcacuaaggccugucuccuucaggggagucccgacugcagggcauguaccugaaggccuaccugccacuacacugcucuuguccacaggaagucucaggagggcagacuguauguagugaguuguuggugacuguguuccuucugcuuuccggacaggacugcugcuuaugcucguugcguggaggggcccugcagagagccaaugacgacaggugaguucucugggaaguuugacgcccaggcccaguucugagcaugugcagugcuucgagggcaggagcugcuccggagggguggugaggacucgggcagcccauggcacggagcuggaauagaaugagcaagacuggccuaggcugccugucucacuucaccuuuuccucagaggcaagacguaagcaguguccuucuuugagagaugacaguccugagaaaaugacacaggcauuuuguggucuggaagugaggacacugaccugguuacaauugccugccugccuuccuuuuuaaagaaaaaaaacaaugcacuuauuuuauguguguggcuguuuugccugcauugcaucucugggcauccugugcacagguuuccacagaggccagacgaagacuuugggucuccugggucuagagauacaaacgguugucagucacucuguggguccugggaauugaacccagaugcccuggaagagcagccagugcucucaaccuuugaguuagcucucugguccugauucuuucuuucaagacaaggucuccugaaauguccuguguagucccugcuggcaucuaacuguugauccuccugccucagccucccacagacugggauuauagauaauacagugccaagcacuuuccacaguuaacugccuggcuagaccugcugguggagaucaggcagauguccuuaggggaaccuguuggguaccggggagagcuuaggcaggccacccacuguuagagcuauagaaguuucugggcuucucagccuccguacacguaauucucauugaguuauacccuugugcugucucaggucuaccuccucugaggaggaaacacaagcuguugagggcuugcucuguagagaguagcacagcacaugugggcugacagcagccggcaguggauggccugucucugaauaaaaccccacggguguccagccucccacccuggcaggauccccauacugcucgagguggauggcuguguggcuguccgcucgugguggauggcuguguggcuauccucacuccuuuacugaaacacggcuguuaccaguggucacuguaauucucccagggcagguagagccuggcugguaacuuuuuuuguugaaguggaaauggcucugcuugaaccucucaucuuugcccuuuaaccuuugauccauguucugcccucuaaggccagaccuguucccauccccaauaacagcccaaccaauagugcagacuuuugauuccauggcuccuauagguuuucauaucgagcuggggcugaaccccgggccuugugcaauugacacaucaguggaaccccaacauuccaacuuugggcaugucuguuucccaaaaggugucugggagggaaaagcccaccacucucggucaggcgcuuugccagagcaaggaggugguguaagcggguugccccugcacuggccucgggcagugugugcacaguacuacauauggugguaaaugacgcuuuccaucggucaugcugggugauagaggaaguuuggucaguaggccccuggggcuauaaaaacgggugacugaaacuuccucuuuuggcagauggguucauguuucaugugcaguggcaauucuagaagcaagguuugucaacauugcugaaagaaguccaguggaugugagcaaaaucccucugccccgcuucaaacugguaagccagagugggcuugggauuugcauagcuuccccgcugaugaaucuggggagcugagugcguuucagcuuagcuuuggucagucucauuccccucgugaggcugaauugccucaugggaacuuuacauuggacauaggaguagagcagucccuaggugcucccacguauugggggaggggggaguuggcuuuugauggcuuggcuuuaugcauuucggagggaaaacaagaagagauggauggccauuccacggaaucgugugcucucucucucuccugugcagaaguguguuuuuuguaagaagcggagaaaacggaaugcuggcugcugugugcagugcucccauggccgcugccccacugccuuccaugugagcugugcccaggcugcuggggugaugaugcaacccgacgacuggcccuuuguugucuucaucacgugcuuccgucacaagauucccaaucuggagguaagagggcaccauaauagaguccucuugacagguuucagggucauuuucucugcauguugccaaguuauuacaucagcacauauccuugauggaaaauguuaaugaguuagcaauuaacauauggcucagccugacccacuucuugccuuggccuucacaguucaguggcacugacaaaccauggcuugguucuuugguuuaccuguucccuugcuuaagucuccugagcaucuucacccaagagccugguaugucagagccguucuguaaguggugagagcugaacccucugacaguuggacauuuucugccacauaggagggcggugacaugugcaggacauguggaguucuggaggagccuggggggggggggcugccccaaggaaguagaggggaguuagaguguaaucauagcuucagaaacagaggaguaugucuaauaagagugaacauucagggugguucugggaaucuggcagguagucauaaaaagugagcagugcccuggggaaggcccuggcccgccgcauuuaaggucccuucucuuucugagugaggauaacuuguggaaggccaggauuucgagucauuugugugcagcucugcacauacauuggaguguacgugggaagcagaucagcuuuugggagucaggucucuccgucugccuuguggguguaguguuucucgaaucccccacccaggcuagcuggccacuuagcuuccaggugauucuccaggugacaucucucaucuugaaacaggcaugcugugacuucacugugccugucacagugacuggcauuuguuuuguuuuguuuuauugagauagggucuguaguccugguuuucuuagaacucacugugcagaccagaguaucucaguucuugugcccuucuccugaggauagagcuaaugcccaagugguugguuagcgauguucagggucuagggcccagggcaccagcuaccuauugcgucucuauccagaugcuaugacacauaccugagguguacacauuagaauguauuauuugguuaguuccagggaaaucaugaagggaagugaguucauggauuuuuggauaagauaggcugaggcaggacauugcuguaaauuggagaacaaaacaaaauaaucaaagaaaaagauaguaucaucuaagaacuaguuggcuuggagcucagagcucaugugaguggcuugucgcuggaauguaggugucuggaaaggccuguucugccuuccauuugucucagucuuuccuuugccacacuuauuuuccccggccccauaggggacagugcgauccaggcuaacccaggcuguuccuucuagcgugcuaagggagccuugcugagcaucacggcgggccagaagguuaucagcaaacacaagaacgggcgcuucuaccagugugagguggucagacucaccaccgagaccuucuacgaagucaacuuugacgacggcuccuucagugacaaccuuuauccugaggacauagugguaaugucugaaagcggcuucuggcagcacuuugggucugggacaucuucuuguuauugccggcuggaugacuguggucucuuugccugccccuggucaguuuccaaacagaaagagccuuuauucccagguucccuuucaaggaagaguggacaugcuggggcgcucagcuuccccgaggaguucagaggagucaguguucccugcaguccacugaaauaugcuuauaucucagaccaaauuauuucuaauagcaucuaguucaggaugcaagcucacacucuggaagcaaaccgcugcugauacaguuucauugcauuaaagcugugggauucuuuuauuguauuuuguuuuuucgagacaggguuucucuguguagcccuggcuguccuggaacucacucuguagaccaggcuggccuugaacucagagguccgccugccucugucucccaagugcugggauuaaaagguaaaggcuugugccaccacugccuggcaugauucuuuaaaagaacgauccaacccuuguuucagccaugcccucucaggauguguuuguaguuuacuuuggguucuucacuggugauggcucuggagcuacagagaaacuaccuaagaaagcuuuaucaacaccugaaacccuagagccuuaccuggacccgagcccagcuuuccuggcucgcuauucagagcuuagcucagguuccccagccuuugcccuuccuuuucaugugcuagccuaugcgcccaacacagaagggcaaaaccauuuuuuccuuagugauucuucacgcauuuuuacuacauuagcaacaucauugccaaaagcauauuaauuagugucuuaguuacucucuguugcucugacaaaacaguaugaccauggcaacuuauaaaagaaagcacuuaauuuggggccuaugguuucagagucgauggugcaaagacauugcagcaggaacagcugagaguucacaucuugaucuccagguuggacauaggggcauggggugggcaugaugacacagguucucucucucucucucugugggcaugaugacacagguucucucucucucucucucucucucacacacacacacacacacacacacacacacacgguuaagaguguuuugaagucucagagcccuccccaaggguuaccuucuccaucaaugcucuaucuccugauccucuccacgcaauuccaccagguaaggaccaaggagccuaggggcuauccuccuucaaaccaccacaguuaguuaccaggcagaguguaacugugaaggcgagggugaucacugguaguagcacggucagggacuaguaagcgcucagccagaccuggugcugugcuguaggucaggaugucucgcuuaucacacaugcgcugagaaguguugcuggcucuaacuccaaacacugcuccugucugagugccuuuuguucuaagagaccguguauuugugaauguuaccuaucaauaguuauucuacuagaaauuaaaacuaagauuagcuauuaucuuaauacuauuugauaugugugugugugugugugugugucugugucugugucauauugacauauuuccccaguuuuaugaaucuuuuucaggucaauucuucuuucacucuuguuguacauuguuucgauuaacauauagggcaugguauaaggccuaugaauccagcucauaagagauuaaggccagggucucuagaguucagaucugguccugacuacacagugagccuaugucaaagccagauagauagauagauagauagauagauagauagauagauagauagauagauagauagauagaaagaaauaaaaaaguauggaaagaaaaccugacauagaaucgcaguugggauggagguaacauuuuacuuuuugaggcagugacucacuguguagcaauggcugccuggaacucacagagguccguccccccuuccccgguccccugagaacaacauuuuaguagcauuucugagaguugaaaugaguucuuuuuggaacugggcauuggaacuagggccuuagcuguugucuguggagcugcugcccgguccuuucacguuuuuaagauaugaaauaggauuuaucuauagcugaagcaggccuugaacuccugaucuuccugccuccugacugguugagauuacaguccuauguuaccaggucuuguuacugggguaauuugaucuuuuagcuuuuugggacaaggcuucauguagcuuggaaaggccuugaacuugugcauacuggcagcacaggugugugcuacuaugccugaccaagcagcaguuuuuuuaaaauagucauaaacaacaugaaauccaaaagcccauugagccuuauggagacagacaugacguccguccgcccaccucacgcugaggugcgucucauccgugauuuguuagacuguaugcuggucauucagaaaacacugccauccugggcuguggagaucuuuccaaaugaugcuagauuuuaauauaaauacauuuuuaaaaaccaaauucacagcugggcgugguagugcacgccuuuaaucccagcacuugagaggcagaggcaggcggauuucugaguucgaggccagccuggucuacagagugaguuccaggacauccagggcucuacagagaaacccuaucuugaaaaaucaauauauauauauauauauauauauauauauauauauauagucagaaauauuaacaugaugaaagggcuagugguuuguuuguguuuuguucuuucuuacuuuuuguggaucugggcaccagggccggaguuauaucuccuggcauugcuuuugucuguucacacggcaggucacgcugcuuagccaaaguugagcuucacccagcuccuucgcuggucucccgggagccucugcucucagcuagauggucccuuccuuuuuuuuuacgaucucucucucucucucucucucucaaaucucucucuuucugucucucucucucugucucccucccucccucccucucucagaagcacaugucuuagagcacucaaaugcaguccuacuguuccuccauagcagagcagcucagcugagaggacacaggaugguggauucgagagcccaccccugucucuguguuuacuacauuuacugaguaaugggguuuuuguuuuguuugcuugcucccccagaggcagcagggcuuagggcagaugaauaaggcagaccuuguuugacggaccguaccuuggcuuucagcccagagcuagcugccuuuccugcagugcgugggcagaaguccuuccugagucauuggcacuuagcacugugguugggugagcugcgcuucacucuccuccucugcucuguccucagagucaggacugucuccaacuggggccuccugcugaaggugaagugguucaagucagauggacagauggccaagucuauggggcuaaguuuguggccucccaccccauccagauguaccagguagccaaagguucuugaaugggcguuugagggugggaggguacuucauuaauuuaguguuuccucgggcaagaagcuugucuuugcucuugaaagaacuugccggucacuuagugccuucacagaucugggguauccacuuugguauugugccuucgggcauggccgucauuccuuacauggaaaguccuuacuaccgaguugcccuccucuagcuacaggaaacugccacugcgcgcaggucccacaggacucugguacccuagcuaaagggccuuugcuugcuugucagguggaguuugaggauggcucgcagcuggugguuaagagagaugauguauacacacucgaugaagagcuucccaagagagucaagucuagacuggugagugagcuuucugugcccugagcauguguccugaacauggcaggcacaugccccuuuaguguuuguuuguguggccacaaagugacaguuugcaugucuuucccuuuguagucgguggcuucagacaugcgcuucaaugagauuuucacagagaaggaagugaagcaagaaaagaagaggcaacgggucaucaacucgcgguaccgggaggauuacaucgagccagcgcuguaccgggccaucauggaguagaugcuuccaggaucugagagguucccagccaucaaggcgagagcacucuaggguuccacagcacagcagacacuuggaacucgaacuuggaacuucacuucgaaagugaagcuguacacagaaaaggaaugacguguccgaccuuucaccuucucacuccacccucgaugcauucugccgggaaaagacaagccuauugugggugcuuggcagcagcuguccguccucagcugacgggccgacacugggaugcugugauugcaucagcccccaguccaaucgggucagcuguuccugcugggcggauuguucuuucuuaguggcuugcuuccuacccgcccaccggcaccagcaaggcagagaggugcuggugcugacccaauccccuuuuguauuuauguaugcgugugugagcgugcacacgugcaaguguguaccuguguguaagcgugagaacgugugaguguacaccugugugugugugugugugugugcuugagaaugugugugugggugugcaaguacguaugugguugcacucguguacgugagugcgugugugugcuuggucaggacuagcuucugccagccccugggcuucacuuucuucuuugccucugcagggcaaacaaaaugugaaauucugcccucagccaagcugaguaagggccccgggggauggguagagguggggugccaucugucccuuccuggaccgaucucaagagagcgccggcaaagcugcaguauugggaugcuaaggagcuggcugccaccucuguccacccuugaaguagaacucagagguuauauacuaugagcccacaaaugucaggcacggaagccccugccugcggccacaguguuagaggguguggguggggaccaccuugaagggauaauuuuaaugauggaaacaggcagagccuggugggugauuuuugugcaguuaugcaggggcuaacuauggguuaggaugaacuggggccacuggaggccaagggcugguauagcuacgcccuuggucaggggugggguggggcugguugagggugggggugggaugggacuagagggcaacauugaagggguuaaacagguuccugaauuuguuugccugggcccaauauggagggcuucauaccuugcucuguauacaggagucagauuuauaauacuuccccuuuuuuguuacguaugaacucuauaaaccaaauuauuuugaaaaccggugcauuaccuuguccuuagcaauaaaauggauugaacagagg

SEQ ID NO: 2074 - RNA, 6490 nt, Mus musculus
cgagaaaccggaaagggaagugguugcgcccgccgggccgcggcaaugcaggugagaagcggguugggccuuauagccgcuggcgggagggugauugggcugaggacaccggggaguuggggcugugagcggagggcagaggaaaggcagcggagccagagagagcgaggccagcugcgggaggcgcgggcaucgagcccgcugaugugagaaggucggaggcccggggaggaaaggcggacuugauugagcguggaaaaggaucgugguggcauuugggaaggcucgggaaaguagugggcugccgcacgccucgaucuaggcuguuggacacaggcgucauaaggcuucagaaggcuaaagggaucgugggccuccaaggaugaaaacuaagcuguuuguaauucgaggcuguggguggaacccgguguccaacccccucagucacauagucagguuugcaaaucagcuuugcaucauucuucccggcuuguaccucguugcuaagggcggagaagugggguaaauaguccucagauagucaaacggaaacccucugccgccucagcguuuaaaauugucuaacacucagaaacaaugugcagguuuccucgccuuugucuuucauuacucuuucauuacucacuuggcuuguugcaucugauaaaccuacacuguuuaugggucacccgaauuaugaaagagacacgggaauauuggcacaaagaugcacguugacuuuccaaagcaccaaaugcuauggauaaacggccaguugggggaccgggaaggggauugcagagcugguauucagagaaaaccuuacagagaggcaacgugugagauuguccagauugugugguugacaguagcuacacucacaagaggaugaccagaggcacccaugauauaaugaacuucgggaauuauuuaggcugugugugcagauagcaccccuguuaucauggcaaaccuuucugaggugaacugaacuuccugaaaaaaacaaaacaaaacugugucaaugccaacaccacagagugacacgagggauucucauccacccaaggaaagcagcgcagugacaauaagcagucgugagguaggcaggccacaucuauuuuccagaagaggaacugacaaagaagagugugcagaaaccugagcacguuccuauuaacccuacugcaaaucuaagagaauguugucuacugggagaggcaguguuugagagcugggaggaggagagcauggaauuaaaaaggugcaaggcuaagugaguucgaagccaguuuuguuacaaagacaaaucaugagguuucaagccaaagagaauuaggucuggugcaaugaccuucuugaaggaccacaguguaggaggguuauagaggaaucaguuaguaggaggacuucaggccaggugaacagguugaaaggucuaaggguugaugcuaucuguaacccaaauaccaagauagaaaacaauuuagcuuuucugaaugugucacgcucacuuguaucugaguaaccaaacacacuguugaugcagagggaggagaagcagcuugaggcaucauuagaugcccugcugaaucaaguggccgaucugaagaauucacuggggaguuucauuuacaaguuggaaaacgaguaugaccggcugaccugguaaggauugccaggacaagcuggggagggauccaugggugguggggccaagcccccuggcugacaggacaucuccagcgauguacccauuuaucaacuugcaaauauccuuuuugauuuggaaagaacuagguugcccaacauugacaaguuuaguuuggcuuaaagccuccauggcaaggaaguagaaaaauguccaguuucccaaccuaggcuguuucuagguuuuaauucuuacgcuuuggcuuccuuagugaggaggcauuuccucaguggaagaccauuauagcuccauuuaugguggcucuccuuccacacaugaggcuggaucugagauccagccuucuggaaugauagagucuguuacuacauuagggaggaggcuuuacagacuuacuacaguguaaccacagccccuguuuccacugcucccaaacccagucaaacaguggguugccuuuuuucuguaucuaugucaaaaauugaaaguguguuccucuuucccaauuccaucucuacuagcaaaucugguucuugccuaugccagacacagggcugcgagucuucggggugagucugaguguugcagcauuaggacuuuuagagguuacuuuguagggagaaguaacucuggugacuucucgccaccuccaggcccucuguccuggacagcuuugcauugcuuucuggacaguugaacacucugaacaaggucuuaaagcaugagaagacgccacuguuccgaaaccaggucaucaucccucuggugcuguccccagaccgagacgaagaccucaugguaagacacacaguaucuuguugacuggauccucuguguggccaugaaaggugagggcugccgucuggaagacuuguuuuuauccuucuggggucaggagagucccccuuaaagaaugaagugaaaaucagggccuaucucaccaaguccacgaccuuccuuuuccaacaucuaugucaggcaaaaagaaaaaagucuguccugcuugccugugacuuugcugcagucuuuaaaaugugggguugagaauuuagcucagugguagaacagacacaaaguccuggguccccagaauagggguggagguagagauucacaaaagaccaaaacaaaacagcaaaaaaagacaauuucagugugguaguggagggugggauuuagcucacccuaguucugauggagugagugagugaaaagagagugucacagaaagcuaucccuaccuccgguuguguugucucuggaaaugcguuuucugauggaagggaagugggguuagaacuggccuacuuggauagcacaauaggaugaauccaaucuauauuacagcgucaaacugaaggacgagugccuguuuucagccaugaggucguuccugaccacuugagaaccaagccugacccugaaguugaagagcaggagaagcagcugacaacagaugcugccagaauuggugcugaugcagcucagguuggacugagucacuggccugcuaccucauccucauccuucauaagcaagacuuuaccaaggcuguguaggggugugggguugcucacagcuaggcugccuguggaagagcacaacgaagaugcuucccugaaucauugcuaaucacuaaucaauucauguguguuacagaagcagauccagagcuugaauaaaaugugcucaaaccuuuuagagaaaaucagcaaagaagaacgagaaucagagagcggagguaaggagggauguggcagcacagagcgagagcuguguaagaucacagcacagagggagagcuguguaagaucacuaaauagcaauggccugcccaauugugaaguaaggacauaagaaugaacugcuggggcuggagagauggcucagugggcagaggugccuguugccaggucuggccuaaguuugaucccugggacggaccuacaugguggagggggaaagccaacaaguuguccucugaccaccaacacaaaauuagaaguuacuuuaaaaaagaagagucggcuccccuccugagcagaggcagccacccucuccugucuuucccaguaaaucucuagugugggguuuguugugcccugugacuucguagugguccuuggcuccugagcaggaggacaccuuuccucucaggaccagaacacauuggugccaugacuuguguaggcucucauggugccugugcuuccccuuggggucugagccacgcugggggacaugggagcagggugggggagaagaaugaaccggugagaaagggauuugucuccuguuaguaguucaucuuuacgacuauccuuaaagcacauagaagaaauagacaaaguaaaaguuuaaggccgggcgugguggcgcacgccuuuaaucccagcacuugggaggcagaggcagguggauuucugaguucgaggucagucuggucuacaaagugaguuccaggacagccagggcuaaaguguuuaagauagguuuggggacuuuuagcucuuugauggggcuagggggauucuagauauugcugcagucauaauuauaauggguuuaguccagagcuggacacauaccugagggcucuugcuuuuuuuuuuuuuuuuacaggucuccggccaaacaagcagacuuucaacccuggagacaccaaugccuuaguagcagccguugccuuugggaaggggcuaucuaauuggcgaccuucagguagcagugguccugggcaacccggucagccaggagcugguacaauccuugcaggggccucaggauuaccgcagguucagaugccaggugcuccaaaccagcagcagccaaugcucaguggaguucagauggcucaggcaggucaaccagguaaggugacauggacugagugcacaggagugugggaaugagcuagaucaucuaagccuccuucaucugcacccuccccuuagaccuggagauuugccuccuuugcuuugucaccucgaaaacaguugaaagcucugcaacauguaccagugcgugaugaaggacccugaguagcagcagcugguguggcuguuuacguccaucgcagacuuugccucaccuguccuguugauucugggugucaguguguuagagaaaugagaggccagcccuuagucaagaccguucgguagauaaucgcagauuaacaagcuggcaguucugcggaccuucauggguccuuccccgcacccuggcccuagcucccugcccucucucacgcucguuuuuauuuccugugagagcagucuggugggguucauggaagcaguucaugcggguaggcugucuagggagaaguacaucugaaacaacugagaacacaguaccucugcccugaaacaacugagaacacaguaccucugcccugaaacaacugagaacauaguacuccuucccugggaccuuaaacgggggccacacggcuuaccuguccuuucuggaaguagaugagcagaaagaagaccauccuaggggagaaggcuguucagaccccuccucuuuucuuucaaaucguccccuuucccuagcugucuucagucagggaagcaggaagaacugcagccuguaguaaucucugucauccagagucagaggccacagaggcucugagauagacugaaaggcugcauuucugauuuauugugaaaguucaccuugcuucagaucucucuuucuguuauuuuuagggaaaaugccaaguggaauaaaaaccaacaucaagucagcuucaaugcauccguaccagcggugaguguggacggcagccuccacucucaggugaucugugcugaguugagcaaugacaugauuuuuugcucaaggcuuauuuagauggggacaauaaaaagaacacaggcuuucagcaagagacagaucucagcuccacugugaauagccauucgaacuugggaaagugaccuaauauuucugagccuguguucucauuuguagauggugauaauaccuaccucguaggguuguugugaggauuaaaaugagaaaaugaauguaaaacacuuagcaugguguaugcaauucugggucuugaauaaaugauaguuuccuaccuuucaacccugccauuccuuguccuauaugcagaacuuauugugauuugguucaucuccaugacaccagugagccaaugggcccaggaucaaguuauccaugguggccuguauguguugggggcauacugucucugcaggcccuccugcccaaguacggccugcuggcccuaaaagcuacaggugaggagguuucuggaggacacuggccacuuccaggugugaugagaccagcucagcauuucccugggaaauagguaaacaugcccaucuuuuagccuccugugcugcuaaagaugcccaggguccagcagguggaagagcucuuaagagggacucuggcaggcaacagcacggagaauacugucuuccuccguggagggcaguuguguuuuauagugccguggguugggguucauuugucugcacagugacgacucccugucucuguccucuuccaucucacugaacguguggcucagauaagaucuggauugaaagugggaagggcagcagcuccauucauauugccugcuuuuguagaguugacgaacaguggaguuuuggacagccaggccuguugccuuucucagcguucuuuucugggcaagggcagagauugagucagcagaauugggccaaaggguuucuuuguuuaauaaagauauuuaaauuauguucccuggcucaggguugucugacuaaaguuuaugagcuaucu

SEQ ID NO: 2075 - RNA, 5277 nt, Mus musculus
cucccccucuggugacagaaagucggcccagcagaugaggaaguggccggcaggcggcccuggggacuucucuccggcccugaucccuuugaacccuucacugcugcccgccugguuuccacuggugaguguguaccuuccauggcuccccacgugccagcgcccccugccuggcuggccaggcuagcccugcccugccugccuugcccugcccugcccaggcugugggcgaggcuguuccuggggcgagugggugggaggucccaggcacuggggcugggccugcccacaggaucccuccccggcaccuuggccccugacccccauuugcucacaccuaguucuuuuucagcaccuccuggccuuccacccuuugcccacuccucucuuuucccuuccugccccaugccggugcccuuuuucuuuuccauccaucuuaagggaacuggcucuguuucacugcgggagggggguggugcgcacccggguuucccucaaacuuagggagagauccucagaagucuggacucccucuugcccucugggucacuguguaucucccgguguuaagugguggugaagggcgagugaauuggaggaggugguugagggaggagauaaggaacuggcaagcucacgugugucagagcacaugccuaagugcuaggccccacuccaacauaagccaccaaccaaagucuaacuguaggaagaaaugagugucacucaccagagagcugugugugcagaagggaggugugggugaagauguacccaugccuggucagcuguaugucccgcgguuaaugcaaucccugacaggugugaaguuuaggagccuggcauguccgaguccaguagggaggccuguuugggugauguggucaacaagauaugccuggacuguguguggauguaugcuggcuagcuccuggcgcgguaugcaugucucugggggugguugagagcggugugaugaagguacauauuacugugugagagcguggauguggaugguagaacucaagccccaaggcuggagauugauggagagcagcuggagcacuccgcuuguugggcaauugccggaguccucugggacaaaguccuaggcucuccugggucuaggcuaaauuuuuguaucccuauaaacuuucccuuggcauuccuuccaacuuugaggaggaggggaccuagcccaugaggcucccucccagaagagggaaagauuccugagaccucccccacucucccaccuccucacauaccacugguguccucaccccucccugguagggaagggugaugcccauucuaaaguaggacaaacuaagaauucauggcugguuugggagagaaugcuggguguggauuuuuuagcaguucuggcuuuggccagacguccuggccagaaguuucuggagaaccuacaaacuuaucuggcuggucagagguggugaggcuggggcucacuuggcuuucucaauucugguggguccugcuccucuaggcauugaccuguggccuggacccacccuccaccccaugcccaacguagcgggggcgggaggagggcggggcugcuacaagaucuagucagacagguggagccgccagggcaggagucucaaagagccaggcuccuggaguggaagagagagagaggcagaacuugccccugagaagaagggaggagagaggcuggaggugaagcacuggaagaaggcaggaggcuggaggugagagccugggaggcaaaggggaagcccgggggcacugguguucaccacagaaguggaacccuagguuuguucagguacuagaaaggacagaagcaggugggagucccugcaggggacagaggcgagaggagagucuuggaaaagggccagagggacuuuaccugggagaaggggguaugagaggaguggcugaaggggagauucucuggagagaagagugucucucaaagcugagagaugagacugcuugccaaaaagguugaggaaguucacugggaagaugaacuguguugugaggagaaaggcuccaggagaccuggaaggcaggucucagagggaaggaggaaggcagggaagggaaacacucgaagagaguggaggggaaaggugggacagcuccauccaggcaggccggaugcuucggcagccgauguuccagacugucucuucucccaguacacgccugcucaccauggccucaccauggccaggauucgaccuggggccuuguguaugcuaggaaaauacuuuaguucagagaccuauccuuuugucagugaggcagcagcugucugauucuguaucuuguccuguggaccacaugugugauggggggccaugcaguggucccugccuaauaccuccucuccaucccuccuuagaguccuuagccaggauggaggcuguugugaacuuguaccacgagcugaugaagcaugcggguaagcugcugucuauggcacugccuuccuucccuucuucccugguaucccaggaucuaggguuauguccuuaggaacuccuugugaccugacucaugucuagaccaaggaaggcucuuaaacccugugacccucacuccuuugacauccuauucacagauccccggauccaaagcuacccucugauggggucccccuugcuaauaacauccauccuucugaccuauguguacuucauccuaucgcuugggccucgaaucauggcuaaucggaagcccuuccaacuucgaggcuucaugauugucuacaauuucucacuggugauacucucccucuacauugucuaugagguaggcuggaaugccuaggcuguaguuucuguugaagguuaagaguuaggguacagggcaugggccagagcauggcacuaucuguugccgagguucaguuagugaaggggagggguugcugggagagaacggaugguuuaauccacucuuuucuuaguuucugaugucugguuggcugaguaccuacaccuggcgcugugaccccauagacuuuuccaauagcccugaagcacuucggguaaguagagccuuagguaaccauaauuauaagcaaccuagauaagggagagcagaguuggccagguagcagaggcucuuuggauacuguguaacuauuaagauugaucugacuucucacagaugguucgaguggccuggcucuucaugcuuuccaaggucauugagcugauggacacagugaguguuacagcuacuacaacuugggagugggaaggauggacggggggggggacaggcaugcaaccuccccauucuucccccaggugauauuuauccuccggaagaaggacgggcaagugaccuuccuccaugucuuccaccacucggugcuucccuggaguugguggugggggauaaaaauugcuccaggugagcagugaaggccgcuggagaagaggguggccacggggaagagaggcucaucuccugaccaucuuguuugccaucguaggaggaaugggcuccuuccaugccaugauaaacuccucuguacaugucgucauguaccucuacuauggauugucugcccuuggcccuguggcccagcccuaccuuugguggaagaaacauaugacugccauucagcuggugaggagccuguugggcccaaagccaacccccaguguuucuaacuuagcuccuucuuucuacccaguuucaccucugauccuugcccuccccacccuaagcuauuucuauucccccccucugcgccccaaccuauuucugacccuugucuuuuucuaucccagauccaguuuguccuggucucacugcacaucagccaauacuacuucaugcccagcugcaacuaccaguaccccaucaucauccaccucaucuggauguauggcaccaucuucuucauacuguucuccaauuucugguaucacucuuacaccaaggggaagcggcugccccgugcaguucagcaaaauggagcuccagcuaccaccaaggucaaggccaacugagaagcauggccuagacauugcccaccuaagugccucaggacugcaccuugggcagcauccacaaguguccucucuaccuacacccgugaccagggcucuguggucaggacugagcaggcggacuggcucuccccuccccacagcugguccacaggggccacuguucccaucccuucucccagccagcuccagggauguggccucacugcugucugccaccagaacuggaggcugaaagggcuggacacuuacuucccccucccugccuuaaacuugggagaggaacacucagggcuggccggcacgcacccgggucuuguggccuuucuccucacacugaagaggucagcaauaaucugucacuguggacucaggcucccuucucacuccacauggaagcaugagcuucgggccaaaggucagaaugggcaggcagcaggccuggaagucaggcugugcgcucacuugugucuuaauuaaagugacgggaaaccacugagauuguguguguguguaaaugaggugcgggacacagcuuuagcucuggcuuguuuacaaacaaaagggaugggugguagugcaugcgguaauuccagcuccuggggaggguacaaagcaggaagcucaaaagagccugaacccugucucaaaagaaaaaugaugcucaguaggcagggcucuggguuugguccccuaaacuacaaaaauaauauaaaaagggggguugccaagucuagcucuagucagaguaggggaagcauguaggaaggaugcugggacauaaggaagauacgaacuuuauuagaaaaaauaaaauaaaaacaagaaaggaaaugcguuuguucaacggaugccuugguggaugaggcuacuuuuagcuacacuggcuuuuucccgcucacgccgaagggcaggguccaucucaaagcagcgccacaaccguagagucucaucagcugcugcugaugccacuguggccccaucuggacucauuguaagacccaggacccgugcuguguguccuagggcgagagcagugcauuugaguauacacacaggccucccucuaacuuugacagucaccuugaaaugcaauuugaaugccauacacucacccuuuuauaauucagugguguuacuguauuuacaagguuagguuguacauuguuauaaccaguaccacgacauucuaaaucuaagccuguuaacucugcauuuacccauucucgugcaaucauacccucccacc

SEQ ID NO: 2076 - RNA, 5277 nt, Mus musculus
ggugggaggguaugauugcacgagaauggguaaaugcagaguuaacaggcuuagauuuagaaugucgugguacugguuauaacaauguacaaccuaaccuuguaaauacaguaacaccacugaauuauaaaagggugaguguauggcauucaaauugcauuucaaggugacugucaaaguuagagggaggccuguguguauacucaaaugcacugcucucgcccuaggacacacagcacggguccugggucuuacaaugaguccagauggggccacaguggcaucagcagcagcugaugagacucuacgguuguggcgcugcuuugagauggacccugcccuucggcgugagcgggaaaaagccaguguagcuaaaaguagccucauccaccaaggcauccguugaacaaacgcauuuccuuucuuguuuuuauuuuauuuuuucuaauaaaguucguaucuuccuuaugucccagcauccuuccuacaugcuuccccuacucugacuagagcuagacuuggcaaccccccuuuuuauauuauuuuuguaguuuaggggaccaaacccagagcccugccuacugagcaucauuuuucuuuugagacaggguucaggcucuuuugagcuuccugcuuuguacccuccccaggagcuggaauuaccgcaugcacuaccacccaucccuuuuguuuguaaacaagccagagcuaaagcugugucccgcaccucauuuacacacacacacaaucucagugguuucccgucacuuuaauuaagacacaagugagcgcacagccugacuuccaggccugcugccugcccauucugaccuuuggcccgaagcucaugcuuccauguggagugagaagggagccugaguccacagugacagauuauugcugaccucuucagugugaggagaaaggccacaagacccgggugcgugccggccagcccugaguguuccucucccaaguuuaaggcagggagggggaaguaaguguccagcccuuucagccuccaguucugguggcagacagcagugaggccacaucccuggagcuggcugggagaagggaugggaacaguggccccuguggaccagcuguggggaggggagagccaguccgccugcucaguccugaccacagagcccuggucacggguguagguagagaggacacuuguggaugcugcccaaggugcaguccugaggcacuuaggugggcaaugucuaggccaugcuucucaguuggccuugaccuuggugguagcuggagcuccauuuugcugaacugcacggggcagccgcuuccccuugguguaagagugauaccagaaauuggagaacaguaugaagaagauggugccauacauccagaugagguggaugaugaugggguacugguaguugcagcugggcaugaaguaguauuggcugaugugcagugagaccaggacaaacuggaucugggauagaaaaagacaagggucagaaauagguuggggcgcagagggggggaauagaaauagcuuaggguggggagggcaaggaucagaggugaaacuggguagaaagaaggagcuaaguuagaaacacuggggguuggcuuugggcccaacaggcuccucaccagcugaauggcagucauauguuucuuccaccaaagguagggcugggccacagggccaagggcagacaauccauaguagagguacaugacgacauguacagaggaguuuaucauggcauggaaggagcccauuccuccuacgauggcaaacaagauggucaggagaugagccucucuuccccguggccacccucuucuccagcggccuucacugcucaccuggagcaauuuuuaucccccaccaccaacuccagggaagcaccgagugguggaagacauggaggaaggucacuugcccguccuucuuccggaggauaaauaucaccugggggaagaauggggagguugcaugccuguccccccccccguccauccuucccacucccaaguuguaguagcuguaacacucacuguguccaucagcucaaugaccuuggaaagcaugaagagccaggccacucgaaccaucugugagaagucagaucaaucuuaauaguuacacaguauccaaagagccucugcuaccuggccaacucugcucucccuuaucuagguugcuuauaauuaugguuaccuaaggcucuacuuacccgaagugcuucagggcuauuggaaaagucuauggggucacagcgccagguguagguacucagccaaccagacaucagaaacuaagaaaagaguggauuaaaccauccguucucucccagcaaccccuccccuucacuaacugaaccucggcaacagauagugccaugcucuggcccaugcccuguacccuaacucuuaaccuucaacagaaacuacagccuaggcauuccagccuaccucauagacaauguagagggagaguaucaccagugagaaauuguagacaaucaugaagccucgaaguuggaagggcuuccgauuagccaugauucgaggcccaagcgauaggaugaaguacacauaggucagaaggauggauguuauuagcaagggggaccccaucagaggguagcuuuggauccggggaucugugaauaggaugucaaaggagugagggucacaggguuuaagagccuuccuuggucuagacaugagucaggucacaaggaguuccuaaggacauaacccuagauccugggauaccagggaagaagggaaggaaggcagugccauagacagcagcuuacccgcaugcuucaucagcucgugguacaaguucacaacagccuccauccuggcuaaggacucuaaggagggauggagaggagguauuaggcagggaccacugcauggccccccaucacacaugugguccacaggacaagauacagaaucagacagcugcugccucacugacaaaaggauaggucucugaacuaaaguauuuuccuagcauacacaaggccccaggucgaauccuggccauggugaggccauggugagcaggcguguacugggagaagagacagucuggaacaucggcugccgaagcauccggccugccuggauggagcugucccaccuuuccccuccacucucuucgaguguuucccuucccugccuuccuccuucccucugagaccugccuuccaggucuccuggagccuuucuccucacaacacaguucaucuucccagugaacuuccucaaccuuuuuggcaagcagucucaucucucagcuuugagagacacucuucucuccagagaaucuccccuucagccacuccucucauacccccuucucccagguaaagucccucuggcccuuuuccaagacucuccucucgccucuguccccugcagggacucccaccugcuucuguccuuucuaguaccugaacaaaccuaggguuccacuucuguggugaacaccagugcccccgggcuuccccuuugccucccaggcucucaccuccagccuccugccuucuuccagugcuucaccuccagccucucuccucccuucuucucaggggcaaguucugccucucucucucuuccacuccaggagccuggcucuuugagacuccugcccuggcggcuccaccugucugacuagaucuuguagcagccccgcccuccucccgcccccgcuacguugggcaugggguggaggguggguccaggccacaggucaaugccuagaggagcaggacccaccagaauugagaaagccaagugagccccagccucaccaccucugaccagccagauaaguuuguagguucuccagaaacuucuggccaggacgucuggccaaagccagaacugcuaaaaaauccacacccagcauucucucccaaaccagccaugaauucuuaguuuguccuacuuuagaaugggcaucacccuucccuaccagggaggggugaggacaccagugguaugugaggaggugggagagugggggaggucucaggaaucuuucccucuucugggagggagccucaugggcuagguccccuccuccucaaaguuggaaggaaugccaagggaaaguuuauagggauacaaaaauuuagccuagacccaggagagccuaggacuuugucccagaggacuccggcaauugcccaacaagcggagugcuccagcugcucuccaucaaucuccagccuuggggcuugaguucuaccauccacauccacgcucucacacaguaauauguaccuucaucacaccgcucucaaccacccccagagacaugcauaccgcgccaggagcuagccagcauacauccacacacaguccaggcauaucuuguugaccacaucacccaaacaggccucccuacuggacucggacaugccaggcuccuaaacuucacaccugucagggauugcauuaaccgcgggacauacagcugaccaggcauggguacaucuucacccacaccucccuucugcacacacagcucucuggugagugacacucauuucuuccuacaguuagacuuugguugguggcuuauguuggaguggggccuagcacuuaggcaugugcucugacacacgugagcuugccaguuccuuaucuccucccucaaccaccuccuccaauucacucgcccuucaccaccacuuaacaccgggagauacacagugacccagagggcaagagggaguccagacuucugaggaucucucccuaaguuugagggaaacccgggugcgcaccaccccccucccgcagugaaacagagccaguucccuuaagauggauggaaaagaaaaagggcaccggcauggggcaggaagggaaaagagaggagugggcaaaggguggaaggccaggaggugcugaaaaagaacuaggugugagcaaaugggggucaggggccaaggugccggggagggauccugugggcaggcccagccccagugccugggaccucccacccacucgccccaggaacagccucgcccacagccugggcagggcagggcaaggcaggcagggcagggcuagccuggccagccaggcagggggcgcuggcacguggggagccauggaagguacacacucaccaguggaaaccaggcgggcagcagugaaggguucaaagggaucagggccggagagaaguccccagggccgccugccggccacuuccucaucugcugggccgacuuucugucaccagagggggag

SEQ ID NO: 2077 - RNA, 4474 nt, Mus musculus
aguuggguuuugaaggagccaaugaacgcuagcagcggagaguuuaagaacaacaguccggcguguccuuagcuugucuggaaaagaacgcguucggcaggcgcacugacgcgcugcgaggagcuggggguuuguguucgggagagcugaguacggagagggaccgggcugcugcgagcuguggcaggcggagcccaggagcccggcgaggaucgcgcuuggucgccuuucgccccgguagcggugccauggcgcaguucguguucgagagcgauuugcacucacugcuucaacuggacgcacccauccccaaugccccgguugcgcgcuggcagcgcaaagcaaaggaagccacaggcccagcccccucgcccaugcgggccgccaacagaucacacagcgccgggcggaccccgggccgaacuccuggugaguggguggagggagcuggaaucgcugagaguccgucuucaugcucccuccgggagccucgucaggcugucugacuucucucucccugcccccaggcaaaucuaguuccaagguucagaccaccccuagcaaaccuggaggugaccgcuuuaucccccaacgcagugcuucucaaauggagguggccagcuuccucuuaagcaaggaaaaccagccggaagacagggggacgcccaccaaaaagguaugauuccacaggggucaugagacuugaggugucuguccccuggcugauaccggucuuccuccccucacuugccguguauuucaggagcaucagaaagccuggucucucaaccugaacgguuuugauguggaggaagccaagauccucaggcucagcggcaaaccucagaaugccccagaagguaaggagugagugacaucaucgaggcuggugucaguccuuccuaaggggagacauguggcugcuuuuccacauguggauggguaucaguuuccaagucuagacccacucucuugccacaggcuaccagaacagacugaaaguacuguacagucagaaagccacgccuggcuccagcaggaagacuugcagauacaucccuucucugccagacaggauccuugaugcccccgaaauccggaaugacuacugugagugcacuguugucuuugcggauggagaaagauggccuaggaauggaccaguccaacaaaggaccucauguuuucuuccuuccccuggcagaccugaaucuuguagauuggagcucuggaaauguauuggcuguggcacuggacaacaguguguacuuauggaacgcugguucuggugacauccugcaguuguugcaaauggagcagccuggagacuacauauccucgguggccuggaucaaggagggcaacuaccuagcuguaggcaccagcaaugcugagguccaggugagccugguugccuguauuguggcucuguggucacugggcucaggggggagcuugcccaccuuacaucugugacccuguggucauuccucugcagcucugggaugugcagcagcagaaacgacuucgaaacaugaccagucacuccgcucgaguaagcucccucaguuggaacagcuauauccuauccaggucgguguuuuucccagucuauagcagaaccuuuccgguuucugccauccggaacuaaaucucuucuucucucagugguucacggucuggccacauccaccaccaugauguucggguagcagaacaccauguggccacacugaguggccauagccaggaaguaugugggcuucgcugggccccagauggacgacaucuggcaagugguggcaaugauaacauugucaacguguggccuagugguccuggagaaaguggaugggcuccccugcaaacauucacucaacaucaaggcgcugucaaggugagaaagcauuugagcugaggucuuuacagacacucagcuauaaacgagggacuacuaagaggagaggacaaggcgggguugaguuuaauugugacacuuagaguugagagaugguuuuguccacugaguauucauaauagaugaugacuacugugcccagagagcugggugccuuccagcaucgucacgauuauugaagcagcuccugucuuggaguuguuugaaaauuguuaucaccucugauuggcuaauaaagagcugaucaaccuguagcuggggaggagaguuuaagaugggugggaaaagaggugaggucaccaggagggagucuccaggagaugguggaggaggagcagccagggcgagacggagaugucagguuacagggcaggugcuggguguuaggcaucagagcuggguuagaauagaugagaacccugcccagcuauagugcaagaagcucuuuaauacauauuccagguuucugugccauuucaagggaaaggagggcauggaaaagcucaguucuuuuacacguagggcugcuucugccucucuguugaccugacccagccuuuauccauuccacccaggcuguggcauggugucccuggcaguccaauauccuggcaacaggaggaggaaccagugaccggcacauucgcauuuggaacgucugcucaggggccugucugagugcuguggaugugcauucccagguaguuuuguugugauugcuacugguggugauucaugguuuaaccuaucccaggcagagguguguuccucuaugugacauuucugaacagccacuucuacuccaacucucuaccugaucauuucuaaauuucugacucagcccucacuggcauucccauuuccuaguuuggcuucucuccaacccuagguccucaagaauccuccuccuccguauguccuaauuaagcuugucaguucaccuugccuuccugaaauguacuguguuccacuuguacuguuuuagaugcagaaccugcuuagaaaucugaaaagccaccuagucuuucauccuucucaggauauuucaguguuagcuugaaauaccauucacauccgucccuuccucagcacucucauucauucauucacucauucauucauucauucauucauugaggcagggucuugugagacagagucuugccuuugcuggccucaguccugcuuuuaacaucccaaguguugagauuaccagcauguaacuccaugcccaggcucccacacauuuucucucucuuccaguucccuuuauacaauccgagugguaucuuacuguccuuaaaccugugaugacucccacaaccuacagcauaagauccaaauacauuagacccgggcuguguugugccuuuaaucccagcacuugggaggcagaggcaggcggauuucugaguucgaggccagccuggucuacaaagugaguuccaggacagccagggcuauacagaaaaagaaacccuguaucggaaaaaaaaacaaaaaaccaaauacauuagaacauuugaggcucuugcugcugauaugccuugcuguaaauacuccaguuuucccuaucugcuccccucacucggccuucacugcaggugugggcucugaaggcagaugguugaaguugccaagggagucgcuuaugggaugacuuuggguaacaugaaacuucccuucugguggauucaucuucaucaccauagaugugugucugggggcuucagugaggacugugaccauuaaguuaaaucuguagugccugacagggugucuaauacuagaauggacugacucgguucugaguaacccugccugacucauguccgugaugaccuucuccacaggugugcuccauccucuggucuccccacuauaaggagcugaucucaggucacggcuuugcccagaaccagcugguuauuuggaaguauccaaccauggccaagguggcugagcucaaagguagguggcaauaggaagccaggcagaaaggccacauaguguauguuuccauccauaugaaauauugagaauaaacagacugauaugacuugccuggggauuuggcaaggguggugggaggguaugauugcacgagaauggguaaaugcagaguuaacaggcuuagauuuagaaugucgugguacugguuauaacaauguacaaccuaaccuuguaaauacaguaacaccacugaauuauaaaagggugaguguauggcauucaaauugcauuucaaggugacugucaaaguuagagggaggccuguguguauacucaaaugcacugcucucgcccuaggacacacagcacggguccugggucuuacaaugaguccagauggggccacaguggcaucagcagcagcugaugagacucuacgguuguggcgcugcuuugagauggacccugcccuucggcgugagcgggaaaaagccaguguagcuaaaaguagccucauccaccaaggcauccguugaacaaacgcauuuccuuucuuguuuuuauuuuauuuuuucuaauaaaguucguaucuuccuuaugucc

SEQ ID NO: 2078 - RNA, 754 nt, Mus musculus
uccuccacaucaaaaccguucagguugagagaccaggcuuucugaugcuccugaaauacacggcaagugaggggaggaagaccgguaucagccaggggacagacaccucaagucucaugaccccuguggaaucauaccuuuuuggugggcgucccccugucuuccggcugguuuuccuugcuuaagaggaagcuggccaccuccauuugagaagcacugcguugggggauaaagcggucaccuccagguuugcuagggguggucugaaccuuggaacuagauuugccugggggcagggagagagaagucagacagccugacgaggcucccggagggagcaugaagacggacucucagcgauuccagcucccuccacccacucaccaggaguucggcccgggguccgcccggcgcugugugaucuguuggcggcccgcaugggcgagggggcugggccuguggcuuccuuugcuuugcgcugccagcgcgcaaccggggcauuggggaugggugcguccaguugaagcagugagugcaaaucgcucucgaacacgaacugcgccauggcaccgcuaccggggcgaaaggcgaccaagcgcgauccucgccgggcuccugggcuccgccugccacagcucgcagcagcccggucccucuccguacucagcucucccgaacacaaacccccagcuccucgcagcgcgucagugcgccugccgaacgcguucuuuuccagacaagcuaaggacacgcc

SEQ ID NO: 2079 - RNA, 754 nt, Mus musculus
ggcguguccuuagcuugucuggaaaagaacgcguucggcaggcgcacugacgcgcugcgaggagcuggggguuuguguucgggagagcugaguacggagagggaccgggcugcugcgagcuguggcaggcggagcccaggagcccggcgaggaucgcgcuuggucgccuuucgccccgguagcggugccauggcgcaguucguguucgagagcgauuugcacucacugcuucaacuggacgcacccauccccaaugccccgguugcgcgcuggcagcgcaaagcaaaggaagccacaggcccagcccccucgcccaugcgggccgccaacagaucacacagcgccgggcggaccccgggccgaacuccuggugaguggguggagggagcuggaaucgcugagaguccgucuucaugcucccuccgggagccucgucaggcugucugacuucucucucccugcccccaggcaaaucuaguuccaagguucagaccaccccuagcaaaccuggaggugaccgcuuuaucccccaacgcagugcuucucaaauggagguggccagcuuccucuuaagcaaggaaaaccagccggaagacagggggacgcccaccaaaaagguaugauuccacaggggucaugagacuugaggugucuguccccuggcugauaccggucuuccuccccucacuugccguguauuucaggagcaucagaaagccuggucucucaaccugaacgguuuugauguggagga

SEQ ID NO: 2080 - RNA, 3940 nt, Mus musculus
gcucaccugggugcagguuaggcaggugaagcgucuccccggaaacagaccuagagcgcccaaccugcuggguccugccugcucaaaucggauucagcacagccaggcgucccgugagugccccauacgccccacccccaccuuuuucacggguucuacuaccgggaaccuccacccacgcuggggucguuccccaauagacggugucagcaccuucagaugagcaagccacaguccugaggaaugcugggacagacuccgcccacggucccucccccaaccacccuuggggcgugggcauuuaccccacccaccuugcgugccaggcaaccucucugcaaagggcagagcgguccccuacucugucucguuggaguaaaaacguggucucggcagugugguccauguggguucugauucaccccgagucucucuggcucaaaaaaguauguuuugagcuccuuugccccgugggaagucuaaaaggaguauguuagaugacuucucccacuccucagaauuaacuucucuguccucacuuuucagaaaaagccucuaagaggugagcuggggcuucccugccccacucccgucccuccuggacucgcagcugacaccuacaggaucggucucuccugcugccggaaguuggguuccuugccggcagugcuagcuuuauuuuuaccugaugugagucaugccgccugucuuguagggaacagguuaaaugaguaacacuguuagaucccuccccacauucccacgaugggaaggacuaggcugcgguucaaauccugaguccuccuuuugcugccuuagagaacacguggagccguuuagcaggggauggacccguggggagcaggcagguucuggaugagcgccgagaacaggacuggauagagauauguuuagaggcaagagacagccccuggggccauggauuggcaaaagcagaaggcgcugaggagcccccggagugggccgagagggagggugggugguaacagcaucuugagaaaggaacacaggaggaacagguucaggguaagaugaggaauuuggguugggcccuguugcaucagagacgaccagcacuggaaggagagacuuggagcaugcgucuucuuuugccugacggagauaggguggaacuagaggaagaacgguguuaggggucagauccugacccacagagaaggaaggguacagcccuaugagagaagggucaggcucagccugcugguuccagaaggguuaagucaccagccucccuuucccauagcuucccccacccaggacccagcagugacagcugaggccaugugagucugauccugaaugaggcauuaucucugacaguuuguccugucauccacuguggcaccaccagcuuccuccgacagccuggauggaacaggccaccgagacagccugugugagaggucaggagcugggcaaggggauucucugaaggggaaggggagcucugugguggagggaacucuguuggggucaggggaggugcuuuggcaaggugcagugcuaggguuguagcucuugggaauagguccugaggaccccggggaagauucuuggggcccuucccugagacucccagaugaggcuauagggccagaugggugggaaauaacuugugauccuguccugcaggugaggguaaccauagccuggacuaagaagaggagacugggcuucucgcuggcaaccaggugauggggacacagggucacgacaaacacccucugaacccugacagugauccucuguccugacccugccugaccaagccaugucccagcaagccucagugggcagggggcugcccccagaugugcuggcagagcagguggagcuaugguggucccagcagccccgucgcuccuugcucuguuucuccguggccgugauccuuguggcuggcuguggggccggugguguggcgcugcuguccuccaccagcagccgauccggcgaauggcgacuagccgugggcacugugcucugucugcuggcccugcugguucuggugaagcagcugaugagcucugccgugcaggauaugaacugcauacgccaggcccagcacguggccuugcugcgcagcggcggaggcgccgacgcuguuguaguguugcucaguggcuuugugcugcuggucacuggccugacccuggcugggcuggcugcugccccggccccggcacggccacuggcugccaugcugucugugggcauuaccuuggcuuccuugggcucagucuugcugcugggguugcuacuguaccaggugggugugaguggacacugcccuccgaucuguacagaggcauucuccgcccaaaauggccacggugauaacaguagcaucuuuagcaucucaggacaguugucuucuggccagcgucaugagaccaccuccagcauugccagccucaucugacagagauggagcccuucuucccaugcccugccucaguauccccagaacuuguggcagacauucacaggugcacgcauauaugugugucgcccccacccccgccauggcauuucaugauaugugauuaggagcucgugugcacccucauauccauuccaugagaaggugagggauaccuccuuggggcuguuuguaucauggacugucaugcucuaugccugguccuggggucucuagaggauacucaucuggagucucugaagacuugacccauauuuccaagacccuacaacuccagccuugcccuaugacaucaucaaggaucuccacagaggugacuguugccuauccacaacgacacuagugaucacucuucagagagugacucucgggaaaacugagagaaauggcuuccggaugagauggaccugacuggggaaacaccuuugagcuuguaaccuagcagcuggggccagugagaggugacucagacacuccugccucaguuucuuagaacaguguugcuauugaugcuuaagaauaauugccucuugggcaagaugauugggcuccuggcaaauguucaauuaaaaagugacuauagugaaaaugaaauaaauuaugggggaaagguggcuguaguucugucugcaccauggcaucucaccucagagagagacccuuacgcccgaccccacagcccacucaucccaggcuauagagccccagaccugggguuucucuucucaugagaaaagggggaagggucaagaggacucuacagguuuggaaagaaaccuacuggugucuggucccagagagagcggggagccaguccuucccacgaguucacuugccgcuuacggggagauuuaaccggugacugugucucuagaaaugugccccuguccuuauguauagucugccuucugggaaacaagaacuggcugcgauuuguguggccacuguaccaguuggcccacuucuggguucugggaacugaagaagcaguaagucacuuccugccuggagucgcucuggaagggcuccucccccccccccccgccccccucguguguguuuucuuuccaggugacaagaacauaggugaaugcuuuggccacuuccugcuacacaagguggagauuaccugaagacaucagagacucagagagacaucugccuccuaaaagacucggaugcaggaaaaacuuggaguaguaaaauuguugcuguaaaggauuuacuaauaaacucacuugggaaaucuuaaguuacacaaagcuaaaggagcuaaaugccaguggcuagcacacuaaccgcacuugcuagaaacugugagaaagaaaauucuguaccacagcugaagugugggcuugcugagaaaguuccugcuuaguuuauucacuacgauggacgauggacgauugaccuccaguuaggcucauuuccuuaauaaaaggagacaacccugau

SEQ ID NO: 2081 - RNA, 1326 nt, Mus musculus
auuauauauggagagaaauuuuauaugucaguguguauauaaacacaugugcacacacacauggaaagucaauaaagggcuaugagagaagagaaaaaggagacacccucuuggguaaugauaagggaagguagcugucagaaagcguggcugaagauggagagcugguccagucuacaacaaucuggagggaguugucauccagccacaacagugcuccugacagucaggggaaccaucacugcugagguccuuaggcauggggcagcccuggguaaggaucugugggagggaaugagauauuuuucuuggcgccaaaggaaaguguggccacaugaguucccuuccaucuuauaagcuugaggcccuuaaaggaauccggagcaaucgggaugccaugugugcagucucaagcccugucagcuguccaggcaggguacccggcccaggcagguacacaagcauuucagaacggcgaccuuugggcuggcugcccaucuagguuucugugcccagggugggcgccagcagucagguguucaucccagaugaggaggcaccagaccccuucauuagccucugccugaagccccugccccucagaacagagcaugccaugcugucccaggaguaaacgucugauugcaggaacgggaucuggaagcgcugguccgacgcuucaagacagaccuucacaacugcguggcguacauccaggaacccgggcugcugaaggagaagauccguggccucuuugagaaguacgugcagcgggcagacauggugagcucugagcgccccgcccucacugcccugugcuaggcuucacuucuccccuccuuggcugagugucuccccacgugaugcgccagguggagauugcaggguugaacucagaccugcaacaggaguacgcccgccagcgggaacaccuggagaggaaccuugccacgcucaagaagaaagugaucaaggagggugagcugcaucgcaccgacuauguccgcaucaugcagguaacggaugcaucccuuugccgccugagaccacccgugcucuagacuccccagacauccagggacccacagcuuucucauggcuccuccucucugaucuccaguagcucauccuggcugucaccauggccuggggcucaccggggagcccaccuaggcaucaucaugcccacugguagcccuauuccuuuugccaucaucccauccccaucccugagaagcuagcgaccugccucguucuucuccguuacccacgauacauccaggucucaguucuccugacuccuuagcuuguuuccagcucccgucu

SEQ ID NO: 2082 - RNA, 942 nt, Mus musculus
cucauucugggggucuaccacagccuguuaccuugaggaaagcccucuucacauccuuguuccggagacuauagaugacaggguugagaaaggcagagaugacauuguagaauagggcaagcuucuuguccucuucuggggaggcuuuagaaccaggcuucauguacaugaccauggcuggcacacagaacauggugaccacagugaugugggaugcacagguggagaaggcuuucagucgccccugugcugaacggaucuucaagauggaagugaaaauguugauauagaugaccaggauaagggacagggggaucaguaugacacuaaacccaaguaugaaguccacauggucauugacugauguaucugcacaagccagcuuuaagacugcagggacuucacagaagaagugguugaucuuguuggggccacaguaggggaggcgcauggcaaagaugguauagacaagagcagcggugacaccacagaguccacagaaaauagccauuaccccacauagacaugggcucaugaugaccuuguaccugaguggguggcagauggccacauaccugucuauggacaugauggcaaaaagccaagacucugugacacccagcaccaaaaaaauguacauuugagccacacaauuggaguaagagauugucuucuucuggcuggccagaugugccaacaucuggggcacaguuguggugguguagccuaaguccaacauggaaagaacaccaaugaagaaauacauggggguauggaggugugaguccaagcagaugaggaugaagaucaagccauugcccagaaugaucaacaaguaaauuaucagaaaggcugagaagagaagaggugugguccuagggcucagggagaagcccagaaggaugaauucugucacaaaggucugauugggaccuugcauua

SEQ ID NO: 2083 - RNA, 950 nt, Mus musculus
uuuaccaggccagccuaccaugucccaucaccuugagaaaugcccucuugauaucuuuguuucucaagcuguagaccacaggguugagcaaggcugugaagacauuguaaaagagugagaucugcuugucucgcucaggggaguagcuggaguuuggccucauguagauguaacuggcuggagcauagaagaaugugaccacagucaggugggaggcacagguagagaaagccuugcaacggcccugguuggacuugaucuugagaaucgccauggcaauaccaauguaggaggccacaaugagggagauuggaauaacaaccacaaaaacacucaauacaaaguccaccaucucaaugacaugaguauccaugcaagccaggcuacgcacugaaggaccuucacagaaguagugguugauccuguuggguccacaauauggcagacucauggugaagaaaguauguaacaaagaagaaaauaaaccacauauccaagacccuccugccaaccguaugcacaagccccaguugaggaugacaguauagcgcaguggauagcaaauggccacauacuggucauaagccaugacaacaaagaaggugcacucagucauacccagggcaccaaacacauacaucugcagccagcagccagcaaaggagauggucugagagugagcaagaagaugcaccaacaucuggggcauggugguggugacauagcccauauccaacagggagaugguacagaggaagaaguacaugggagugugcagcuguguguccaggcagaccagcaugaugaugagcccauugcccaggacugagcucagguacaugagaaggaagacaaugaagaggaugcuguuggucguggggucacuggagaagccaaucaagaugaacucagaaacccaacuuugguucugcccuggaaucauccacaug

SEQ ID NO: 2084 - RNA, 1010 nt, Mus musculus
uucaccauugugguccacggguccaccugccauaaaacaucaccuugagaaaugcccucuugauguccuuguuucucagacuguagaccacaggguugagcaaugguguaaaagcaguauaaaagagugagaucugcuugucucuuucagaagagcugcuggaguugggucucauguagauguaaguagcaggaagauagaagaguguaaccacagucaggugggaggcacagguagagaaagccuugcagcgccccuggguggacuuaaucuugagaauugccuuggcaauaugaauguaggaagccacaaugagggaaauuggaguaacaacuacaaaaacacucaagaccaaguccaccaucucuacaaagugaguauccaugcaagccaagcuacgcacugaaggaccuucacacaaguagugguugacccuguugggcccacaauauggcagacucauggugaagaaaguauucaauaaagaggaaaagaaaccacagauccaagucccugcugccaaacguaugcacaggucccaguugaggauaacaguauagcgcaguggauagcaaauggccacauaccggucauaagccaugacaacaaagaggaugcucucugucauacccagggcaccaaacacguacaucugcagccagcagcuagcaaaggagauggucugagagugagcaagaagaugcaccaacaucuggggcauggugguggugacauagcccauauccaacagggagaggguagagaggaagaaguacaugggagugugcagcuguguguccaggcauaccagcaugaugaugagcccguugcccaggacugagcucagguagaugagaaggaagacaaugaagaggaugcuguugguuguggaaucacuggagaagccaagcaggaugaacucagaaacccaacuuugguuuuguccugacauccuccacaugguagagacuguaagagaauccauuauucuauguguugucugacacaug

SEQ ID NO: 2085 - RNA, 1034 nt, Mus musculus
acaggcaagcacuagagcccuugucuaguguacccaggaucccaaauuuagucuucacuacaacagaaacaacauguuuagcaugcacggucauguucaaaaaguaccauauaugcugaugacaguaauggcuggagggauggcucaggggugcagagcacgauuuucuugcagagaacuuagguuuaguuccuaguacccaaacuaggcagcugccaacuucuuauaccuccagcccugggacaucugacacccccuuuuggcccacaugagcaccuguacucaggugcacauaacccacauacagauauacacaugauuuagaauaaaacuuuuaauaauuauaagaugguaauagacauagccauuauuaguuuauuggguauauuuuuaucauaauuucccagugaguuccuucugcauacuagaacaguuugcccugaaacacccuucuggguuacaugccagcauccuggcgugucucauguuugccaucccuuaauugcaucaagagcccugaguggcccacagcauuuaguuuuauuccaaaugcacucugauguucguacaguggaaucaccuaauaacacauuucucagaaugggcccccuuuaagugaugcauaagcacaaugcugaagucggcauuagagaagaggcgguuggagcucacggcugcucacagugagugcccacagucagcugggagcaaaggagugaccugggauuagaacucauuacguuuccauucagaacuagcugcugagcccugcacugucuggcuucccuuguauagcaggugcuuaggccaccuuuucccagucuguucuaagccugagccuggcuccgucucuggacuugacacacaaaucaugaugaccaagcagggguaaagaugaugagggacgagggccgccccacucccacacacuuaccuuggcaaagugcugcucaccuuuccuuucugcaccuauuccuuucugcugcacuugaggguguagaucaggacuggaaauggaauggcugugaagagac

SEQ ID NO: 2086 - RNA, 1034 nt, Mus musculus
gucucuucacagccauuccauuuccaguccugaucuacacccucaagugcagcagaaaggaauaggugcagaaaggaaaggugagcagcacuuugccaagguaagugugugggaguggggcggcccucgucccucaucaucuuuaccccugcuuggucaucaugauuugugugucaaguccagagacggagccaggcucaggcuuagaacagacugggaaaagguggccuaagcaccugcuauacaagggaagccagacagugcagggcucagcagcuaguucugaauggaaacguaaugaguucuaaucccaggucacuccuuugcucccagcugacugugggcacucacugugagcagccgugagcuccaaccgccucuucucuaaugccgacuucagcauugugcuuaugcaucacuuaaagggggcccauucugagaaauguguuauuaggugauuccacuguacgaacaucagagugcauuuggaauaaaacuaaaugcugugggccacucagggcucuugaugcaauuaagggauggcaaacaugagacacgccaggaugcuggcauguaacccagaaggguguuucagggcaaacuguucuaguaugcagaaggaacucacugggaaauuaugauaaaaauauacccaauaaacuaauaauggcuaugucuauuaccaucuuauaauuauuaaaaguuuuauucuaaaucauguguauaucuguauguggguuaugugcaccugaguacaggugcucaugugggccaaaagggggugucagaugucccagggcuggagguauaagaaguuggcagcugccuaguuuggguacuaggaacuaaaccuaaguucucugcaagaaaaucgugcucugcaccccugagccaucccuccagccauuacugucaucagcauauaugguacuuuuugaacaugaccgugcaugcuaaacauguuguuucuguuguagugaagacuaaauuugggauccuggguacacuagacaagggcucuagugcuugccugu

SEQ ID NO: 2087 - RNA, 5038 nt, Mus musculus
accuugggucccacaccuacuuguaacuaguacagaggaaggagaaggccauaagcauggaggaucuccaaugaucucccuuucuggcagguguucuacuacucaacgagcaucuucgagaaggcaggugugcagcagccuguguacgccaccaucggcuccgguaucgucaacacggccuucacuguggugucggugagucucgcuuuuggucggcagccaggguccaguucagggcaucaggacagaauggcagccuguugugggagccagacuuaaugucaguaaacgugugaggcucauuacucaccccgugcagcugucacagaugcucagggaggugagaaggcaagagcucucccaagcucacagccugugugcauuagcucucugaucaccaguaccuuucacccugguacuguugggcucagaggcauauuccuucccucggucccuacaaggcccccaagcuucagccugguggggagagguauuucccccacuaguguauguauuuccuuguauuuagcuauugaggugagccucugggcagguggcuccaagaggcaccaggcugagaacaugucuuucuccuugcccacagcuguuuguuguagagcgagcuggacgacggacccugcaccucauuggccuggcuggcauggcaggcugugcugugcucaugaccaucgcccuggccuugcuggugaguggcugugcccuggaaggcccagugcaagguagaguggggaccuggauugaggcacaccgggcauguacaaggugccauggcuguagauuauaccuggauuuagaucccaaauaaauacccauguugcacccagccucgguugccccaugucagugugccccuggacugggccugaccucugcuucucagguuguuuccucccaucucgaucuuucucuucccugccuggggauuuccugcacauguagacagacccaagcuccauauggaaaugccucuccugaagcugaaccuuacagagccuuuaccuagaaagccucaguucaucuccagagcaaccuucaguggacagugguccccuuacugccacagaggugcacaaacacgccugucuccauucuccaaacuaggaacugugauguuaguuuuuacagcuugagcuucucugaagugcucaaccagauuugugaauaucugcauauauucagugaguuacuuucagauuaggacucaagucuaaaaguagaauucauuuguuucauaugugccuuccacacaugguauguuuaucaugucuguauuuugacuggcaucagacguggucagguagacuuuucccucuggagucaugugacuugcucagacagcuucagauuaugaagcgucucacgucccacucgaacuaaagucccaggcuggauaaggaaugaagcuaagcauugaccucaggccagguccccagccuaucacugcacacacuccuccccugaguccaacccaagcaaggaaaagcccccuggaguccaagagcacgagaagaugggcauagacuagauccuugugggacugagacccugcacaggacaccugggugugucuguugcuuuuuaauugcuguaauaagacaccaugacuaaggcaauuuauaaaagaaaacauuuuacuuugggggcucaugauuccagaguccacagccauaauguuggagagcauggcaggccacagguaggcaggcaugauccugggguaauuacugagaaugacacaccuccaacaaagccacaccccuuagccgucccaaacauucaaacgugagcccauggggggccauucgcccucagaccaucacauugcagugcacagcaaauccaggugaccccaggccuaccucucagcccaguuuggagacuccuccucuuccuccugaaucugucaugucccaccuaaccucucacccuaucucccucaacaggaacggcugccuuggauguccuaucugagcaucguggccaucuuuggcuuuguggccuucuuugaaguaggcccugguccuauuccaugguucauuguggccgagcuguucagccaggggccccguccugcugcuauugcuguggcuggcuucuccaacuggaccucaaacuucauugugggcaugugcuuccaguauguggaggugagagccgcauugucuguccuccaucguucaacuacacguagggagccaucaugcuuugugauggccuggcccaagagucaugugacaagcaagcauagaagcccagcucaccuggcagagcacugccaguccaggcucuccccuuaguucccaugccguuucuggagccugucacaggacagguuuucauagcaccucuggguggcggucgcaaaccccuucuuaagaccaaagguucagagguucguguuggagagcauggcaggacccuugcagccgggaugcgggcugaccugugucuguuuugcagcaacugugcggccccuacgucuucaucaucuucacggugcuccucgugcucuucuucaucuucaccuacuucaaagucccugagaccaaaggccgaaccuucgaugagaucgcuuccggcuuccggcaggggggugccagccaaagugacaagacacccgaggagcucuuccacccucugggggcggacucccaagugugaggagccccacacccagcccggccugcucccugcagcccaaggaucucucuggagcacaggcagcuagaugagaccucuuccgaaccgacagaucucgggcaagccgggccugggcgccuuuccucagccagcagugaaguccaggaggauauucaggacuuugauggcuccagaauuuuuaaugaaagcaagacugcugcucagaucuauucagauaagcagcagguuuuauaauuuuuuuauuacugauuuuguuauuuuuuuuuuuuaucagccacucuccuaucuccacacuguagucuucaccuugauuggcccagugccugaggguggggaccacgcccuguccagacacuugccuucuuugccaagcuaaucuguagggcuggaccuauggccaaggacacacuaauaccgaacucugagcuaggaggcuuuaccgcuggaggcgguagcugccacccacuuccgcaggccuggaccucggcaccauagggguccggacuccauuuuaggauucgcccauuccugucucuuccuacccaaccacucaauuaaucuuuccuugccugagaccaguuggaagcacuggagugcagggaggagagggaagggccaggcugggcugccagguucuagucuccugugcacugagggccacacaaacaccaugagaaggaccucggaggcugagaacuuaacugcugaagacacggacacuccugcccugcuguguauagauggaagauauuuauauauuuuuugguugucaauauuaaauacagacacuaaguuauaguauaucuggacaaacccacuuguaaauacaccaacaaacuccuguaacuuuaccuaagcagauauaaauggcugguuuuuagaaacuugguuucaaaugcuuguggauuggggccaggcagguuggguuggaugugaaaagggcagaauagcauggcugugaccguccaguggcuggggauccuggcagugucccuuuuguugcucaaaaaccuguuugaccucugacccggaggaaaacuccagucagcauuuucauaggcuacuuucagacugauagcuaacccugccagccccgagauggccucgaugcgcaagcuucaacacuaucuugaaagugaagauaggaauccuaucuuuaucugacaggcuucaagacguuuaacaagcauauuuuacaacuccguggccauacccuguuccccaaacaaaaggagcucuuugugcugccacaguacguuguugccacgcuguguauccaaggcagcuuuccuauuuacagaggccaccugagaguguucaccgugucugggcagcacuaaacaggcagguccuuuccagagaaccucccucaucgaauucagaggcacuugaagggauauguccccauuugucuggauucagaguuauucaguccaaggcuaggcacuccagaaauggcuauaguagagcgccacggguccccucuccuguccccuguucccccacccgaaaaaaaaaucccuuuauaaaaccuaaagggaauuuucccugcauacagcuauucaaucucagcaugucaaagggcuuaaggaaaggaaacuauagagaauguauaaggaauuaacuccagccggguuccaaauuaaaguugagaagggccaugccugaauugcugaggccagauaaggaguacgggccuguuggccuuuuacuauuuguaaggcgcaccaccgccuaguaaguuguccguuaacacauaggguagggacaauuggggagcgaguuaguaggugcguggcaaggcaagggagaaaccggccuuacucaguucagguccagggcugaaaaagccagauuacagcccucuugccuuggagccuucccuguccuuaaacacggagacgcgcaggcgcaacugggccgagauggccacauccuccaggccacacugcagggacgcacucagcccucugcugugcgggggcggaguuagugacgucgucaccaauuagagcggggggcgggcucugagcuagggaggagcacaccugucgagcaucaggugaagccuucagccuucaguuucugauuggaagccaacugggggggaugcucccuccucucccccuccacucccccccccccccccgccagcuccuagacaaguuggcauuuuaucugcaacccugccucagucucccugggaacuaccuggacuccgcggcagccuguaauuuccucauuauaaugcugugcauccacugcaggagucuguccuuucuccagagcaaggagggacaagacuaaaacauucuuagaccucuguuuucaucagagccucuggucaggacuucua

SEQ ID NO: 2088 - RNA, 16094 nt, Mus musculus
uggcuucuguggggggcgggacucuggaaugugccccaggcgagcagucccguuaaguggaggagcaaggccauggcggugagcgaaaggaggcugcuggcagcgaugcuagcggucgccgccgccgccgccuuacggguugcggcggagucugagccgggaugggacguggcagccccugaccugcuuuacgcagaggggaccgcggccuacucgcgcggggacuggcccggggugguccugaacauggagcgggcgcugcgcucgcgggcggcccugcgugcccuccgccugcgcugccgcacacgcugugccaccgaacugccgugggcaccggaccuggaucucgguccggaccccagccugagccaggacccgggcgccgccgcccugcacgaccugcgcuucuucggagccgugcugcgccgugccgccugccuacgccgcugccucgggccgcccucugcccacuugcugagugaagaacuggaccuggaguucaacaagcggagcccguacaacuaccugcaggucgccuauuucaaggugcgacugguccggagcccgguggccgggagcgaccuggggaacuuggggagcagagcagggaugagacggcagggaggcaagggaccucuuggcuagggagcucuuggcggacuuugggagcuucacccgguucuuaugggcagaugcuaacccuaaagguccagccaguagugacagcccaagccaagaaaaaccugaccuuuuucuuuugggaaggccuccuagagggaaccgaggcggccgcuagggucucccagcaguacuucauugcaaguguccaagugcuucugcaacaucuuccuuccgguucguucuccaaucaugcuuucccugcucccuaauccaacagcagcgcucuuucaggacgugggauugccacgucgccagcaggggcugccuggcuccgcccuguggaggacccucuagcuaguauuuuuggguuuuuuguuuuuaagaaaaugacugucuuuugggaugccacagcgauuuaaggccaagucaauaagcgggcuuggaacgccagccuugucugcccgugaugacugguaacauauauuuccaggacuccguuaaagcacuuuacguuuguuuauugccucauuugcccugauacauacaguauccuuugaguaaaugauauuagucccauguuaggggggugggcugcucaugcagacuacauagcuacaacaguuucacagaccuuucaguucuaccuaaagaaagacuuagaggcucguggggaccucagauuucugcuuuguccccucgguuccuucugguuacuggaaagcaugcugggaugacuggguucuuacugauugggucaugccacuuaauagcacuacuuaaaauucguugccauuuauugagcaccuacuacauuccaguucuuggacaggugguuaaaaugauugcuccuuuguuuuuccuugugucacugcuaggagucacuguacuaagggcuaacaaaaaagguuauguagcuaaguuaggacuggggggagacaaaggagggaaacuccagcuuugccucaguuaaauuaggccugagagagaggagccacugaagaaugguuauuccccagagaggggaaauuggagcuagagugugauauaucuggggccaugggguagucccguccgugacuccugcguggggagacugggagugacuaaggaguuuagugaggcuucugcacaccucaggcagccaucaccagaccucauuuucagaauguuaauucuggaaggagaaauuggugguggugaaaacaggagaauuaggagcccaguccaccagaggaagcuaggugccagugcucagagggaagaaaggaagggcugggggugcguagcagaggaaacaggaguaguccugagugcucaggaguguaagcugggcaugguggcacagugcucuacagcagcccuaagaugcugcuauucuguauucucaccaccaccgugcaguuguuagcugcccuuuuguuagcugcccuuucugcagcauucccagguaguugcagcuuuagucacuauguuuagucagcucagucacuaccuuucaaucagucuuuguuggauugcuuguuuguuuuauuuuguuuugagacaaagucucaccuauaaucccagcacuuuggaucugaggcaggaggauugagaguuugagacugacuuacauagcaauaccccguaucagugcacacacaaacacacccgaacacacacauacacacaaagaaaccaaccaagcaaacaaacagaaaagaguuuguaugugaauguauucuuuuacuucaucuauagauaaacaagcuggagaaagcuguggcugcggcacacaccuucuuugugggcaauccugagcacauggagaugcggcagaaccucgacuauuaccaaaccaugucuggggugaaggaggcagacuucagggaucucgaggccaagccccauauggugaaaagacauccccuacuguguguguguguguguguagggggggugcgugugugugugugugugugugugugugagagagagagagagagagagagagagagagagagagagagagagaaagagugagcugcuguguaauucuguacuguauaguccaugcuggccccaaaucuuccauauuucuuuuuuucuuuuuuaaagauuuuauuuauguuauauaugugaguacacugucacugucuucagacacaccagaaaagggcauugcaucccauuacagaugguugugagccaccaugugguugcugagaauugaacucaggaccucuggaagagcagucagggcucuuaaccucugagccaucucuccagcccccauacuucauuuuuuagccuaauuuaauaccauauucuauguguauuuucaggaccuuuuugaccuaacauuugaacagcauuuuuauaaagaacuuauguucuugauaauuuuaauaguuuaugaaucagaacauuggagagccaagggauauacucauugguaggacacaugcuuagcaugcacacggcucuggguucguauucagcaacaacaaaaaaaccguguauguguccauacauaacauucauauauauacauacaaauaugaggacacuaucagaacgacagcacucauacacaguacacacgcuaagcgcgcuaccaauaccagaggacuuuuaaaguaaacuuguguuggcugugcaugguggcauaaaccuguaauucuaguuucagggagucagagcaaagcacaucaggaguucaaggucauccccagauaguuaggaguuugauacccuccugaaccgcuggagcugugagacauugcuucaagggagauagggguggguugugauucauuuuuaguuuauguauauuugugguguggugugggggggcagguggggaauuuaugugagugcccagggaggccagaagaggaaaucagaaccccuggagcuguagucacaggccuuugugagccacccugugugaaagcuggaacuaaacucaagucuccuggaaguacaaguugcuaauuauuugagccaucuuucugaagcccacaucaucugaaagauaagcccuauagaaaccuauaaacauuauagcgagcgagcucuucuuccuacauuaagaguuaagccuugugaaauccaaggguacuuggaagcccguuuacuaucggccuucauuauguaggagcacccaggauccccuguccaucuguaacuuaggaaucaccacuuagggaucaucacuccaugauaguggcuuagggcaaggugaggggcuccucuggagccuguuuugaguacgccuucccuccaguagcaugaguuucggcuggggguacgacucuacucagaggagaagccacaggaagcugugccccaccuggaggcggcacugcaagaguacuuuguggccgaugaggaaugccgugcccucugcgaagggcccuaugacuacgacggcuacaacuaccuagacuacagcgcugaccucuuccaggccaucacaggugggugccauucaggguguggccugaccaagccucagaggacuuuaaggucaaaguccugacaaugcacacaaauaccuugcaaccucaucccccaauuuuucuuaaacauuuguuuauuuuauguauaugaauacacugaagccaucuucggacacaccagaagagggcauuggaucccauuacaaaugguugugagccaccaugugguugcugggaauugaacucaggacuucuggaagagcagucagugcucuuaaccacugagccaucucuccagcucuucaaauuuuuuaagucuagaacucuaacuaaaaauuaccuuuucaggggcuggggagaugguucaguggguaaggugcuugcugcacaagcaaaaggaccuggguucaaauccugacacccaggguccuggccauaaaagcugagcaugguggcacucaccuguaauccccuugcuagagcuugucucaucauaugggugagcuugagguuacagagccuaucucagaaacauaaugaagagugauggaaaaagaugcugacaucaucuggcuccuauacuccuauacacacguguucacacaugccacauacuugcacacacauacacaaaugcaugcacauauccuccacacagagaucacuuuccacuucaacuuuccuauguuagccagaauuugaaucccaaauaugacuguauuagccaggcagugguggcacacaccuuuaaucccagcacucaggaggcagaggcaggcggaacuaugaguuugaggccagccuggucuacagagugaguuccaggacagccaagcuacacagagaaacccugucucagaaaacaaaaccaaacaaacaaaagaccucgcuguuccucaucucugauuccuuucagaucauuacguccagguccucaacuguaagcagaacugugucacggagcuggcuucccacccaaguagggaaaagcccuuugaagacuuccucccuucacacuauaauuaccuacaguuugccuacuacaacaguaagaccugcuuucucucuucucuccgaugccucaacuaaaguguagccagccaggcaggguugugaccacuccacuucuucagcaugucuagcagcuaugucugugggaggcaacaugcccaaugauuccuggguguuuugucacaagccuguggcccagguagccaauuucuacugcccagaagggaggaacaggggagucuaggaccucuuucuuuugucccuuuuuguucauuuauaaucuaaauuugcaugugaauaagaaugaauagcacaguuaggauguacuacuguugacacuagcucacagggcaggcccagucuuccuccagggguaaagggacgaaaaauauccagaaaaacaaacccucagcaaaucagcaguuguuuacuggguaccuacugggucccagccagaauagcacauccaagaguacaugguguguguccgcgucgaguuaaagagguccuucugucuaggaggcucccagcuauucuaaucuuccucuucuagaaaguuguguggaaaauacuacuuuguccugucauuguggccucaaggcuucucugaaaccagaugcuaaguggcugcuggugucugggauuauacccuucccucacggccguuugcuuuucuuccuuugcaguugggaacuauacacaagcuauugaaugugccaagaccuaccuccucuucuuucccaaugaugaggugaugcaccagaaucuggcuuauuacacagccaugcuuggagaagaagaggccagcuccaucagccccagggaggugagagacuggcuucuggcugaacccaaucagaaggaagaugagugcucaugggguggggugggguggggccggucuuggacucagcuugucacucagggugggaaggaguaccaggaguuuguagaacauggcagagccaaauccucuagaguucgauguacauucuuuggauuggcacacagauuucucugcccugauugacacccaagcuagacgcuggaugccauuugcccaaaggcaguguucuuuccuucauaaugggucuguuuugcucacacggcuuucuguuucuguuuuagucccagagugcauuucuccuugucauugucugcuuucuucaauuacucagcauuauccacaucucuagaaugaggagaaaacuuagguacagacuucaacucugagggccaagccacaguuccucccacacagcucuggaauugagucucuaaagaaaauaaucccacugucagccccucccagcugagacuggcguucuuguaguuauccuucuuguccacuagauggcggccaucuagcuuuaagaaggcccuuccagucuuugucuugcuggguugauacuuuuucccuucccugggauccuauuaagagucucucagaagggaaggaauguacucgugugagcacauuuaccuagaacucucccccaggaagaacucucccccaggcgagaguagcuaauacugguuugcgcccccggccagaccgcucaccccgcuggauagcacguguggcuugguuucuggcauuuggagcaggaagccgaucaguuaaacuccuuccucaugggugacugugguagccgacgggguggacuccuuuaauguguuccuccuugaacugccuccacuuuagcacugucuuuuucucucuuccuucugcugcuuggauccuaguaggggacccagggaaaagaugugacccuggaagggacucaguuucccagcucuggguaagccccaccccugaauacacaugcaaugccagagugccaagcuuagcuauucuauagcugcccgccuucagggacggaucgagcccagccauucugagggguggcagguggccaaauagaaagaacaugggcuuggggaccccaaaacccagauaggaucgcucucaauccuacugcuccuaagggucuuuaagaugaaguucagucuccgcccaugagcuuccacucagggaacagaggcagaagaaucacaaguucaagguuaugcagugagaccuggucucaaaauuaaaauggcagauggcucaguggguaaaggcauuugcugcugagccuggugaccugaguuugagcucuggccccucacaguacaaggaggaaacugacaaauuguccucugaccuccucaccuaugucacagugccgcccccccccccacacacacacacgcacgcacgcauacacacaaacacacagagaauaaauagaauaaaaaaaucuaauuuuaaaaaagguauuugccgggcuggagagauggcucagugguuaagagcacugacugcucuaccagagguccugaguucaaaucccagcaaccacaugguggcucacaaccacccauaaugagaucugaugcccucuucuggugugucugaagauagcuauaguauacucauauacauaaaaucaauaaauaaaucuuaaaagaaugguugacaaaagaucuucuaaaaaaaaaaaagguauuugccacauaagcuuguaaccugaguucaaccuacagaacccacaaaaggauggauguaaauaacagacuccacaaagucguccccugcccuccacacaugcacaguggaggccacacgcuccacaacacaccaaguaaauaaauaaaauauaacaagaagaaaagagggcucaagacacaauucacagccuggucuacagagugaguuccaggauagccaggacugcagagagaaacucugucucaaaaaaaaaaaaaaaaagacacaauucaguugguagagagccuugccugguaugccuaaagcccuggguucaaugucaaggacuucaaaggcagaaaugaagucuuuccauuuucaggaucaucaguucuuccauuucagagaucacuggggccuccucuccuucaguguggcugaauuacgcugcccucgggaguccucuugagcauagaggggagaccuuuggccaaacugggcaacacaucaccugugacugggagaaggcaccucagucccguagagcaaugcacaaugccagggagggccacccuagggcugaaggguaagggcuaaguucuaggagacucuuuguuuccucagaaugccgaggaauaccgacgucgaagccuguuggagaaagaacugcuuuucuucgcuuaugacauuuuuggaauucccuuuguggauccggugagccagagcaggagcugcagggagggggagagggggacacugggcacugagggaguacacgcugcagaacucugggggagccgcuguccaaggccgagccaagcaugggugcgugggcccugaggacgggagacaaaguggacagugaaaggcgguccugagccauuaaaaguaauggucccaagagcccaccucaucucaggcagugaggcaggucacacacagauaaccugaaagaucaacucucuugcuuguuuccugaccugccuuaggacucauggacuccagaagaggugauucccaagagacugcaggagaaacagaagugagaaaucccaugguugggucgggcucacgaagcacuucaggcuuccugcacccaggcagaugggagcccagccagggguugggaguagggacacugggguaggaaccagggcugaccccagcagucagugcugucaugcucacaggucggaacgcgaaaccgcaguccgcaucucccaggagauuggcaaccuuaugaaggagaucgagacccucguggaggagaagaccaaggaguccuuggaugugagccgacugacgcgggaaggugaggcagcaguggguggcaugccugcccacguucaccagguggcagcacccacaaggcauugcucagcccauuauauaccagcuucugcuuggguagcagaugcugggacuuccuccacaugcaacacacuaaggagcugucauccagacagcccugagaacgggccuuuggcuaagaaguacgauccccaugucacaguuagacuagcauagucacaguaaguauggagagcguaaguccccugccucccccuccaaaugcucucugacagcucacgcuguuaucaggagccgauaacagcagcuauccugucuucucugcuccauuugcugcacuccuggcccacagugauggcugcucucuucucuccuccucuccugccuuugguucucauaggcucaaaccccuccugucuguccucauucuuucccacccagauagcagccugucuuccaaacagcggcauacacgcauucucaauagucaaccaugcucuauguacuugcucuguguguccaugcaugcauucucaauaguuaaccguccucuaugcaccugcucuguguguguagcccccaugucucugcaucaggugggaugggcuguuuccaguucccugagccugccguuggcccacaggucauuguccaugcuugucccacuccugguauacuuugcaucaucucuguccuuaaccacaaccccgagagaccuuacagagccuccuauagccucccuccucugaguuucugagggugcuucgaugugucucgcccuggcuguugucugacuguggggaaaggcucucuggggcucucugacuauggggaaugguguuaggcccucucugcugcaucacucaaaggucucagcacguagaugggguugagccgggucucuaaugugacccagcagacaccucacaacuacaggcagaacgaacguugcccuuugcccuucuagacugaaccgaacagggacaguguguagcaaguuugcccagcgccgcucuguuuucagaaguggauuucuauuuuucuugcuucucuucaugucugagagguagguuaggcagauuacaagaucguuccuguacacaguaugacagugaccauaccaugggcgacacuuuugagcauucacucacgacgagccaaacacuguacugaggguuuagccuuauugguugcucucacuaaucuguugucaaacuuauaagguuaacaguaauugauugaaaaucaaggcugggccaggcagcgguggcauacgccuuuaaucccagcacuugggaggcagaggcaggugaauuucugaguucaaggcccagccuggucuacagagugaguuccaggacagccagggcuacacaaagaaacucugucucgaaaaacaaacaaacaaacaaaaaacaaaccaaggcuggguguggugguucuugcucuuaauccccacagaggccagcagaccucuugaguuugaggccagccuggucuaccagugagauuuuaucucagagaaaagagggggcaaaaggaaggucugaagagauagcucaacaguaagagcguugucugcucuuacagaagacguggguuugaaucccagcacccacgagguggcuuccaacuguaacuucagucugaggcuaucuaguuucuuauucugaccugcuugggcaccaggcaccuacaugguacacaauauacaugcaggcaaaacacccacccauguaaaauuuuuaaauuuuauuauuuauuuauuuacuuauuuugguuuuucgagguagaguuucucuguguagcccuggcuguccaggaacuagcucuguagaccagacuggccuugaacucaagagauccgccugccucugccuccugagugauaggauuaaaggugugcaccaccacuguccaucuaaaauaaaauaguuuuuaaaaaauuaguauaacucagagugguuaggucacacaguaaguggaggacuuggggaucaagcccaguccuuugauucugggguucauguuugagaauguguguagcucuuuacuccaggagccagcagcugucuaauggcagagugaggccuuggauguggacuugcaucccuuuggaagccucugaguaggaaugccucuggaaugccugauuuuugcgaggaggcccugggcagagcugcccuagaaccugguccaucuuguccuugauuuucaggugguccccugcuguaugaaggcaucagucucaccaugaauuccaaagucuugaauggcucccagcggguggugauggauggugugaucucugaugaugagugccaggagcugcagagacugaccaaugugaggaacccugucacuguaccuuuuccccacucugcauaccaagcgccuccuugguaccgcggucccugcugcccuugguugagccuauucgucacacacccauuggcauauucacacacaugggaacucacccucccacacacccacacacgugcacacacacacacacacacacacacacacacacacacgcaacugcagcuaacuuugucuuuucuuuuggguccauuaggcggcagcaacuucgggagauggcuaccgaggucagaccuccccacacaccccaaaugaaaaguucuaugguguuacuguccucaaagcucucaagguaaaauccaaaauccaucuugguucucuugcacggagcagggagaaucugccagccagggaggaggaggacucuccggcucuggggaggagcugggagugggggauagagagggagaagugucucagugcugacauuccagcugccaaggagugaggauaagcuaugcagggagguuuccugguaaaucuuggcuguuaaagcaggcgcgauaaaaaugaggcaaccgagaugggagggauccccaggugugugggcuggcugugagucggggcugaucccagagggcuguguuccuaagcaggguacaggaaaacuguaaaggagaaaggagaagagacugucaggugugggggacggagaccgcuccuucaucaguggggugggaggugcuuucagugugcggccuuguaccucaguguccugggcagccauagaggagagucagggcagcugaccaccagucuucuuugcagcucgggcaggaaggaaaaguuccucugcagagugcccgcauguacuacaacgugacagagaaggugcggcgcgucauggaguccuacuuccgccuggacacgccccucuauuucucuuauucccaccucgugugccgcacugcaauagaaggugggccuuaucaccccgcaguuucuggggagcaggcugugcccuggcgcuauacuggacaaugagaacauggaguaggcagggugugguuccuucaugccggcugggacaucagugcaaauguguuggcugcaucccagcauguugaauguggcaugggggggggggggggaauaugcagucaaccacccaggggucaggaggccuccaguggagcagugagagcguuacaggauaaauguguuuguggagcugagggcagcaagaaaccuugcaagcuggagagaccaguucuaaaggaacagaagccccgggggagcugagaacacugccaguguacagagagccacucucuggagcuuguacuguccuuuaacucggucccuggcuccugcucugugcugcaagcccucucaguaacuguuagauaccaaccgugugugggagggagugcauuugaagucagacagacagagguacaaggccuuguuccuucucccugacauccccuuggcgcucacagcccugagcaggggugagcagaggcacggccaggcugccagcagcucauuuuuguggcccaaagccaacucuauccugccguagcguucaaaagacucuguuucugacacuuccuuggaagguggcgggcgcuggaaagcuucucucucccucaggguguuaaaagugcuaagaaaaucuggacacaccaaaggaaugugucaggcacuugacugugugccacggagccuccaagugaagugcuggcaugaggaggaggcaugagcagacagugaaggacuuggcagggccuuccuuuuaaaagaugaacuuggcagcugcaugcugagagauugggaacagguggaucaggcuagaggcaugggagcaauggucagcaaugaccaaggugggugaggaugaaggcucgagauccggaaaggccaaggaagcagaggugccgcaggagagguggagaggaagaugggcgggagcuggugacuggcuggaccugacgaagcgaggcggcaucuaacauucccacacagggugccaagguuuacacuggaggaaggugugaucugcuggcauuuaccauaauccugucccuucucuuucuguguccccucccugugugguucccuaccuauccccacucacagagccccacuucgcuggcuaugguucaaugcuucuguuacccgccccaccccuccugcaggccugcuggagaauggaaucaauggaugcccccuacccccagccucacugcugaccucugugauccuuccuauuucagaaagucucuagcuccaccagggugauggcacucagcccaggaucugccuuguugacaccugugagcugcauccuguucacccccaaaacuugcccuaaucucuaaccuguggcuuaaccaaagaguccucccagccaggacaugacaguuccagaguuucacauacauuuggggacacacuguguuuccuguauacucuacucuaacguggauuaucuuggccacagagucacaggcugagaggaaggacaguagccaccccguccacguggauaacugcauccugaaugccgaagcccucauguguaucaaggagcccccagccuacacguuccgggacuacaggugaaugcagcaguguggugcccggguacugcgcagcucugggcuugccuuggaagcuucucagugcccugcacucugccucccugcccucacacaugugcacacgcaggcagagaggcaagcuguccucagaagcccguucuucacccuagaccccacauaagaagacagacgguagggagguccuuaggagggaguggggaggagggcauggcuggguuugacacaaagguaugcuagcuagggugugguggagucuccaaagaggggugggggacccugccagcuguucauggcuucagagacgcuucaggucuccagcugcuaguugaaaguacacagaggaaauaagccgugucuggaugccugccuuuccagcgccauccuuuaccucaauggcgacuucgauggaggaaacuuuuacuucacagaacuagaugccaagacugugacggugagugcuccccuguccucaucccugggggcugauggccccagaggacaguagaaagaaugacuuacugggcuuccuccccaccccagcccaccccuaccaacccccagccuguuuccugucccugggccaggggcuuugggauaugauagcucuccucugacuguccuuugggucuuuguccuaaugauccauugcucuucugaggcuuucccccaucuccccuccccgcccacaggcagaggugcagccccaguguggaagggcugugggauucucuucuggcacugagaacccacauggagugaaggcugucaccagggggcagcgcugcgccaucgcccugugguucacgcuggauccucggcacagugagagaguaagggcuguugggagggccacuuguguuucccugagacuccccacccaggcacucccugcagucauugcccgcccacccucccugggccuuucuuuucacguggaaguggaagaggguggggcuugauguggaguucuugguucaugccuugggccugcuccagcaaccagagcuuaagccugcugggaaggaggcagucccagagccccugugguaacacuaccauuguucucuuggaagcggcagcuaagggggugaggggaccucuccagaggcccucugagaagaguuugccuuugcaggacagggugcaggcagaugaccuggugaagaugcuguucagcccagaagagguggaccucccccaggaacagccccugccugaccagcagggcucgccagagccuggagaagagucucugucagacagagggucgcugcacaaggaugagcuaugacaacagcuaggucacaguuggguguccuuggacucaugagggugacucaguccuucagccuggacuucccggccccucaaggcugcagagugagaggcgcuucuguuggccccccggccagaggauccuguccacagccuucugcauggugcuacuguucuuggagugggcauagcaggacacacucuucucugggcuuggcuguaggcucagaaugcaggcccagaaccacccuggggccuauguaggcagcugccgucagcagcgugauauauuuaagugucuguaaagacaaccaaagaauaaaugauuuguguuuuuuucacuuagugguuuguuccaagagagaaaauauuucuacucuuccugggacgcugagcuugguagcagcuccucuagguagugugccguggcacaugccacaugggaauuccucuguagccucaggccagauaacccagguaccuugggcuguuaccauagaaggggcaucuugguccucacugccuaccuucuaugggaacuggaugucccagauacagcacccaggauggcagcacaucaucagcuuuaaaggcuuucaacaucuagauugucacuaauccucuucuggcagagagcaacagucagcgcugcucuggcagggcagccgcaggcuuccugcucggcuggcuggccucagagcccgcaccugacuggaguuucagcuccuccggccacauagcuggcacgaagcccacccccuucagcacuccugagaugcuguuguacggaguuauaggaaccugcggcugaguagucauuggucagucgaacuauuuauuuagugagcaccagcuuguugcugggaauaugagagggagcaaagcaaaccuaggccucucagagcuuguauuauauaggggauacauaauaaauguguaaauauguau

SEQ ID NO: 2089 - RNA, 1013 nt, Mus musculus
cguggcucgggccgcgucgccuaacgguccggcccgcggccccauccccggucccuucuggcgcucaccgaugaccuucuuguccccgccggcgggcgccgccgaugugaggccacccgggccgccacuacccgcgccgcugcccguggagccgggcuuggugucggcggcgcugagggcggcggcgggggcggcgggcggcugcugggucucggccucgcugcucaugguugcggugauggugacuggggccggcggcgacggcugcggcuccucccgggugugauggugacuaggccggcggcggcgguggggcucucagggcucucugggguccgcucuccgcucccgcuaccgaucgaacuagcgagaauggcgggacgggcgggauaagccccgcgauagacccgcccucguccucccccauugguccgcaucguuguccaucucaccaccugaccgggucucuagcgccuauuggcucacgcuccgcggcuccugcgcucucauugguaucuuuagcgacuaauucgcccgacccacagcuucucaggccuccgccgccauagagaccggaacuagaaugagagccucggccgugagcaccauagaguaccgggaggacgcgcagagggaacguucccagauggggcugcgcucgucgcgcacgugggccgcgaucgccgggccuacuccggccuccuagaaggggcuccuucccacggcugggugaacgccggggccuccuuaaugggucaggcuuuuggugauccagucaccuuggagggaccacgcaggcgcuggagcugccacgacucagcguguucagggcgggggugaucguuucccccggcguccgaggaaauguauuucauacuggccacaaaucagauuuaauuucgccucacauuuauuggauguuaggguuuuugacuuuauaaacuaagcacuguagacaaggauugcuauccuuguuuuuauacacuguaaaacacacgcugccuucuuucuga

SEQ ID NO: 2090 - RNA, 1013 nt, Mus musculus
ucagaaagaaggcagcguguguuuuacaguguauaaaaacaaggauagcaauccuugucuacagugcuuaguuuauaaagucaaaaacccuaacauccaauaaaugugaggcgaaauuaaaucugauuuguggccaguaugaaauacauuuccucggacgccgggggaaacgaucacccccgcccugaacacgcugagucguggcagcuccagcgccugcguggucccuccaaggugacuggaucaccaaaagccugacccauuaaggaggccccggcguucacccagccgugggaaggagccccuucuaggaggccggaguaggcccggcgaucgcggcccacgugcgcgacgagcgcagccccaucugggaacguucccucugcgcguccucccgguacucuauggugcucacggccgaggcucucauucuaguuccggucucuauggcggcggaggccugagaagcugugggucgggcgaauuagucgcuaaagauaccaaugagagcgcaggagccgcggagcgugagccaauaggcgcuagagacccggucagguggugagauggacaacgaugcggaccaaugggggaggacgagggcgggucuaucgcggggcuuaucccgcccgucccgccauucucgcuaguucgaucgguagcgggagcggagagcggaccccagagagcccugagagccccaccgccgccgccggccuagucaccaucacacccgggaggagccgcagccgucgccgccggccccagucaccaucaccgcaaccaugagcagcgaggccgagacccagcagccgcccgccgcccccgccgccgcccucagcgccgccgacaccaagcccggcuccacgggcagcggcgcggguaguggcggcccggguggccucacaucggcggcgcccgccggcggggacaagaaggucaucggugagcgccagaagggaccggggauggggccgcgggccggaccguuaggcgacgcggcccgagccacg

SEQ ID NO: 2091 - RNA, 4095 nt, Mus musculus
uucaguucugagagugaaacacuggacgcucuccuggaucuggaaagugaacaagaguucacaaagaggacugugggauugcguggccugcagagcagaugagccaggagccgcugcguguuggccuacuguaaggucauggugcgugaauggucaugcucugaagaaguguuuaucaagugccuaccaugugccagggccuuugugagcugugagggucugaaagaugaaugagcacgucucauuugggaacuggauguacaaaaauuuaugugcaauaaaguaugugcccacaaagggacacuuggaaagggcggguuucugguuuuuuguuauuguuuuuuuuuucuuuuacaauuuaguuauuuuauguguuugaguguuucugcuugcauguauguuuauacaccaugggucugcgguaccuuuggaggcuagaagaaggaaucagagccucuggaacuugugagccuccauguagguucugggaaucaaaccugggucuuuuaagaagaaagacguuuuuacuaaaacaggaguaaugcagauaagguagaucacagaccucccuacaucuacuuuuugccucuuggccuagauuuauuccauauuuagguaauacuuuucaaauauuuuaaggcuguucuucggauagauaaccagccuuccacuuggacccuggcaggaguuaaaugauugcuucugcccugagggaacuguuacccugugauaaagugugguguuuagauagccagcugggcauucuacuagauucaugaaugaggcccuugacuuaaucuuaguuuauguaucuacaguguagggauaaaaauagagcauuggucucaugucuggcacuuuacacucaguacgcuggugcaauuaccguuuuucucagaaucaggccaaaacauuugaucacugagucccugagaaacucacuaucccuaagaaguucucacuauccuguuuuagaguacgagugaauaccuagugcagaaaaaucuccaguaagugagacguaggguaguccuaaauacaguugugugugugugugugugucuguggugguggugggggggugcuguuauuauguagaagucaguguucuacauaaauuucaguuagggacuaauggugaaauucaguaguugagcacuuggcuagcaugugcaggccuugggucaaaaccuggcuuacaguacaacuggccauggaguuggaaagguacccugacaguacagaguuucaguuaugacauaaacagaaguggcaagcaagauaaguagaaacaaugaaguuuggaauuguggccuccagcacaagacgguuuauugcugcagccaggagugaaaccaucucuuggagcacacaguugucaugaacuuuaggucuaguuggcaaaacuuccagaaaacaacaggcuucgccacuggaacagugcuguaaaagaugacuuuccucucuacaggcacagccuugggugcugacucaucugcuagaacuaggugauuuugaugauaauauucaugagagcccacuuaagaucguuuuauuaaagccccaaacaaucucuaacuugucuuauggacucaccagagacuucucccuucgguuuauggucuguucugagagcuucaaaacacccagguaggaguuccagguguguguguguuuguguguuagcaggaggaaauacuugcaaagggaaacgaggcguuuauuugcuccagcucggaggaccaaggagccuuaccuaaggaggugauaaugaaacugaucagugggaguggguggaaauggaggugagcauuuuagaucagagaggggaaacacuuucaaggccaaggaagaaaacagaaaauaggggacacuguugaggugauggucccccacaugauccagaaggaagggcuggcagcuagaauaagaucaagaaauguagguggcguuuuagauaccagaaaagcagaagccuccagaaauccagcuuugacaacgcaccuggagucucgaaaaaagaacaucugaagauuuaaguugagccugugcuaaacuguaucacuaaaguacuuuggggcuggaagaagacauggcuacugaaccaagacucauucccagcacccacgaggcucccaaggacuguaucuaguuccaggagaucugguauccucuuuuggcuuccuugggcucuagcugugauguacauuaacuuaucaauguaaaccuacaugcacauaaaucuuuuuuuaaaaaaaauauuuaucuugcauucuauaagaagccaaacagaauugucaauuagcuuaguuaggcuuucuuaaggguucuagccuucgugguaauucuggucaagcuugauuuaaaugaucuuaagugggcucucaugaauauuaucauaaaggucaccuaguucuagcagaugagucagcacccaaggcuguggcuguagagaggaaagucaucuuuuacagcacuguaccaauggcgaagccuguuguuuucuggaaguuuugccaacuagaccuaaaguucaugucaacugugugcuccaagagaggugguaauucaugucacaaaaguccagaaguguggaaauuuaccuuagguacuccaggugugaugacaaauucuggcccuaaauugagaccugauaugcacaguaucuugccuuuuuucuuuucucuuuucuauucuccuccuccuccuccuccuccuccuccuccuccccccccccuccuccucuuucuucuucuccuucuccuucuccuuccuucuccuucuccuuccuucuccuucuccuucucuucuccuccuucuccuucuccuucuccuucuccuucuucuucuucuucuucucucucucucucucucucucucucucucucucuguccucucuuuucuuuuucuuuuuuaaaggcaagguuccauucuauagccuaggcggcaccgacuggaaucuacuguauaacacuagcugguuccaaacucaauucuaccucacucucaugugcguggacucucacauccaaguuuugaagucacuuacagaaaaacaaauauaaggagauagguugaacuuggagggaaacaauucgagaauuagaacccuauguuuacucgcagucugagaauuauauagacgcuguacacuguuguuaugguuacugcggucuccggagccaaugggguagucuguaguuccuggaggccaauggugugcgcuguaacaacagucuucacaggaagaacggcccgggccacccaaagcgugcauggucuccauggcucccgccgggucgcgccugcgcgucccccgcugagugggguugccaugacagcggcugggcggcuggagcugagaguccccugcuccuucugcgcgcuggcaggaaaaucccaccucagcccggggacggaccugcucuucccguggugcacauuccagaucucuucggaucgccggugagcuccuucgcgcggugcuggccggcuucggcgugcucggcccgguaacgguuggcucaggagaagugugcucuugaccguccccgaaggucccagccacaaaggccccagagacaccguugugcccugcgcgcggcccgagcgaaaggacugugggacuagcuucgucacacgcaaccuugcauccggaugaagcucugcaggccuuuggggauaccagcauccgagaucaucaagucaguugccuucugccuuucagccuucaacuccauccacuucucucaccauccgagcacccggcuccuuuauccuguuuaccccacaaccaucucacccuuccccguccacgcugugcauuguaaugucuucaccauucugucaccuguagaccaccuccuucugcuucccuacaggaaggcuuugcauggcugcacauuucucauccuccagcccagcaguccccguaaagaguuuccauuucucugcacuguugcaaauucucugucuugggugaacuugagaugggugaaguaaaugaugcaaaugcauacaugagacgguugcaaaccuauuguauuucgaaaauagaaaagaauuaaaagaaaagaaucaguuuugaacuucuu

SEQ ID NO: 2092 - RNA, 3896 nt, Mus musculus
ggggcguggcgccagcggcccggcgugcccgggcgcugugguucuaccguggggugacuacagugcagauggcggaaauggaccugguggcugaguugccgcguccugcgggugcugcgcgcugggccgagguuauggcucgcuuugcggccaggcugggcgagcagggccggcggguggugcugaucacaucuggaggcaccaaggucccccuggaagcgcgagccgugcgcuuucuggacaacuucaguagcgggcgacgcggagccgcgucggcggaggucuuccuggcugccggcuauggaguccuguucuuguaccgagcgcgcucggccuuccccuaugcccaccgcuucccgccccaggccuggcugucagcccuucggccuucuggcccagcccagucgggcaagcugagucuggaggccgaagagaaugcgcucccgggcuuugcugcagcauugcagagcuaccaagaggcagccgcugccggcaccuuucuggcuguagaguuuaccacuuuggcggauuaucugcaucugcugcaggcugcugcccuggcucucaguccauuaggugaauguuccaaggaaauccaaagguuuuccuggcuguagagccguucucccuagccucuuuucccuauugcuugcugccuaccccacagccaaggaacccgaguuaaagaaaagauuccaugcccuuccccgauuucuuauacuccguuuaucuucacaggcucuucugcgauguuuuaccuggccgcggcagugucagauuucuauauuccugucuccgaaaugccugaacacaagauccacucaucugguggcccacugcaggugaugggcucuucucuuccagagaucugacccccucuaaccaaucuuggguuacuuuccucuugaucuggauggccuuucagccuucuguaugagcuaggcacugggaauacagagaugaauaagacacugcccucaaggaucucacagucuagcgagggccuggacaccagccauaaucacagaucagaaugauaaaugcuguaguggagguauguacaaagugcagucagauccccgggguagugagacgggggugucagggugauggagaugacucaucaaaagauggacagagggccugaucaaguggggaagguuauucuaaguggaguuacaaguuggaguuugcaacuggguaauguucugugaaccaaagugcuuugguaaggcugaagaggcaucuugccucuugguauacacaaccuuuguauuccuuaagacccuugaacuuuauccuguggagccuggagacacaaagguggaaggaaagacaagacguuguuuggaugcagcagcaucuucccuuucauugcagcccuccagggacagaugggcucuucauuucaaggcuagccuggucuaccuagugaauuacaggccagccagagcugcacagugagagaguaaauaaaucucaaaguaaauaaauaaaaguaaaaaguuuuguuuguacagaauauccuaguauuuuggaacuaggaagcagagggauaaguggggguuauuguccuuucaggaagaagaaggggaggauagugucaccuuagugucaccgcugaaaauugaaggugauuuggugucuuggaacaugagggaaaucauagacauuuguuggcugauauaaguaguguuuauugaugaaauugucugaggggcgccuuggggauaguuaaguuacacauuucagaguaccuacugugugccaaguguuauuguggaagagaaguacacuggcaguugcuggcauugcuuucagucugcaggggaaucccugaugcacacaggugguaaaugccaagaagagagaucaagugggagcuugugugggauuccuggcacacuugcaggcagaacucauacucuuuaaaaauccugggaucuccaguuuauccuuuuuuuuuucuuucuaccuuaaaaauauccagaaugaacuaggcagugguggcacacacauuuaaucccagcacuugggaggcagaggcaggcagauuucugaguucgaggucagccuggucuacggagugaguuccaggacagccagggcuaaacagagaaacccugucucaaaaaaaaaaaaccaaaaccaaaaacaaaaaaauccagaacaacuuaguauuccccuuugguuguauaagguuuaggaaacagggcagggacuuuaaucaagugaagaccaagucagucaugucucaguacucuguugugauuauuguauuaauacuuuuaguuaacaaaugaaaaaaaaaaaaccuccaaguacaaaucaaaucaguagccacgcccaccagcacgacauuuuagacuugagagauuuaaaacccaauauauuggaauccugccaaaguaacuuuuuuuuuuccccugagacaggguuucucuguagcccaggcuguccuggaacucacuuuguagaccaggcuggccucgaacucagaaauccgccugacucugccucccaaaugcugggauuaaaggugugcgccaucacgcccggcucaaaguaacauuuuuaugaacagauuauaguuaucuucagauuuucuuuaaaaaauaaaagagaugaguaugauuaaaauacaaucuauaaaauccucaaagacuuaaaaauauuuaaaugaguuaaaaggaaguuccaggcuugguggcagcucacaccucuaaccccagcccucuggagacuggcgggaagaucagcauuugaagccaaccuggcccauauaccaaccucuagguuagccggggcugcauagugaaacacugucuuugaaaauaguaaaauaaaggggaacguuugagaaauuguaaugaaaauggcaggccaggacugguucagaaaacauacuuugcagcaaaguagaugaugggcucugaauucaggcuucaauaugaaccuaaacgaaucuacagaacccagucuuuggcauuuggugugcugcaagaaguuuccaaacuguaagaaagcccaccuaaccuuagucaaaagucgguccuugguugcuuggaucccugguagggacugaccaguguuaacuaacugaacuuggcuugcuuuuucggauacagauaacaaugaagauggugccaaagaugcuuuccccucuggucaaagacugggcuccuaaagcguuuguaguuuccuuuaagcuggagacagacccggacaucauaaucagucgggcucggaaugcuuuggaaguuuaccagcaucagguggugguggccaacauccuggagucaauaaaguccuuugugauuauuguaaccaaagacucggagacagaguuacugcuguccgaggaggagguggcaaaaggcuuggugauagaagagaagauaguagaugaccuucggucucgacacacagcuuuuauaugugacaaaaacugaaggaaaugcuccucuaggaucaaacaccagagcucuuaccacugauaggaacuaagauugauccucuguuaaggaucaacacagugaagagauaguaaacgcggugugcaggcaagugccugcugggacuucaguucugagagugaaacacuggacgcucuccuggaucuggaaagugaacaagaguucacaaagaggacugugggauugcguggccugcagagcagaugagccaggagccgcugcguguuggccuacuguaaggucauggugcgugaauggucaugcucugaagaaguguuuaucaagugccuaccaugugccagggccuuugugagcugugagggucugaaagaugaaugagcacgucucauuugggaacuggauguacaaaaauuuaugugcaauaaaguaugugcccacaaagggacacuuggaaagggc

SEQ ID NO: 2093 - RNA, 9224 nt, Mus musculus
cuuuuuuuuuuuucugguaaaucaguauuuauuugccacgcuacaauauaaguauacaaaucuaacacacacuuagcaaaauauccaaaggaagcacggaucgacugugcauuuagcacuugaaucuuaggucccagagaaacacaguucauaauccagauaagcauuucaaacucuucuucucaucgaugugccuguuacauguucacacagagagggugagugccacaggcaguguagacagggagauggaacgguucuuuggugucucgagaugugacucugcuuaggauggucucauggccuuggcucaggacuugucugaugggauggcaggaucuguuaucuucucuccucccuccaucaaaggacucugagauuccuugccagacagcuccugaggggcagccaugggggcugggacaagccagcccucagcagggaaggcaaagccuccugguuggccaugcuguagaaggcuguauaccauggcagucagagacucugagagcugucugagcugagagagcugcucaggggugagcagggagccaagcuucugggccugcaucuggacugugucucuauaaaucuccucagacuucccccgcagaaagcucaccaggcucuuccgaauggguggugggucuguauccugagguucugggcaaugggcuaauccauccuggugaccauuggcuuuuggcucagucuucuuuacugaagucuugugucucuuuuucccaugcaagcugcccucauuuccuauucugaccaggcuggaguccuuggaagagcgucuucuuuuccuggguguuuccaccaucugagcugauucuucagugugcuuucuggaauugcugucugauuggcuggaccucugcucauuuuuacuugguucugauccuaauguccugacagagguggucugugguccaguggggagguccagcaguugacaggaagggccuggaugggguguuucugaauccaugcucagguugaacugaaaggcuuucucuucuuccagcuuguugucuggcuaauccaacagugguugcuugugaacaaaauauccaagaguccaguaguuguuuauuucacaaggcuggaugucuaagguggucuucacuauaugcuggaaucccaaucaagucugaugcaaggccagugggggaagauacuggcuagcaaggggagaacaagccggcaaagacagaggcuuccaucuuucauguucuuuauaaggccucuagcagaaggcauggccuggauuauaggugggucuucccaaagaucuggauuaaagguguguguucccaguuuagagauucaaaauagaagcaggccuuccaacucugggccuuuaauuccuggaaccacucucccaugugucuugcuucaagcucccauucauuuuucaaggcuaaacucaaauguuccuguauaagcaaacuguguuaagacccucagccucagucagauuaaauuccuuccucuaggggugaaacaaggaacuaggaacaguuaguacucacagugugguuucuguuaauucaccaugcaccuauccagcggcuacuauuauuauuucaauuugcagaugagaaaauugagcuaagagaaauuaagaaaucgcccaacuaauguuacugaucuccagguugauuuuaccuguagauggggagcccauguuuuuggucaugguuaugccauacugcccccuagcuacugcuuuuaucuuuguaguaccuugacucuuuaaggaaacaguaauaaacagguugaaucucuucuugcuuugggggacucauccacagauuaggccaggcuuauucagccauacucucaaugguugcaugaagaauauccuguggaaguauuuuuuucccucaacccuaucucaauacuagggauugaacuaaaggccucacacauucuaggguauggguuagccuaccacagaagucuuuaagucacugcuccuuccucuuugaagauaccuaggaaauguuaagccuugugacucucuguccugauguaucugaguuuaggguuaaccuccaugucuucuuuguccagucccauuaucaacucuacuaagccaauuaccaagcucucuggaacacccccccucccccccccguuuucuacagcucuuaaugcccugggaggauguaugugugugccuuuaaugaacucuuccccacuccaggccuccagagccccugucccacucuccauuuguguggcuuuuaaauaaauaaaaaauacaacauaaaaaaaugaacaacagccgggcaugguggcgcacgccuuuaaucccagcacuugggaggcagaggcagguggauuucugaguucgaggccagccuggucuauagagugaguuccaggacagccagggcuauacagagaaacccugucuagaaaaaaacaaacaaagagcaacaauccccuagcccaaguuggcaacaaacaguagcacaucaagagcauuugcagugaguuaggagauccaaguuacaggucuagaucauuauacaacauuaguuugacaaaaauauggagacugccuaucgggugccagguacaaugaugguaccauguuuagagacagggggcaucgucugucucaaaaacagggacugaauucuaaaguucagcguuacuucccuagguccuggagcacaacaaggcuuaaagaggcccgcuaucugggcuggugagauggcucaguggguaagagcacccgacugcucuuccgaagguccagaguucaaaucccagcaaccacaugguggcucacaaccauccauaacgagaucugacucccucuucuggagugucugaagacagcuauaguguacuuacaaauaaucaauaaauaaaucuuuaaaaaaaaaaaaaaaaaaaggcccgcuaucgcccguagaucaaaaucaaauuuaauuuugcuauguccuauuucuuuuuucuguaauauuccccggacaaucucuuuaccuggaaaggaugccagcacuuuaagacguuccagaaaaggguucagaaacagucuguauaagcucuguuacguugcugccgugacucucagcucucucucagugguccaaugggugguuguccucauuuguugggucuuucccaggucugcuguggcuuugcugcacauguuuuccauucugggucugcugcagauggaacagccuuuacccugagcagcaauggucaucaggacagcuaggaauggacagcauaauuuggcacacugacuggaggcuugucucauacagauauuccuaaucuauuaggugauacaggucacaaggucaauucugcucucagugggaagaucuaacccaaccuugagagguacccuaagcauuugggaaugguaauauagucaauuauacugucucugugguacucacccgcuaagacgucuucuugcaguggcuagccccaggagguugcaauuuucauaucaguagaaacaaugccugugggguuggagagucuuuugaaaaugggcagaacagccgaccauaguggcgcacgccuuuaaguucaaggccagccuggucuacagagugaguuccaggacagccagggcuacacagagaaacccugucucaaaaaacaaaaaacaaaacaaaacaaccccccccccaaaaaaaaaagaaaaugggcagaacaaaugcuaagcaucaagugguucuggguucaaauccugacucugcuggcucuucuucaaaauugagagggacaccuccuaguuuugugguaaagauuaaauaaagucucacaaagggucgauuaugcgguccaugaagaauauucaauagguuaucaguacgccuuuaucacucuccuccagcacaggagcuucccaaagggucccacuuaguucauucaacacaaaaucagccaacgauguuauaccucagagcuaauaauuuaacuuccaaauuugcacccagaggaucaaguuauacuaccugguugccauuucucugcuaugcagguuccauucauuuuaacacucccuaaaaucugagucauugauggagaggagaucccccuugaacagccacugacugacucuuccgagggccaacauuucaucuacgcgauugcuuaccucuaauguaaauacuucauucaggcggcucauuggcuuauguuugcucagcugucuuggugccuuugugucucucauuauguuuuuaauuagcucaguugauucugagaguggaggugagccaagguuugaagcaaguuacaaggaacagagaaggauuugugugugcguguguguauaugugugugugugucugugcacauuugcuaucagauuagcaaauaaauuauuuuggcuauuacugguggugguggacuugaguccaagauggcccuuucuacagaaacugcuuggcuccuauaggaugugaaaacuaacuuuuguuuuaccaauagucagaaacuaaagccaagcuaucagagggaagaauucaguuuaaggagaguuuacauagagcaauguggucuagcuccaggcgauaguuauugccauuagccaugaguauuuaaugaccuuuuauaagacuccuauuucuguagcuugccucuucuucuaucuacccaaccuuucccacuuuuguacaagguguucucaccccacuugaguuuuucuuuauucccaagcuugccacugucucuagauagcacacuucugcucauuuauugccugaaccccacccuuaccuuucgagggggaaguuuccuuugucucuccaggccuacagcuuccugcacccaauugaacaguuugccucaucccuguuuccauggcacacauacuagucucugcugacuugcauugaacgaacuguuuaucuauucaggcuuaacuccuugauauuuaacgcaaugccuggagugaguaggcacuugauaaaugacugcugaccgcucuuuaaguaugcagagugacuaauacucaaguguugucauuaagcagcuguaagcaguauuaagagcuucccaguggccacuguguaacuuuuuacauuuuacaucuaauacaaggaauuauguguuagauaaagauaaccaggaaauuuggaaggcucuucaagagcuggaaaugagaaggccuugcaucacguuucucccuucucccucuugcaaaucuuggcucauuuuaaaccuauuucccauuuccccgagccuuuuguaacaaacagagaaaaggaucagaaggaaucuuucugucuaaguggcuguggagucccacuugucaaacacccugucaaucugugcucaaugcuugguuuguaggguucucacagcuaggcaauggacuguguccuuuucagggaauuuacaauccacaugaagcuggagaaagacuaaaaacaauaaacagcaacaccuucaucucucugaaucacaaucugucucaauaaucugucccuaggcuuaccaccuuuucucugagagcuggccugcuccacccuuccuucccaaccuaucuguaucucccaagacagcaaaccacucuuuccuaugggaacucuccaccacauauauagugaacagcugucugugggggcuuuggcucgaugacgccugugcacaaacucuuuggcuaggucucugugauuaaaaucuccagcucauagauacaguaacagagauggagagaaacuaaauuugauauaggcaacacaugaaguuaagggauaauagauuuguacuuaggucuguccuuccaaccuugguuuuaaacuuuucuuccuugcaaggucccagaaccuuucuuguugcuauggccauugcaaucgugugugugugugcucaugcgcgugcaugccuguguguacuuuuccaccuguuaauuuuuuuaaauuaauuuuauugucuauguuuaagguauacaguaaaauguuaugggaugaaaacccauggugaacagguuacuauagcaaagcaaauugacacaucugucuucuuaccauuauuaauuuuuuuuuguuucuuuagccagaccagcuuaccuucuauccauagcaggaaucccauauaaaguacaauuuuauugguucuccaccuuuugaaucucuguggccucugguucuguuccucaaagucagagguuuaccaccugacccuagcagguauguaaaucuguuuuuucucuaauucuaugcacccuguaagccagaaugaauaucucuggacgguaucucagaauucuaaacaguaagaaguccaguccacgacugauuuauuuauuuauuuauuuauuuauuuagagacaggguuucucuguguagccuggaacucacuuuguagaccaggcuggccucaaacucagaaaucugccugccccugccucccaagugcugggauuaaaggcgugcgccaccacugccuguccuguccaugacuuguaagaggaaguuguauucgucaggguucucuagaaucacagaacuuaugcaauucgucaggguucucuagaaucacagaacuuaugcaacuuaacauauagagauauguuaagugaauuuauugugaugacugugugucuguaaucuaauaacuaaccugacaaugggcagcugugcuaugucuccagcagaagguguggccuagauuaacaguguggaucugggacuugcucuuucccaggcugacuuugaacucagagaucuuccuugccucagucucccgggauuaaaggcauguacuaccuugccuggguguaaacuuuucauggccacuauggcucaagaucuccacgccaagaucuaggucugaaacuucucuuccagccucaagaucugcaucacaggugugcccuccaauucugauuguaguucauuccagauaaaguugacaaccaggaauagccauuacagagguagccaaagugguuuagagccaagucccugcuugucuuuguacuuuaucuucuggcugacucuacuuaagugucucagagagauuccugacuauggucuuuuaugauccugaucuccaggucaaauccuggugacuccuggcuucaauuuaccccucccacaaacggaaacagcuguaucagucucucucucucuguuuuuugagacaggguuucucuguguagcccuggcuguccuguagcucacucuguagaccagacuggccuugaacucagaaauccgucugccccugccccccaagugcugggauuaaaggcgucugccaccacugcuuggcuuuguacccgucucuuuaagagcagcacccaggcugcuuuuuaguauucugucucaagccuagguggaggaaggugaacuuugagaucugagaggcugggaaggcuaguguuaauuauguucaacugaggagccacuugauugaccagccaaccagguaauucuaauucucucuaugaaucugcgguagucuacccuuccccaggaagacuggcaaggggggugguggggguauccucuuugggacuauguucuccuugucaugauguuauguaaucaguuuacuuaugucucacuagacuaugaguucuuuguuuuugagacagaguccauguggcccaggguggccucaaacuuaucauucucuugccacaguuuucuuagagcugaaguuaugagcaugcaucuagaugaauuauuuuucuaacuauuuauugugguguguguguguacacguguauagcgcacuuaccacagcauguguguggaauugguucuuuucuacuuuacauggauuccagggauuagguucugguuccaggcuuguggaguaaucuccuuuaccuguugggccaucuugcuagccccuagacugagugcuuaaaaauauaaaagcccgugucuuauuuuccugugugguucuguccuaauuuaggucaucaccuugucccuggguagugcccccucugacuuccuacccuguacucuaagcagagcauucacuguuuaaagcucuggagagacugucaauagcccacaagauaccccucuguccuuaucuuuuaccucucccgacccucgcuacuucuaacacucacagggauguucuaaccacaauuacaucaaaucccuucacuucuuucaaaccucugauucaaguugccuuauuauuguggcucacccaggcagcucuuuuuaaaaggauuuuccuucuaguguuccacacagcucuguccugagugcuccuccccaaucccccaagguaucauucaauguuuucuaacauuauuacauaauucauaauuuuuaucaccuuucugcccaugagggaaugauacuugccccuccaccggccuuuucuguucacugauuaaucugaagcacuacaguagugccugguacaaugacuuuuuaugucuuuguuggacaaaugaguggauaaaccuuuagaauucccauugccaggagaugcuugacagaugaaaguguucaaugcuccaugaaggaauggaaggaugguuucacacugucuuagcucagcaagguugccagggucaauucucucagaccuuugcuuucucaaucaaccaaacucacugacauccaucuaaccaucuaauguccaaauacugagcaacugcucuucacuugcuguucuugaggcugcagggaagaguacgugacuuaacgcggcuucugcgcagcaaauaccuaccaaguguaacaggauagcacagauugucaacgcuaacaguucagagguaggaccagggaagaccaaagggaaaguccaaaguuuaccagaagucugaacaacccuacuaaaggcuccaccuguugauagugaggccacgaccuggccagcuaacuugagauggagaggaugacgcggcagggguaaugacaagaugacaugccuggguagggaggggccucgaacccggguucuugacauuccgaaggacgcguguccccaagcaagguccaaagcgccccgguggcggccgggaaaauccgcgcugggugcuugacggggccgcgcagaggcagaggcuggaaggcggggaggucacgaggcgcauuccucaggaguuggaaucccgggaguggggccggggccgccucggccagccgcugucaaguccgaggcgcaaacacugcaaggcgcuccgcaccgcccaccgccgguucccgcuggccgcaagcaggcagagccgcgggagcucagaggcacua

SEQ ID NO: 2094 - RNA, 9224 nt, Mus musculus
uagugccucugagcucccgcggcucugccugcuugcggccagcgggaaccggcggugggcggugcggagcgccuugcaguguuugcgccucggacuugacagcggcuggccgaggcggccccggccccacucccgggauuccaacuccugaggaaugcgccucgugaccuccccgccuuccagccucugccucugcgcggccccgucaagcacccagcgcggauuuucccggccgccaccggggcgcuuuggaccuugcuuggggacacgcguccuucggaaugucaagaacccggguucgaggccccucccuacccaggcaugucaucuugucauuaccccugccgcgucauccucuccaucucaaguuagcuggccaggucguggccucacuaucaacagguggagccuuuaguaggguuguucagacuucugguaaacuuuggacuuucccuuuggucuucccugguccuaccucugaacuguuagcguugacaaucugugcuauccuguuacacuugguagguauuugcugcgcagaagccgcguuaagucacguacucuucccugcagccucaagaacagcaagugaagagcaguugcucaguauuuggacauuagaugguuagauggaugucagugaguuugguugauugagaaagcaaaggucugagagaauugacccuggcaaccuugcugagcuaagacagugugaaaccauccuuccauuccuucauggagcauugaacacuuucaucugucaagcaucuccuggcaaugggaauucuaaagguuuauccacucauuuguccaacaaagacauaaaaagucauuguaccaggcacuacuguagugcuucagauuaaucagugaacagaaaaggccgguggaggggcaaguaucauucccucaugggcagaaaggugauaaaaauuaugaauuauguaauaauguuagaaaacauugaaugauaccuugggggauuggggaggagcacucaggacagagcuguguggaacacuagaaggaaaauccuuuuaaaaagagcugccugggugagccacaauaauaaggcaacuugaaucagagguuugaaagaagugaagggauuugauguaauugugguuagaacaucccugugaguguuagaaguagcgagggucgggagagguaaaagauaaggacagagggguaucuugugggcuauugacagucucuccagagcuuuaaacagugaaugcucugcuuagaguacaggguaggaagucagagggggcacuacccagggacaaggugaugaccuaaauuaggacagaaccacacaggaaaauaagacacgggcuuuuauauuuuuaagcacucagucuaggggcuagcaagauggcccaacagguaaaggagauuacuccacaagccuggaaccagaaccuaaucccuggaauccauguaaaguagaaaagaaccaauuccacacacaugcugugguaagugcgcuauacacguguacacacacacaccacaauaaauaguuagaaaaauaauucaucuagaugcaugcucauaacuucagcucuaagaaaacuguggcaagagaaugauaaguuugaggccacccugggccacauggacucugucucaaaaacaaagaacucauagucuagugagacauaaguaaacugauuacauaacaucaugacaaggagaacauagucccaaagaggauacccccaccaccccccuugccagucuuccuggggaaggguagacuaccgcagauucauagagagaauuagaauuaccugguuggcuggucaaucaaguggcuccucaguugaacauaauuaacacuagccuucccagccucucagaucucaaaguucaccuuccuccaccuaggcuugagacagaauacuaaaaagcagccugggugcugcucuuaaagagacggguacaaagccaagcagugguggcagacgccuuuaaucccagcacuuggggggcaggggcagacggauuucugaguucaaggccagucuggucuacagagugagcuacaggacagccagggcuacacagagaaacccugucucaaaaaacagagagagagagacugauacagcuguuuccguuugugggagggguaaauugaagccaggagucaccaggauuugaccuggagaucaggaucauaaaagaccauagucaggaaucucucugagacacuuaaguagagucagccagaagauaaaguacaaagacaagcagggacuuggcucuaaaccacuuuggcuaccucuguaauggcuauuccugguugucaacuuuaucuggaaugaacuacaaucagaauuggagggcacaccugugaugcagaucuugaggcuggaagagaaguuucagaccuagaucuuggcguggagaucuugagccauaguggccaugaaaaguuuacacccaggcaagguaguacaugccuuuaaucccgggagacugaggcaaggaagaucucugaguucaaagucagccugggaaagagcaagucccagauccacacuguuaaucuaggccacaccuucugcuggagacauagcacagcugcccauugucagguuaguuauuagauuacagacacacagucaucacaauaaauucacuuaacauaucucuauauguuaaguugcauaaguucugugauucuagagaacccugacgaauugcauaaguucugugauucuagagaacccugacgaauacaacuuccucuuacaagucauggacaggacaggcagugguggcgcacgccuuuaaucccagcacuugggaggcaggggcaggcagauuucugaguuugaggccagccuggucuacaaagugaguuccaggcuacacagagaaacccugucucuaaauaaauaaauaaauaaauaaauaaaucagucguggacuggacuucuuacuguuuagaauucugagauaccguccagagauauucauucuggcuuacagggugcauagaauuagagaaaaaacagauuuacauaccugcuagggucaggugguaaaccucugacuuugaggaacagaaccagaggccacagagauucaaaagguggagaaccaauaaaauuguacuuuauaugggauuccugcuauggauagaagguaagcuggucuggcuaaagaaacaaaaaaaaauuaauaaugguaagaagacagaugugucaauuugcuuugcuauaguaaccuguucaccauggguuuucaucccauaacauuuuacuguauaccuuaaacauagacaauaaaauuaauuuaaaaaaauuaacagguggaaaaguacacacaggcaugcacgcgcaugagcacacacacacacgauugcaauggccauagcaacaagaaagguucugggaccuugcaaggaagaaaaguuuaaaaccaagguuggaaggacagaccuaaguacaaaucuauuaucccuuaacuucauguguugccuauaucaaauuuaguuucucuccaucucuguuacuguaucuaugagcuggagauuuuaaucacagagaccuagccaaagaguuugugcacaggcgucaucgagccaaagcccccacagacagcuguucacuauauaugugguggagaguucccauaggaaagagugguuugcugucuugggagauacagauagguugggaaggaaggguggagcaggccagcucucagagaaaaggugguaagccuagggacagauuauugagacagauugugauucagagagaugaagguguugcuguuuauuguuuuuagucuuucuccagcuucauguggauuguaaauucccugaaaaggacacaguccauugccuagcugugagaacccuacaaaccaagcauugagcacagauugacaggguguuugacaagugggacuccacagccacuuagacagaaagauuccuucugauccuuuucucuguuuguuacaaaaggcucggggaaaugggaaauagguuuaaaaugagccaagauuugcaagagggagaagggagaaacgugaugcaaggccuucucauuuccagcucuugaagagccuuccaaauuuccugguuaucuuuaucuaacacauaauuccuuguauuagauguaaaauguaaaaaguuacacaguggccacugggaagcucuuaauacugcuuacagcugcuuaaugacaacacuugaguauuagucacucugcauacuuaaagagcggucagcagucauuuaucaagugccuacucacuccaggcauugcguuaaauaucaaggaguuaagccugaauagauaaacaguucguucaaugcaagucagcagagacuaguaugugugccauggaaacagggaugaggcaaacuguucaauugggugcaggaagcuguaggccuggagagacaaaggaaacuucccccucgaaagguaagggugggguucaggcaauaaaugagcagaagugugcuaucuagagacaguggcaagcuugggaauaaagaaaaacucaaguggggugagaacaccuuguacaaaagugggaaagguuggguagauagaagaagaggcaagcuacagaaauaggagucuuauaaaaggucauuaaauacucauggcuaauggcaauaacuaucgccuggagcuagaccacauugcucuauguaaacucuccuuaaacugaauucuucccucugauagcuuggcuuuaguuucugacuauugguaaaacaaaaguuaguuuucacauccuauaggagccaagcaguuucuguagaaagggccaucuuggacucaaguccaccaccaccaguaauagccaaaauaauuuauuugcuaaucugauagcaaaugugcacagacacacacacacauauacacacacgcacacacaaauccuucucuguuccuuguaacuugcuucaaaccuuggcucaccuccacucucagaaucaacugagcuaauuaaaaacauaaugagagacacaaaggcaccaagacagcugagcaaacauaagccaaugagccgccugaaugaaguauuuacauuagagguaagcaaucgcguagaugaaauguuggcccucggaagagucagucaguggcuguucaagggggaucuccucuccaucaaugacucagauuuuagggaguguuaaaaugaauggaaccugcauagcagagaaauggcaaccagguaguauaacuugauccucugggugcaaauuuggaaguuaaauuauuagcucugagguauaacaucguuggcugauuuuguguugaaugaacuaagugggacccuuugggaagcuccugugcuggaggagagugauaaaggcguacugauaaccuauugaauauucuucauggaccgcauaaucgacccuuugugagacuuuauuuaaucuuuaccacaaaacuaggaggugucccucucaauuuugaagaagagccagcagagucaggauuugaacccagaaccacuugaugcuuagcauuuguucugcccauuuucuuuuuuuuuugggggggggguuguuuuguuuuguuuuuuguuuuuugagacaggguuucucuguguagcccuggcuguccuggaacucacucuguagaccaggcuggccuugaacuuaaaggcgugcgccacuauggucggcuguucugcccauuuucaaaagacucuccaaccccacaggcauuguuucuacugauaugaaaauugcaaccuccuggggcuagccacugcaagaagacgucuuagcgggugaguaccacagagacaguauaauugacuauauuaccauucccaaaugcuuaggguaccucucaagguuggguuagaucuucccacugagagcagaauugaccuugugaccuguaucaccuaauagauuaggaauaucuguaugagacaagccuccagucagugugccaaauuaugcuguccauuccuagcuguccugaugaccauugcugcucaggguaaaggcuguuccaucugcagcagacccagaauggaaaacaugugcagcaaagccacagcagaccugggaaagacccaacaaaugaggacaaccacccauuggaccacugagagagagcugagagucacggcagcaacguaacagagcuuauacagacuguuucugaacccuuuucuggaacgucuuaaagugcuggcauccuuuccagguaaagagauuguccggggaauauuacagaaaaaagaaauaggacauagcaaaauuaaauuugauuuugaucuacgggcgauagcgggccuuuuuuuuuuuuuuuuuuuaaagauuuauuuauugauuauuuguaaguacacuauagcugucuucagacacuccagaagagggagucagaucucguuauggaugguugugagccaccaugugguugcugggauuugaacucuggaccuucggaagagcagucgggugcucuuacccacugagccaucucaccagcccagauagcgggccucuuuaagccuuguugugcuccaggaccuagggaaguaacgcugaacuuuagaauucagucccuguuuuugagacagacgaugcccccugucucuaaacaugguaccaucauuguaccuggcacccgauaggcagucuccauauuuuugucaaacuaauguuguauaaugaucuagaccuguaacuuggaucuccuaacucacugcaaaugcucuugaugugcuacuguuuguugccaacuugggcuaggggauuguugcucuuuguuuguuuuuuucuagacaggguuucucuguauagcccuggcuguccuggaacucacucuauagaccaggcuggccucgaacucagaaauccaccugccucugccucccaagugcugggauuaaaggcgugcgccaccaugcccggcuguuguucauuuuuuuauguuguauuuuuuauuuauuuaaaagccacacaaauggagagugggacaggggcucuggaggccuggaguggggaagaguucauuaaaggcacacacauacauccucccagggcauuaagagcuguagaaaacgggggggggaggggggguguuccagagagcuugguaauuggcuuaguagaguugauaaugggacuggacaaagaagacauggagguuaacccuaaacucagauacaucaggacagagagucacaaggcuuaacauuuccuagguaucuucaaagaggaaggagcagugacuuaaagacuucugugguaggcuaacccauacccuagaaugugugaggccuuuaguucaaucccuaguauugagauaggguugagggaaaaaaauacuuccacaggauauucuucaugcaaccauugagaguauggcugaauaagccuggccuaaucuguggaugagucccccaaagcaagaagagauucaaccuguuuauuacuguuuccuuaaagagucaagguacuacaaagauaaaagcaguagcuagggggcaguauggcauaaccaugaccaaaaacaugggcuccccaucuacagguaaaaucaaccuggagaucaguaacauuaguugggcgauuucuuaauuucucuuagcucaauuuucucaucugcaaauugaaauaauaauaguagccgcuggauaggugcauggugaauuaacagaaaccacacugugaguacuaacuguuccuaguuccuuguuucaccccuagaggaaggaauuuaaucugacugaggcugagggucuuaacacaguuugcuuauacaggaacauuugaguuuagccuugaaaaaugaaugggagcuugaagcaagacacaugggagagugguuccaggaauuaaaggcccagaguuggaaggccugcuucuauuuugaaucucuaaacugggaacacacaccuuuaauccagaucuuugggaagacccaccuauaauccaggccaugccuucugcuagaggccuuauaaagaacaugaaagauggaagccucugucuuugccggcuuguucuccccuugcuagccaguaucuucccccacuggccuugcaucagacuugauugggauuccagcauauagugaagaccaccuuagacauccagccuugugaaauaaacaacuacuggacucuuggauauuuuguucacaagcaaccacuguuggauuagccagacaacaagcuggaagaagagaaagccuuucaguucaaccugagcauggauucagaaacaccccauccaggcccuuccugucaacugcuggaccuccccacuggaccacagaccaccucugucaggacauuaggaucagaaccaaguaaaaaugagcagagguccagccaaucagacagcaauuccagaaagcacacugaagaaucagcucagaugguggaaacacccaggaaaagaagacgcucuuccaaggacuccagccuggucagaauaggaaaugagggcagcuugcaugggaaaaagagacacaagacuucaguaaagaagacugagccaaaagccaauggucaccaggauggauuagcccauugcccagaaccucaggauacagacccaccacccauucggaagagccuggugagcuuucugcgggggaagucugaggagauuuauagagacacaguccagaugcaggcccagaagcuuggcucccugcucaccccugagcagcucucucagcucagacagcucucagagucucugacugccaugguauacagccuucuacagcauggccaaccaggaggcuuugccuucccugcugagggcuggcuugucccagcccccauggcugccccucaggagcugucuggcaaggaaucucagaguccuuugauggagggaggagagaagauaacagauccugccaucccaucagacaaguccugagccaaggccaugagaccauccuaagcagagucacaucucgagacaccaaagaaccguuccaucucccugucuacacugccuguggcacucacccucucugugugaacauguaacaggcacaucgaugagaagaagaguuugaaaugcuuaucuggauuaugaacuguguuucucugggaccuaagauucaagugcuaaaugcacagucgauccgugcuuccuuuggauauuuugcuaaguguguguuagauuuguauacuuauauuguagcguggcaaauaaauacugauuuaccagaaaaaaaaaaaag

SEQ ID NO: 2095 - RNA, 3208 nt, Mus musculus
ccucugauucauacugagagaugugcuggggcuucuugggcugcacagaaggaacccauaggacaacuucucgagacagggguccagaggaaagagagauucuagagugacagcaaaauucugaagacuuaaaguggcagaaacccaaaacccccuagauuaacccagauguggcaaggguaaagggcagaaaccagaucuccggagugugggugcuaggcucgcaggcgcuccuggcugcacagccacagcucagcccaguccccaucccagcuccuaccugguagguaccugucgugguugugauuauacucuguggcagugagugauaagugagucuguguaaagggcugguugccaaacagauugucacuucgaagguuguggcagagcuucuccaggaaacggaggacauaggugaugcuguugacugcugggagguucagagugugcuguucccggucaaacacggcuguggagucaaguacacaaagaaguaaguuguacaacgaugggucgugccggcuggagaagcucagcucaugugugucuuaggcuuggcagguuacaaaaggcagugccaggcugcuugcccacuuguuuucuuccugcucuuuuccuugcucaagggcuuugauuuuugccucuaacuccaaagggcguguaaucaugggagugccaggccaggucuguugcacccucagggcucugguguggucugacucaaccugugcaaacaacuaugaacauaaugcuaucugcuucaucaccuggcugggccucuuucaggaagugcgcucaccuagggugcuguguucacaagaaaucugcccaacaacagggaggcuaugccgaaauaauacugcuguuguuagcagcggccuagacauacaauuuccaaucuacaucaggauacuggauuuggacaacauugggaaauguuucacacuuguuauuuuuacauacuaauuucuaucaaaauauugucauaauuuuuaaaaagcaaaaggcucauguaagugucuuugagggaagugaggaaauggaaaucuggggagauaaaucacucaagaaaguuuuaaagaggaagaacucuaggcaguagaggugaagagcaacugcaggcaguuaggacaccucagacccugcagacggcugcaaaggaggccagagaguggucugggccucaagaccugguuugaauguaucugcaguacccauccuccaugcauccagugacugucuggacuugccucuguaacauuucuguugucacccuucuauagaguauguagauuuucuuuuccaccauugcagacaugagucuguuuucccuuuuccuggcuaguguuuggcagaaaccucugccacacaguaaaggcucaacagguauuugcuaaaaggacuauuuggcuguuuaugcuuccugucagcugguuccuuaauaccauagcagcuugcuaaggggaaaggggggggggacuauaaggaaacauuagaguaaagacuggaaggcacaagguaggucaagccauuguagccuugguggguaaaaauaagauuuuggacuuaagaaaaccgaaaagaaauagaacacagcaggaaaauauugucaguuacugcagaaaaaguaccauacuguuaaaucaagcucgcauuuucccucuauccuggaauucagcucucuuggauggguccuauaggcccagaagcuuaggaggcagagaaaugaaaggaggucaaagcuccucuggagccaguugaggaaauucuuuugcugcaacaacauaggcccuauguuauuuccuaugaaauggcuuuaagcaacacuuauauuuucuguguguggaccaaaguuuagagguuguguuagguauuuuuggcagagguauuugguacauacuauaugguauucagguuauauaaguccagcagagccugggaacuggcaguauggacucuggaggaaugagauacguuugcauucuccagagccuaugaguaugaagucaguacuaggaucucucaucagaaugaaggucugacacucggguuaggaggccaaacuagcccaaaaguuuaccugaaaugacuucaccgccguggcccuguuugaggaagcugaagacaguuuucuggugauaagcacagucaaugcaagccuggacagccugcugcagcaccacagaggcacgggcuggcccaaaauggucagggaguuguuggaucuucuucuuauccaggugggggcccgugcugccgcucuuguucaaguagauacaaacuacaggaaacaaagaacccaggaaccuuagagugugccugguagagagaagucagagagcagcucucuuccaucugcucaacucuggccuuggcuccacuuggcuccaagcugcaccaccaagaacucagaacaaacaaagcccauuaggagaacaacacagaacagaaaucaaggcacaggucuuguguuuuguuuucugguccccuauaagaaaguguaaacuuugaagacucucaagaaucaaacugccuuaucuccuaaccuaaagauagcuaauuggcaggaaaaaaguucccaugaagguggaucuaagggucaaucuaugaaaagaaggaucagacuaggucugucugcuaagaaauggggacagggacuaugacgauguucaguagaucaagugcuuacuguaaagcgugaggacuggaguuaguaccacaagaauccauguaaaggcaugguggaccaccucuaauccaaacccuuggaaggcagagucagaaguucccuggagcuugcuagcuaccuagacuauccuacauuggugagcuuuggguuuaacugagagaccuugccucauugaauaagguagaaagagauugaggaaaacuauuggcacacacauauaaguacacaccacacacacacaaggaaauaaaacacaaacagugcauguuguugaacaucuguaaucccagcacuuaggaugcugaggcagaauucuggguuccaggcaagcuugggguaauauuaaguagacucaaaaccuccccaaauuuaagagaacaaacaagaacaaauaacaaaaggcaaaauguaaaaagaaaagaaaaaggaaaagaaaaaaaaaggauuuucauguuuggcagugugaccuuuguucuaaagucacuaaaaauagaggaacucagagauaagacacuu

SEQ ID NO: 2096 - RNA, 3829 nt, Mus musculus
cgccgccgggaauucugggacaggggugaagagcuaaggggcugccccuuucaggcacgccccucauucggguuuuuguucugugcauuuugggcccgcgauugagucuuugcgcuugggcacaccagggggacuggggcugggggcugaguggaaagcacacgccugccugcguggaaggccuguaacgagucaggacgcagaggaugaaggcagcagcaggcagccggaagccaucagcaaggcagggccuccgaccucaggcugcggcugggaaccuggagagcagaacuuaccgccuggagaccuuacccuuggagaggccaguguuaggaggauuuaugacacgcagcugcccuagcagugugacucaaguggaaacaccauaaugugaaggaguggucaggugaagagaacagaaguccacauuccaucauagcaaggugccuccccaucuccccucguuuuaauacaugcucuucccugugaggagggaaaucaacuaaggcccaggugaguacgaguugccucucuccugaacuuuucagagcaaauagauacauaguagacccaucaaugccuuuggaaggaaagccacauuuauuguguguuaguuaauaucuguacuguuuuagcucugugggcauugaaggauuagcuuaccaguauacauuuuaaagaugugccagucucaucagagaauuuuugaaaugugcccaagauuauucaagaaacaaauagcagaaccgggcgugguggugcacgccuuuaaucccagcacucaggaggcagaggcaggcggauuucugaguucgaggccagccuggucuagagugaguuccaggacagccagggcuacacagagaaacccugucucgaaaaaccagaaaauaaagaaagaaagaaacaaacaaacaaauagcauaccagcaaauucuacuggacguuucaagauuagauucaaaaucuguaucuucaggaucccuagacucuugaugccgaucugguauuuucugaacaucuaucucauuuaauuuuucaccuaauaauuuucagcuuuaucuguuuuaaaacuuuuaaaacauauauucauauauaaaauauuuaauaugaauauuaguagauauuucuauaucuuuaagaagucaagggggcuggagagauggcucagagguuaagagcacugacugcucuuuuagagguccggaguucaaaucccagcaaccacaugguggcucacaaccaucuguaaugagaucugaugcccucuucuggugugucugaagacagcuacaguguacuuauauauaauaaauaaauaaauaaaucuuuaaaaauaaaaaaaaaaaauaaaaaaaaaaagaagucaaaagucugccaggcaguggugguauagccuuuaaucucagcagcuugagaauaaguucuaggacagccagagcuacacacacaaaaccugucucucucucucucucucucucucucucucucucucucucucucacacacacacacacacacacacacacacacacacacacacacacgucagaagucuaaaaagaaagucauaaaaugaggcuuuugauggaugauauagcagcuuuacaauuaaucuaugguauauccaaaaacgcuaguccaggcagcagguaaaguucauuaugucauccuuucugaacuucuguauuuagcagcauaaaagugucuaggcugugcauuugcgucuaaauuuuacaucagugugaacuguugucuucuuuuacaugaaugugaagcccuugucugucucaguguacuaauuuuuguauucucaguugugcuaauagaccuuuuucacccauaauauuuuaguggcagcacuugggaggcagaggcaggaggauuucugaguuugaggccagccugguuuagagugaguuccaggacagccagggcuacacagagaaacccugucuugaacuccucccaccccccaaaaaacucugcugggcuacagcagcacaccacuuaauuagugugugcaaugaccaguguucucccucuagaagugaaaaaaagaaucaacucggaugacugggugauaaacaacacaaagacuccuuuuauaagguguaccuguguguaacucauugacacuacuaauugguuauaaauaaauugacuucuuagggcuaagaaguagagagcacuugccuagcacacauaaggcccuggauucaguucucaguacugaaaugaaugaaugaaccaaccagucagccaauauaugauucuucuuuaucucaggaauuuacaagucugacaauauuuggcauguucuacaggucccuauuuguucaaucuagggcuguaccauggcugagacuggggaagaggagacagcaucagcagaagccucaggguuuucagacuugagugacucagaguuaguugaauuucuggaucuggaagaagccaaagaaucggcuguuucacuuagcaagccuggcccuucugcugaacucccugggaaggaugacaaaccaguaagcuugcagaacuggaaagggggauuggaugucuugucacccauggagagauuccaccugaaauauuuauaugucacugaccugugcacucagaacuggugugaguugcagaugguguacgggaaggagcuuccugguucguugacaccugagaaagcagcuguuuuggacacuggugcuagcauccaccuagcaaaagaacuagaacuucaugaccuugugacaguccccaucgccacaaaagaagaugcuugggcaguuaaguuucugaacauacuagcaaugauuccugcccuacagucggaagggcgcgucagagaguuuccaguguuuggggagguggagggaauauuucuuguuggagucauugaugaguugcacuacacauccaagggggaacuagagcuggcugaacucaagacacgaaggcgccccgugcucccccugccagcucagaaaaagaaagacuauuuucaaguuagccuauacaaauauaucuuugaugccaugguacaagggaaagugacuccugcuagccuaauccaccacacuaaauugugucuagacaagccacugggaccuucugugcugaggcaugccagacaaggaggcgugucuguaaaaucuuugggugaccuuauggaacugguuuucuugucucuuacacugucugaucucccagcuauugauacccuaaaacuugaguauauccaucaagagacugccacuauacugggcacagagauuguagccuuugaagagaaggaagugaaaagcaaggugcagcauuacguggccuacuggaugggccaccgagauccucaaggcguugauguggaggaggcauggaagugccggaccugugacuauguggacaucugcgaguggaggaggggcaguggagugcucagcucaucgugggagcccaaagccaagaaguuuaaaugaaugaagguacacuuucagaaauguugaucguuucuguucuuaauauacccauguaagaggaccagucucucagcuuggcucucguggacaguguuuuuuauguuuacaaucuugaauaacauuccaucccagggccaaagaucaagaauguggagagaugugguguuagagugaccuuggagcuuucagguaaacugcaaagaagacagauauacaucagugcagcaaagguaucccucacuaaucacuguuggcucaagaaaauucuuuggauucugauaaaucuuuacuuuuuucuugauaauuuuuuuacauuuuuuacaauaaaaaugaaaugcugucuaaaauag

SEQ ID NO: 2097 - RNA, 39009 nt, Mus musculus
cucauucuucaggcggaagugaggaagguggggcgucuuauucuagcagaaauaaguagguccuugaagaguaaggcuggagggaaucgugucuuugugacacuucuggcaaagcugagggaaugggcgucugaagaagcccucggaagggacccguauuguugugacaccgcuggcacucuccgagggacgcgugucgcugaggcaccggugcacgcuaaaggagcgggugagauagggugacgauggggaugugggcaucgguggacgcuaugugggacuucccugcggagaagcgaaucuucggggcgguguugcucuuuuccuggacgguguaucuuugggagaccuuccuagcacagcggcaggugagcauugacgugucucccccggcugagccccuggacagccuuaggccagcccgagccucuacccaagccccuuaguguuugcccggauguagcaaaccguaacccccggugagcuuccuaacuuuuccuaauggugacugccgcuuugaggaguuuuuggaaaggcagaaguuguuugcaacguuguaaugggacccaagccuguaagcggcuaaugaaagggaagaacugcccuaccgccaaacuugagcaugucuaugccugcuuuacagcgucuuaagaaucuuuggaccgggacuugaccaagccucguugguauaggcuuucuaaguggaggugcuaaauuuguagaauaauaacuucccaugauauugauguuaccaugcucaaccucacuuugcaaccguuccaaagacucgcacgccguuugaaaauccucauuagagcaaauguuguuuggggccacaauguguguguguuucauuaaaauuucucuuuggguuuuuuguuuaaaacguuaaauagugcaguagaaaagcuaacaguuuuccauggagauagccauaauuaacaguuuaauucgaaaugugaacguuuuagugagauggacuuugaaacaacaaaacaaguuaucugcaacauuauaaugggucccaagccuguuggugucuaauaaaaggaaaggacagcccugccgucaaacuuaugcaggucuaugccugcucugcagugucuaaguuuggacaacacucgucugugucguccuugagaaccuuccccuuuaacugcuggaccuauuucuugagcucugcaguccuuuucgucugcaguuuucuucuaacuuacacuguaugugaguuucuuugccaggcaagugcucucccacugaacuacauuucccagcccuucgugacucuccggauugcaaguuugaaauuuuuuuuuuuuuuuugguuuuuuuguuuuuuguuuuuugagacaggguuucucuguauagcccuggcuguccuggaacucacucuguagaccaggcuggccuugaacucagaaauccgccugccucugccuccagggugcugggauuaaaggcgugugccaccaagcccggcacaaguuugaauuuuaaaaaucugucagugucggguuaugucuaccucagucucuuccuuuaguauguucaacguguuaaaaauuacuguagcuagguacucaaagcuucauuaguucagaauugcauaaguacccuugcuugaagcaaacacauaacguguaguaucaaaacagcagggugagauauugaguacuuaucugacauaguuuauuaauagaucaaguugcaucuuuuuuuuuuuccaagacggaguuucucuuuguuuagcccuggcuguccugaagcucacucuguagaccaggcuggccuugaacucacagagauccaucucccucugccuccugaguucuaguauuaaagccaugcaccacgaccacuuggcauuguugcauuguuguaggguuauaauuuaaugccuucagcuuuuuguugcuguuguuguuaacauacaacaggaaaaguauuuauuauaaaacuauuauagaaggucuauuauaccuuugguaucuguuccuuguguuaugucccaggggcugaaauuacucuuuagaauuugacauaaugagaaaauuuguuguaaagauuugauguuucugucacucccuaauucuuaucuaaguugaccucuagaaccaaguuuaaugaugauucauuaauaaaguauuaaauguauguguuaauguguguugugagcauacuucucuuuuuucaugcauuauuuucuauauuguaagacauaccucauacucagaaagaauggucuccucgugaugucacaacuuugguucacacaggcaaacugaaaguguauugacaacccagauggccauuccaccuagucagcuggccuuguugcuggaauuguuuuugucugcuuaaaauuuccugugucaguuguuucaguggucaguguucuugacuaaaugcaaaacauacauguaugugacaaauucuacaagcuuacaugacaaauuaaugcuacagaccauucgguguuugaucacaaauuacuacuguguaauaagaaauauucauuaaaguguuuuuucuucaaaauauuucagagaaggauauacaaaacgacgacucgcguaccagcagaguuagaacagaucauggauucggacacguuugagaaaucucgauuguaucaacuggauaaaaguaccuucagcuucuggucaggacucuacucagagguggaaggcacugugagucauugauuucuuggagacacaagucucagauuguuuaaagcuugauaaugcuuggucuggccuucaggugccagccuuuagcaguccagugucaguggucucuagccauccuggcagagucuagguuggcucagggaggaagcaucaaugguguaugcgccagcauugcagauggaccugauuggcuaaguuccuucuacuuuuccacccuuuuguuuuuauuuuugauaaccuggugggagucagaguucuuugcucuggccuuguugaccccaccucagggaccuucauuguaccaaugcaagagugguauuccuagguagguaagcccaauguuuauaggcagggcuuaaucccugaucaucaaaggugaggaaguuuaggugaaaaugggccucugccagggccaggggaaggucauguuuggauucaggggagguaaacugagucagcaaguccuuuagagucugaguggaccuuucuacuauccucugaccuugaggguuauagggaauccuaaaagugguuaaucuuccaugaggcaucaaacucauugaauuguugagaggcauagggagggucauuaucugucuucaaaacccaaggcacucccauaaccaacauagcagauuccauagccuugauggugugggaagcuuuuucucccauugaggccacagcauauacagagaagcagcaaguaucuacaguaacauguacauaucuaagauuacaaaaagagggauagugaguccaguccaucugccaaauagcacugacuggggcauaacccucuuggcuugacaccuccccuauugaggggccccaauggugcaaguggggcgcagauggcacaaggucuugcaagauauuuuuauuguuucauggauaauuuggcaagagcuuguguaaguuuuguggggacaggugaaauuguuuguguaaugcucucaucuguuccaagagcccuggucaauaaccauuauaagucagucauaucccugcccuuagccaagauuccuggcagccgggagugggaucugaggugagaaaugaaccaugggugugcccuaugcucaagggcuccuugaagggauuuuaucaggauguguuuggaacuauccugauauucuauguaggaaucuuugccucucacccaacaagacaucauagaggcagucagggccgcucuagggccugcccugucaaggucucugauggcuacuacccauuuaugaaagucaucauggacuucggcaaaccaaauuucacguuagggcauuaagacccucccaauccaauuguuuaaacaagcaugucucagaugggucccaaaucgacccuucucucuacugccucaauaacccucguaagaaagucuguaaaggacucaccugauuguuguacaaaguuauagaaguaggcaaagagaccucugggagugcaagccuuaagggccuugaaagacagauuggccaccugguugaaguaggcauguuggcagauaguagcuugguuaacuggguuaauguaugcccuguggcuggucuagggugauguuaagcuuauauucaagauuuaagcaugccugacucucagccagauccugauaggcugauugccaguuuaagaacguggcaggcuccaggaccacuuuaagacaauuauacuagccauaauagguuuguaagugcauagcccacuguucaaaguagggagagucacgccccaauucauuggccacuuuucugacuaaaguuaggucagccagggguguagggacccaagggcgguuggcugcaucagggccaagguugacaggauaagccucuguucaggcccuaugggccaaguaaggcaacugugcaucagaagguugugggaguccaaccacaaaaggcuguaaguguugggagaggccuggggugguuacauccauggcacaaaguucacaucauggauuggggggugggguggggaggggcugcagucagcuccaggcauucagaugccuuugaaagaugagguaguuuugccagcaccagaacaagggcccucugcuccuccucugauguggccgagagggccagaggaggggcaguuauggauacguucacacuugccugccuguuccugacaguauuuguuguaggaggcgauaacuuccucuugggaaaaagauuucaaacuaguaauaauggcaagaagaauugcaacaaaagggggguggggcuauucccgaauucaccuuuuccaggccagaaaaaaaaacccucauucaugaaucagguucccacguguucucaggagagauccauagggcuagaacugcugccucggucuagaagguuuccagauucgaggccuugacuuucaugcccucuuucucauuggcucacuccauugccagauccagcaucagugguuucuagccaugccagcagacucuggguuggcuugaggaggaaguaucagcaguucgugcaccagcauugcaguuggacucucgcucaggccucgggacaauagcggacacccaagaacucacgagagaccaagcuugaugcaaaccacaugaagcuuuauuaggggaaagccagagcucuggggacgacucagaucccacgcagugguagaggagucgaccaugaggggaaaggggucccaguuuuuauaggcccucaggggagaaaggagaaggggggaguaggggauuuccagaucuaaacaaugucuauucucaagaaauggguaugggagggguacaaggaaagagucugguacagguguagcaacuccggauuggcccggcuaugguugcuggggagauuuuccaacucuuucccagcaaccaguaucacaaacaccuggcaaugggcuucaucagugggcacacacauggguucaaggaauggucaaaacauuggcagacacacgaguucaaggaguggccagagcauugugcaccucuguuuuucuaaaucagugaagcugguucuaucuugaaaucuaucuugccaauuucagggcuucugugaucuuuuauauuuugucaugaucuuucagcaccacuuggcuaaacuucugcaaacaguaacuuagcucucccacacacauacagagaacauuaauuuacuacacacacacacacacacagacacaccauuuugccuuguuucuuugcauuuaagagaaacuaagcaggcccuguauaaccaauugucauagugaaaaagcagcuagugaggaaaaugcccacacucucugagaacaacuuuaccugauaucucacagguguccauaaaagcucuuccaagaaauggaaugacuaacacuauggcacugugcuugguaauccuagcaagaaguggucuggcugggaauggagaagaguggaguagacaagcucagguuguguguguaauguuugcagugcaguugcacgugugcaugagcaugucuagagaucagagguugacacuggcugucuugcucagucucuucucuaucuaauaacugaaaccuauagauaacgaguuggguagacgagaugaccaacaaguuccaugaauccuccugcuuaccuccucgcagugggguuauagguuugaguauaugcuuaugcaugggcgcgcacgcacucacacacacacacacacacaccuggauuuuuauguaaauguuuagauucuaaaauaaggaccucauacuuguacagcagauaaacacuuucucacuaagccaucaucucagcucuuuguuuuuguuuugggggaugugugucucacuauguagccauagcuauccuagaacuugcuauauagaccauaugggccaugaauuugccagaauucucuuagcguguugauugcuaggauuacaagagugacccauuagacucagcuaaacucaaaauuuugcucucuggguuguacguguuuuuacauaaccauuuucaucuuuguuguuauuuguuuuuguuuuguuuuucaagauaggauuucucuguguagccuggacuguucuggaacuugauuuguagaccaugcuggacucaaacucagagauugccugccuuugcuucccaaagugcugggguuaaagguguaaaccuucaccacuggcauaguuucaucuuucugagcuucauuucuccugaaaaaugacaaguagaauauggcucagugauuaagaacguguaugcucuuccagaauauccaaguuuucuucccaguucccacacuggaagggaucgcagcugcccaaaacuccagcugcagagauccaaugaccucuuuuggccucauagacacuggugcucacaugcacauacccuucucucucucucucucucucucucucucucucucucucucucugugugugugugugugugugugugugugugugugugugucuaaauauuugaagucauuauuaaaaaaaaaagaaaggaggauagacaccagaccuuuguauggcuaguggcauggacugaguaggcagucaaugaagcacuuaacauaggccucaacauguaacaagcacuucgccaccagguuucuuugggcauuaauucaaccucucuguguuccaauuaccucccugccaugucuucuuuucaaggcucuagugagauaauauaugucagaauacuggaguugugucuguugugcuuauuuuuuuaggacucccuggaguguauucaaugaggaguacaacauggggaaaguuuauagcuuauguacuuguuuuuaaguccccaaaguaaacucaacaagguuuggaacagcaguuuccaaguguguucauaaauuauucaaaggcauguuuaaauaccuucaauguuuauuuaaaagcuggaauuuuaguaguggcuuuuuuagccuucuaucaaaccguauaaguccuuaauucuacagcauuuguuaguauugggaggaagauaaaggccaugccaccccaagucagucagcucagcagcuguggcaugugacaggcggugccagagcaugucuuuuaggaacagaguuucuuacggccacagaguagaaaugcuugcaccuagaguucauagcuuacuuaagcagucaccugugagugcuagauucaccugcaggcuguugggucccagcccaggcuuugugcugcggccagaaaauguguacuccugacauaaccucaggugcugcuguuccugguucuguucagaagccguacuugagaccugugcaaaccagugcagcugguaaaacuccaaaugauagcuagguguggggaugcacaccuggaaucacaacccuggggagacugauggaaggggaucauucugaguucaagaucagccaaggcuacguagugagcucuaggccaauuuuggaugcauaagacucuguuucaaaacaaaaauguaaaagauagauaguauaaaaugugugugaaguuguagaaagauaagagcacguguacuguggaugaaaauauaauaaagguauaauguggcuggaagcagcuggcaaucccaaguaagguuagaggucaccauggaaagaucuuuacggauagaguuuaggccagaugugguggugcacaccuuuaaucccagaacuugagaggcagaggcagguggaucccugugaguuugagaccagccuauucuacaaagcaaguucuaggauaguggaucugcauagugagacccugucucauaacaaacaaaaaauguaguuaaaaaagcaaguugugaaugagugaucuucaguccuuuauauacagacuuaaaauagauuucuguauuuuaucaauacauauauaaaaguggaaggauauaaauccauaaaauaugauuguucccaagcccuucagacuggauuguagauacagcuuagaguuaagaaguccaaggcccuguauucaaucccuagcaaauauauauacauauauaaacaaacugguugauccuuuuugguuuuuugagacaggguuucucucuauagcccaggcuggccuggaacucagaaauccgacugccucugccucccaaaugcugggauuaaaggcgugcgccaccacacccaggaugguugaucuugauauuguguuccugacuuccuauuuggagaaaacuagauugguucuugacaaagugaucucugcagguucauuauuacuaguaccuauugcagucaucaaaguuucuuuuuaaaguggugccagugaugaagccaagacuucauacaugugagcacuccaccaguaagccacaucccuagcaccaaaguugauugacugacccuuccuuccuuccuuccuuccuuuucuuccuuacaacuagggacugaauucaggaccucacgcgugcuaagcaaucacuccacuaaacugucuagcagccaguugcuguuucuccaauaccacagaaaggucucauuguuucuugagcuaacuugaacucacuguguagcacaggcgaucuugccucaauuuccuggguagaugggauuacaggcuccuaaacauacuucaugguuucuaauguucuuagaaugugacuuagugaaugucuguuuacguauuugcccaagacaaagagugguaagggccuacuccugaagcccugauuccugccuuaggauucaucuuuuccugaccacaggaggucugagucuccaauucuguuccacagucugguaaguggacaugacucaccacuucuuuagcaauaguaacaauauuuuaaccaggcauguuguaaauaccauauucccagcuguguagaaggcaggaagaucauuuagaaccaugaguucaauuacugccugggcaacauaaugagaugauaucucagacaagcaacugcaagcuaauacuuuuuccugacugaaaaggacacuuuuccucucauggaaaagauaguuauaaagccauauugccugguuccaauuccaucuguugcucauuaccugugggauuuggaacaaaccauuuaacccuuguaggcuuaagugauugauaaguuuucauuuuagucucuuggcaaauguuuuuaccuacuuuuuuaagcgauuaugauuaacacauaugauucuuauuucugggguucacuggcauuuuugaugcauuguaauaauagugauaauaucaggauaauuagcauauuaucauaaaaaugggagggggguauauguaugugugauacaaacauuaaaacccucucuucuaccuguuuucagauucaacuauacaaagaccagagucuguucucucugacuuuguacuccuuaauaauuucuccucauuacuagcuuuaaguuuuaauuggcacauaauauguaugcacauuuguggaguacauuguaauuuagaaaaugaauaccauguaugacaaucggaccaggguaauuagaauuuccauuuccuuaaacauuuuuaugccagaaaucuuuaggccugugguucucuugaaauacuucauaaauuguagacuaaagugcugacuuauuacagaugccugaauuaaacccuacugacggacugcuuggauauccauuguuuaacguauuucuagauugauuucucugauccucuuccagucucuagugacuacuauuuuauuuuccccuaaaagaaugauuuuuaaaucuuuuuaaagauuaauuaauuuguuguugguagugguggugauguguguaugugugugugugaugggagggacauggugugccucagugugcguguggaggucagaaccacuuuuggaaguaaggucucucuuucaucuuuacacuggucccaggaaaggcuuauauagcaagugccuuuacugacucaacccucucucuggcccuauauugauuuuuuuuuucaacuuucacaagucagacuccuggguuugccuuuuaaacagauuuuuuggaauguaauuuacauaguauacaauuuacccauauacauuguuuaggcaaaaauaucuuaguggucuaaacuuagugucacagugauuuguagucuucuaaaugaauauuuuauucuaaaugaagucauaccccccuuuuuuccuguaauuuauuuauuuuucuuuauaaugcauucuuucauaugauaguugcuaagauuguuugaaugugaccacaaucugcuuuguuuuacaguuuauucuucucuuuggaggaaucccuuaccucuggagacuuucugggcaguucuguaguucugcuggcuuuggaccagaauacgagguaugugauuccuucaccuggauuguucagucuuuauuuugcuugguaagcuuuacgcugaaguugccuuuugggcuccuaccauugguagacuugccucuuggucucugcacugcuugucugugcauggauuagcauaaaccauaauauguuuugguuacucuucuauugccaugacaaaacacugugaccaaagcagcuuguaaaagaaagcauuuaauugggagcucaccauuucaaaguccauggccaucauguuagggaacauagcagcaggcaggcaugaugcuagaguguagcugagagcucaucucugauucaugaccaagaggaagugacacaccuucuccaacaaguucacagcuccgaaucuuaccaaacaguuccacaaacaguaccaacauuuaaauaugugagccuacgagggcguaucauucaacuacuacaguuaguuacuauaacuccagaauucuagugacuucacaguuuauuucccagucacauaauagcuaauuugaguauuuuaguuagcaggugacuuuguucugugugcugagucagggaguaaggugguuuguuuuuuguuuguuuguuuuucuuuuuuaaaaguguucaucauccagugacacugggaagaucaugcccucuuuuuaauuucuguaaugcuaaggcuaugauagcuuguguucacauuacauggggaagcagucauuugaucuuauucacguggaagagagcugggaaguguagucuugauuacacagcugcuuguuaggaacaacccuaugcaaugguaggaaccccuguuuuguggaacuuagcagauacuuuugcggcaugcacauuaaacaggcacuuuaaauuaagacagaaagucuaucuucuggguguuaaacgaauucuccaucuguaaugagugcuguaaccuguucuccuggaagcugccaagucauuuuaccuccuuucuuuauuggaaaucauggaccuccuguguggguggguugcccuuggcuuuaacugugcucauccuguaccccuuucuaaagcagcaagacgugugugugugugugugugugugugugugugugugugugugugugugucuaaguuagaggacaacuugaaggaguuccuccuucuacccuaugggcucuagggcuugaaaucagcuaguuaagccuggggcagcgucuuuaccaucuaagucaucuugcaggcucagagcaguuauacuuuguuggaugaguaaauacaacuucuacaugugccaggaagaaacacucacaucucccacugaguaagucagugcagcccaugugcacauauguguagggacauccacuaggccaugggcagcuaauggcugcucucccuuccagcccuaacaaaaaaaaaagugacuuucucucucucagcacccauuagcugccauuagcuccugagcugggagugagucuuuaucuuauugggauauuuuauguaauguucugagguaugaauuuugcauuuaauagugacuuaggguuguuuuccuguugguuuauuuagcuaggacuuuguucuuugauggcugcugauauuagaguccucauuuuuguguaguucugauauauacauauguaaguuaccacagugugguuuuaacaccagcccucaauacgggcccaauuuucaguuaccagaguauguuaugugaauaguuaaauaaacugcagacuuccuuguuagcuggucaguauacagaucaugauauaagugguaaucaggaauagucaugucaguauuuucaucagccuacauaauugguuacuguauauguuauucaaagcgugaugccucauucuccuccagcauuuauaaaaagaagugguugaucuggguccaguggugcacauuucuggucuguuacauggacgacuaaggcuggaaacuaggcauucaagacaauacuagacaacagugaugagauggacacagacagacagacagacagacacagagagacacagaucuagacugaagggagcuaagaugauuggaaggcagaguuggcugacaagagugaaaguauagcaaagaagugaaaaugaugauagaaagugaggcucagauccagccuaaugagcuacaccacagccccaacgcuggcuguggagugccagugcugcuccuuucagccacuagagcuacacagcaggacuguaugaccacaacuugaucaucucaagugaaggccauggaugugaugaaaacauggagcuaucccagaacuagugauacuagaaagcccacacauaaggaccuuuggggauauuucacguugaaguucaaaggauaaaacaugaaaagcugaucuaacuucagcuguaugacaucucuccagagagggcugucugugcaauaagaugcaugagaggagcugagcauuguuuaaauucccuucaaaucauugcaaaaagagaauaaaaaaaagagagauuaguccugaauuuuccucaguguuuuaucuuuuuaauaauuuauuagguuugugucugugugagaguaucauauccccugaaacuugaauugcagacaauugugagcugccauguggauacugggaauugagcccagaaccucuggaagagcaagcagccagugcucuuaaccacugagucaucucuccaaccccugucccauguuuuaaaauaacaagguguuaaauuaguuuuguuauuuucuuuuacuucccuacacauuaaaagcugauuaguaaucuuggguauugaccaaaauuuuuaaagaccaagacaaccacauucuuuuuuaauuauuuaaguuauuuuuacaaugccagguacuguggcuggagaauuacgaguucuaggcuagucucucugguccuuagagagagaccuuguccuccacccacucaaccccugcaaaaaaaaugcgacccagguuuccagcacccuucccuagccucuucggacacugacacacacauaguacacauacauguguguguuggugcaugcauaggcauacaugcaugcagacaaagcauccaugcccggcagaucugugaauuugaggccacaacaguuugugaauuuggucuauacagcaaguuccaaggcagccagggcuacauagugagaccggcucaaaacacugcuacauaccuggcaggggagauaccaucaucaugaaggugguuuucccaagccaaggcuuacccauugcacucaggaugugcugagcccugcgauuuccucaaacucgggacacucgauugcauaauuugugguaguggugaacuguguucacacucuccccuggggggaaaaaaaagaguucaaggccagccuguucuacaaaaugauuuccaggauagccaagacuucacauagaaacccuaccuugaaaaaguaaacaaacaaaaauguuuaaaugucauuucucuucccccauuucaguggccucaaaguugcauuuaaugaguugcgaagcucauuaaauguuucuugaauucagcacaucccuuuauucccaacacugaggaggcagaggcaaggucucaccauguagcucuggucuucauagagacccugccucaacaauacacaagaagcccaagaauaagucuuccuugaauccaucuaacauguguugcuuucucuguuguccgaauccuaccaaccauuugucccuaugacuucagguagcuuucaagucaugccucgucuucuaaguaaacauuuuccaagggcaggcugccucagccuguuucccacaggauugagugcauugcuuggggcagaacaggcauucaguguguacuugcugguuugugcuucagcucacuugaugguuuccuuccuuucuuguuugugcuuagaucauucagucauugguguuccugcuguuggccacacucuucagugcacugacuggcuugcccuggagucuguacaauacuuuuguaauagaagaaaagcauggcuucaaucaccagguaugacagggaacaccagggugucuaguaugaagguuuucugugcuucagucccaugcuggcaggaauuuagauagucugcuaucuuacagcaugaauccacugaggaaaaaaaaaagccauggauaugguaaagaccuuagcuaagguccugcuagaaacccuuacugcuugccagcuaauaguaauucuguucugaacuaugaaaugcaagacuuuuugcuuauuguccuaggcugccuaccuuauguucuuuaaguguuuuaaaaacacuuaaagcugcuuuuaaaauaaacguguugcucaguuaauaguaguaauauuuucuuuuucagacuuuggaguuuuuuaugaaagaugcaaucaaaaaauuuauugugacucaauguauuuuauugccugugucugcccuucugcuuuacauuauuaaaauuggaggugacuacuuuuuuauauaugccuggcuguucacauuaguuguuucucugguaaguagauccuuccuuccuuguucauuuuauucauuuauuugagacuuucauguauuaaugcuacauguacauucuuugcuccaauucuucccauguucucccacucccucucaaacucauggccucuuauucuugaauuauuucauuuucuuuugcaaaaguuccuuggcauuacugggauuuagguuucaccgccguauaagugguuccuagagaagguuuccauguaaccagcugcccauauacauuuuccucuccguuccugcuuugggauauaaaggagaacugacugaccaccucggauuuucuucucuuuauccuaacucuuaauguuugccagaagcuugugaucuggcugccuggcaacugagacagcacuuguaaguuuagccagaauggaugacuuuuuuuauugauguauccucuccaccucccaaugccuaaaaggccuuaauguuuugaauuaguggauuuacaagagacaagaaauuaaaucauagggguaaggauguagcucaguuaguagagugcuugucuagcaugcacaggguccuagcuacaguccccaguacuucauaacacaggugugaagacaggaggaucagaaguucaaaaccauccucagcugaaauggagggcagucaggguuagagacccugucuuuuaaaagcauaugcuuuccuuacccagcuuucucccacccucccuuccuauuccccuuuucuguaucccuuuccuccuuuaauuguuuguuuucaaaaaaagaagcacccugcucuucaguucaggcuagccccaacgcuacuauguagccuagacuggccucagauucauggcaauccucuugccucagccugcugagugcugauacaggcauuccccaccaugcuucuuuuccccuuccccuuccccuucccucccguccuccaucucuccucucuccucucuccucucuccugcauuuuccuuccuuacauccuuuuccuucucuguuucucauauucuaaucugcuucaucacagacaaucauacaggcaaggggaacguucacagacccuagaaaauaccaucuguccauucuucagcuccacuggugaugaggguuauuuccaccugaacuguguggcguuuguugcuuuaucucucacuggugggaucgagaucagaagaugagcuacuugucuuuaaauaccuguaauauggcagagacggagaaaauacucuagaagugccauuuccaccagcaugaacaaggguguguuauaauuggcuuacagugccagaaauccccaagaaaggcugcugauuaggcccagaguucuuagucacuguuaguagcauuaucuucuaaaauccaguugacuuguguacaguguuauuacagugcuauuuugauuuaauuuacuaaacagauaauguccuggguguuuguuggaugaacauaauuauauuauauaauuaaguuguuauuaaugaacagucuuuccuguuacuuauuuuucagguucuugucaccauuuaugcugacuauauugccccucuguuugacaaauucacaccucuaccggagggaaagcuuaagcaggaaauugaagugauggcaaagaguauugacuucccuuugacuaagguguauguuguugaagguaaggcuaccuggaggugaggagaguggucugaguacucuguucuuaagucagucagucuuuauuauuuauguuuguuacuuaaaaaauagggucagauuuuacaguuggcuuuuuaagauuuauagaaucugcacaggagagaugacucaacaguuaagacucauggguguucuuccagaggagccaaguuagauuuauaacaucuacauaguggcucacaauugccuguaauguaaaauuuuagaaaugaaauaaaaauacagggaaaaaaaagauuuauaggaacuuauggcauuucuucauauagaaacugguagccugaugccaaauccaguuuuugucugcaacucuguuugauuaaccauauaguauuguucuuaaucuuuguucaaagccuuuuuacuaucucauccuguacuguauaguagaccaaaacucacccuauugucugccuggcuccuuuggguaauugaauuggacucuugaaugaaugauuagcuauauagcacuaguuuaaaggcugcaaaacaaaaccaguguucuuggcuuuguuuccccuagcagagcaucagugucccagggggacucuaaucuguggcaccaucagacaccucacauuauuaaacuguuuuucuguuugccuuggggaguuaagccaccuguuaguuucauaagacugauuaaguuucacggaggcugccaaauuaagaggauaacaguugggugugugucaggauuucaguuuaaaauaaauauaaaagauucugucucagcagcuuacuagcuaugggaucuuaaacgaaucacuucuucccucuaccuuucaaccguguguccucugaaugguaguucucuguaaaaaagcaagcuauucacuguugagagcuauguggccuacaguauucuucagagauucaguucuauauggcagaagcagccacagacagggcauaagcauggaaccuggcuguguuccaauaagacuacaugcaaacaagcagcaccuugcauuugauuugaagccauaguuugcuggugccuacuacaaacuaaacuguuaccaaugagaagcaauugcaaagugaaagaacagagauggcugucacuagaaugagcagcugcaaaaguacgucagucugacaggccucuguaagucaggguaaagaguagccaaaccugaccucagaauuacucuacaauugagguugaccgugaacucuugaccuuauucccucguguugggauuauaggugugagccaccacacacagccaggagacuguccugggcuucugcauagggaugcauuauagggcaaggcaagaacagaaaagaagcacuaagagcagugagaaggcuauuugggcagucuagacuaaaugaggucggguugugguugugguuguuguuuucuuuuguuauguuuuagacuugcucaaaguugaugaagaaaaacaaagaacguugcugccauuugcugauuuacauacagggaaaugaggagagacauuaggauaacuaacagccuggauuugauguggacagucauaaauggcagcuuguugagagggaauagaguuugaagaagaguagauucauaaggaacuaagaguucucaugucugugcuaguauugaaauagcuuuaaacaccaucuuagucauagcucuacaagagcuagcgauuuaagcagaggaauuuuuuuuugguuuguuuuugggggggggggggguugguuuuuuucgagacaggguuucuuuguguagcccuggcuguccuggaacucacucuguagaccaggcuggccucaaacccagaaaugaacucagaaauccuccugccucugccuucuaagugcugggauuaaaggcgugcaccaccacugcccggcaggaauuucuuauugauaacuacaacaucuccagaaagcucuuugccaaccuuaagaaauggacuuuuagaugggugguuaugggcucagacucauagaguggagccaguauggauggggagguuacauuguuaccacugcagaauccucuauucaaggcuuauaucacuuaaucucauugacaagcaccuugucuuccaugaggaccugaguuuaaucuccagaauccauauaaaaaugccuuguguaguggcacucagugguauucccagugcuggggagguagaggccagaggauccuuggagcacacuggccagccaguguagccuaggccaauaagaggccuaaucucaaaggaaguagauggcauuuugaggauaacaccugagauuguuccguggccuucacguguuuccagccucaacacggggucagaguucucaacuggaagcagggauaucuggaagguacauaauaaacagacacagacuacuuuuuggguacaaacugacaggcaauuuuucaaggcuuaaaguuacucucucuucucucucucagaacuugaggcugcacacacucugcauucucuugcgcacucugcuuuuguccuguauguuuuucuuuucuugaacucccacacuccuacacacccuuucacucacacacacacacacacacacacacacucuucacacacaucucacauacauacacacacacacacaccacaugcacucuccuuucacacacacacacaaucuccauacacucuccacauucccuucacucacuuuucacauucaccucaugcacaccucacucucaccucacucacucuccacuugcucuucacaugcucuucacauguucuucacacacucuucagugcucuucacaugcucucucaccuuuuccuugccccagucuuuuauugauacucuuggaguagcagguagaaaaaaaaagauuauauaauuauugccaaauuaaauucaaaagaauaaccucaucccacaaagaaucaagaauuacaauuguucuccaaagcuucaaacuuucccuauucccaggcccgaacuuaccauuauuuaaacuuuaacuuuugacuuacuauacuuccgaauucagagcgcugaggucagcuacuugcauuuuccugugaaguucuaaugauaaaugacaugggcaaagcugccaggcaguggccagaaauaauuaaguuaacccuuaacucaguaguuuugcucauuagcuuucugcuucuguucauugcacacaaugacucuccugagucccaguguuuugacuuagcuuuacuaauguauaauuuuaugcauucuauacuuuaucuaggagccacucucaaauguuguacaaaacuuauaacuuuaauaguuuuuuccuagccgggcagugguggugcaugacuuuaaucccagcacuuggggggcagagguaggcggauuucugaguuugaggccagccuggucuacagagugaguuccaggacagccaggacuacacagagaaacccugucucaaaaaaacaaaaacaaacaaaaaaauaguuuuuuccuuucucagggucccaguguuggcucuauuucauuuuuuaauaauuucuucaaacccuuuuagcaagucaaacauuaaucugaaacuaccauugugcaauuauugcauuguuuccaagcugagagugcacagcauguaccugggccaugaggacuguacugugcugugcccuuaugccuugauuuuuaauuguuuaagaaucauugcaucagggaacaucuaguuucacagaauucacaaaagcaguaggagaaagaaguaggaaagucagauauaauagaauaauuauguacaucaggaccaacugaaaagcagucauguacaaaugaaaucuauacagccauugucggggcuaagguuaggagaaaugggaacaacugguuuuuuucacaaagaguugccgaaagcuacugagaugucuccaucccggccuacugcaggcaauugcuuauuuuagaugguggguccccugcagggaugugucuccugcuucucgggauccagaugccaucuuuuuauaaggagcagccaugggcuucugagauguuuccauuccagccuacugcaggcagucccugucaccccagcacacauguagagguauacauguccacacauagguguaccuacacauacaaacauauaaauacauuuuuuaaaaguaguggaggcuggaaagacgguuuagugguuaagagcauuuguugaucuuucagaggacccaaauucaauucccagcaucagugcggugacuaacaacuagaacucuaguacugggggaucucucacccucuucuggccuuguaggcaccagacacacacaugguacacacccauacauauaaauaaaucuaaaaauaauuaaaauaaguauuuuauuuuguuuguuuuggggggagguauuugguuuguguuaaguaaaaccauagcaucucugucacuggcaguugcagaaugaauucuugacugcuuugcuucuuugugugacucugauuauucagaauucucagggcuacaucucacccacuaagcuggugcacggggcuaguugccaggaguuccugaggaagcaaauaccuggcucuuauguuucccaaaugagaaguagucucaugagaucuucacugggugaaauucccugagcucugaaaggagauucaguaguggacaggagaagaggcauaaagauaugagaaucucgggcuugaagagaaggcucggcaguuaaggacauuugcugcucuuccagaggcccagaguuugguucccagcacccauacugguuggcucacaaccucucuggcccccugaggauucuuugcccucuuuuggccucuacaggcacucacaaauguguguauacacacacucauacacguucauaaaaacuuuuaauucuaaaacaacaaauaauggguggagggugguucaguaauuagacgcacucgccuccacgucugaggacugcgcugaacacuagaacucacaugguaggaagagagaaccaauuccugcagguuguccuccgaucuccacauuagccaagguacaugcauacacacaaaaauaaauaaucuagccuggagaguuggaucagcaguuaagaguacuugccuugaaaccaugaggaguaaguuuggaucugagcaacucccuaauggguaggaagucccauaaacaccuguaucugcagcuccaaggaucgucuggucuccaaucccugcccccaaccccacacacacacaaauuaaaauuuuaaauuccuuauagaauacaaagaaguugaggucuaucccagggcuucuccuauagcugcauauuguuagaaaccccucauacaguuacugguuuugcaucacacacaggacuauuucucaggucuaugggaagggacaagauggccaacaaaacauaugaaagcccuuaaucgacauucugaguagcagcuuacaaauggguaugaacuuggcuuguucauguucauagcacugacuacauugagaagcaggcagauccauauaaccuaaaagcgauccugaaggaaauuguuuaaagcgagauuccaaagaucuuagauggggauuuugaagcuuuguccaaaugcucacaauucagguacaggcaggagaaguccgagcagaccaaguuuaggaagaaccaaaguggccuuguugggugaaagaaagagucacaacuugugaguuccuuuucuuuuaaaagauuuuuauggguuguuuuauuuuuuagauuuauuuuucauuuuauguauaugaauguuauguucaaauggaugucuguguacuacaugugugcuuaaugcucucucagaggucagaagaggcuguuggaucccuggauccauuggaacuaaaguuauaguugguugagucaccauguggcugcugguaauugacccguucucauaccacaaugaagaacauuuggaaauuguagaaauacauaaaguagaaaguaauauguaccacaguucaggaacucucagcuucucuugaaaguuuugauauguugucuuccagucuuaacagagcauucucugauaacaggugucuucuuuuuuaaaaagaaaacugagaacagagacaaaauccauacuucuggguccccaugaacuacauuuccuuacuuugguauuuuuucucauagacuuggguuuaugccauucuguugacaugcacaucuuuuaauaauaugguaaccuuauauauguguggcauuuuguauucuucacuauacuuuggugagauuuucucuugcuaaauuccacuauauauaaauauuuuuuuucuggcugcuuaaaauuccauuccauagcuuugcugcaguuuaaucauuucacacuguuggguacuuuggcuuauuuuacuauugcuacacaccagggagcauaaguggagcagggugacagccaccccacugcugcuauugaauuauauuaauacagccuuucaguguuaaugcccuucccacuaguuccaaaggaccccugguguuuuaacuguucccugcuuuggacugucuuccauaggaucuaagcguuccucccacagcaaugcuuacuuuuauggcuucuucaagaacaagagaauaguuuuguuugacacucuacuagaagaguacucuguaccaaacaaagacaaccaggaggagucuggcauggaagcccgcaaugaaggugaaggggacagugaagaaguaaaagcuaaagugaaaguaaguucuuucuuccucggagccuuugacuuauaauaauaauacaaguuuccaugcagugugugggccucacagagaccaaguacaaacacuacaacucuuaaggugcugcuguuugugagaaaugucuaccauucccacaugcuaagccaccaaacuuucauaagauguacauauuaaaaccgaaagaccuuaguuuuuaaaauauuauguaauagcuuuuucugugcgagagagagagaaagagagagagagagaguguguguguguguguguguguguacaccaugguaaaaauggaaaucaggacaacuuguaguugauuuuucucuacauugucaguccuggggauuauacucagcuagccaguacaggugacaauuguggaguauccaccagggaagacugcucagacacagcuugaagccaauaaaagucuuuguagcagcgggcaacuacucaguguaaucaccauagccccaauauagccuuucuuagggugaacuuuuaagcacagaaaccauaccugaguugacaugcuucaguuaacaagaacaguuagugagaagugaaauuacagaagcaaaaaagcaaggugaguacauuuagagaauucccacaacuguggacuuugauggaucaggccuuuuguuuucauuuuuuggcaaguggugcugucuauguacuaaguuuuauggagucaguuguguucaggucugggggccuguuaucccugaccuuuacccaaugacccaucucauuggcccauauuacuuuuauguuuaugaucaaagaauuucugcagacaaaguaagggauaaacauuuagcuuuuguguaacugaggcauacaguuaauagguuuuccuggcuuuacuuuggcaguagacagagucaagaccugguccugucauuuagucagugaggauccuuggguacauuauguaauugaaucgguuuuauuugcuuuuaucacuuaagaaacauaugcuuucuacugaacucuuuugcuuggcauuaaaaauauaaaaguagucaggggaagguggugcauaccuuuaauuuaauugaaguacccaggaggcagaaacaagugauucgaggcuagccuggucuacggagaacaugccagggcugucaaaaguauacaaaaguagggaaugggaauguagcucuguugguaaagugcuugccuagcauguacaagacacaaguuaugauggaucacaccucuaauccagcacucaggaaagcacugggguuagaagagaagucuaacuuuuuuuuagauuuauuuuaugaaugagugcauauguguauaccauagcacaugucuagagaucagagaacaauuuuguggcacugauucucuacuuccaccuuuucuugaguuccagggacuaaacucaagucuccaggcuuuugggcaaagaccuuuguaacccauugaguugucucaccagcccaagaaaacuuuccuguuuauucauuuguuuguuuguuuuuaagacagguucucuauacauagcccugggugcccagaaacucacuguauagaugaggcuggccucaaauucagagauccaccugucucugccuuuaagugcugguauuaaaggccugugccaccacauccagccccaagaaaacuuuucuuaaauuggaccugagaaucuaaaagcauugcuggaugaggucagcuaaugcugacuaauaaaauuuaaaauauaauauaaauggaugaggaggggauagcaagaaauaauaauaauagucuucagaaauaaccccuaguuauuuauaugugggauugcauaugcccuucaucuguucccaugugagacaauuauaaaucccuauucacucagcagcuacauagcucuggacaagugauuuaagcuuucugaacuucugauuccuucaggcaaaaguaaggcuggcaguguuuuucaaccuuggcauuauuggacuggauaguaccuuguugugauguuuggcagcuucuauggcuuaucuccacuugaaaccagugacacuacuuuuuuuuuuaauuuucuuuuuuuuuuucaauuuuuuauuagaaugcuauccugaaaguccccuauacccuccccucgcccugcuccccuacccacccacucccauuucuuggcccuggcguuccccuguacuggggcauauaaaguuugcaagaccaagggccucucuuaccaaugauggccgacuaggccaucuuuugcuucauaugcagcuagagacaugagcucuggggguacuguuuaguucauauuguuguuccaccuauaggguugcagaccccuucagcuccuuggguacuuucuccagcuccuccauugggggcccuguguuccauccaauagaugacugugagcauccacuucuguguuugccaggcauuggcauagccuuauaugagacagcuauaucaggguccugucagcaaaaucuugcuggcauaugcaauagugucugcguuugguggcugauuaugggauggauccccgaguggaggaauggauacagaaaaugugguacauuuacucaauggaguacuacucagcuauuaaaaacaaugaauuuaugaaauucuuuuuuuuuuuuuuaauucuuuuuuuuuuuaaagguucauuuauuuauuauauguaaguacacuguagcugucuucagacaauccagaagagggagucagaucuuguuauggaugguugugagccaccaugugguugcugggauuugaacucugaaccuucggaagagcagucgggugcucuuacccacugagccaucucaccagcccugaauuuaugaaauucuuaggcaaauagauauaucuggaggauaucauccugagugagguaacccagucacaaaaaaacucacuugauaugcacucacugauaagugcccagaaacuuagaauacccaagauacaauuugcaaaacacaaaaaaaucaagaagaaggaagaccaacacguagauacuucauuccuucuuagaauagggaacaaaauacccauggaaggaguuacagagaaaaaguuuggagcugagacgaaaggauggaccauucagugacacuucuuuuaugcacucacauauuacaaccaaaacaccuccaguugguaccagauguccuuggaugggaguggggcagaaucagaauagugcaaguucucuugugucugggaaaugguaauuccaagaugcucgcuguucagaguucugagcugaaauuaaaaugcccaugaaaucucuugugcuuuuucuuuuaagcucuggaaaauaauaauugucauuugaguauuuauuuucauuuuaaagggaugaucuggcaaggugccuguaccuguuaugaauaucuagaugagacaauuucugugcaaggauuaaauaauaugguaaagggguuagugccucugauuuuuuuuuaaaauuauuuauuuauuuauuauuuuauggacauugaugguuugccugcauguaugucuguguaagggugucagauauccuggaacugaaguuacagacaguugugagcugccaucugagugcugggaauugaaagaauauccagugccuuuaacacugagccaucucuccagaccagccuagugccuuugaauuuuuaaaggacuaauuuauuguuauguguaugagaguuguguguggguaagugcauaguccagagaaaagugucuggguccucugcagccagacuuagaggcaauugugagccacuugacagggauaucgggaaccaaacccaaauucucuagaagagcagaaagcccucuuaguuugauugguugguugguugguuuuguuuuaucuuauucaugcguguguguguguguguguguguguguguguguguguguguguguguguuuugccuacauguaugaaugcaccaugugcaugacugguaccuggagaggacagaagagggaaucagauauccuggaacugggguuauguaggauuuuugagucaccaugugugugcugggaaucaaccugggcccucuuuaagagcaacaaaugggucggcccguggguggguggguggguggguggauugguuggcugaagacaauauugaaugacugggaagaugucccaguggguaagaguuguucuacaaacuugaggcccagaaucugaaucccgggcacccuuguaaacagccaggcauggagacaggcagguccuacugacagccaaaacugagcuucugugugagagcuugucucagggcuaagaugcacaccugcauucacaugcaccacaagcaugugaauauguacacacacacacacacacacacacacacaaugcaguagaaugauguauguggcccauauuggcgugggccuugcuauacagccuaguuuggcuucaaauuuggggcccucugcuucaagcuccugaguguaucauaugcaugagcuauccuacccagcuuuuuguuuuguuguguuuugguuuuugguuuuuucaagacaggguuucucuguguagcccuggcuguccuggaacucacuuuuuagaccaggcuggccucaaacucagaaaucugccugccuccaccucccaagugcugggauuaaaggcgagcgccuaaaauuuaucccuccgauguccugcccuauuuuuguuguuguuaugcugggaauuagaaccauacccuuguacacauuaggcaaguguucaaccaucaggcucucuaugucccuacuccugaggcucuuuuuuuuuuuaaagauauauaugaugaguacacuguagcugucuucagacacaccagaagagggcaucugaucccauuacagaugguugugagccaccaugugguugcugagaauugaacucaagaccucuggaagagcagucagugcucuuaaccucugagccaucucuccagcuuccuggggcucuauuuuuaaauugccauuacugguauguuuuugaguccugagaaagguauaaaguagucaagcugucaggugaugguggugcacaccuuuaaucucagcacuucaaaggcagaggcaaguggaucucugaguucgaggccaaccuagucuucagagugaguuccaggacagccagagauaaauaaauaauuugauuaauuaacuaacuaacuaaugaauacauagucaagucacaguuaucuaucuuugauacagucgacugcuccuaauaccgugcugugcuuccugucagcgcauccaauggauguauacauaacuguuacuugaccucaucauggccaccaucgguuucuauguccagacaaacuuggaggaugagguuucuaauggguuuaggauguggcugccaagucguuucauaugacuuguuuaacccuuaccuuauugauaaagauuuaugcuuuuuccaauuuuucuuuuacccaaucuaaguucgucuagggaauuaaacuuagugaagcuggagccugucuuguuuauauuucuguuguugggacauaacaaaauaucucacauggagugaaugcucuguuaagcaaaguucuauacuaaagucugguuguuugauuagaugggucaaggcuaaagauauaaaugaauuaaagguuucuaaucaguuuuccuuuuuucuuugauucagaauaagaaacaagguuguaaaaaugaggagguacuggcugugcuuggccaugaacugggacacuggaaguugggacacacaguaaaaaauaucauuauuagucagguaaguuuggcaugacaguuuuguuuuauuuuguuuugcuuuguuugaaacagcgucucauguaguugaaacuggccugguguucacuauguagccaaggaugaccuugaacucuugauccuucugccuuuaccuuccaccuguuaucuuuuuuuguuuuguuuuguuuuguuuuuguuuuuuuaagacaugguuuuuccauauagcuccugcuauccuggaacucacuauguagaccaggcuggcgucaaacucagaaaugugucaccacugcccugcuccaccuguaaucuuaagagcucaggagacccaggcagaaagaucucagguugacggggcugacaaacuggccuaagaguugaagguacuugcuaccaagccuaaguucgaccccaggacucacauaauggaaggaagaaccagcucccuuaaucuguccucugacccucugcucuugcacuguggcaugaguucuugugcacacacauaagcauaaacaagauaaguuaaaaaauguuagacgcuuuaaauaccuaauaaaaaauggaaaaaaaaaauuaaauaccuaauaaaaaauggaaaaaaaaaaauggauauuagccacaaaaaaaaaaaaauguuagaagcugaagacuguuuugaacuauacagcaaugcccaggccagacugagcuacauaaagagaaaagccaaguaaguacauaaagcaugccaggcccaagcgauuauauaaugauggguuaagacagaccucaggccaggagcguguuacagccuuguaauccauucaggaagcugaggcaggaggaucacaacuuugaggcuaagcuaccuggcuucucuuuguggcucccugagugaucugaggcaauuccuuaauuucucucugccuccauuucuucauugaauaauacagcauagugcugguuaagacagauguggauaguccugccagaguuugggaugucccgggagcaaggugaguacauguuaguguucaccgcuguuaccaucgucgcucuuacucccauagcugcucagauaugugagugugaaaaccaaaggaacagaaagaacuaggcaaguuguacauuaaaaugcuuuuuaaacuuggugagauuguucagcauacaaaggcacuugccaccaagucugacaauauuagauugauuccuggggcccaccuuuuagaaggcaagaacuaacuccugcaggcuguccuucugaccuccacaugcuugccaugacauacacacugcugcaaagacacguacacaugcaacaaaaauaagcaaaucauaaguguaaaaaaauagacauuuuaacucacuuuguagaccagacuagccucaaacucagaggucuuauuggccuuugccucuugagugcugggauuaaagaugugugccaccacugcaugguuucuauauauuuugaucuacuuuuuaaagguuuuaaaagacucguuuguaaaauaaauuuuuuuuguuuuuuuuguuuuuguuguuuuuuuuuuuuguuuguuuguuuguuuuuuguuuuuucaagacaggguuucucuguauaguccuggcugucuuggagcucacuuuguagaccaggcuggccuccaacucagaaauccgccugccucugccuccggugugcuggaauuaaaggcgugcgccaccacgcccggcuuaaaauaaaauuuuuaagagcauuuuguugugauuauuuuucaaguguagauauguaugucuguauauggauauguguacuugagggcaggugcccacagaagcccagaagcuuaggauccccuggagcuggacuuaaagaugguucuaagccacaugauguuggugcuggaaaccaaacccaaauucuuugcaagagcagccagugcuuuuaccugcugagcucucuccccagcacuaaaaucuucuuccauggcaggcauuucggcacuucagcuggugcuagcauaacauguuauuauauguguuauaaauaaaauuuuaagauuaaaaaugugaagccaggcagugguggcacacgccuguaaucccagcacuccggaggcagaggcagguggauuucugaguucaaggccagccuggucuacagagugaguuccaggacaaccggggcuacacagagaaacccugucucaaaaaaaaaaaaaaaaaaagaagauuaaaaguauaugcuuugaaugccuccuaccagaggcagaaggauugugauugugaagccagcaugggcuaccuagcaagacccacuuaaccuuaguuaugguuucuauugcagugauaaaaugccaugaccaaagcaacuugggaaguuguguuucucucauauauauaucugccugcaaugguucucagccuguggaucuugacaccuuugggggucccauaucagauaucuugcacaucagauauuuacauuacaacuuauaacaguagcaaaauuauaguuaugaaauagcaacaaaauaauuuuacuguuggggaucaccacaacaugaggaaguaaauauauuaaaggguugcaauauuaaguugagaaccucuaaugcauaaaggaacauugcuuauugccuugcuccucauggcuugcuuagccugcuuucuuguacaaucuaggaccaccugcccagggguggcaacauccauagugagcugggcccucccacaucaaucaagaaaaugcacuacagguuugcuuagcauccugguaacauacaguguugugcccucuuuucuagaugaauucuuuccuguguuuuuucuuguuugcuguauuaauuggucgaagggaacuuuuugccgccuuugguuuuuaugacagccaacccacucugaucggacucuugaucaucuuucaguuuauuuucucaccuuacaaugagguaauguaugcuuuuuaaaacuaccauauaauauaguuuuugccuguuucaaaucuagacucuuugggguaguguaaaaaaauaaauaaaguucuauaaucuucuaguuccucacugacagauuggacaguauaaaaguagccgggaaaccugagaggaaguaacugaaguaacugagugcucauaacacugucaggagauaaaugagagagguggcgccuagcaaccaaaaccuuguuguguaccucagagcugcaggagcuggaguccagccaugugaucaccaguguaggugugagaaaucugugugugagaggacaagacaaauuauaacugaauaggugacagcuagccuggaaagagcugugugacaguguuccucugacuguucacagcaacucuaaaguuccuuccaggacccacuaagccaaaaguggguauuucacuagugagcuuagaagcuaaucaggagcagaucgugcacgugugauaagacauguugaugagacuguauuucagagcagaaucucuuggcauuugcuaaggcuuccagaugaaaccaagaaauaauauuggugaucuugaggaaccuccauucauccuugagacaaguucuaaagacuuggcucucaaccuuccuaacgcugcgacccuuuaauacaguuccuuuauguugugacauccaaccauaaaauuguucuuguugcuacuuugugacuguaaguuugcuacuguuaugaguuauaaauacaugauaugcagaauaucugauaugagacuucugugaaaugguuguuugaccccaaaaagauuugacccccaaaagauccacagguugagaaccgcugcucuagaguaaaaguuauaagggaacuagcuguaaagugauguccacaguguugcaguaaaucuccucccaaauaugcccgagcaaugaaaacaggacucaguuaauaugguuacaugcugugggccuagauugggcagauacacuaccaucuuccacaucaaugagaccccuuagaacuugcgguuccuccaggcuaugugcuucuguucugcuuuucuucuuccuccuccucugcgucuucucccucuuccauuuucuccuucuuucacuuucugcuccaccuucccuuuuuucagcccaaucaucagcucuccuuuauuuuacaaauuaagguuuauaggaagcaggguuacaggaaaucaccugaguguugacccaguccuuauucacggccacucacaggaggacagaguuaacagcaaagaucauuagccccagggcuguccacaacaccgcagaacuaaauguaacaguauuuauuagucuauauuauagacauuaaauuauugguuuuuugguuuuaagauuuuuauuauuuuaaacuacguguaugauguuuguguaugguaugugcaugugaaugcaggugccagcagaggccagaguuagugaauucuccuaaaguuguagguauaggcagcugugagccaccugacauggcugcugggaauccagccugcguccccuggcagagcagcacguacuguuaacugcugagcuagcucuccagccccuaaaaauacacuuuuuaauuuuugaggaauguauaaaaugcauuauguaguuuacugcuuaaacaugguucagagccagguggugaugguguacccuuuaaucccagugcuugggaggcagaggcaaguggaucucugcguuugaggccagccugguuuagagugaguuccaggacagccagagccacauagagaaacccugucucgaaaaauaucagcagcagcaacaauuaaaaaaaaugguacagaaugcuuuuguuauaucucagcuucgguaaagucacugcacauacauagucauaaauaauccucgagcacccugcauuuuaauaguuuuauuuauuuaacuaauauuuucuuaccccuuugggcuaauaauaucacugugcuuccccauuaguccauguuuaguuuucuuuaacuggccgcccagcguacaggggagcuccagcugaaguagaggagagccgcagaagcagggaggagggcugagggcugggaggacaaugccgcagaagcagggaggagggcugagggcuugcugucugcuugggccacucagaggauuuuuuuuuuguuuugucuccucacucaguaguugaauucacuucacaaaugcugagauaaacguaguauuagagugguuuggaaugugauuaguccacagauguacuaacagcugauuuuuaagcuuugaguugccuaggagaucuauuucagaggugcuacuuauuuuagccuggaugucuuguaagcagugucagaguuuaaggggccuaaaaggagagaugcuguccugggauugcccuuucaaaacaacuggagggcuagcucaguguuucagagucagugcugcucuuccuagaacucaugucaggcacugccugugacuccagcucuggauccaauggaucugccaucugcagacaccuauagucaaguaacccaugcccacgcugcaugcauacacauaauuaggauaaauucuuaaaaaugauuggaaacuuacaauagaacagaugguuagucauuuaguguauuuauguauuagagcaaaaaucaaaggcugguugacuggguacuuacaggaggugaaggacaagaauaagggauuguauguuuguuuggggggcuuguuuuuuauaguucuaaaaacugaaccuagguccucacaugugcugagggaacauugagauaagguuauuagagccagugaaugaaggcuaggguagggguugccuuucuccccuucccuucuuuccuuccgugagauagggucucacugucuuguaauaaggcuggccuccgacuccugccucacccucccaguagcuggagugacagguacaguccaccucauguggcucagauagccaaaucaaaauguacauucaagauuugaaagaaauuucaugcagaauuggaugguaacagagacucacaaacuuuauuaggaaacuaguauuuguuaguggcagagagagacagacagugagcucugugcauaagaaugcuuacccaugugugugccuguggagaucagaaguuaacauuggaugccuuccucuguugcucuccaagggcagacauucacaccaggaaucuuccuaugucacugaaccuggcugcccagcaugccccugagaacuaccccaucuccccacuccuuagcacuggggcuucugacacacauuuagccaccaauucaaauuuggguucucaggcucucgcaguaaguacuuuacccacacagccaucuccccaguccccaaaagcaaaagcaaaaaagaacauuuuugacagguuuuuuuuuuucuuucaguuuuuuaggacaagguuucucuauguagucuuggggcuguccuagaacuugcucuguagacggggcugccucaaacucagaaauccacuugccucugccccccuagugcugauacaaaaacuucuuaaucccccagaauguauauuuuucccgggaaaaguuucccucucauaauggucuuuagaaauuaugaacugacucugagauguuguaggagccacuuggagaacagucaguucugaugugggaggcugaaguaggaggaucacgggugugaggccagcuauguaggaagaccauggccguaacaaaaccaaacuugaaacuauuaucagaggcuuugucauaguuuuuagaauagcucagagaagacuuauuaaagauagauaggugaucaagaauauuaagagugauucugugggcuggaaagauggcucagugguaaagagcacucacuggccuugcagaggaccuggguucaguucccagcaucuacauaaugacucaaccaucuauaauauaacuccaagucaaagggaucauaaagcccacuucugaccucuuuggacaccaggcaaaauacaaauacaaaauaaauaaauauuugaaaaagaacuccagaugagguaguggauuccuaugauccuagcuagcacuugggauugggggccaaaggauggggaguuugaggccggccuggguuguaugaaacccagucuuagaaaaacagacaagggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauaaaauaauaaauaaaucuuuaaaaaaaaaaaaaaaacuaaaaaaaaaaaaaagaaaaacagacaaagcauaucagagaccgaacgugagcacaggucugacugugagaugguggugugcacuggcuucagagucacccuuguucagcacuaaccuccagccuuguggccucuggaaaacuguccaguccuuugagcgccucccuccugaccuguacggcagaauagagaggucaugaagacuuacaugauaacaaaggcaccagguaacuaaaaccuuugauuuccuucugcagguucugucuuucugccuaacaguccugagccgcagauuugaauuucaagcugaugcguuugccaagaaacuugggaaggcuaaagacuuauauucugcuuugaucaagcugaacaaagauaaccugggauucccgguuucugacugguuguuuucaacauggcacuauucacacccuccgcuucuagagaggcuucaggcucugaaaaaugcaaaacaagacugagccacucaggccccaugacuggaugcucuuccgguuauucuguccuggcagcauguuccggcucuugauguuuuuaauuuuuuuaagaaaaaugauuacguacauaaaaguccagauuuaaauacauuuacuaucucauuucaaaaaugauuuuaauaauccauuucuuaaaacacuggauaaaauuuugaggcuuaauauuuuuaaagcauaguuuuaucuaguaucuuauuuaucaucaauuuguaaaaugguuuaaggaaaugcacaacuuguuuuauuucugcacuauguggaaucugcauagaggguuuuaggucauaaguucaaagguggaagcaucaccuccaagcacuuuuugcaaagcagaaacagaguggucccaaaccacugcgcuguaccuacauggaauuuguuuuuaccuacguguuguuauaauuuagcccagccaaucaguguuuuaaauaaggaagaaaaguaaaaauuaguaaggcuaaugcuacugaaaugaguuguuaggcaugcuauacugucauaguuacaaagcauucuguucucuuucuugccacaccaaucaggaauucccucccuccuuccucucuccuuuccuuuuuuuucccuaacauaagaucucacucuaguccuugcuggccccaaauucauucuuuagcacaagguggccuagaaccuguaucaggccuccugccucagucuuccuaauguugggauugcaguugugagcugccacauaucgcuuaggaauuguuaauagugcuugaaauuagaaaccuuuuaaaucauugacuuuggguuugcuuuuaagaaggucuuaauuuuaaaccaggcuugguagcacuuacauuuaaucucagcaacugaggcagaggcagauggaccugugagcuaaggccaagccuggucgacauagcaaguuccaggccagucaaacuggggucuuaaaggugguagaguaaaaguccaucucgguuuuuauuuacccucccuuccaucgaucuuauuauaaguaaacuagccuuuucucauucauuuuuucccaguaaauaauaguauauccuuuaacucagcugaaauugccauauuguauacaucucccaauguuaauuauggcagaauauaaaaaaaaagaggggauaacauuugaaaagacauaaaggugaaauauucaugauucucuuauuacaggaaaauauaguuuucuaucuuuuuucaaggacagaagucucuacuuuuauuuuuguaauuuuuuauucacaaaucauaaguagaccagauuccauuuuuuaaaaauuauaauucuugguaggcaggcagauguugacuugcagagaaagcgccauaaaagauuuccagugggaaaagguaugugcuugacugcuucaaaugucuguccacguccuaagugagaguccugcugcgccugccacgcccagucacugguagcgagugccuccugggcauucaguccacaguguaaucgacucuacacuauggcaucugcacucugcugacaagugacaaggcaucugcgaugccuucacauggaccauaguagcgucagcucacacucagcacugcauuguuuauuuccuacagcuacgcagagcagcccacgguuucucuccagcacccuuuccugugacuucaugcucagauaacugccuuuccuuccuucugugccuuuaaaaacauauuucaguucugcacaagugagacauuaaaaauugccaaugcagauuuac

SEQ ID NO: 2098 - RNA, 30473 nt, Mus musculus
ccucccuuggaggcggagcccuuuuccaaacgcuccuaagccagauucucucuccgguggcggggaaugagggcggagucacgagcggagcggccaaacuucuuccucucccccgggcuagcguuacagccagugguucauuuccggugggggugccgcgcccagugagggcccggaagugggucgcgcgaagaccgcugggcgguucuugccggaaguggagagcggcugaucgcaguccggaggugaggcggaacucuuaaggugaggguuggugguuggauaaggauugggauggucuuuggggcccaccggguccuggccguuaguaaaggcugugcuagccuacgcgcguuugaggagucuugcugaaaggccgggguuugggcccuucggccaucccgggcuccugggugcggucucuugagguggggcugggguaccagauugaaccaggaggucuuggggaagccacuuucuccuugauuucgcagcucugccuaucagccuccgcggaggccugauuccuaaaggcauccuaaccaacugaauggacccugggagaccuuagaauuuccuccugaccgggucuuguucccauuacucggauggguaacuugaucucggagaagaaaagaaucugguuuuagagagagguuuccaguccuagauccuuccuuuccuuggaaccucucuaacuuucgaucugggcagcugcagguuaaaggcuaucugguaguagaacuaaaaaaaaaaaaaaaguuaaaaauuuggaaugccuguuaaauuuaagguaggcuaguaagcccugcguuuacguucagugagcuccccuuacucuuagacugccacuguucacucgcaauccaagcuaacuuuaugggaggugcuguccacuucuggaucugaagucagaugauucagguugggucuggcacaguugccaagugccuguggucguaggaucgcuguguuuauucuguguuggcaacauggaaaaugucaucgaauacagcuuugaaaagucuagucauugcccccaucgaguuagcagugaaagacaguuaagaaauaguuacaaauguggugagggugcuguggaaggacgcagcaagggagucagaagcguuuugaaagaucaagagggugugugugugugugugugugugugugugugugagagagagagagagagagagagagagagagagagagaauauauuagauagagguuaguuaguaucagaacugucagcuguagcucuuuguacugcuuucccuugaagugaaaauccaggguuagaacagcacguucaucaucugccaagcauuuauuggaccucaguaugugugaaaacauuuuagcuuaggcacuuagcccuucuggcuaggaauacacuuguucucuggugauauguacaguaugggaggaaccggcaaaucaagggugguugagugugugcacugugugaacacagagcuacugagaacaggagaaauaucugaaccacaguucuaggcaacaaugagggacuuaguguuucaagauuuccuuaggcauauaaugagccuaggaaacggauuucuaggcagaacuagauggaaaggcgcagagaccuaggcaugagaaagacccaagugacuagucagccguguugugguuccaguauuacuuggagaaguggagaaaaugagagguuguggagucaaauagggaggcccuuggaagcaugcuaaagaauuuggauuuuagccuggaagcuauggggauacuuugaaggguuuucccacuuggcagagugggaagggaccagacacuggaguagaccaguacuuaaaaagcuguugcugugucauggcuugagcuggagaggggaaguggaaaugaccaagagggguugcauuugagcagucuuggccauaugugauagugugugucugccaugucagcaccuggaguuugaggcaggagaaucacgagcugaagccuagggcagauaucaaggcuggaauccaaggaacuggaggcuuguuauuuaugggagugaagaaguaguuguagucuggaaauugcugcuguucuggucuaagauacugucaguaccauucagauaaggaauauaaaagguucauuggaaagagauauaaaauugugaagugacaaagaaaaaaaucuguagccuucugggcauuagugcccccaggucuagccagggcaaauugcaaagguguggcagaagaggguuuggucuguacugcuaugagaaauacucaggccuggaguucgguaggagcugggagcgggguggggugucuggcugguuguuuggggcuuugaaugucuuagucugaauguguuuggauuuuauuuuguaacugucuguuguugcuguagugcucagcacgcauaacuuucuggacacuuccuacuuugcagaaauauucuguaggucagcggagcauaauuaaugaugcagagaagguuaauaaaauugguagcaaugaaaguacuuuaaagucuaacuuaacucugcagaccaagugguagguacuggugacuuuucugagugcagcaggccuugaggaggcaguguuucccuucugaggagaacuuuuuucaaccauguucaugguagcgcaugaauuuuuguuguuguuguuguuuuuaaucauaggcugacugguuuaaaagaaugacuucuucauuuugguuuucugagaaacuauaaguacaagguucauuuugcuuaaacaagcaaauacaaaguguuauuggaaguaaaaccuuuuggcuugaaauuuaaugcugagauuugaaaccugaggacuauacacuauaucuuaccaaugguugugauuauuucuuuaaauaucaucaucaguuuaucuaguauuaacuugucuucuguaccuagcacuccagcuucucuguaccauagugaaucauuuaaaggucuugaaaacaaaucauuuuucacccuuuugccuauuauucucacagacuucauaaucccaaagaaccaagucuaaauuuuuuuuccagcuuaccaguccucuacaauuagacuuuuacauguuguguugugcuguguuguauuguuucauuuuggaaguguucgcuguugaacccagggcuugugcuuccuugucuccuagcgagcuguggcacagccccacucagacacuugccuaaauuaauuuucagacucgacuuucuaauuuagauuagcauuuuaugugagucauuuguucucccuuuaugcuucuuauauuagaccaguuuuuuuuuuuuuucagcuuuggcacaguuggcauucugggcuguccuguaagaugcuuggcagcaucccuguccucuauccauuggaugcugguagcacuuccucagucgugauagccaaaaaugucuugagacauugcuaaauguuuccuggaggaaagaauuucuccugguggagaacugcuuaagaaaacuuuguagguggccuggggagauggcuuauacuauaaaggcuccugcugcuaagcacagcccuugaguucuaucccugggacucacaugguggaaggagagaacugacuccuacaaguuguccucugaccucuacccaugccugacuccugcaaguuguccucugaccucuacccacgcccuguagcauguaggcauccacacaauaaaugaguguaauagaaaacauagcuauguucuacugggucuuauuuccucagcuaacaucucugaggaggcucuggagcugcacuuagcauaguguaugguacauucuaagcauuguacacuaaugaauaagucauuuguuuucauugagguacugggaaguugugcuuuugaggaaguccuuaccacccuccuaagacuccuguuucaguuauuguucuuuuuuuaacaucuauuuuuuaauuugauguauaugcacaucccaagugcaugcauguccaccauguucaugcugguuaccauggaggccagaagaaggagcuggaguuacagaugguuuuaacugccugguauggggcugaggaccucagggucucuucugagagcagcagcugcucaugaccacugagccaucucuccagugccugacuugcaaucuuuuacuagagaaaggccaaugauuggcaggaacuggcagcagaguuuguguuaguuaccuggcagguuagcagauuugucugucccugauauggaaauguagacuccuuuuugaucauguucauauugcuagcaguuagcuugcuuggguuuaguggcuggggauuauagaguugauagucuuguaguuucuuucuuaaauuaauauaacuuuggcauucaccauaaaacuuucuucucaauauaccguuauguaaacccaauuaaaaaaaagucaaagcucuaaaaauauccuccgcuacagugcagcuuuguuugccuucuauuaccagacaugugccaaacuuuuccauuuggcuaggaaauaguugaaauguuuaauggaaggaauaaguagccuugcuauuuuuguuugagguuuuuuuuuugggaggugggguggaggagaauguuuuuagcacuuuccuuccuccagaggccauuacaacuccuauauuuaaauuaauuauagacuuagaaucacagaucuuuucauaucuauaguugcagcugaaucaugucuaaggauggauaucaucuuugaaaauaucuuuauguuugugaguuggaaaggcuguucuauuaaagcacccauccaggcagaaaucagcagugcaguuguucuauacagacacagggaaauaacaagggccugcugaauguucauaauacucuucagucuacagggagagaggauucauagccacacagaguuaucuguuagcccugaaccauugaaacagcuaguucccaagucugacuucagccugggagauauuacucguuucaccucccucuccugagucucagcuagaggaccguagcagaggggaauaggagccgagcccugacguugacuuggauucccucccucccuagaagauaggccuuucuuuucucuuuuagucuaauccucagguggcagugacuugggcacgaaaugucauugguuucaucagugaaaccaaaaucuuagggaagaacaguggcuccugauuuggguuagauguagaugacaucuuuacagaguugauucuuugguuucuggguuaagccagcugucuuagaauuucuguuguugauacaaacacugugaccaaaaagcaaguuggggaggaaagaguuuuauuuggcuuacacuuccagagcacugaucaucuuugaaggaagucaggacaggaagagggcaggagcuuauacagaagcuaaggaggagugcugcuuacccgagugggaagccuucuucagccugccuuuuuauagaacccaggaccaccugcccaggaauggcuccacccacauggccugggcgucccccauugaucacuaauuaagaugaugucauacagcuggauccuaugguggcauuuuucuccauugaggggcuccuuucuuugauaguucuaaauugugucaaguugacauaaaaccaaccagaacaaaucuacauguagguauuuccuauuagcgucuuuagaggcuaaggaucuauauuauuugggauagaauuaacuaauauauauagcuuugugguagcuugaaacaggcaacccaggagugguguucucucgcucauccccuagucccuuuuugaaauagggccucgauauguaggccucugcuuccugggggcuggauuaaagguguuucccuuuucuuucuuuuuuuuuuuuuuaaagauuuauuuauuuauuauauguaaguacacuguagcugucuucagacacuacagaagagggcgucagaucucguuacggaugguugugagccaccaugugguugcugggauuugaacuccggaccuucggaagagcagucgggugcucuuacccacugagccaucucaccagcccucccuuuucuuucauucuuucauucacuguacuucuaugucaaaguuuagaaaaaaaggggaauuugcugacaacuuuguaaugugcaaaauuguaaaucuuaucuuuaccccccgcccccgccccccaguccauuuagcuguuucccauaauuaggagcccaagguacuuucacuauagaugugugcauggauauguaacacuacagugaauaucuucauguuaucaucacuuucaggacauuaugauaguauacuuucuuaggauaaaaucucaacaggguuacaaagacaagccuaagaaagcauuuuuuuuucuuucuuucuuucuuucuuucuuucuuucuuucuuucuuucuuucuuucuuucucauauucucucucucucucuuuuuguuagguuuuguuuugucaauuuugggacaggauuucuuuguguagcucuggcuguccuggaucucacucuguaggccagguuggucuugaacucagagaccuaccugccucugccuuccaagugcugggauuaaagacgugucccaccacugcccagauaagagaagaauuuuuuuuuaaagauuuauuuauuuauuauauguaaguacacuguagcugucuuuagacacuccagaagagggugucagaucuuguuacgacggaugguugugagccaccaugugguugcugggauuugaacucaggaccuucggaagagcagucaguguucuuaacuccugagccaucucuccagccccaagagaagaauuuuaaggucaguugguuuauuaagaauauagacugauuuggacaguuguuuucauuucuguuuuauaugaauugaugacuuagaacucccaugggauaaaguagaaaccauuucucacuacuggcuuauggccucuugaguugugaccagagcugcuguaguaaccuagucccuggccuucugcaugaguuaaugaauaguaagaaguuguuggaaugaggagauugagagguuguuaguugcugacguagcucaguggcacagugucuauguaguguguacaaggccaggcuguggguucuaucccuaguaccacaaaauauagaaggaugaaaacaaagcaguuuugcaagggucuggaaccauuucuaguuuuucuugguuuuggacugcaaaagaaguugcuggagagucaggcucauaguuuccuuccacccugcauggugaugucaugaagcuuuucuugccagugacuuguaaacaucaucuccagucuugauccuuucccaggcucucuuucuaaauacuuacuggacauuuuuauuuagaaucuucaucuuuucuucagacuccguaaaucuagagcagacaccaucuuuuugcuguaacuagaaccugcuacugccuuaaugccaucauucuuguaaggcccccauucuugugacucuagaauugcccuucucucccuucugaaugcuguagugcuuucaguccaggaccaguuacccuuguucucugucugguucacacucaugugugcccuccaggggcagagcugagagcaguggguggaaguuucagggaggcaaauuugccuccauauaaggaguacuucaagcugucugcauagaaaugggcugucucagagucuaggguucuuucucuaugccugaaggugcuugaucacaggcugcccagcuaauugcuaagaauguugaagggacuguucuggcaucaaauggaguuuugauaaggugauuucuacaguuacuuuuaauccggagaagcugauucuaugggagguagcuuugccucuccccuuuugggcagggaaacuauuucauccuuuaaaaaaaaaaaucucagcaguuaauucaggugccaguuccuuaguugccuaaaagaggacugauuguaggcuaauugaugguuuucaguuaccaguuauuguagguuuuuuguuuuuuuguuugaaauauuuugaugaauuggggcaugguagcaugucuuuaaucucagcacuccaagcagaagcaagcaggucucuguaaguuugaggccagcaggucugucuacacagugaauucugugccagccaaugcuacuuauuaagucccuagucuuuuguaguagccuucaucuuuuccugagcauuuuggagcagcuagguaggugagcaaccuuacagaccuugauauuuucccuuucguucaaaccuuauucuguuuaccagauaguauuuguaaaugcuuugcuuucuuucuucuguaguccuuuuuuucauuuccaucguuuauaacaagccagacauuagcuggcuuuucuaggauaucugacccagcuuauuuagccagccuuaucuccauacugcaucauucuaaacuuuuuuuuuaaagcauagucuauuucugucaguuuuuaaaaggauuuauuuuuaauuuuauuauuuuugagaaaagaucuuacucuguagccuuugcuggccuggaucucacuauuauauagaccaaacugcuucaaacucauauagaucccacccuaccuucccccccccccccauauguauauguguguguggggggucuuauaagugggcuuggagaaauggcucaguuuauuccccuacacacacacacaaaacacacacacucacauuuuuuuuuaauuuuauuuuugagagaguuucuuuguguagcccuggcuguuugggaacuuauucuguagaccaggcuggccucaaacucagagaucuaccugccucugccucccaaaugcugagaucaaagaugugcaccaccuaaauuuuuuuuuuuuuuuuaaugaugaggauggcuugcugaaauugguucucuucuugucuugugggcccuggguauugaacuucgguugucaggcuugguggcauguacuuuaaccucugugccaucuugccaguccuaaaaugacauuuccuaauaagcaaaacuauuucccuguguuacuuaguuucaagauaucuauaaagauaucuaugugauuugugccugagaaagcagcauuuauuuucaggugaacauuauuuguaauauuuuuacaaagacaagcaaagaauuuuaaggagggggaagaaacacauccccgcagaguugacagaagggaaagaggccagguccguuuuagaugucaguggguagguccuacacacauuuguucauucauuguccaaagauccacuaaaaccaccauaguuuuagcuccuguuaauuuccuaaugcuggauuuacaaagacaagccaugauuccugcccuaaggcggcaaauugccuguugguucuuuccuuuccuuccauccacccaccuaucuaccaauuuaucuaucuaucuaucuaucuaucuaucuaucuaucuaucuaucuaucuaucaaucaucuaucuaucuauuguguguguucauccauguguucaucugugucccuguacaucugugcagaagcauggaggugaaagaacaacuuucaggaguuuuuuccccauuaugaggguuuccgggaucuaacuuggggccuuaggcucgguggcagguauccuuauaugauaagcaucuuauacccuuauaugauaagcuaacucauacccuuauaugaugagcuaucucacccacuccugcuuguugguuauuaagugguuuuaacccucuguggugguagagauaaguggcacaguaucauggaaguacauaaggacaauaaguacauaaaggacaauaagaauuccugagauggggcaaagugccaccaugcaggguggguagcuuaauaagugaaagaagacauggcuuuuuauggaaguccaaguaaguugguugcugaagugugguuaagguagauggaaugagaagucggaccaggugaggauaggugauaacacagggccagaugauggaaaggcuuauuuggacuuuacccugaaugcuauggggaauacugaaugguauuaaauaagauauaaugcaguaagggaaagcucaugauguacaaaaucuauugacuugaguuugauuauggaacucauguuggaaaaagaacccagauggaugcuggagcaaguuucuguacuccaagcauucuuccagcaagaugggaggcagagacaagagaaucaaccaaagagcacauacacagugcaaacucaagaaacacugagagacccugccccaaacaagguagaaggagagaaucaacacccggaaaguuguucucagcaccccucccaucuccacacccacuuacacaagguuuaacaacauauacauccuaauuauauuugcauuugacauggcugaagaaaggguauguugcugaauuuaggggagacaagcuaggaaguuauagcacuaaccaaggcaaaauuuaagugauuuuuguuuguuaaagucaggaugaaagcaagggacaucuauucuugaggaaugcaaaauauagccuguagauguguuuauuuaagacaguuuuucaugcagcauuugggagguguauacaggagaaccaggaguuuugagaccauccuguccugugugagacccugucgguacaaaacagaacaacagaagaaccacucuuguuugcacagacagggucuauggcugacaguuuccagguuauuagcuugggcacuuaugugacugcgagcagugcuggggaagaggaggcaugguauuuguuugaggugccuuggggacagccagguuuagaugucuagaugggagcuggaucuaagauucugaaucccacaagaauggcuugacuugaauaugcugcucugaggucuuaacggauaagugcuuguaagcagguuggauguguuucuauaguaauggcaguugaggguuaggaagaaguggacaugaucacccugagaguguguagggcaagaagaggugugucuugcugaaaguggugccucacacuuguaaucugagcacuggggaggagagaggcgugucauuuggcuuguuuuugcuuuuggauauucuuucccauaaccuaucaaaucucacucuauucccacaaaacaaaacaaaacaagaacaacaccagagcccugguuacugcucuauauuugguuagugguaggaagaaaugagcuauaaaugguaguuuuauccagguaagguguucauaccuguauuuuuagcacaugggagguagaagcaggaggauuuggaguucagcaucaucuuuagcaauuugggaguuacaagauuuauuuuuuaaaauuauguguauuuguaugaguaucugcauguaaauguaagugucccagaggccagaagucauuagaucuccuggaguuggaauuguaggugguugugaguucccugaaguggauguuaggaacagagcucagguucucugaggguugguaauuuuuuaauuuauuuuuuaaaccauagaugcuucuuuucagccccuaaaacuuauuaaaauuuuaaaauuaguugucagggcuggagagauggagaccucagagcagcauauucaagucaagccauucuugugggauucagaaucuuagauccagcucccaucuagacaucuaaaccuggcuguccccaaggcaccuccaacaaauaccaugccuccucuuccccagcacugcucgcagugguuaagagccguggcuguacuaccugaagaccugaguucaauuuauccacccauaaggcggcuucaguuccagaucugacccccucuucugguucugugggccauccauauauaaaaaauacacagacagacuuguaugcaaacacccauucauguaaaauaaaaguaagucuuaagaugaaaugccuuuaguuuucacagcugugguagcauguacuguccuacacaguuuguaucgaaguuucuauguuagcucuggcuucacugccugccuuuaugugugacagagcauguuauauagcaggacugagugcuuugcauggaugguagcuuugggauuuaguuuauuccccuagauuuauaguguggauuacaugugagucugcccuggccaguacccagacuggaucaaagaaguagaauguauauuguuugauggucuugcugucccaggucuguucccaugugacuaggaauagacccagaggcuccugcugcugcuucagcucaggaaacagaaaaggugguuucucacguuuauuauuauuauuauuauuauuauuauuauuauuauuccccccugcucccccacuggcacucguaaauaacacuugguaacaagugacuggauucagagagauagaaccugcacauagagaagaugaacagagauuguauugucuggugagcugcuuaucuccugcacagggaagcuaauguggaagagugagauacgcuggcaugcuaucuaucguuuuggggaagauucuaauuguuguuggagucacugagucccaucagcuucaguuacuugaauuaccuaauguuugaugaaucagacuauaagucaaggcuuuaacugaaauucugcaaucacaguuaccuuguacaggugcugauaggcaaugcuucacacuuggguguguaguccaagcaccugucaggauccuuguucuucugugguuucauaauguguauagguucauaaauaaauccugcacaccuucuaccuaaccagccugguaguuaguggucuagaagggcgaguagaguagggucaacuuagauaaccauucuuugcucuucucuuggagcuuacucuuacucuuagacagugaaugaggcugguucagguaagguacucucugaaaaguguauagcaagcuuucaggucugugguuuccuuggcugcauagccagaccccacccauucccguaugagcuuggcucagauggcagcuucacgauacccuuaucugaucucccagcugaugcguucagccucugaaacuccaugccucucugucugcagcuucugucaccuucagcuuuuucccagcuuguucgguggcuauuaguuaaauacccucuccccacccucaguaagaaguuagugaggaugguauuuaucuugguaugugauguccuacuguagacggggaguugggggugggguggaaaccauauugaacauagagcuuggaggcuugaguguuggcuucuguggugacuagugugugacuagagacaaguuauuaaauguuacuaaaaauuaaauuucuguuuuaaguguauuguaauugguugaggguaugacucagugguagaaugcuuaccuaacauugaugaagaccugggcuaaaccuccccuccccgaaaaggaguauaguaauuaucccaaauaguuguagggagguuuaaccugagaaaacauguauggccuacuuuguaaauucuaaacuccuacacaaauauuuguuaguauauaccaaguccccaaguauuugaguaagauuugcauuagugaacacuuuuuccuguguaguuuucuuacuuaaugaagucugcaugguuuugcaaaugcucuagaugacuuucccccuguauuuuauuacuaaauuacccuguucuauggauuuggcaucuuccucaccucauguaguauaauauuaaaauaacauaagacauuugaucuguuucagcagguggaacauuauggcugacaugcaaaaucuuguagaaagauuggagagggcagugggccgccuggaggcagugucacauacuucagacaugcacuguggauauggagacagcccuucaaaagguaagccagacccaguggggugcucgcucugugugauccuggccuaguauuucuguccuggugaacuuucuucuuuggagcucaccucccagacuaauguagguagcucaucuccugcgaacagauaaggaaggaagugacuuggugcagaccucccugugguuaaguaauuuuaacacaagaacuuccugcuugugugauguuuccuguccuuucuuuagcagaaugacuagucauucugucagaugacaagugaaacuaguuuuuucucucuaagugauugggacaauuauccauuuugccuauacacuagccaaacauagaauguuagagaugaaagguaucuugaaggauuuucguguuuauuuucaauuuauagaugaagaacauuaagcccagagaguaaggaugucauggauucaguuagugaugggcuuagagacagagcccugcuguucgacuccugcucuaguuuucugugcacugggucucauuggcucuucugucuggggaccuggcucauuggguuaaguaagugcuugccguacaagcuugauggccugcccgaguucagauccacagaacccucuuaaugcugaacacaguagcaugugucuguaaucccagugcuccugugugcaaggacaggagaguccgggaaccucguggacuacguagccagguguguguaguggugaacaggaaggcaugcugucaaaguagaaggcaggaaggacugauaccugaaguuguccucugaugaccacguaagugccaguacacaucacucagugucucuuugauucuccuauugcguguguuugccuuccccaggagcaguuccauaugugcaagcauuugacucgcugcuugccaaucccguggcagaguacuugaagaugaguaaggagaucgggggagaugugcagaaacacguaaggacacgggggcccuuucuuucuccuccuauuuaaggacuggaagcuuuucuucacaucucuucacccucaucauaggggcguccgggagcccccugacuccuuuucuucuuccuuuauugguccaggaacagaaaugggguucauuuuucuaggucuccuguuuuauuacauauucuguguguuucuuuuaugacaaagcuuguuuggucauaaaauacaacuguguucaucuuugugguggagaagguccuggcagucuuaucuuaauguuauguaaccaaguggaggguggcuuauucaaaagaaucacuuucgugacuuagcaccuauaaaccgaggaugguaguuauuaguuaugcuaauauggauuacuuucacauuuagccccugcgagaaugagguaggcaaugacagaugccuguccucccacuucccuucaugcucugccuccuacacugucaccaccaccugcaucccacacucacugacacucugcaucucuucuggagcccagcacggaaugaucauuuauaaacaguaaccauauuuaggcucuuucuaacugacccugagccccuuauacacuagccguuggcagugucugagagguggggacucuguggagcacugggacuuuccauugguaggggaauggugguauauuuuuuacuucagacaauuguauaacauuugaaaaagaauuuaagcaaccuuuaaaaaaauucuauaugucuguguguuuucccugcaugcauguccauauaccaguugugugcauggugcccagagaggccagaagaggacauugaauccccuagaaguagaguuacagauggugugagccaugaugggugaugagaaccaacucugagucccguggaagaacagcuuguguucuuaacugcugagcccucuccagccccccgaaaaaguuuuuuaaacauaugucacuuuuaucucugaaaguacaagucuagcugcagugugguagcuccugccugucauuuuagucuugggagacuauggccugaggaugucacacauuuaagauccugucucaaaacaucuaaaaauaaaauaaggagcuggagagaugcucuugcagaugucuugagcucucuucccagcacccacuucaggugcuucauggcuccaguucaggggaucugacacccucugcuggccuaaacuggcauaugcacagagauacuugaauaaaaauaaaaguaaauuuaagcaaauuuuacuugggccugggcuacacuuauuaccucagugguagaauauuuuuuguaccauucaaaagccuuggauucuaucccuaguaccucaacaaacaaacaacccccacccccagcaaaaauccaaacagauagaucccaaaaguacuucaucugaacucacuaacuugccuucaccuaagaugggcuaucuucauuuucaguucuggcuauuuguccuugacaguuccaacaggaacgauagugaaugugauucugguaucagucccugaacucuggaaugcacgagucagacaacauggagggcuuguggauguguaaguuucagguuauccuuaaugucaugugucauggacagcagauuguuuuuuccugcaggcggagaugguccacacaggccugaaguuggagcgagcucuccuggcuacagcuucucagugccagcagccagcugguguaaguuuacuagauaguugcgcuugcucugaugcucagaaauuuccaagaggcugucacagcgugcuacaauaacacacagcaguguacagacauaaaagcacucaagugccccaugggacugugccuuggguaguuaccaguccccaaugacuuuuuguuuucugucauuuuguucauuacuuuaguugccccugggaugucgcugcuucugucaggcagcuuugguguuugacagguggcacagcugugguggggauccuaagccuuugauacugggacugccuucaucccuuacccucccuuuagcuugacucuuauuucaacauuuucugcuaucugcuauggaaaguuaaguuagagaaaugagaacuuucuuagaaggaaagauuauuaacuugucuuagguuuucuugaucacagaagaugcuaaaacaagucuuccugcuaaggcugaaauaaauaaaauccuugauccuugucaugccuaagucuguggaaacaaugcagauaauuuaaauaucugucuugagugacgagaguguuguaucucugucuucucuccaaguucauacuucccuagaugaauaaaauagcugagacacugucauauuuuagacuaagguuagcaaaaccacagacuauaggcugauuuccuccaguguauggaaaugaaguuuuuugggggaacaaauauucacugauuaguacuuuagagaaguuuucacacuucucguuagacugugcacacaggaccugagaacugacaugguuaggaaaccuaguuuugaagggaggaucaaaaagugggaacacaaggcacauccauuuugcucaguggcuuugaauggcagcaucacggacugcauuugaaucaccagaucucuacuaagcagcugcuguguggcucagggugcauugaggacaaaggagaacugagacaaagcucuggccuuugaaaaguuaacagaaaaacaagcacuagguuugguaguauaccuuuaauccuagcauuugggaaguggagagagaaaucaggaggcguuaaagucauccucggcuacauacacagcagccuggacugcaugagagagacccugucuuacagagaaacaagggaaaggaaggacauaugugggucuggggauaguuugcaguguuguaugguaagguaucgagauggguuauauugacauaugauacagaagcuguggcagcugggguaaaaaagcugccacaugaagcuaaaagcuaaaagcucaugaaguuauuuagauaaguggagaaagagcauaaggaacaaaaauaagcuguaucuucuauuggugagucagaaaagagacaagugguuugaauggagggaggggcuuuucaaauacagaauauagguuuuaagcacaaagucucucuugaggacuugaaacuuuaugcagaggaaggauaugagcaguaucuuagucaugugagucauggugagucauggugggguggauacaaaguuuaccuagguguucauuauaggccauaacaaauucucccauugccaugcuuuggguacaugguuauaauuucaacacuugggagccgaggcaggaguauucuggauucuagacuacauagaauauugucccuauaaacugaagagggggaaucacuugccuucagagucaacaguuggucugcauauauagaaauacuauuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaaaaaaaaaaaaaaaaagaaauacuaaccauaguuguuucccaucucuccuagaauaaacuuucugauuuguuggcaccuaucucggagcagauccaagaaguuauaaccuuccgggagaagaaccgaggcagcaaguuuuuuaaucaucuaucugcugucagugaaagcauccaggccuugggcuggguggcucugguaagacggaggggaggauguaagcagggaaggagguauggcugcagagacuaugugucacuggcugcuucuuccucuacaggcugcgaaaccuggccccuuugugaaagagaugaaugacgcggccauguuuuacacaaaucguguccucaaggaguacagagaugugugagucuagccuuuccccagggggcaggacaaauguagaugucaccuccuggagugaccucuguguuggucuucucacuucaaggcuguuucguggaaacuugguagaucucaucucauagaaacugcauuugcaagcaggaaauauuucugcuuccauuucuuuuuuuuuuuuuuuuuaaagauuuauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagccccuccauuuugacucugaaugcuaggugcucuuuaguuuccccgcccagguuaagggggucauguuagagguaaaauggauuaauacuuuugaaguuucuuuuaaaaaauuacuguauuauuauuauuauuauuauuauuauuauguguaagguuuuuuauuuuuuggcuuggguguaaaucuaugcacugugucacuccucuggaacuggaguuauagaucuugugagaugccaugugagugcuaggaauugacacagggucccccugaaagagcagcuacugcucuuaucuauguagccaucucuccagauuuuuaaguugcuuguuuguaucagauuuuguucuucuguugcugugucucaacagugcuaugacaaaggggucagucggacuuaaugaaguaaagugccuuguauauucauguguucagguaaacugacaggcugccuagccaggaccuguaugaagaaagggagucuuuguguucuauccacauaaucaugcuaguccuaaaugacuucucuauugcuaauuuugaauuggagugacuacaguuacuuagcuguauaacucuccagacaucauuagucagcagacauuugaugaagcuguguaagaaauaagccuucauuuguguguaaugugucccacaccaccacacacuuuuaaaaauccuucuagaugccuggaauuacucagacccucuuuggaauuuacccuaucauuuauagcugaagaaauuaggccuugggcuaaguaaucacagaaccuuccagcuaacguuuacaaagagaaggauuagucuacuuacaaugcaauguaccuucuauaacaaaugcugauuguugaccccccaaucucucucuuucuuuuuuuguuuguuuauauuuguuuuuugagacaguguuucucuguguguagcccuggcuguccuggaacuccaucuguagaccaggcuggcuuucagucuaccugcuucugucuccugagugcugggauaaggcaugugccacuauugcacagcugaugguuuucucuuaaagaaacacuuuuaguugggagcauauuuugacacaaggcacugggcucauggagucccucaaucccauggcaaugcuucacuaaucuugguuuuacuguggcuuccuacacaaauguuuuuaacaacuuugcuguuagguucugcuuaugguguauuuuggaaaaacaaaaaauugguccuaacaaaaacauugauaaacacugcugucaaaaauaaacauguaauccaauguccaugcucugcuggaguuuggucuaauuagaguaagacgguaagauguuuguuuguuuguuugcuuguuuauuuguuuugaggcacggucugucuucauagcccuggcuguccuggaacucccucuguagaucagguugggcuggccucgaacucagagauccacuuccucuaccuccaagcacuggaaucaaggugugcaccaccauggccagcuuggucucuucuuuaaaaaaacaucacuaaugagauagagagauggcuaagcaguuaugagccucacugcuucuauagaggacccugcuuugauucccaacagccacaagcaucuauaacuccaguucggggauccaacacccuacccuggccuccucagacaucagacaaacacauggcauauagauauacuuguaggcaaaacacccauacacauaaacuaauuaaaaagauauuuuugaugcuagggaagcugccacugagcagagccuaggaaaugccacagcaggaggaugugagccaaugggcaggauggguucuggaguuaguaccauacucaaauucuuaauuuuugcagggauaagaagcauguggacugggucagagcuuacuugaguauauggacggagcugcaggcuuacaucaaggaguuucauacuacuggccuggccuggagcaagacgguuaguguguuuuccuucucucccucuuccucucuccaggauaggagacuuaaaucaccaaggccagaaaaggaaugcuguggagauagaugguccagcauuuaagagcucuggcugaccugguuuaauuccugugcccacagggcagcucacaauugucuauaacuccaacacucucuucuguccuccuuaauuaccaggugcaccugugggacacaggcaugcauguaggcaaaauacuuacacacauuaaaauaagaguaaguuauaaagucaauuuuaaaaauacaaagacagaucccuauuauaaauuaacaaguuaaaugcuauaauaaauacacaguccacagcaaauaaagaacaauacagagguuaaggaguguaugacuauauucuugcauuucugcucaggggccuguggcaaaagaacugaguggauugccaucuggacccucugugggaucaggcccaccuccucccccaccgggcccgccuccucccccaaucucuaccaguucugguucugacgacucugcaucacgcucagcacuguuugcacagauuaaucagggggaaagcaucacacauggugaguauuuuggcaugggcaguuguuaaagcaaaugauuccauuagauuucaucaaccagacacuagucuaaaccagaacccuggcuugcauguggcaacauucauuugggggugucuaaagggacaucaaacuuaaguuuggugacugacaggccagugagauagcucaguagauaaaaagauguuuguaggccaagccuuguagucucugaguucaggcccuggaagccacaaaaaaugaagaaaaacugacuacugcuuugucuguccucucacaggauaggcacaugcacacuagcaugaguuccuccuaucuacaauaauaacuuucaggaaagggcagcuggcucaguggguaaaggugcauaccaccaagccugauugaugauuugaguuugacccccgaaaccaaguugguggaaggagagauccagcuccugcaaguuguccccugacuacucucuccgcccuacaauaaauucauaacuaaguacguaacuuuaagaaguagacauugaacauggguaaugacagugaagucauuaaguaguauguacagggcaccuuauuagccagcucacagugcugcaguuuuccuggagcccgugguacaguuccacauggucucugaagucauuguguugggaugcuaacuucucaggauguauacuugucacaugggaaguuugccaaauagggacccaccauuacagaaaaagucggcacuucuauaccucacuaguggaauucuuacuugacuuauugacuaagaauguacccuguuauuuauaguagccaguagugguguacuuagagaaauauucagcauuaagggaaauggcuguuagcuguaugaguagagccuaggugacagaagagauccaguaaauaaccucuuccccaugcuccuguaaguuucaugccugaugaaacucacugucucacacagagacaugaaguagcaggggacuuguugggggaggaaggggagcaagagaagguaauggggugaagaugaacaaacacauucuauccguguaugaagaaugacagcggagcacagcgguguguguaauuaauacaugcuaagagaaagguaggaaacggcaagugccaacacgugguuaggagggcuagcuuucuuuccacugaauuuucacugugauguacuuuccccuuucuauuaucacauacauucuguguguauauauuacauaccuuucuagauguauuuuugugcauuuacauauccuugcuccuuccucaccuucaacacauacauuuuuuuuuuuuaaauaaaacuauauaacuuagaggacaagugaaaccauaaaagcaguucuccaaagguuugcaagauggucucucaagagcuugaguucuugcuuugaaguuucugcuaaggacuaguaauagcagaccuuguuuauugccucagcccgaagcucugguaugaagagcaggaacgagguagcugugguguguucuuacagcccugaaacauguaucugaugacaugaagacucacaagaacccugcccugaaagcucagagugguccaguucggaguggccccaaaccauucucugcaccuaaaccccaaacuagccccucccccaaaccagccacaaagaaggaaccagcucugcuggaacuggaaggcaagaaauggagaguggugaguuaaagcagccugacuccgggaagggacuaggaagaaggcuuucagcagagcuuagcugaagagugcgggggucuggcucuuggugggagaacaaagguuugggaugaugugaccuuugugguaagaauccugggugugucuucaucaggaaaaccaggagaauguuuccaaccuggugaucgaugacacugagcugaagcagguggcuuacaucuacaagugugucaacacaacauugcaaaucaagggcaaaauuaacuccauuacaguaggugagucccccuugcugcccuaggcagguucugaccugcagccggagaggguuagagccucuucccacaucuuuguaaauucuuacaccacuuagccuuuucagucccacugcugaccugcuuccuuucuucuagauaacuguaagaagcuuggccugguguuugaugacguggugggcauuguggagauaaucaauaguagggaugucaaaguucagguaacuugaugucuuggcuucuccuuuuggucccugaagaauuaauugagagagacacagcagacucgcagauguuccuugggcaggaaucugauucuccaaagccuguaagcugagcuacuuuggauguggcagaaguuggcucuuuaagggagcucuuuccaggaccuagcccagcccauccccaguuuguaauauuggugugcacugggggcuuuugugaaguaguguaaucacuuaaaacggugaauauucugcagcuuagucugcucauacgugcuggaacucaguuuuuuuuuuuuguuuuuuuguuuuuuuuuucugcaggugaugggaaaagugccaaccauuuccauuaacaaaacagauggcugccaugcuuaccugagcaagaacucccuggacugugagauagucagugccaaaucuucugagaugaauguccucauuccuaccgaaggcggugauuuuguaaguuuucuuccuuuccuauccuuccuuccacagugucucuuguaucccaggcuggccuggagcucauuggugauucuccugccucugccuccuaagugcugagauauagccauguagcccaggauugcuucuuugcuguuggagauugaacccaggacuugugcaugcuaggcaagcauucuucccacuaagcuauaucccugaggaauaugacauuauaaacagaauaaucugggacuguugauauacaccuguauuccauauagggucuuaccacauaacccggguaggccucaaacucagaaaucuuccuacucugucucagacaacugaaacaggacugaauacuuauugaauuagagaaaacuauuugguggauauuggcauuuuguagguaaaucucaacaauacauauagaagccagguaguccaugaagggagcuccagagggagggagggagggagggagggucauuccugccuuucauaguucaguaagaauaagacuaaccccccaaaucaggcuguugucuagagcuaagucuguccaggaccacagaucucucaacagugaacagugcacagugcaagcagcauggcugggagguuaagcuugucucacuccuaugugugcccgguuaccugggacuggaauuacaaaugguucugagccacuacaugaguagcucaaguuaagagcaagugcucuuuuuuuuuucaauuuaauuuaauuuaauuaauuaauuuauuuuuuacuuuuuaauauuuuuuuauuacguauuuuccucaauuacauuuccaaugcuaucccaaaagucccccauacccucccccccacuucccuacccacccauucccauuuucuuggcccuggcguuccccuguaccagggcauauaaaguuuguguguccaaugggccucucuuuccagugauggccgacuaggccaucuuuugauacuuaugcagcuagagucaagagcuccgggguacugguuaguucauaauguuguuccaccuauaggguugcagaucccuuuagcuccuuggguacuuucuguagcuccuccauugggagcccugugauccauccaccaacugacugugaucauccacuucuguguuggcuaggccccggcauagucucacaagagacagcucuaucuggguccuuucagcaaaaucuugcuaguguaugcaauggugucagcguuuggaagcugauuaugggguggaucccuggauaugccagucucuagaugguccauccuuucgucacagcuccaaauuuugucucuguaacuccuuccauggguguuuuguucccaauucuaagaaggggcacaguguccacacuuuggucuucauucuucuugaguuucaugcguuuagcagauuauaucuuauaucuuggguauccuaaguuuugggcuaauauccacuuaccagugaguacauacugugugaguuccuuugugaauggguuaccucacucaggaugaugcccuccagguccauccauuuggcuaggaauuucauaugugaguacaccgucacucucuucagacacaccagaagagggcaucagaucccauuacagaugguugugagcuaccaugugguugcugagaauugaacucaggaagagcagucagugaucuuaaccacugagucaucucuccagccccaucauccuguuacuuccuuuuugcagaacgaguucccaguccccgagcaguucaagacccuguggaacggacagaaguuggucaccacagugacagaaaucgcuggauaagcaaauacauggguccugugcccucucccuucacaccaugggauacaucuguauggagacgguucuuuucuagauuuccucuaccuuucugcucuuaaacugcuucucugcucugagaagcccagcuaccugccuucacugaaauauaccucaggcugagacgggcgggacagcaggucaguggaucuucaccggaaggugcagcuucucggcaucagcgcagcugcaccacaggcugagcuuacagagcuucaggcccagacuggggcaccgaagcuuucagcuuugggggucauucuaccaacaaucagucccugaggguucacaacacccuggaaccaaacaucagaaugcacacuauucuccuaacagugagcauggggggcaggagccagggagucuauuagguucuaaccaaccuaguuuucauuguugacaagugaggccaggcuuccacucgaccaaaagcuaaggauugccacccagcauuccaagcagacuuguuuccuaaaagcauccuucaucugcauuccauccugggucagcaucaaccacaacauagcaggcauucccuugcagcugcaguacaguagcaguguccuuuucugaggaaggaagucuuaaacccuuuccccccacccccugggaugacugccuugauucccauggggaacaacuuuaaagaaaaccaccacagcauuccaaggagucuggcguuccuccucccugccagaugacugucauugccuccacucacccuucugcuugucacucggcagcuuagggccucugcgcaggaaccugacuaggacuaugaccuccacggcggcuguuuaggucucgacuuacaucagaaucuugcacagcauugcaaaaucccagugcucccucuaggacacacugaccaaaauaugcaaccuuuccuuuccuauuuuuuuuuuuuuuuuuuuuuuuuuuuggugggaaaagaggaagaaagauuguccugugacuucugcccauuaccugaggccuguggaaauaaaccuuuauguacuuaaaauuauacagaaaauagaauaaaguuaauaccaaacuuguuuaguuauucaccugauguuuucaguacagagaugugaaaauacugaaaaugauaccaaguauaagaaacuacucuuuauuauuuuuaaagacaaucucaaaacuauuuuuagauccucccacuuccugcccuuaacccucauccuuuuauuugaguagguuugagaaaggaaaaggaaaaacaggcagugggugaauucuguggugcuaauggugcuuucaugaaaacagucauuucuccaaacccgugcucuagaggacccaucuagaacaugcugagaucucagcaugggcacuagggaguccaugcucaacuguaggaaaugggggaucagggugguuucuucuuuaacaaucaaaguuaucaucuguuuaauaggagggaaaagaagucuacaauauuccccaaucauuuucuugaggaaucaaaucagcagcaguuugauguaugcugguaaauaggauguaggguaggaaugccaaagccccaccuuuuuagacuauuucucccguucuuugcaauggugugacauuuaugccacuuauaauauuaagggcaagaacagacaccugguuuucacuucuauacucccucacuaucucauaguauauaagacacacauugcuguaggcuguggugaugcaugccuuuaaucccuguacuugaaaggcagagggggcaggugaucucugugacugugaguucaagaccagucugcucuacauagugaauuccaggccagcuaggguuacaaagugagugaaacccugucucaaagaagagaagagaagagaagguccauuuccuuuccuaagcaacccugcuggcaguuccccccugugugacuaauucuguuacugaggauuaaggauacaaggugagcucugaaggggacgugaugguaggcuuguggggugacugcuagguaccucuagagggcaacacuuacacaggaaaacagucuuaagaaaugauggggaaacaucaugcacggcccacacagcagugcagagaaauugcuugugugaacaucucagaccugggcuuuuauuugcuccaaauuuguauggguuuugcccucagagcuugucucuuuuucacuucugucucuuuuaggcacaauuacugaucugcaacaacagacucccauuucuuaaacgggagcuugaccauaucacaaaguuguaaaacaaucuccaugguuauuagcuaauuaaacuugaauccaacaccauauggugauagcaggcggcaaaggauaagauugagaucuuagaucuuuccaaguaggguauguuagaugauaagaggagagaagggcugguugcaggcuagauuagaguucagggcugagcaugaacuauguacauggcuuggaagagcugugguuucaugaacucugcuauaaagugccagggcuucacuuaagaaaagguaugaugugggcaguaaaccauucuuuagauauuugaagaugguccccuuccuuagccagaaacacuagcuuuccugcuuuguccauuuucuuuagccccaggcgguccuguagagagaaaggacauaaugaauccaagaggcuuacugaagguuuuagacuaacccaguagaauauuaacaauuacucucaagauacacacuuucccuucaguauuaaacuagagguacacgguuaaaaaagaugacacccccuuucagaucuucguuuuguuuguuuuugagacagggucuugcuuugcagcucuagcuggccucgaaauuguagcaauccugccuuagacucgagugccaggauuauaagcauguuuuaaacugguuccuucaguuugcuucuaagcaauagauuuacaugugcaaggccaacauugugucaggccccuuuaauuccaccauuugggaggcagaggcugguggaucucugugguuucaaggcuagccaggacauucaggggcuacaugcuaucuuuuuuaaaaaaagaaaaauacuguugaauuguucuacuuauguucugccucaucccacccccucaacuccagcaagaugcuagaagucaacccagggccugcuccugagcuguaccccagugccuauaagucagcuuccugaaaagcagcggggcaagcaaaacuggcacacaacaucauagugaacaagagcugagccaaagucaggagaaaauaauguuuaauauccaacauagcugauucuuaggauaaugaacuugggauguguuagaaucuuacagugucaucccccaguagccaaggugucaggcuuuugcugagaagagaagaucuagcaugcaaggacagugccacuucuugacuacccuggguuugaauuucaugauaaggaagaucuuggcuguaauuuccaaagcugccagaaccuagcuucccuuuauuucuauuucauccaaaccaggacaccacacacaugaaaaaaaacaaaaaccaaaccaaaccaaaaauguggaggaaagcgcaccucugaaauuggggcaggggggcuguaauaaaaggugguuucgauaugguacuugggcauuuguguguccaucuccaguuuauggcaagcaauaacugcauguggugagacacugcaacuucugcuugagauacaggaccuacugcuagacaggaugccugacagcccccguugagagacuggcgaaggaguuuccccuugucaaugcagauugacagguuuacucuuggugcuggggcacaaaccccagucauccuguaugcuaagcucauuucuaccacugaggcauacccuuagacugccagaauccacaccucauggcugccaugacauaaaaccucgcccaugucugcauuuacuuaggggcuucugggaguuguaguaaacaacucgcaagggaagcuaguuccaaaccuuuucuuccaaaguaaaaccucagaguugauguuucucuuguguguuuaaaaaccaugagcaagaggucuuaggaucuaguaccuauguagaaaucagcacccaggaaguuggugugaaaacagccuacuaugaccuuaguuagacagcuuguaagcucuuagugcucuaggacagacaaggcaggagucuagcuccaugaaacacagcagcuccaggaaccaggguggagagaaauaguuucaaccucccacagcagaucugucccuccguuaccucuguguauagagugcucuccuggaggggaaugguuuccuuagcuuggccacuucuguaaaauccaaaccacuucaggagagaaggaagaaagccaggucagaucaugcacccagcacacuugcaaaaaucauuugaggcuagcuaguaccuaaaacuaccagcaaaaugaacauuguaauagaucugacagcaagcaagaaggaagaaugggaaggggguuuuugguuuaggugaccuggaacucacuuguguagccuagguugguuuuga

SEQ ID NO: 2099 - RNA, 38374 nt, Mus musculus
ugcucagaugccuucaagauggcggcugcggcugcugcacgagcaguuccugugagcucuggauuccgaggccugcggcgaacacugccacuuguagugauucucggggcuacugggacuggcaaguccacccuggcucugcaguuaggccagcggcucggcggcgagaucgucagcgccgacuccaugcagguauggcagcgugcuuggcccgggggccugggaacccuggaggucgcgugcgggccucuggacuaggggacacccugucgcguggcuguagugggugaaccucgaggcguauggggauccagaugaaaggaacccacaccugcuagguacccauuccaauggcagacaguguccauuguguccugugaucgcuaaguaacuucucaggccauuacucuuucguagauaguaccaacaguuucauuuauggauaaaaauguugggggcuggggaggugaagugaccuugugcguggcacauugcaaauaaauggaggagagauaguggaacguuuaagguugacauccggugaauuucaguaaguuaauuauucccaaauuuugccauaauucuaauucuagcccaagguaagucagaugccaccugugagugucuucuugggcacuagagcagucagaggcagccacuggcuucgugacuucagaucaacagugcccuuuacuugaauauuauauuuguaaaguggaggaaaugucauuugccccacaaucacaaggcuaaaguauuuaauaagugagacauuggaguguuacaguggagagagggaggccagcucgaaggucagacauugugguaaauauuggcugaaccugagggcuuuuuuguuuauuuguuuuuguuuuuuaauccuuuuguccucuuugcgagaggacuuucggggauguaggagcauuugagcuagagaguaggugacauuuugggugaaugugagaagaauuacaacagcuguuaggcauguucaaaggugucgaacauauacaaccagucgcagaacucaugguuaguaaccuaaaauuaguaauuaauucuuugccccacuuuaccucauaaggcuccugacauuguuucuacccucauaauuuauuuuuccaugauaagaucaucagcuuauacuaaaagguaagguaauguaacaaauaguuguuugcagccugcuuugugccagcuuagggagauaaagaguuuagcuugaacugaaucucagccagauuuuuuuucccccaacuuuuugcuacaugaacaaagauaccuuuguuccuuugcuaaaauaggaagaauauaaaaaacaaccuugugaucauuaaaugaaauauaugugaagcacuuauuacaaguguuuaaaaaauauguuaacagugaaaacuauggugacuguguguguguguguauauguacauuagaccaaacuccuuauauuggggaauguuagucuggcuaaacauagaguaagacagagcuaauaagugaacagagcuacuuauagagcauuuucaggugggcggguucagaagaucagaagagacuacaagugcuggauuucgugauagacuauuaaauuugguagaauucuugagaagggagaaaucaaugaaugucauggaaagucucuaaagaagugccuaggcuggggagacccugacccugaccucucuggccucuacauacaugucuguauguacacacacacacacaaauacaaauugaaaaacaaauaggucaguaugaauuauaaaagaagagcuuaaaauugggcaaagugucauacgcugugaucuucacucuuuuuggaagcugaggcaagaggacaaccuugggugucacuacuuaggugcagcucaccauuuugucuguuucugagaaucccaaucuguuuugagaaggacagaaucugcuucucccagcaccgaccucccacauucccaucuacugaguccgaguagcacugccugcgugaggguggccacaacccgucacuccccucccccagcagccagaagcugcugaucucaccucagcuaggguuggagccucaggcuuucuccuccauccgcaacagaauuucgacugcacugaucugaugcagguccaccgaguccaugucauguucagaagacagcaugaagcauucguuuucauacucaguuccuccuucccucccucccucccucccucccucccucccucccucccuuccuuucgacuuuuauguguaugaauguugugccugcauguauaucggcacaccacaagcaugcagugacuguggaagcuagaagagggagucagauccccuggaacugaaguuagagauagcugugagccaccacaugggugcugggaauugaaccuggauccucugaaagagcagccagugcucuuaaccacugggccaugucaugucucuucagcuccauccuucagcucuuaacugucuuucugccccaccccgaccccuauguucccugagccuuguggggguugguacagaugucuuguacagagcucagcauuuaacaauuauucuuagcucuuggaccaguuccucuuaagucccugcauugacugguucccacugcaggaacaagcggucucugaccaagcuugaggacugcauaaguuuauagagugaguuggcuggcacagcugccugcugaaaagugaaguucuuagaacccucuggcucuaguaggcucuguuugcuacuuugaaaggaggggcaagugggagccguugguuucugcagccucuguuuucugggcucucgcuuguggggaagggaggcucugaguccuuuucuauagcucucucaagucccugcacuccaccauggcuucuucugguucuuggguguaugcaggcacauucagaauuguacauugugacuagaauuugaggguaaaauuucuuuuauccuugauaaucauuaauauaugaaaaacauagaaaauuuuuuugaacuuucugaacuguguuuaauuuuagauuguguuuaauuuuagauguuuauaacauuucccuuugcucucaauuggagaucuuugaucuuugauauuuuuuuuaacuuuugagugcaauaaaauauccauguccuguugccugaauacauagguacacccaguucuucauuucugucuuugcucaccauugugcacugcugcaacuagagcucauuuuuagccagugggaggaggagaagcuuuucauuguuauuauuuugucuuuugaaacagagucuccuugcuguguagcccaggcuggcccugaacucacagucuugccugcugcagcuucucaaauggagauucuacuuuuaaaagaaagauuuauuuuuauuuuauguuaaguauguauguauguacauauguauauuuugugugugguugcuugcauguauacauguacaccaugagcaugcagugccuugcagaggccagaagagggaauuggauccccuggaacuggaaugauaaaugguugugagccaccauguguugggaacugaacuugggucuucugcuagagaaaagugcucgucaccucugagccacauuguacccuggagguacuacuuuucagugauuuaacagaaaauauuuucuaaauauguaaacaagaugucuuuuugaagacaagaugucaaguggccagggcuacuuucaaacucaguauauaacugaacuccaaacuugucaccuucuugccuucucccccuaagcgcuggggcuguggguaugugcuagcgcaccucgcuuuaugcuccuuauuuaauuuuaauuuuuauuuuuuucaagauaguguuucucuuguguagcccuggcuguacuggaacucucucuguagaccagguuggacucagacucagacaugucugccucugccucucaagugcugggauuaaaggugugugccaccacugccuagcaaauuuauacuuuuuaaaaaaaaauuaaauuauuauuauuauuauuuuggguauaugaguguuuuggcuacauguauugaugaugaugaugauuauuauuauuuuggugguugcuguguuguuuuguuuuuugagacaguuucucuguguagcccuggcugucuuagaacucauuuuauagagcagguuggccuugcacucauauaaaucugccugcuucucgguccugagugcuaggacuacccugcgugcauguuugcaccaguugcagucugcuguuuguggagaacagaagaggggauuggaucccuuaggacugaaguaacaguuguuuaugagccagcaaguaagcucugggcaucaaggccagguccucagcagcaauagccagugcucuuaaccacugagccauugcuucagcuccuaggcuuuauuuaaauaaaaaaaauauuguauguguaauaauuguguuuaugaguguuugauguguggggaugcccgaggaagcaagagggggcuucagauucuccagcgcuggaguucuaggugguggugagcugccugccacgugggugcugagggcugagggcucagcugcuagagcggcaguaagugcuugugacugaugugccaccuugagucccuaacgcuccuuucaaaucuucacacuaagcugcauaaaguagauaguacuuaacaguucaggaaauacgccgaagaucuguacaucucuuauugaacauauuucucuccuuuuauuguuuuuuuguuuuuucgagacaggguuucucuguguagcccuggcuguccuggaacucacuuuuguagaccagucuggccuugaacucagaaaucugccugccucagucucccgagugcugggauuaaagaugugcgccaccacgcccggcuauuucucuccuuuuaugucuagugauuuuccucuuuaggugaggcaagagcuguaggauucugucaccgagaguguuucuuagccuguauuccacucaucccucaugggaauaugcuacacuuugaucaggaucuaaaauguaccuuuuaagauguaaaagaugaagccugguuaagcaguauacaacugcauuaacgcuugggcagugggagaggcagaaggaccagaaguucaagccauucccagcuauauagugaguuugaggccagggcuacaugagcuucuggcucagggccacugagaugguucaguaguaacagugccugacgccaagcuuggggcccugaguuugaucccuggcaccagcauggugguaggaaggcccugacuucugaaacuuguccucugaccuccguacacauucuguggcuuaugugagcuccccucccccauaaauacaguuuuuaaaaagucaccagaaaugagauuuauggugucauggugugucagauggaguuuugagcagaccaguggccaccggcuguaucauuagaggcuaaaacuugauauagcuaagaaauagaauuuaucaucaaguugauacucaagauggauguuuauugagacaaaagaggagcucaggccugugaggaauccagacuacuggagacuuacuucuuaacagccacagaugaaagggagaugaguagagagugguaauuagaagggcuuuucaaguuuucaagaugaguguuaauuuauuuuuauugguuuauauuuugagauggggucugguuauauuaucgaggcuaauuuuaaauucaugggcacaagcgauccuucaccucagccucccaaguagcuagacucuuugacuauuauguuuacauuuuaagacuuauuuauuauuauauauaaaguacacuguagcuguccucagacucaccagaagagggugucagcucucauuauggaugguugugagccaccauuuuguugcugggauuugaacucaggaccucuagaagagcagucagugcucuuaaccacugagccaucucuccagcccuuauguuuacauuuuaauacuucauuuagaggugcucuuuggauguuuauauucagaaauguaccaguaacucaaccaaauuguaaaauuguguuccacauaagcauagauuauugugugugugugugugugggggugcauguuguggaacucacucuguagacuagucugaccucaaacucacagagguccuccugccucuugucuccuaagugcuggaauuaauagcaugugccuuccacuuaauuauuaauuauuauaguaaggauuuguuuguuucgagacaggguuucuuuauauaacagcccuggcuauccuggaacuugcucuguaaacucagagauccucaugccucugccuccccgugcugggacuaaaggugugcugccaccacccagcuagcugcucgcuuccucccucccucccucccucccucccucccucccucccucccucccucccucccuuccucccuucuuuccuuccuuucuuuaauauguaaguguaccaugagcaugcagugccuguagaggucagaagagggcacugcauccccucuaggggguccuagaacuggaguugcagacaguugugagccaccuugugggugcugggaaacaaacccaaguucucuguaagagaagcaaauguuuuuaaccaccaagccaaaucucuggacucuuuuauuuuuuuuuuuaagacaguuuucagugaaccugcagcuugcugauauuugcuaggcugacccuaccugauccaucccacccaguguugggguuauagauguguucuguuccauuggccuuuacaugggugucagggaucugaacucaggaccgcauaauugcauagcaagcacuuguaaucacugagccauuuccccaucccuuguucuuccagagguccugaguucaauuccuugcaaucacaugguggcucacaaccaucuguaaugagaucugaugcacucuuaugguguaggucugaagucagcuacaguguacucauaugaauaaaaauaaauuuuauacacacacacacauacacacacacacacacacacauguugucuuaggucagcuuuccuucuauccccuuuccuuccacagggucucauaacccaaacugucuuuauucccuuaaucuuucuuccuugaacuccuagcggggugucugaagugcgagaucacagugccacuaaaccuagcuagauguuuucuuuuuuccuuccuuaguuuauuccuuccuuccuuucuuaauggugguaaggacugagcucagcaugcaguuaucuugccuguuguacuucuucugcuacucuuuguccuaacuuaaccauagggucuauccuagguaaauuuuugucaauuugacauaagcuagaaucauuugggaugagggaaccucuauucauaaaacgaaucccaccagcuuagccugagaugcauuuucaugaucggcgagagagggcccaacucacugugggcagugcugucugagggcuaggucuuaggugguauaagaaagcaagcugagcaagcaacagggagcaagcuaguaagcagcauuccuccauggccucugcagcagucucugccucuaaguuccuguuuugacuucccucagugucuuagucaggguuucuaucccugcacaaacaucaugaccaagaagcaaguuggggaggaaaggguuuauuuggcuuacacuuccauacugcuguucaucaccaaaggaugcaggacuggaacucaagcaggucaggaagcaggagcugaugcagaggccauggagggauguuccuuacuagcuugccucaccuggcuugcucagccugcucucuuauagaacccaagacuaccagcccagagauggucccacccacaaggggccauucccccuugaucacuaauugagaaaaugucuuacaguuggaucucauggaggcauugucucaacugaagcuccuuucucugugauaaccccagcugugucaaguugacacaaaacuagccaguacacucagugauagaguuugacaugaaaguugcaaguugcaauaaaccuucuccucuccaaguugcuuuuagucaggugcuuuaucacagcaguagaaacccuaacuaggacacagugauuccauggcaaccuuuacaaggcacuaacuuuucuaggaaauacuuuuuuuuuuuuuuuuuuuuuuuaaagauuuuauuuauugauuauauguaaguacacuguagcugucuucagacacuccagaagagggagucagaucuuguuacggaugguugugagccaccaugugguugcugggauuugaacuccugaccuuuggaagaacagucgggugcucuuacccacugagccaucucaccagccccggaaauacuuuuuugauaagcauugaauaucuuuuaauggcaccgcucaugccuguaauccuugcacuugagcugagguaggaggauucccaugaguaugaggcuaccucggcagaaaaaggaagggagggagggagagaagugaguguuaaauuuaagcacugaggugaaauaacaugcacaggucugaaguggggauuuuucucuugggagccuaauaaacaaugaccugagugucuagcaucagagcaucagagcagcuccuuucaggcuuccuguccuggggauuacuucuagguucucaugcauuucuguguggcucagacagaagugaccucuuauacugauagucugguuuuuccaaaccccaacuguuucucaauguauagaaacauaaauauucucauccagcagugagagucagaauucaaggggaggccaguaguaacacaaucccugcuuuccaggauggaaaaacugagguacagaaagauuaaagagcugccuggagaucauacugcaagacaccugcacaccuggaaauuggaucuggaucuucaaaugcauuugcagagucugauccagugcaggaagaugauacuggaggucuuccuuucagucuggguugucauccuggcaugcaaauccaaggcagagugcaccaccuucagugacugugaaacaugaaggcaguugcugaacauguauacugucugccugccugagaagagagacugccaaguguaggcuaggaggagauaaagcguucuguuuggguuuauagagagaaauagcucugaugccuuaauucuucgaguccuagggagaagcaauaucagaccuaggagcacaguuccugcuguguuuucucaaagcuauaggagaggagcaaaugacuuuuggcagacugacuaggcagcaggcucugugucagcuaagagauggggaacucuguguucuuuucgucugcuuuugggacauaauuuaggaacaguguuuuguacuaaaggacugucugucugauagugcucaagggagaucugggaggcacaggggaaggauaugaaaggagagcuaggaugcugccucaugguggcuucauaggacucagauaaaaggcacaaagauguguuaaccaggagagagacaggacucuccagaggcucuuuaucacagcuggcagacacaaucuuuaaaaugacugaccaugacaagaggccaaguaggaaauuucagauguuuuugacucauguagugugcgcgcgcgcgcgcgcgcgcgcgugugugugugugugugugugugugugugugugugugugaugguuucuagcucacuugguuuccuuccauguuaaauauaguuuuacuuuguguagguucugcauauauggucccuuuuugcuacugcagggagaccccuccaugugaggaagcagaagugacuacuagcuaaacaggaagccacaggcaagcacagagggggcuggagaggaggcugcugagcugagguacucccugacuauucagugacaguuaagugucagagauggcucaccacagucucuaauuccaguuccagaggcuucgaugcccucuucugaccucuuuguguaccagcacacaugugcacguacauacaugcaugcaaaacacucauaacauagaauaaaaaagcccaaaaaguuauuuuuaaaaaagagaauaccauggcgaaggcuuuugaguugucugcucucuccuuaaaagcacauguccuuucauacuuugaggaauggcuggcaaccaucuggcacaaaggauucuugagggacagucguaggaggugaaacuaaaaacacagacccuaggacacauuguggaggcccuuaaaagccacaccacgaaggcuugggguuucaucagggaagugagacugacucuggcagcugaguggagagcgggucagaggagccagccuggguucugcagcacugcaugguuaaaagaaucaaacauuucuuuuuuccuagaauuuuuuuuuagaguacaaugauuuugauuuccugauaaacugaagucuguuuuuagguuuguuuaugaagcauacuugcauuuuauuaaagaacaaaggccaaaugguccucagacucugagcagugucaucuccguuggucuggaaguagcgaaggucaugaucuccuugucagaugccaagacucuuucuacaacuugguagauuucucgguaagguauuucagaugccuuuuagaaccguuucucagaaacaacugugauuugauuucugagauuuccaguuuugccaucaacuuuaaccuuugcccauagaaacuguucagcauuuccaucuucuauuggacgagcagggaccacaucaaacuuccaaguugaucucuuaggcuucuuguccuucuaugcuuuuuucuagaauuuuaauuuguuuuuauuuugugugcguguuaacgagcaugccccagcacacaucugggaggucuguggacaacuuggaguugguuuucugcagguuccaggacuugaacucagaccaucagacucugugguaaccacucuuaccuacuguuuuguuuuguuuuuuaagauagagucuaacucugucacccaggauagccucaaauucacaaugcucuugcuucagucuccagagugcugggauuucaggcauguguuaccauucccaauaccacugcccuguuguuagcaucuuucugcaagccacccugccaacauccauccaugcaggauguaaggcugugacuccucucccauucagugagggacaguuuuggcaacucauuuuuaaggaguuugaacaagaugcugucauuacugaaaugggaaggcuguggaaagagaaugacaaaucaaauacagccuuagcugagcagcguucacacccucaguaaugacucuuguggauuauuccugacgaaaggcugagaggauggaauguaucaucaguuuaauucugagaaacccaaacucaaauugagggacguucaagaaaagaacugaccagugcccuucagaagagucagggacgugaagauaaagaaaaacugaaaacugucccuccucgagaccaaggacacaugaucauucaauacaauaaagaauccuaaacaugguccugagcugaaaagugacaucagugguaaaauccacauccacaggucaggacccgggcucacaccugugacacuuuccuaauucucaacauaucaugguaauguaagauauuaggacaagcugcaugaaacaagagagacgcucuuuguugucuucucugaccacacacgggugcccacacucaggcccacacaucacacauacucauauaauaauaaaaaaauuuuaaaaagaaccaaaaccaaaccaaccaccaaacaugcaauaccaaaaacccccaaauaagcaaaaaaaccgaaaacaacauuuuggcuaaggauguagcauuagcagguagagugcuugucuaggaugaacacaaagcucuggguuccauccccaggaccacaguaaaccagaugcuauaggcaaaugccuguaaccccaccccucuagagguggagauagaagaauaggaguucuaagccagucuugacuacauagugaguuugaggcuagccuggguuacgugagacccuguuuuagaaagggagggagggagggagggaaggggaaaauaauagcaaacagaaaucaccuucucauuguuuauaauauauuuauuuuuuagugugacuuaucacaugaaaaauagucucaguaauuacuucuuugagauccaaaauugccagggcagugcugugugcagcuguacuucucgucacagaagucaguaauaagccucuuaugcucacaucugagaguguaugugagagugcaggcaugcuggcaagugcauacgcuggacuugaacugucauccuccugccucagcuuccccaaauacugcuauuacgggugugcaucaccacauucagucccuggccccauccuguuuuaguuauggccgacauaauugauggauuuacugugacagucuauaguuccuguguuugguagauaauuguauuuaugugugugugugcgugugcgugggagaugcggugggguguggggaaugugugugugggaauacaugugccauggcagccaugaagucagagaagaacucucuggagucacucauccuucagccuccuugcugagacacuuuguuucugcccaacugcauugucuccgggaaagcuggccggugagcuucuccugucuccauuuugcaucucacagcaggaguguccagcuuuccacaugguguguucauuccgaggacaagcugugggaguuguccuguccuuccauccugagagauugaagucaggcugucagauuuggcuacaagcaccuuuaccaccaagccaucuuccugauccaaguguauuuuuuguuguguacaguucuguguuuguugugcucucuuuuuguuguuuuguuugugacuccagggacucaccuuggauucauaugugccuggaauguguaugugccuggaaugcgcuucuccacugagcugcauccccagaccuaagggggacgcuuuugccuugguuuucuuuuuuuuuuuuucuuuuuuuuuuuuaaauugagguuauuuaaauuccacauacaauuaaucuuuuuuaaaugagcaacucagcugggcguaguggugcacgccuuuaaucccagcacuugggaggcagaggcagguggauuucuggguucgaggccagccuggucuacagagugaguuccaggacagccagggcuauacagagaaacccuguaaaaccaaaaaaacaaaaaccuaaaaugagcaacucugugguauaaugcauaguguuauaugaacuaauacuuuuaucugguuauaaaacauuuucacccuauauaaaaaucccauucccuaguaagcagcuuccccagcagcugggggcuuccaggcaggaacuuccaggcggcuuucucucccuguuuguguuaagcauaaacaagugagcacaugaguuugaguaccuuuugaaauuacaccccacuccaguuauuugggcauagagcuagcauugcuaggccaugugguaauuauguguuuaacuuuguggaacuuuccgacuuuuccacaugaccauaccauuucgcauuccuaccaguaguguauagagauacccauuucuccauaucgucucucauacuuguuauuuuucuuuaaaaaauuuuuauuuuaaagcuggauguauugguacauaccuuuaauuccagcacuugggaggcagagguagaggcaggcacaggcauaucucugcguuugaugccaacuuggucuauauagugaguugcgggacagucggcuacuaaaccaugugucgaaaggagaacccugacuuaggaaauugucuucugaucucuacgcaggcaaaguuaauuuuuaaaaggcuauucuaguguuuuugaaaguggugucuagcuuuaguuuugauuuauaguucucuaacacuauugaugguuuuguugccuucuuuccccacuugugggguuggaacccauacuagcaaagugcucuagcgcugaacacagccccagccccuuccccaaaccccagugagggggaacucaugaucuccuacaugccaggcaagugcuguauaccucugagcuauagccccucauuuuauuuguuuggucuucauauguagccuagacuaacuuuuaacucaaaguuguagguauccgccccuuucauucuugcuauuguuaaacuuagaagccugaaccuccccaggcaacuguggcugcuuauuuuuaaaguggguuguuugucuuuuuuguuuuugaguugcauauauuacauuuugauacaucacugucauguuucuuuuuucucuguguagcccuggcuguccuggaacucacucuguagaccaggcuggccucaaaaucggaaauccgccugccucugccucccaagugcugggaucaaagacgugcgccaccaccgcccggcagaagccaguaucuuuaauuuacaguuuguuguuacuuuaaggucuuccuuuuaccugguagacauguuuacuuggaaaacuggguuugcuuucagcccugauacuauauguagguauaacuggacaagucauggcuccuuugggccucagcuuccccuuuggguuagacuaggaaaauguacugggguuagagcagcagcugucaauauuuugcuaagaggcguuaguaaauauuuuaggcuuuaagggucauagauugucucaguguuuaaagccccuuuuguuguuggagcuguuaggggucagauagagccugggccauggcagcccuagucauuggcuuuagccaccugucuuuuauuuauuuuuuugagauaggaucuuacuguauagcuuggaacacucuauauagaucaggcuggccuugaacucagagaucugccugccuccagccccguugcucugucuaaagguaugugccaccacccaucuuuaauaagccaguuaagccgacaagcauagagaaacgcauggaaagcagaugucuucacuguugucacagugguaagaagaacagauaaagaaagggguucaguaacaccucaccccaacccuguucaucuuugcggucuugacaugagguuuagguguacacaguguguaaaaggucaauauccugcucaugcuguggaguugccccacugucucagcuccgggcucuccugcuggguggucugacaaguugucagaacucugugaaaugucuuccuuaguuccucaucugguggcacuaggguucaacaauucccuuuuccagcaugagguuccuggggaaauuccagcuccuuagggaucagaugucaggagucucuuggccaguaggaagagcgcaggagucuuuuuagaauagccucauccugaggcccuugaauugccaccaagccugaagaccugaguuugauccccuagaaaaccacaugguagaaggagaaaaccaacuucugaaguugcccucugacccccaacacuuugaggccaguuacacucuuugcucugguacauugugguucuuuucuuucaaacacuugccagggggcucaccuccaagagccaagggaaaucauguuuaaucacuaguaauuaaacauauuaaauauaaugucaugcaauuaauguaguacuuacugucugcuggcacuguucuaaacacuuuacauauauuaacucauuaucagaauacucaaugaagaauguagaugcauucauuauccucacuuuacagaugaggaaacuuaaggcagaaauaaaaauuagcuccguaaccugccaagugaaggcuccagcuggcuaaggaagccaaaacuuaaagcugacagccugcuccuuuuuacuguaugcagaacugccuucccagacgcagacacgcacuuccacgucaugcaguugcucagauaccacuuaagacgucagauaggacacugggccuggccugagcaucuucaucugcacacgaaucacucagagauuuauuuuuaauuauguguucuuauuaaguagaaccacacugaaacuaucugaaguugugugcaaggauguaugcaaggcauucagccacaagucuaacuugacuuggugaaaaaaagguccuagacgcaaauaaauaauaaaauucuaagcaugacugaaguaucugagauauggaugucaccuaaaccugggccaaaaauagcauuuuacagaaugauuuguuuuuggguuuuguuauuauuuuauuuuuguuucuguuuuucucugauugaacccaggaugugcuagacaagugcuugcuucccacugagcuacgccuucagcucccuagaggggugucugaauauuuaccuauaaugcaaaucaacaguagcuuguuauugugguuuagauggucauuuauuuauuuuuacguguaugacuuccugcaaguauguguauuacaugagugcagugcccacagaggccagaagacggugucagguuccccuggagcuagaauuacaggcacuggugagccaccuaugaaugcugugacuuaaacucagggcuuuuggaaacguauuguaugcucuugaccacugagccaucucuccagucuccuguuuuuacuuuuuagcucuguagcugguuuuaagggacaaaaaaauaauacccagaaaauguaucauuuguguccauauagcucaguaaauugucaaaggggaaaaaauaaugcccauguaacgacacuaaguuuaagagauggaauacuaucagugcugugaguaauucuggacauuuuaucucauggcugcuauuuucugguuuuacacugccuacagcugucuucagugcuuuucuuuuuaaagcugcugugcagcauacaccuguaaacccagcacuugggagguagaggcaggaggauuagaaguucaagguuagccucagcuacgaagugagucuagccugagcuacaugagacugugucucaaacaauaaacauaaaaaguaauaaauucagauaaaauauacauggcucagugggagaguacauuuuuucauauauguagacccuagguuuaaucuccagaaacacacacacacauacaaaauggcaauauauaacuaaauuuaucauuuuauuuuagggccuuuauuuuuauucugagaugagucucacuguguauuucugacuagcguugaacucacagagauguaccuaccuccuccuuugccucagccucuggagugcugggaguaaagguuccugccaccacaucuagcucaagggccauuuaaaaaauguuuuuacauuuauuuuguggaugaauguauguaugauuacacgugccagggcaugaauagagagggagggcaacuugcauguucaguuuucuccuuucacaauguggauucuagggucaagcucaggugucaggccugguggcaagugccuuccuuuaccugcuaauccucagugguuacuucuaccagccgagcagcauuacuuaaagucacaucuuccugugaccaccaucaccuuccauuucuaguacauuccugccuuucaaaacugaagcucugcccaguaaucagcaauccugcuuucugucuccauggccguacccacugcaggugccuuguuuguguaagugcagucauguucuuggggccucagagauuugugcccuucuagggccgguggguuucacucaucagucaggucuucaagguucaucuuuguuuuaacaucacaguuucuugucacuuguuaagacuguguacuaucccaucauagagauguauacucauuuaccuguuacacccauauguuuaauacccuguuuuuauuauuuuagguauuuuccaaaaggagauuugcuguguuugaagaacuuccacauuauuuauauagcucuaccauuauacauuuuucuaaguuuguuuuaacaugucuguuuugucugaauauauguauauauaccaugugugugccuagugcccaaggaugucaaaagaaugcauuggauccccuagaacuagaaccacagcuccccuguggcuccugagaacuaaauccacauccucugcaagagcagcaagugcucuuaacugcugagccgucucuccauccccuggcuccaccauuuuuguuuuauuuuuccuggucuuauuugucuaucagguuuuauuuguagaagccgaugaucaaagcuacaaaaacaugguuuugcaaguauaacaggcccaaagagaagggcucauaggaacaaguaguuuuuuuuagaccccgaaggaggccuuuuaguacgggacagaugaggcuguagaugucuggacaugagucuagagagacagcagccagcagaguuguaacugaaagagcugaggcuugggcaagugaacuugcccuuaccucgcccucuguaggucucagaccccaugcauacaggcaacuuguguuucuaguccccagagcagggagaggaaggacuguuauaccucagagaucagccauuggcaagccacugaaugucagaccacagcugccccugcaccuguccugcuuagcuccugcauggucuaguguugccuguagguuuucugucagcuuacacaggaugaggucauaaguaaagccagagaacucugaccucuuggugaaucgcaguguguccugcauguucuucacuuugauacagggauaccaaggaaagugggcuagaacauggaccaccaagcuucauggucuuggaggcagugggcuaagagccuguugcgugucucugguggcaguucagcuucucuaugggguccuaaagcuuaggcauaggagagcugcugcugcuucauccuggcucucagggucagaucagaggcugggaccuuuuacuguugcuugcuguuucuuuccuugcccucuuccuccuuauuucauuuaauuuuugagacagggucucaugauguaauuuuggcuggccuggaacuaguguauagacuaggcuggucuugaauucacagaggucugcuuacuacuacuggguuuaaagacauaugccaccacaucuggcucauuuuuguguuuugagucagggucuuucuauguggucaaggcugaccuaaacuugugaucuuuauucuuuuacuucuuaaaugcuaggauuacagaugugcacuaaaugccuggccucagauauuucucacuacuuguuacgagaacuuuucccauggagauuugaugugaaagacuccaacuuuuguuaucaguauuuucuucuacuuggcacauagacaguaccaagaaggacaaggcaggugucugagacaaacuguccagcagcugucuggucuuguguuuggugcugacaagcuccuaguugccaucacugucauugccuaggaauuuggggcuguugcuguacaggcugagggacagucacagaaguguucuuuguggccaggucuggacuggaagagcugagagacugggcgaugccuuuggaugugaaagccuuuggggccugguagauaaguccuugcaguaaggagaggauggucuucagucugcagguggaccuggguguggggcugccagugcugaauggagaaaaggcugugucagcguuucuauuccugcacaaacaucagaccaagaagccguuggggaggaaaggguuuauucagcuuacacuuccauacugcuguucaucaccaaggaagucaggacuggaacucaagcaggucaggaagcaggagcugaugcagaggccauggagggauguucuuuacuggcuggcuuccccuggcuuucucagccugcucucuuauagaaccaagacuaccagcccagagauguucccacccacaaggugccuuucccccuugaucacuaauugagaaaaugccuuacaguuggaucucauggaggcauuuccucaacugaagcuccuuucucugugagaacuccagcugugucaaguugacacaaaacuagccaguacaggcuguuugaccucagucuuccuuauugcuuagaaggccucccuucccugugucacuuccacugaaugacuguccagagucugagugacagguacugugcagaagggcuugguugggaggugaggaggagagucuggagagaugaauaacugguuagacauauugggugaaggguuguguggugggcucaucaguagcacagcuguuauuuugcugauucaguugguuaccacauuuguuguuguucagauggaagauuccauggugugcucaagggauagacugcuggggaugugucucucugagacacuuccuuuguccuccccuugcacacacacuggaugguaguggaccugaguacgcucuguuuccaaccaacaguagcugcaguagcagcagagggagggucgguaaggucagcucagagcuauagugauauaagugaugucagcugggagcgcuacacccugcucuguaguguaaacacuguuuuaaauuucuaaacacuagugccccacaaauuccacauucuuuacauccuugucagcauuuguuuucuguguucuuuuauuuguuucugguggugcuaacaauccaaacuaggacaagucucacuugcuaggcaagucacauucccagccuuaccugagaccuuaaagaaacaaauacuaagcugagcaugguggcauagaucagagauuucagcauuuggaaggcaggugaugucuaaguuuaaggucagcauggucuacauagcaaguuccaggccagccagagcuacauaguaagacucuugcucagauuuuaauuuauuaugagauaaaguuuaaugccuacgcuggcugagaacucucuguauagccagaugaccuugaauuucucauccuccugccuccaccucuagaauguuaagauuacaacaagcaugagcuaccacaccucucucucugccugugugcuguugugaucaaaccaggauuugugcauguuaggcaaauacuacauucaagauuggcggggggugggggggguggggaguggggggggagugggaugggucccaaggauccaauucagguuguuaccaggcuugguggcaagugccauuacccacugaguuuccuguucuccaccucuacccuccuaucucaaacacacacacacacacauacacacacacagaggucugucuucuagcuuuaguuuggaaacuggcaguauugcaggucuucauuaucauucucauaguuacacaauaauguuuaggucaaccacgagggacuuggcauagaacacuguaggaugugauuauaugacccagugacacuguagcaaaccuaguacaguauagaaguauauucugugaaauauacaugaagaagccgccugacacagauuucaaguaacauguguccuuauugcaugccuuuuuuguuuuuguuucuuugagacgggagcucuccauacggugcaggcuggccuuggacuugcgggccucagccucuccagugcugggauugcaaaugaguuuaccguguucagcucacccauauuuuuauguccuauuccaauuaaucuaaugcuauaggaggcaaaagauagccuuacuaauguauguaacucauuaguaauugauuuuuuaaauuuuuauaugaacuauagucuuuaacaccaugaauacaaguuaaacuaucaauauuuuauuuuuccugauauucuuggcauuuguauguacuauaaaccacaugguaagcaguuguguguguaauaacuugagccuacuucuguggcuaccuucugucagaauuacauuuacauagcauuagaaagaaccacugcccuagaagauauuucuaaaggcagaucccagaaugaaaguuuacuuugagugucugauggaaaaguaguguaauacagagccacaaugcuuagcaaaugccagguaaaaucaaagggcauuguauauggauuaaauaauuagcucuaguaccucugcugcgcuuauggggauuggguucagaggaguugguacccuuguacucccaagaauaaaaaccaggaaguggcagagccaguaguuaccugagggaccguggugccaggguucuucuuuguaaccauagcacuguccuuuacuuacuugacacuagcguaaguaaaggcaaaugugagauagaaaacaccuuuaacauccuuggggcucuguggaacuugcuauuuguugguucaguguuccgcacagagucacugauuacagagagaacauuucaucccagacauuuaucccuguucccaaacuaguauuuucaaguuugguccccaucugagugagaccuuccguucagacaaagaacucuugcacuuuuaguagaauuggcagaucaagagcuugcaggcagcacauugccuguaaguacuagccuuuaagugcugaccugagcagucccugggcagauccugaugucgcugguagagcagggcaggagugaggaucugcguguucucugugucuucauggguuugacacuucuucauaaaguggaaccaaucugauaggaaucccaaaaccuuuuagagccccuuaaguagucuaagaacuacugaacuuuuuggagcacgguuaugaacaaugcaaaaaaaaaaaaaaguuuuccuuucuggagacugugaugagcagcauaagcuguuuuuaaaugccuggagaaaucuuugacucuugugaaguuccuucuuccuggcagggauuuauauaccuccuuaaucuuuucagucaggccaacagcuacgguguggcaagcaagccagugccuuuucugacuuagcuuuugugccucuggcugugcuuccagaccaaagcuacaacuauggcuuggggucagagggggaaaucgacugucacuucugcucaucacgugugaugcuguggaggcugaugacucucucguucguguucuuucucaggucuaugaagggcuagacaucaucaccaauaaggucucugcccaagagcagaagaugugccagcaccacaugaucagcuuuguggauccacuugugaccagcuacaccgugguggacuuuaggaacaaagcaacggcccugauauccuuaaggaaacuuagcacccagaccuggaggguuucuaguggugguuuguucuaaggagggaacuucccucagagcucauuagaaacgcuggcucuugggcuccacuccagaacuacugaguagagucugcacuauaacaagaggccugugugguucuuucuuuuuaaagcuuauauaucuuuauuguauguguguacauaugugugucaucucuguauguggaggucagccauccuguguauggcaggcauucugaccugugaugaggugccaagugagucucuaguuucugucuccugucaguguggaugcugggauucuuaaugugcaccauauccaaccauuucuuuauuuacuuuaauuuguugguuuuuuuuuuuaauguguauugguguuuugccugcaugaauguuucauaagaaugucagauucccuggaacuggaguuagggacaguugugagcugacaugugggugcugggaauuaaaccuggguccucuagaaaagaagccaauguucuuaacugcugagccaucucucuagcccuccacaucuggcuuuuuauguguccccuggggucuaaaaucaggccaucaggcaugcuagguaagcuccuuuacccauugggucacuuucccauccuacacacuggggacauuugggaaaaacacuuuauggcaggaauacugauuuagaagaaaaucuauguucuaagugugaaauugccucuuuggaucauguuguuuccaccacagcacggagcuucaguccucugcucuguagaguggggauaugaauuuauacauuuauaaugacaaggaagccacugaaaaccucaaaggaguuauugaguagggaaggauugaggaaaauaguucugauaaaauuaagacauuuuugagaacaaaggaacuugguaagaguguuuacaccuauuauuuuuagcuccaguggaaaccgaggcaggaggauuaugcuugcauuuccagucugagauaaauggugagacuaucucaaaaccauaacuacuggaggauguaguccagugucagagcacuugaucugguauaagugaaugagguccuggguucgaucccuaguaacagaagaaaaacccugacucauuaauuagagggugcauuggcaguaacaguuauaacauaggugaauuuguaacacgggccggugagaaggcucaguggauaaaagugcuugccauguaaaccugagggcccaaguuugaucaccagaucccagaguaaaaaaggagaaaguuaauucccaaaaguguguguguguguuuuuacacgcacaauagggaacucgguguacguugaaauggauguguguguguguguauguaugcauacauacacacacacacacacacacacacacacacauauauauauauauauauauauauauauauauauguauuucagacuaguaaagaaugaaugaaagcccugggugcccuuuuauauuagcacuugagaaggcagagucagacaaauuacucugaauuuaaggucagccuggucuacauagcaaguuccaggauagccagggcuacacaaagaagcccuguuucugaaccaaaaaagaaaagaaagauagauucguuuugcaucgguaagggugcaugcaaggacugcagauccagguggagugcuugcccagcgugcacaaagcccggagugugaccgccagcacuguauaaacuuggcaugguggcggcuccugcaaucccagcacuagggaggcagaagcaagagaucagaaguucaaggucauggcagcaaaagaaguucuaggcaagccuaugagagaaaacuugucucaaaagguaaaguaaaaggcuugucaaaccagaacaccuaggcaugugcccuaggacacucuaguucaggcaguuugaucuagguauacaauaaaauuuugcccuaauagcaguaaacacccaaauuuguacucucaaagaauguacaaaauuuguuuuacucauagagguucuuuguaacaguaaagaugaauagauuguagaugcaucagucagcauggaagaauuuuauaaacaauauaaauguugagaauugcaagauacaugugggguuuugccacaguuauaacuacaaaaguugaaaagcaaacuaugcuuggugugguauacgccugcaaucccagccccuaggaguggaucguaaggccauuggcuacacagcaguucaacccagcuuugagcaaacaggacauauauaagcuuggggaaaacguuuauaacacagagaacaagugacuaauguucuuaauaaaugaaggacucuccugugaauaugaagguacuuauagggcugguauucacauaggagcaagcacagaugauaagcauggaaaagguuugcccuccuuacuaaucauggcauucaaauccagacaaugagauaguggcuuugccuaucaaauggguagauuaaaauguagauaauaauuucaagucugccuacuuugcagggcuguugugucagaugagauaguauacauaugaaaucccuuucagguugacagcuaaagaugagguuuuacucugagacagucagauugcuccuaaagaaugauaugacguggagaggguuggauguuuuccaggcacagaggcagcagaggacagcuucaccagacuagcucuaggcuagauuugaagguugguuaagagcauagaagucacagugucaaacugaaagugucccagugagcuccagaaucccaugcaugaagauggggcauucaaggcuagccucugcuuguguccgcagacuggguggcaagcaccuguaccuacugagccauccugcuagccccugucuguuuuuugagauaaggucuguguaguucuggcuggguguauuuuugcuauguagcacaggcuagccaugaacugauagaauucuucugccucagcauugugggugcuaagauuauaggcuguuaugccuggugccagcccucugugauccuuuguugguaguaucguccuuccuauucugccaauuagaaggauucuggcggaaucccucaucuagcucuacacugcaggucggcuggcaagaaggaggagcaaguaaaugaugaacugcauguugaaagucaacuuuucuuuuuaaacaagcagagcccuaguuaaagcaaguaauuaucugcucagcagaaauucuaaagagaaucaaucccaagaagcagaaaucuguggcugcaggaaauugaguacuuucugguuuccaggcauuacaguagaggcuuuauacacaguuacaguucauguuccuaaacacucuggaguuguauagaugagaaaacugaagcucggauagcuugaguaacuugccauuagaauugaagucuggugaggucucgaguggcugaacugagcacuacagcucaguagugacagacucugacucacagcuguggcgugggagaacuagccugugucuuaccucagaaagccgggucacacacugugugucaccuuggugcgcauccuuaggacuagcaagaccuagacauuucuagaaccagggggucaccgugcauuuaugucugcuuugcuuugcuuuucuuucuucuucuguuuuuaaauaaaauauuuacauguguaaaugcuuggccuacauguaugucugugcacaugugcaugccuaguacaggucagacgagggcauuggaucccuuagagcugguguuacagaugguuguaagcugccauguagguguuaagaacugaacuuggguccuuugcaagaacugcaagcacucuuaaccauugagccaucucuccagccccucugucagccaaccagccaaccagccagcuagccugcccacccucccgcccucccucccucccucccuuccuuucuuguuuuccauuguuguuguguaugugguguggauacucguuagucugugugcauguaugugcaugugcacauaagcauaaguggguggcagccugaggugugcaugcgcaugcuggccuuuggggguucuuguuaauacucuucuucccacaugagucaguauucacuuauugauauuaaauaucuuucuuaauguuuacauugaagauauuuuugcucgagacaaaauucccauuguggugggaggaaccaauuauuacauugaaucucugcucuggaaaguucuuauuacuaccaagguaagucuaguucacuuguaacucacuagagaaauggcuucccuuuucuuuuuuccugccaaauaauuuuagugggaggaaggcugacucuuaacuguuucuuauagucagcagcaguaauuuuccuacuuaauauucugaacaaaugccaccuccguaugugaaguauacuccuccaagcuggccuaaggguagggguugugugugggaaaaaaggcucuguggguuaauuagcaucccuguaaauuagcaguacaucugucugacucagcauuuccuggcugccagcauaguguguaugucagagguguccagcucugaccuuuccuguggaggugcuacuguguagggcaggacuuugcaaauggcagugugcuagcaggucugguccacucuuuguuauccuuaggaagugugcacucuauugcugaacauguaaaauagaugugguagcccaguuaaacaagcagaguagccaaguacuucccaaagcgacaagcgcccuuacuuaccagcauauugaaaauuuugguuuaugauuuguuucucacuguaugguacaaucuucagcucuaucuuuguucuuuauuucuaaggcuuagcaagaugucuggcccauuuauagucucgauguuuauugaauguuagauuaaaucuacucuaaacuuugauguccuagccccaggagaugggcacugggaaagugguugaucggaaaguagagcuugaaaaggaagauggucaugaacuccauaaacggcuaagccagguggacccagaaauggccgccaagcuacacccgcaugacaaacgcaaaguggccagguaaggaagccuggguccauugccccagagucccuuuauagagcuuggagacaguaaagugugugccuaaccugggugguagaggggcugggaauaguggaaacugauuugcuguucuaguucaguggacgugcaccgccucaguccaucuccuucaguaaacagucucacucggcuuugcuguuaccucuuaaaggauaguacuauauuguuuuuccccggggccuauguaaucuugcuucauuuucuauuugaucuuugcuuguauaacaguuuucauauaaaauuuuucuggcaugcaauccuuuuacauugugacuugaguuucauaauuugauugugcaaugcuggguuguggcccaguagcuuucccagugggaggugguguuuauacgcugucuuacaagucagcucaccuuugcacauggaaacuuuguagcagggaagagagguggugaauaaacuccucacaugcuuucucagaggguuucagaauugaagcuuccuguguugcuuuguuucucugcagcguugggaguggcucccguggcuggcacaggagaccaucuaaggaaggauuuagugggugcuagcuacacacaucacuugcuaugguaacaguggugucggggcuuagaaaguguucuucucuaaagauuugcuaagaccaguguuucuuaauacuuuuccauuauuccaccuuagaagagccauuuaagaguguccccaccccacugugaucucuuccaaugaaacuuuacauuaaaggagaaagguuuuccacacagagguuuccuuggagggcuacguucugaccuucaccucacgaaggugcugucacccuggugagaaggauguucuagggaaaugcaguuuguacuuaggcauacuuuuuuuuuuuuuccuguuguugagucaagaucucauguaguccugacugccuuagcugagggcggcccugaauuccuagucuucucuuuucuguaucagcaguguuuggaaucuggcauuuaucuccaugcccaacucgacacauuuuauuucaauccaaaccuuuccuuuuuuuuuuuuuuuaagcucaggaacauuguagugaacacuccauugacaguucugcaugcugugauuuauuuauuuauuuauuuauuuauuuauuuauuuauuuauuuuuagagucugucuuuaguuuucucugcuuuccugaucagaucuuucuuucucuuuaguuuuuugagacuggguuucucuggcuguccuggaacuuauucuguaaaccaggccuuguacucagauccaccugccucugccucucaagugcugggguuaaaggcgugcgccaccaccaccugguucauauuuuuauuuuuuaugcugcuugagaacugugccuuaagaagaaucacuaaguuccaagcaagaacucuagggucuauccugucagaaagauggagaacuuuuaucauagcucuuuuggguggagucuguagacuucuuuccauaaguaggugagguacuguuagguuuuuuuucuuauagauguucuuugagugaccaugguuauugaacaaaaagggguuucccucuaguguuggguuuucaggaaacaaaaguaggucaggaagggaaagguugccuuccagcugauaaguugcagccauccaagugagacuguggcuuugggagcucaguuaccugcugcuguaauacagcagacugcacacagacauggacagcagcuuaauuaugagugugugggcucacucuuugauagccucuguuccaggagaguguaguggauuagccaguguucuugauuacugcgagccauagcuaaagagaaaguggccgagcuggaugugcagcaugcuuggcacugugggaaaggcacuccagcgagaccagacuuguuggcuuguacagagugucccaaacaagcuuguacugcucacuugaaaguaagucuccuucuguuuguacagaagaaaccuguuauuucugaacuccuuuaacuaauucuagaauguguuuuuaaaagaacaguguuauuucucacccagaguuuaggugccuuucugaauagcucugggauuagaguaaagccggagcuucgugcuuugggaauuuaugcaugaaguugaaaaaugaagcuuucuucgagacagucuuucucuuuauucuaguugagaaugaauauuccuaauggguuccccacuccacccccuuuuuuaaacaacguaggagcuugcaaguguuugaagaaacaggaaucucucacagugaauuccuucaucgucagcacgcagaggaaggcggugguccucuuggaggcccucucagguucccuaacccaugcauccucuggcuccaugcugaccaggcagguaaaugcuucgguccagagucugucugagacaaaacggagaauacuaggguuuuaugugucaagugcuucgaaccacugguggcugacacugagcacuagugugagcucccaaguuuacugugucagccaccacaccuugccuuagaccccauguagugcuuccuuagugauucaggaaagaagggaaggagaauacugguucucagauaaccagcguaggguaggaugaaaugugcagacuaaagagagacugcugcugagaagguugaaaggacagagggagggagguuuccugucggaccucaugguuggcugcugguaggaucucucauuaggccugagaaauggguguggcaacuggcuagcuaaccugauagcauuuguugcuaaaguauccugaugcccugugcuggggacuguuucacccagaaaggcauccagugagcacccaguggugaauggcccagucuugaagacgucguuuuaccuuacgaugcuugcucacugucuccuaauuuuguuaguucuuuuuuuuuaaagauuuguucauuuuauuuaugaguccacuguagcugucuucagacacaccagaagagggcaucagaucccauuauaggugguugugagccaccaugugguugcugggauuugaacucaggaccucuggaaaagcagucagugcucuuaacugcugagccagcucucugccugcucugugaauucuuaaggccaauuaguuugccacucuguauuccaacucuucaguaaaauagaauugauaguaauaguauuuaucucaaagugcugauuaagaauucaauagaguaauauuaagcagaguugugggacugagaguguggcucaguaguaaaacacuuguuugauagucacaagaauguguguucaguucccagcagggugcucacagagauucaaacaguaaaacauugguuuacugaccaguccuugguaaacaagucuuagcaagguaagagagagccauggucauuagaggccgagaggcagcagcagugaacagauagggcagacgguccuaguugugacgagaguuccuccugagucauucucagaaguuuauggaagaauguaacuuuuccauaaugaaauguuuguacaguccaaccguaccacacaguucaguguaaacuacugggcugccucauggcagugcuguguguggcugcuguaccacggggugaugagcucccacucaccuggguagcugaagcugcaccaggagggcaccaggggauccugaugaaaacaacaaaguuagaguaaaaaaauaggacaaaauuuagaaagagucaaccacuggacauagugaugcacucuuagucccagcacucgggaggcagaggaaggugagucucugugaguuccaggccagccugggcuacagaguaagacacugucucagaaaaccaaagagaaaagaaaagucaaccaggagacccucagccauuuguaaaagcaggggcuguguagugcacggcaaagugccugccccuguucccgcugugccauucagauagcaggaaggcgagugcucugcucuguuuugguacacaguccaaaggucagguaaauacaauaugaauuuuuauaucagaggaauccuuucauucggagagaaaccccuucuuuguggcagccuggucaauuugccaugugagugugcaguaggcacuucacgugcuauucauucaugggcuguucugacucaaguucuagaugagcgcuuggauaaaagaguggaugacaugcuugcugccggacucuuggaagagcugagagguuuucacagacguuauaaucuuaagaacauuucagaaaauaggugaggauuugauugcuguucugacugacccucccuugcuugccuaugguugcgagacuauagacaagacuggcucuggaucuacuuacugguccucugccgcggcaguggcuuuucuuucagacauucccagugcuggcguggggggugggggugggggggaucucagucaggaacugucuagggccucacucucucaucagugacacccuccaaggccccacuggcuuccagaggcuguggcuuacugcugacacucuccuguucccagccaggacuaucaacacgguaucuuccagucaauuggcuucaaggaauuucacgaguaccugaccacugaggggaaaugcacaccagagacuaguaaccagcuucuaaagaaaggugugaauuccuccguguguaaccuagccuuggacauccuugggugauagucugagcugaggcuagaagagucucagcuaaaaaucgagauuguuaucuguggagucuaauagugcgcuuauuucuuuuguuguucuugggcugggagggugcugacuccuaacagaaagaaguacuuacccagaugccauugugucugcuguaucuuccagguauugaggcucugaaacaaguaacuaagagauaugcccggaaacagaaccgauggguuaaaaaccgcuuuuugagcaguaagucccacuuuucuucucaucuucuggauccuuuuuaacagaguauugaucuguccuaagaauuggaccccaaggucuuuugcauagaugguuauuggggguguuuucuaaugaugucucagggggaaaaagagaaacaauuuaaguuuccauugaagaugugucuucacccuggaacagauggugguggcuacaacagauuguaagagcagcauagcaaugugugagcagacuagguguucagaucugauucugucuucaguuuuguaccugaagagcaggcagaaagcugcagggaacuuucccaguuaaaguggggccugggucuggugaucuuuacuaaaaagagcaaaaugaaauguuucuccuugcuuuauuuuugugaucauauacaugguacuugacuugcuucaaaggaaacuuuaaugggauagaacguuuuuaggggaggaagguuucaagacaguguuucccuguauaacaucucuggcuguccuggaacuugauguauagaccaggcuggccuuggacucacagugauccaccugccucugccucccaaguccugggauuaaaggugugcgccaccacguccagacuuggacagagcuuuaagggagagagaaggaaagucucauacugugucuuuggcacuaaauuuagugcuauauauaguugaagugaggcuucaaggugaagguaauuguuuuacagauaagaacaugaagaccuucaccccuggcuaguaggcaagagagcccaaacacaggccugacucuuaaguguaggcucauguuucauuaagcuaugcccuuggcuacccggcauucauaucggcccucagguccccagugguaugcuuaugagcuaaaaggagauuaauuuaaguguagugaaacuccacuuuuaucuuguggacacuuuggaaauacacuucugaaucaucuccaguuuacuuuuugccaguagaguucugcuuucaguuauagguuaggccagcugaagccucugccccuggccuuuggugccuuugaccauguacaccuuaguguauggugucacuuccuucaguuuacccuuugccuccugucuugauacauagaugggucccaucuuaguuucagcugaacuugauguucacagaucucaaguacuucccuucccaugucugacaguaagucugaaacagaagcuuuuuguaaugauuuagaaguuccucuuguuguaaggcaauaguaacuccggucucugaggcuggagggguuaauggcaccucauucugugcaggcucaauccuggugccagagugaaaggcacagcugcccuguaagucaggagccacauuugauuggccaggacuagucugcugggauauggccuggcagagagccagagggacuuccccaccccagcuuggccuuggacccaagccagaaauagcagcugggagccgagaacuuguugaaaggugcuuagacagggcacagaagcccaacaaaggacuuagaggagaaagggaaauguagaguggccuagaaacaggugcagagcuugacuaaggccaggugugcugugggugcugccugcgcucuccuggucucaccuuuccauguggcggcagguguaggccaguccggucuauggagaaucuuauuugugguuggcacacucaaaaggccagcaccugccagccguuggcaucuugaugccuuugauauuuuuuugucuaugggacaaugcuucuugccuucagguaacuaacuucaccuagcuguggaaggcagucuaguguggcuguggaaugcagaggcgaacuguagcuaaaguauuacagcacgguugaugugcucagaugcguggggucuuuuccuucucccuccagucucaugucuguucggaaguauuuaccgcagagugggcuuucauccuuuauauaugguucuuaaaaaagguguucggaaaccugguguuguacuacauggcuguaaucccaucacuuagaagguagagaggcaggagggucugggcucuaagaccuaacucaggugcauagugaguuugaggauagucagggcugggccacaugacucucugacacuccuccccaagagcauggagggcagggugagauuuaacuagaucagccccaaggcuaauagaguaggcacuuacucaaaccucuuagcuuaguuccuccuauaaaguacugucuuuguaucacaguagcccaccuaguacucaccagagcuguuacuccguuuugauuuccuuacggaucgaagacucugcaccuaagucccuguuuacauggucauucguguuuccugccugugagucaggcuaugggucuuugagguuguggcucauauuuauaguagaaucauagcauagucagagugucacuccuuuggccccgugcauucugcuugaggguuuuaagagucuuagaaacagaagagauuggaacuuguaggccagacuuucacaacuuuucuuugucgucauuaggaccugggcccaguguccccccgguauauggcuuagaaguaucugauguuuccaagugggaggagucuguucuggaaccugcucucaauauaguacaaaguuucauccaggugacuauuaaggaggcauggccuaugaucagguuugcagagucuugucuuuuacuggcacuuuugcagcuauuuuggcgagccaaaugccuuuucaaugggauaaagcagcagggcuuacugcuguuacaucucuggagccuguuuuugcuuucacauuuagaaagguuguugcuaaaaucuguuaacagcccaccugcucucugggggaugaaaaaggaaucuugggaaaaucccauucucuuuaacaucaaagacuuguccccaaaucucuuugcauugagugccccugccuguuuuucucuuagggucacaaaccuacagccaugccagugaagauggcauacaaugaaagugagaacaagagaaguuaccacaugugugaccucugugaccggaucaucauuggggaccgggaaugggcagguagagugcagaugaggggcuguguggagggucaugggaaauauauuugggugggugggggugucacacuuucuaaaacuucgucuuuaauaauugaaugcuggaaucagcuuuguaacaggacagauuccugagaaccuuucccagacuagggcauuaccucuguagccugacaugcagaagaccguuguccuccagaugcagcuagaauaggaauauucuauugagagaaguuuguuggccuuuccuguguagaacuuaguugugggacagagaaauaaaguuauuuuaggcaacuccugcaagcuaguuuggagcggaagcacagcuggaagggagcaggcaucauggguuccucaggcccagaggucuuucagccucucuagauaacuuguugaacuggugauggcucagacugugacagaagaugggaagaagugcagugagagcuagccugugcuagccugcccagcggcaggaagccugcacagagugugcuucgcugggacucucagaguagauguuucucuccauaucaccccauacaaugauuaggucuauuaacuggcaucucuggcaaaaugcaccccauugucagagacugggacggcuguguguccguccgagcagcagaagaagcccugauuguuguugguguauaaugaugaaaggggaagagagagagggcgucugauugcuuuguaaaggaaacuuagugguucgauuuguugacuguccuuuggggggagccuuugugagcuuggcugugugagccuucuguagugccaucugucgaguccgcgcucccauccccugcugccguggagaggagcccagagcccagggcugccuuacgcucugguuagagaagaaagcugacucuucgucccacacaaagucucucagcuucucaacacugccacacucacacuucagaccuuguuuuagugaugcuuuuaauauguguagaagaauuuagccuagcucaguggguaaaggagcuugucgccaagccuggugacuugaguucaaugucuggaaccagcaugguaaagggagaaccaccuuccacuuucacaagucuccccccccauguauauacacaaauaguaaauaaauacauuugaaaauuagucugaucaucccucccucuagguguucccaaaggagguuucuuugcagagcaggauaguaaaaaugagccuauaugaacuagucacuggguaaaagugagaggaccagggaguucauguaacaaaccugcuggcagagccuuagccaauguacagcacaggccuagagccgugcacuugggaggugaaggcaggagaagccugaggucagugugggcuaccuaguaagaccgucuuaaauagcgauaaaugugugucuacucuguuauuuauugacaguuuaaaaggcugaauaguuauauuuaaaugcucuuguuuguuuauuuuuguuuaauuaauucuagaaaacccugaugacuuuuuguuuauuuggccuuuguuuucucagcacauuuaaaauccaaaucucacuugcaccaauugaagaaaagaagaagguuggacuuagacgcugucagugccacaggaagucaaaguaauuccccagacugugacccggaacgcaucgagggggaauccucggggcagcacaaucaagagcugaaggccaguguuugagagacaugccuaguggccuuugcagagacguggggaucaagcccaggagggaggggagugucgcucucccacgccuggacugaggaaugcugggcagaaggccccaccaucuucuuucauucugugcuguggucugcaguggaaacagcaggccuuucagcuccuugugugccuguugugucugguaaugauguaguucagagugggauuuuuuucuuugaaccuuaaagguuuuauuuuagaacgaggcacagaucgcacauuuucuacuugaggaucuuuuuuaguggugaauaccaagauucagugcauccuuuaaaagagcguucuugucccuggcgcuggcuaaaaauagcucguuuccagaugcuuuuguagaugacugaaguauuguaaggcgcagucaggagcucuggacucgagaacggcagaaaggaguagugcagagagaugauuaagcaaacucucccagcucugugaaucuacagaagagggggucaggcugaggugguugugaccuggaucuugaagacuaaaagacacagagucugcugagcugcuccugugcaugguggcugucucuucaucuagggcagaaaucuauagauucuuuugaaauguaaauaaaaagauuguaaacgcccuauaguuucuauacagcaugcugcauugu

SEQ ID NO: 2100 - RNA, 1130 nt, Mus musculus
ccagcggaggaucaagccucugacacaagagccguuucccuuguuguucuggacauuuuuaguuuucagcuguuuugucuggauugcacaguugucuuugugacuuauaccuucucacagagucucaucucuggugggaaagucuaucugagcguugggugguccugcguuuccuugcugaucaugauaaacaucaaggcuuaccacucuccuccacccccaaccacugacccccaugccaaauuaaucauaugggcaaaugaggagauuggguuacccagugugugacugcugcacaacuuguuugcuacacgcugaaggaaugaugggccuuugccugugaguucagcaaaggugcgccccccugccuguacagccugcauaugggucgaccaugucucccacaggacuugaagaugggggaaaaugauggaaugucuuuccacuaggaaugagggcucccaucggggucacuuacaguucucuggaauaguugauaauuacaccgcccucuggaucauguguccuuugcucccuuuacccuggauaaaaaucgaugcucugcugagaguggugguagguacgugcccguaauccuagcacucuggaggacgaaggaggggggaguaccauggguaugacgucagcccugguugcauaguaagagcccguuucaaaaaaaaucagcaagcaagcaaagacauaaaacaggcaggcaguccuaccggaagcguaccuaaaccugcauuccuuacagcaguaacuacuguucacaccgugcuccaguccagagggaguacugagaaauccgcccuuuccuuuaguaaucagcagguuaguccgcauuccugcaagguggugacagauaagagccuggcuuuucagaccugaaaucccagccccccacccccaucuccauccaaccuccccacccucuacccccaccucuccacccccacccacauacccacauacccccacacucccacagccucccacccacccaccccaccagacacugaggcagggggauuucaaguucgaagcugauaagacccugucuuaaaaaacaccaccaggcaaaacaagcaagauggaacaccaggagcuuucucucugcguuccaggug

SEQ ID NO: 2101 - RNA, 3418 nt, Mus musculus
uaauuaaaaucucuauuagguuuggggaagacacggcugauuuaaccccugcuuucuggaaacauagcuaugucagccuuugagagcgaaagaaucuggugcacgccuuuaaucccaucacucgggaggcagaggcaggcagaucucugaguucgaggccagccuggucuacagagugaguuccagggcagccagggcuacacagagaaaccuugucucaaucccaacucccucuagcccccugccaaaaagacaaaaacaaaaacaaauacaaaucaaacaaaacaaaaagcaaaaacaaaacagugcagggaugcucccuaaauauuccucccuaggcaugugugugcgguuggauaaaaguaggauuuguucuucagauuuggccucugcccugacagcugcacccacccugggcucuccuaccuggacucucagacuguagcucucccaacacugcacucaugcuaaagcacgcauggaucguuuggcucacugcugugggucuguggguaggcaacacuccccuuacccaugcagaccagcuguccugugaauagagcaccucugcuaacugcuaagaaacccugccaugucgggcagaugucuccaggauguuauggccugucccaggcuugucauccuucuuuaauguuuauuucuuucuaccucuguucuuccacuuuccuuauguccccuagaagaaauguggguccuuuguccucugguugcuggcacugugucccucccuucccugaggcccuucugcugcugaccuugugguguggccugcagucugcacagccuuacccagaacacugaaggaaacugaagcacagcccugccagccaggcucagcugucagacaaaggcaggcucugggaguccucuaucccacugaagcucagccaauuacaucccuguccacagggcuucuccuuggaauggagcuguuucucuaccuuggaccaauguccaucuugccgccagccugggggcuaugagaggcagcacugugacugucugugcguccaggggccugcugagcacauccucagcuucccacagccccaaguccugaaaccuggugagcacccagggcagaccacaagccuguguguagagaaagcaugggccccacccaggcugccugggguccuacucugagcacaagccauccaggcuccuggugaugaccccacucccacuuugucuuccaguggaacgcgaccguacccugggcuaccaggagccacacuggaaggaauuccacuuugaccuaacccagaucccugcuggggaggcugucacagcugcugaguuccggaucuacaaagaacccaguacccacccgcucaacacaacccuccacaucagcauguucgaagugguccaagagcacuccaacagguaccgucccucugcccagugcccaccccaccucauagccuccuggucucuggcagggguccuguccagggggugcauuuccaagaaaggaaagggaagccuccugggaaaggggccucagacaugagaaagggguuuggccugaaacuccugcccugucacucuggcuguggggcccucacuaggucacagcacugagccagugucccuaucagcacauggacucuaaaaugucaaggguugauuaucagggaaauguggaaccaaagacaccagcccagagucaagcagggaagaggcucugagagugguccccaggcaggcacaagauacaagcagcugugccaaccuccucagcccuugguuaauuguccuuucauguccacagggagucugacuuguucuuuuuggaucuucagacgcuccgaucuggggacgagggcuggcuggugcuggacaucacagcagccagugaccgauggcugcugaaccaucacaaggaccuaggacuccgccucuauguggaaaccgaggauggugagacuccaggacuuagcagggagcugcccuggggucuugggaggugguuccagcagaggccaccgggcuaguacacagagaccucucacuguggggguguugggagggagguguuuagccuuuauugaggacuugggcagaauggugagguccuggacaugggaaggccccagccaggaaugccuucugguccaccucauacauagcaacugaccuccugagaaccaggaccccuccaggaaagggguccuucucucugggcagcaagccuccacucugacagguucuguacuaggaaggagggguggggggaucugcaccccagguuuccugagcucagagcuaucacagcucugcagaguuguaacucagcagggaagccuguuuccuuggguacagauguuucuacuucacucacagggguuuccugggacauuuccuuaugucgggcagggaggacagaaaggacaacagggcaggaacagucucucuggaguccagcaaaaggcuggaagauagguuggaaagggaggacagggagguggcgggcaggggucacucuaaguuagggaaacguggcacagcccugggagaguuuagaguuuaacaucagggggugacagaugggacuguggcuuuaaaagaugcgcuaacuucagccccucccuccaggaggggggauccuaaccuggaacugccccauccccaccucugcccuggggcgagcucucuuggguacaguggagccccggugcucacugccauuugucagcagcauuaagcagggguuugaagugucuguccaaggcucuugagagacaggcugggcagcaggaauggccaaggguguccucggcugagugagacccacgaccaucccuggcaguguccaccucccugcucugugacgcagcgcagagcgcugcucugccaaagugcaccuggucuuucucucucugucccggagcugggagcccgauggcuguggaagauggcggcgcugaggcuucuggccugggcgcucccacguggggucucugcucuccgcccacgaccugcgcugccccaccgccuuauccgccgcuauguuucggaccgcagcgggaguguccauuucuacacggacccggugaaggcgguggagggcgucaaggaugggucgaccgucaugcucgggggcuucgggcucugcggcauccccgagaaccugaucggugcgcugaagaccaagggcgugaaggaccugaagaucgucagcagcaacgugggcguggacgacuucggccugggcaucuugcuggccuccaagcaggucaggcgcguggugugcuccuaccugggggagaacgcgcucugcgagaagcucuaccuggcgggcgagcuggaacuggagaugacgccgcagggaacucuggccgagcgcauccgcgcggguggcacuggcgugcccgccuucuacacgcccaca

SEQ ID NO: 2102 - RNA, 12884 nt, Mus musculus
gcgagggggccggccgagugccggcuuccggcggaaacgggcgcgagcaagauggccaccaccaagcgugugcuguacgugggugagcaggcgcgggagcuagacuuagucugagcaaugugggaaagggggaaagcagccggggucuauggagggcuugcugggccugagggugugagcccgagauggaaggacaauuccggcgaccuuccuaguccacuaagcgcacaggaaccccgacgagugacaagaauuuugggcuuccaaaucccucccgcccauucguuuuacaaacauucagugcggaauggcuggaucucugcccuaaaggaggaguuaccagacuaucuaggagaaagugggaaauaaccuacacacccuagcguuguaauagggacuaacaaugaugacaggaacuugggugagggcaaacuuucuguugccgggacgcagaaguugagcaggaguugggcaaagagucagaguagaggcaaagcuguucgcugcaccggagccgaagcucaaaggcguaaaagagccuggcgccuaggggcagcugggucauuuuucgagaaacucagggaaauuggggaaaacaaaauggaagauacaagagagaucggcgagagucggaugauaacccuguguacacuaccaaggagcucucacuuuaucuugaggacagugacauuuaagacuuugaagucuaagagaaccgauggauucauuuccacuuauauuugguugggggggggcgguuggaggaaggaauugaggcagagaggucaguuacaaagcuuucacaagaguuggagaucgaaucagaacuguuuaaaaggagauugaagaaaggaaaguaguguggguaggcuguagagagagauguuuguguagacaaaggacuggauggaaagaucccucccuuugccugucauaccagugacaggcaaagucccuggugugcagggaccucugaguguguaggacagcggcucagaagguccuuggcucauuugcaggcgggcuggcagaagagguggacgacaagguucuucaugcugcauuuauccccuuuggagacaucacagauauucaaauuccucuggacuaugaaacaggugggucauuugagugucuuuaacgcucauuacccuccgauagggaaagaauuaaagucacauuccaguucuaaauuuacauucuuaaguucuaguagaauucuugcccaccauaugaggcuuugguuucaguucccagcacuaaucacacagagacacacacagaggggcagagacacacacagagacacacacagaggggcagaggggcagagacacacacagagacacacacagagaggcagaggggcagagacacacacagagacacacacagagaggcagaggggcagagacacacacagagaggcagaggggcagagaggagagagacagggugggaauagcaagaucuuuaaacucugagucuggggaaucuccccacccccuaaaaaccaguagaguaguugauggccacgguggcacaugccuguaaaccuagcaauucagaggcugcagcgggaggauagaguuuaaggucagucugggcuacagcagaaacauaugcaagaaauguucuacugacuuucuaguuggcacuguugugugggggcuuuuucuuagcucagaauuugucucaggauaaaacugaaucuccuuacagguuuuagaauuuaucuguaguugaucagauuauauauuugguugauggcuuuuuuuuuuuuuuggccuguauuuguuuuuguuuuguuucuauuucaaaaugauuuaacuguguuguccgggcuggccuccaaacugaugauccuucugucuuagcuuccuaaguaguuagcauuacaggugugugcuguggcaccuggaaucaaauuguagauuuggauaaauaguugauuugcuaaauaacuuaccuugccaguuuacacuucaugagaaguugaaguucaauauguagcuuuaaaaaaaaaaaggauucauuuauuauuauaucuauuauaucuguagcugucuucagaugcaccagaagagggugucagaucucauuagggaugauuguaagccaccuugugguugcugggauuugaacucaggaccuuuggaagagcagucagugcucuuaaccgcugagccaucucuccagcuccucaguauguagcuuuaucccuagaagauguuuauuauugcuucagguauuaagaggaaucaaaggaugaggguccuuuguaaaucaugacugaguagguuuucuggugucuggacaugguaugggccggcuucuuugugauuguucucuuuucuucucuugccucacauagcaguuaccuagaucuuuguguuuauuucccuuuuuugcagaaaaacaccgaggguuugcuuuuguugaguuugaguuggcagaggugagacuuuugugcuuugcuuaagucuuuuguuccuacagagaaacaguucucagccuguggggguuguauaucauguauuuaaguuaugauucauaacaauggcagaauuacaguuauaaaauagcaacuaaauaauuguauaguuugagguccccacagcaugaggaacuguauuaaaggguugaguaccuacugcuaaagcggaagcuauuucccauuuacuuagguuccggguccuaggguaaugcuuucagagguccagaaaugcuguuugaagcaaggcuuccuaguagacugaucugucaauaacagcucagacccagucagacccugccugucuuacucugcagggcucuuccagcucuguucacugaacauucuugccuggcugugcaggugauuaucucuuaagccuucagcuagaaaaaacaccuucagcuagaaagagauuaugguacagugagcugaaaaacugcccaagaaguguuguuggucacacaccccaccuaggcaggaaguacagaggugacuuuuuccuguuuauuuugcuaccaagugugcauuuagacacacaagaaguauuccacuacaagccuaaacuuacacuuugcauuuccuuggcaggaugcggcagcagcuaucgacaacaugguauggcuggggauccucauucuaacugaaggugccuuucgcugguacagugggcccuuguucagauacugguauucugaauuucugaagugucaggauuggguggggagguaaagguuaccuucaaguaaaaacauccacugugggcuggucaguaguaaaauugguucccgcccagacgccuccccguuacuugagcacguccugcucacugaucugcuuggcuugucucucacuggccguccacccuacgugauagcaaacgggaaggguuucaugaaauaguagaccaguuaauaacagagaagagagauucaggaagagguaaccaaaggccacgcuacugacacagcugauuagaacagcuggaagaguccuuggaaacaauggcacucuucaagaucuguggccugccuaagacacuuauaugucaugucagaggugaagugcaaaggugucauauccuguggcuagaacuuugcugggaaaaaaaucuauaaaacuaaucaucucugguuacauauuuccauuauaaaucaaugcguaauugauucucauacuaagaaauuuacacuuuuauguuuuucugguuucauaaaauucuaauaaaagacuuuuuuuuuuuuuuugccacaaaguuuucacugcugacuuaagguuuacauuaaguggccuuuccuggugcugauaucuugcugaaguuguuuauucauuauccucuaccaccuauuuuccauguaugcuauuucaaagccgaucuugcuuucaaaggugaacucagaucuauguacauuuuucccugucacuugcauccuuugagcucagaauuacucuuaguagugcaggucuuuggugguauuacagguuugcagcagcucuggggaggaaguaccuuguaauuuucuuuccuugauacuguuuguggugagagcauagcuuucauugcuaagggaucuaggauucaaaggaaacaccaaucagguuucagaaguaaaugaaaagcugcagaguuguuuguuugagacaggguuucucuguauaacacuggcuguccucagacucuaaacuacccuugaacucagagaugaccugccucagccuccugaggauuacagaugcaugccaccaccaccuaggugcugccagaguuuuguaaccugacaguuuaagcagcuggauuuacaaucuuuucagaaugaaucugagcucuuuggacggacgauucgugucaauuuggccaagccaaugagaauuaaagagggcucuuccaggccaggugaguggguaccucagagugcuugucagguugucugauuugcccuucuuuauguguguguucagugcugcuucugggggacgagagugagggggacaagaggguggcucacacuagugaaggauauacauuuccuuuaucagugaauagucggcaaagccaaaguaauuguuccucucaugagagaacccuguguggucuccuccucguuuucuugguacuccauuucuauaaaagagcugaagccagcaaaacccuaucuuugucuucgauauagccuuuuccuuuuguccugcuaagagcaggcccucuagggagucucagagggauucaacaagggaacuucucuggccaagaggaccacagagaugaucaaggcagcugccggcaguggaggaauagucugaauuucuuaacuuuucugugucuuuuccuucuagucuggucagaugaugacugguugaagaaguuuucugggaagacucuugaggagaauaaggaagaagaaggacccgagccucccaaagcugaagcccaggaggugagggugaaaggggcguccugaggggcuugcagauccgagcauuggugagggcagugcuggggugaaggagcacagcuuugggagcuguguuuguaacuccuccacacccaccaggcagcccuccugugcagagguaacaggacagguaacgucacuucccuuuaacuguguguguucuggguuugccugggccaguuuugccugccgggcacauuuccugguucucagcucaccucccugaccacugcugcaggcaggacuuucucuguguacccugugagguuuauaguggcauguggcuuuucuguccuuucucagcugacacagcagcugccacucuuggccgucugcagcccuccugugcugcacugucagcuuugauggucucuguuucugacauuggacuucaguuguuucuggcugcaagucucauuguggcuuauuuggcugggaguggaugcucuccuuuguuuuguccugcugugcuuuugaucuuucuagccacacaauuaccuaagccagaaguuuguuugcagaccuaaaguagcacucccaguggagucccuaauccuucuuuacaguagaaccagugcagucucaaacgcaggugcuuuuccugacagccuucguguacuguuggaaucugugucucgccuugucuuuuguuuggaaauuuucaguuguuuguggcuacagucuuggaucuucugguccuuucccaaggaagguaaucuuucuagagcacagauccaaucauuccaucucacuccccugucaucucaggguguaagagcccggcagggcuuccggguccaucuuguccaucuugcagaugucauuuuugcuucucuauaguguacucccuacucuaugcuuagugaaauacucuguuuccaugcauaaguuuguuuuugcacaggauacuccuguacugauugccuuuuucuagguaauauauuuaaugagcugaggcucauuagauguaugcauauuguguguauauguauacaguauauaguauauguaauauauaucuaacugcauagacuugaaggaagaaaguagcuucaggucuuacucaucucuacucccaagaccccgggcaauacagcaagaacuguauuguugcugcugugguauugcuaguaccaauguaaacagcaguaguuagagcauccacauuauuccaugugcuugaucaugugcuuuagucuccccuacuuaaguacauagcaagccucagccucuugcccuuugagcauuuggaccgcaucagaagggcucccccaugcuuccagaguaagccuaugacagugacaauugugugaguguguccacuagauguaguaagcuauaugacuugaccuaggcacugaagaugagcuggguugaguauucugacaaggaaggcgaacaggcaugucugagggugaguguggagagauaugccuaugguuaggggguccuguuuuauagggcugagugagguuuccugucacuggguguccagcugaguauuguggccauaguuccugccuccuacaguccuaucagggcccaagaccuucauugccaacaucuguguucaggcuguuugauggcgcuguguucugaagauauguucagaggauuucuuauguacuuccuuagggaguuagagguccucugaccagcauuuuuguuucugcaccuagggagagcccacugcaaaaaaagcccggucaaauccucagguguacauggacaucaagauugggaacaagccagcaggccgcauucagaugcuccuacggucugauguggugcccaugaccgcaggugagcagaccccugugcucagguggcaucaagcugauggcugagcagucucucaagguucuugcugccccagcccuuagaccuguggcauuguuucugaccugaauuaacuuguagcaucuaagauccuaggauauaguaacagaggucagguuuauaauuuuuuaauaguagagguuccuuuuuuuuuuuuaaaauaacaugguaagauugcauuauuaugaauauugugaaaaucauuuaaaagaauguaucaaacacauugucccaacaauauuauaucuagcucuauguuccagaaguaacuaguacuaauuucuaguucauuaaaauauugauuuauucuuuaauguaaauuuuauuauuuauacauuuaguuuaaguaguuaucacaaaauuugcuuugaaaaaucauuagucccuguaauaauagaguccaauaaccccauuuccugcccuacugucagcaccauuugcugcaccucagaggcagccaguuucauuucauagcugguuauuuugguuuuaacuuccauauugaaagauaauagcuuuauauucaccccuucucuuuuuaauuuuauaaaaauuauuuucaguuuaggcauucucuuuugauuuagugcuccagaaaaggaauuaucuuuuccucucuucaacacccucacaucuuucuugguagucacuuugguuaggccgcuuaugagugccuguaacuuuagcuccaagggauuggauacucucuccacuuucacauguauauacucauauacagacacaccacaugucacauguauauacucauacacagacacaccacaugaccauuauuuaaaauaauuauuguggccugguguaguggugugcuuggaaggcagaggcaggcaaaucucuugaguucuaggccagccuggucuauauagaguuccagaacagccagggcuauauagugagacccgugucaaaagcaaacagauugguuuuuguacgugugugugcacaugugcauguggugugcaugucaugacacauauggagguuagaggacaacuuuuuagaguuccagcgaagacaugaaauguucacucacacuaguuagaaaauugauggacacagcaaagaaacaaccaaguugaaguugaugagccagugaguuuauugugguugccucaggaguauggguggguaguuacuuacagaagcacaaauugacucaaucagaugcaccgccaaaggcccauaauggcucaugaaagguagaaaccuucaggcgccuugauaaguuagaaagcggcuuuccaggcagcuccauguaucugaaagugucucucagcaguccuuccuucagggaagagaggauccuagugaaucugcucaguuucagggacuucuugaugcuuugacuuacuuccuuccugaguugauaaggcucuccccuguaggauggaaaguuucgccuuuuuagaacauccugaaucgcauuaagcuucccuccgaggugaaacuucaucuaggaagaaaguggcccucagcugucagcucuguccuuugacucugguucagacgcaggcuccaggcuugcacaguagcgccuuuacuucacuggcucuggauuuuuuuuucuuuuuuuaaaaacaauuuaccaacacguuagugugguuuggggaugcaacagagagaggaugcacauauucacuuaauccgagugccauaugguuauuuaguaagucagugucauggcagcuuauaaggggcauacagugagaauauagacuaugaucagcccucuccaugcaugguccacaucugugaauuuaaccaaucacauagcagaaauauguaugggccagucagauggcucagcagguuaaaguccacgcugccaaacaugaaaaccugaggugagacuuagggcccauucgauagaaggagagaaccaugccuuguaaguuuuccucugaccuauauacaccugcacacaugcaugcacauacacgauaaauaaauauguaauaaagacuuaaauauauuugaggagaacauugugucucuacuaaguaugcguguauuguucccuugucauuacauacccuagauaauagauauaaaaccauuuauggagcauuuauauuguaucguguaucauagauaauauaaagauggcagaaaagauacagaauccaggaggguucugggaaccauccccauguguguggauacccaagagcagcugugcaaaacuaaacauguaaaacauguuucaugauuuauuucucucccuuuuauaccugccucccccuguauaucuagaugguuaccuuaauuuuuauaccugcccccccuguauaucuaggugguuaccuuaauuuuuauaccugcccccccuguauaucuaggugguuaccuuaauuuuuauaccugcccccccuguauaucuaggugguuaccuuaauuuuuauaccugcccccccuguauaucuagaugguuaccuuaauuuuuauaccuccccccccuguauaucuaggugguuaccuuaauuuuuauaccucccccccuguauaucuaggugguuaccuuaauuuuuauaccugcccccccuauaucuaggugguuaccuuaauuuugguuuggaagcuugauugccuuuaaccucagccccuuuuccuuuucaacgccagaaaacuuccgcugccugugcacccaugaaaagggcuuuggcuucaagggaagcagcuuccaccgcaucaucccccaguucaugugucaggguggugauuucacaaaccacaauggcacagggggcaaguccaucuaugggaagaaguuugaugaugaaaacuucauccuuaaacacacaggaccagguaagcacugauucugcuguggcgaguaaggcagggccagggcaaauagccugggugugauuggccagccacugaagagacacaugcugggcugggcugggcugccugccucuccagucuuguacuuucccccaccuucauuccacaaguugguguucccugcuaggguaaagguugugguuaucccugcaagcucccugugcccucagcuucucuguguccccucuauacccucagucccagucaaagaucauagucugugccuguucuucugagguuuccauauugaucugaggucuugccucgugccugccacagaugcaugcucugacucccuccuauuacagaguccaucuaucccuccugggcuggauggagucugucccucugccacuuaggaucuucaugucuccugcuggcucccuuugacuuauaaacuguguuuccccuguucagcuaguuugguccaucagugaccaggcaugcaaucucaaucuuaaaaaacccaauaaccaccuuuggacucuuguuccuuccaccagcaucaucuugacucucuacuuuuuagcaaaacuuuuuagaaaaaauguauaaacucacugccuucauccuuucuaaguccuucuaucuagauuuuuagccccagcuggccaugcaaaccuuucuuucuuuuuuuuuuucgagacaggguuucucuguguagcccuggcuguccuggaacucacucuguagaccaggcuggccucgaacucagaaaucccccugccucugccuccggaaugcugggauuaaaggcgugcgccaccacgcccggcuacacgcaaaccuuucuugcuaaagauacuaaccaucuuuuuugccaauagccaguuuuccgccucagcuuauuccagcgugucagcauucugugcugacagugccauacuccugcucucucugucucugucucucugucugucugugucugucucugucucugucucucucugucucucucucucucugucugugucucugucucucugucugucugucugucucugucucucucugacucucucucugucucucucugcacuggcaggcggccccuccaucuucagcggcuucaucugcuuugccaccuuucugucgugcugcuuccuccuguuccauuacugagcacgaugguggucagagaugaguucauuucucccuaggaaccuguccacugcgccucuguucuuccugcaagcuugugcuagacugaaguacagggccaagaaguucuuccugccugcauuaucuuacaagaaaguauguccugacacacuuucacaagaguuauuccaacgugugccgcucagauguuagaagacagacaggcugucgcuggcaauuuggauaccacagaugguauugcuggugcugacacaauuuugugaaaugauguauaggauuacauuauaguguuaauucuugaguuauuuuucuugguuuguuuuugagacaggaucucacacucuguaaccauagcugaccuggaacuugccauaaagaccaggcugaccuggaaaucaccaagauccaccugccugaggcucccaaguacugggauuaaaggcguacaccaccauaccugguuugcuuuuugaaacugggucuuagagugugacucaagcuagcacugaccucuggauacucaugagugcugagauuacagacauguacugcugcauacggcucccuagaagauuucacuacacuuaaaguuugccguuugugaaauauaauagacuuaggucuuaacuagaaagguggcucagugguuaagaacacuugcugcucuuguagaggacccucaggcaucacagguuaaaaugguucuccuucaacucccuuuaugucugaguuucaguagauaacuguucacuuaugccugaucagggguugggacucaucuuggauucauuuccccugucacccuaguugcaccuugucucuaguucaucuccuggcccagcuuuccuccuucccuccaugugacugucuuaagcuucuccccagcacagaugucccugcaucucaguugucauagcacaguagccuuuacaagagauguacuuaucauuuggguugguugcuuguaccaaguacuuuaagugaggguccaugcagcacagucgguguggaggucagagcacacuuugaggagacaacucuuuccuuaccauagguucuggaaaugaaaugcagauuguccaacuuccacagcaagcuccuuucucuguggacccaucuccccagcucauacacuuacacuuuaaauaaauauuuugcucaucaguguuucaggauuuaaugggccugguuacaaaauagacugcaagucauuguuauaaaugaaaagacaaauaaaugugaaggaaaaaauaaaaacggaaacagcccacucauccuuuuucuguagugagggaaagacaaggugcugugucuguuaggacccuuccauggccugagccaguaugcagaagcaccggcagccaucagcacaugcaccaugggcugggagcaguguggagggagcugacaaguuuauuuucuccuaggccuccucuccauggccaauucuggcccgaacaccaacggcucccaguucuuccugaccugugauaagacagauuggcuggacggcaagcaugugguauuuggggaggucacggaaggccuggaugucuugcggcagaucgaggugggugguuggaaguugcuuccugccuggaccuugcgugggugggugccccagugggagaguuggggagggcucuugauguccuggaagggggcauuuagagcaggucccugaaugucuggggagaggaugaugcucuagcggcucucgcauccugcgucucuccugauuucucuguucugcccgcacaggcucagggcagcaaggaugggaagccaaagcagaaggugaugauugccgacuguggagaguacaugugaggcugcgcucucugcuccaccucuguaagacgaggggaacugccuggucugggcccugugcagcaagcuguguagagcacaagccuuuccuuggggucaccugccuuagcagcugcucaucugcagugcccaggccuucugcaggcaugacugggccugaaagccagcauaggcagugugcugccgccaccuguccugaacugucuguagcugcuagguggcuucuuugcuaaaauaaacugcuuguuuuguuuuuuuuuuuacuguugccuccugca

SEQ ID NO: 2103 - RNA, 2228 nt, Mus musculus
ucagguacuuagcugaacgaggcuuucucgggaacugcacaaauauuuggagucgggcaugugccaauaggcaauuaauugaaauguggacacagcaagcuuccggaggagggaagcugaaguugagaaauuagcaguggguagcgauucucuguuaagauacaaaacaguaauuuggggauuccuuuaccuccaacugaaagugauuugaugggggaaaaagaaaggagaagaaauuaaaaagugagcuaguaagguugacuuuugcagacuggaauagggauugguucuccgauuacacagcugggacccuuguggagaggaaaggggagccaaggucagggaugagaccaggaaacugcaggaccagaagcaagacaccaggcuccagcccugggcacuuugugcuuuccaagcagacugucuaccuggagaccugauuaccauaucaggaguuaaagggugagcacugcgaucuaagcuguuuccugucucugucgacugugugaaugcauuuagcaaaauccagcuucuauugacugaccuuagcagcggagugaacggacaggguccaccuugaccaagaucccccaucuguguucugccuaacacuggcgauguacaggcugaaaaguacagucuccagggcuggggaccggcuaccugacagagcacagcccuggcaaauagggaggccuguggcuucuaccaacaggaccgcacccaugaugcuggccuguggcugggccggacucuuuguuuuccuccagaaagcagggaugcucacucggcucccuucuccagcacacugguccucugcuuaugguguuuuauaagcuuuauaagaagugaagggggacucacucugucuuugcucagguacggaggccagacuuacucuuuugagggugccccaagaacacggcuuucaaagggcagccuucggagccaaggagaaaacgugaguuccccggauccaagccaucguucugaauccagaugucagagcgaugggguccagcaucagcacaggcuuuaacaagcccucgggggauguugaugcucagucaaguuugaaagccaucgcccuaaaaaauuaugaucaggaagucugggccgcuagauucaggcacucggagaguaauauauuguugauuauuggacccuuaagaauaaauucucuuccuuucaaaggaugcccaggugagcuguucccacacauugcugaguguucaacaggaaaacauuuccaagccauucuuuaaaaucgaacugaccagcauggucagacgagagucuagcguugcaaccuauuuauggcaaguguagaauuuucauacuuuaaucuuccauggaaugacuggauacguuaauugauugcugacucugcuauuuuuagacuugcacuuccuuaccucauaugaagauguauucagaauucaaaugggggcuggugagauggcucagcguuaaaaguguuugcugccaagucugaugaccuaaguucaaugccaggaccuauacaauggaaggagagaacaccugcaagcugaccuuugaccucuguacaagccccacggcguaggugcccacccacacauacaaauacagaacacacacacacacacacacacacacacacacuaaaauaaguaaauaaguaaauggaaaaauuaaaauuaaaaacauaggccaaaguacggaggagcauaaauuggaaaccucucuguacaaaagagagaguucaagaccagucuagccaacuuagugaguuagucauuuuuguauaugaaaaagcugggcaugcagguccacaauaggugacuagucuuucuugagcaaagccccggguucaauccccgguuuuccaaaauagaauauucaaaugggaccauuuuauuacccacaaauauuuucuuauauacuuuaauguguuacuaaggaaaccaguuauaacagugacauuauuucgguaaugaauuauuaggcaguauagaugucagaguauaaucucucucccaaacuucacauagacugugcacacuucuagcacagggcaugagaacuaugggagugaggcaguagggaggauuccugacccagagugacaggaguuuccagagaaugcauucuguaccuuucaugcguuugcagaguggggugauuccuccugugugcgugcgugcggccccaggagccucugcgugccgccccaggagccccugcgu

SEQ ID NO: 2104 - RNA, 15627 nt, Mus musculus
ugacagccacucgaacucgggaucccgcgucucagggucgaaaccuguggcagggacaauggagcacggacugagccacgggguugaaaagccagcugcauuucuguaagauuguaugugguggagacuccccaagcccgcuucgcuccugcucagcuuguaucugaaauccaaaugcaauuaacagaagugaagaagcuagggcucugccaaagcaggacugauucauuauccaacaaacuuuauuagguggggaauuauuaucccaaguuuauagaggaggcaacuaaguucaggaaggauaugcaaaguagagacuuaaccagaugcagcacuaaagagcaggcuggagauuuaacuucccucauccuucuucugaaaccuccuggccacuacagacaaacuagaaauaagcuauauugcguauguuauuuaauguacuauuaagacaaguccucuggggccugggaugcagcugguuaggaguacuugccuagcgugcaccaucaagcuauggguuggauauccagcaccacauaaaacugguggggggcugagggagagaacagacauccauaaucucaaagcucaggagguaaaagcgggggggggggggggggcacgacgacgacgacgacgacaccagaaguucaggaucagcuugagcuacucucauaaucucaggcuuuaggaagcaaggaagaucgugaaucccagaccugagcaacauguugaaaccuuguacacacacacacacacacacacacacacacacauacacacacaaagacaaccuucugguacuccuaauccaauguguaccccuccccugcagaaguuccugagcaaccucuacuucugacucaaacccaguccugacucucaaaccuuagcauuaacccuucuugcuaaacccuucuugucuugccugcucggcuuguauaacugcaugaaccagauccaacugcauugaggaaaucuaagcucaaguccuggguuguggcauggcuaggcacugcuuucaaagcugaagucugaagaaguggaaaaaaaaaaaaguccacauucacauacagagaguggcagagcuggggucucaacuaaaauuguggcauuuugugggucuuagugucaaaaaccuacuuguuacuucaacucaugaauggucucaggauaaguuucuuauauuugcugugucagcuuguacaagauacuuaaaagccccucuccuuuaaaaaaaacaauauuuuuaaacugggagguggugguguacagcuggacacacagagguccaccugccccugucuccugaguacuggaauuaaagauguguguuacaauaccuugccauuauuagucuuuuuaauugcagaauugaggucaaugggaaagacuagacucuugggguuccuagaacuggggggggagguguccuaaaacuugggucagaaacuuacucaucaauaaaacaggaaauccacuccuuacuauucuugcuccagaaaugaaacaagauaaccacaguuuguuuugcaucauguagauagcuaggaaaaugucuggcuuacgguaggauuucaguuugaagugagcuugccccuuuccucaccugucuguuucuucacugaggcacuaccucacccagggaggauuaaggaggagagccucaucccuucauauggaaaguguuagcuggugggaauucaaggaucugucccugucacccagguuccuuccuaaggaagcccuguccugauggucagagcaauaagaguugguacagaacuuccauguugguuaccucagacaggguguggaacccccaaggaaagaggaaagagggggugagaagucugcaagacagacauaaaaagugacauauccucaaucaauaucucucucuuccucucugucucucuguuucugucucucucucugucucucucucucucucucacacacacacacacacacgccucuugaaauaauuccucuggcugccuaaguccuucauuugcacaaaccaugcacacacacacacacacaccuaucugaacaauacacccagcaacuucagaaccaccuccaccuccuaucucuaugggauacacauacacccaucucugaacaauaguguuaggguuuccuaccucucgucucaaucaaauuuagacaguuuucuauucaauccuauucccaaugaaucuauguaugaagaauggaaggacuaaucuggccugaacuaguuuggguaaaugggaaguugagcaaaauuguguccucugguaauauuucaggggaaauuucucuacuuaccacuuuauaccuaugcauaauugggagugcauaugauuaaaaucaggugcuuuauggggaggggcacgcacaauagaaaaaaugaguacaugacuuaaccuaucaaucaaucaauacuacaccccuuaguaacaagucccuucuaacacuaggugauauuccaggacccuugaguugaucuugacagugucucccucuauaacuuacccuaugccuuuguucugcugacguuagcuugccuuuuuuugcaaaucugugugagccccacuuuucaaugcuucggauaagaggccaagaaccuggaacacucagccuggacccugaccacagauaacaauaccauauucuguucauccacucagcaaauauucaucuaguguguaguuguacagacaguguucugaucaguuaggaugaaguugucaacacagugcaaacuccuggccccggugguaccuugggucucaucugaaugguuuccuuacuuucuauucuaucuaucccaucgucccaaguccuaugaccacaccccuagucuaagccucauuuuuaaaaaacaguuugugggaaugaauguuuuuccagaaucuguacauuuacaccucacauaaauaguacacaaggaggccaaaagagggugucagguccucuauaacuagaauuacagguaguuauaagcugucccguggauggugggaauugaaccuagggccucugcaagaacagcuaguguucuuaagggcggagccaccuauccagcccccuaagccuuaugcuuuaugucugaaccaugguggcaccugccaccuacguacuguucugcucucccugcaccaggcucucacugccuuccauaccugucaccaguggagugucucaaacugccaaaucuuacuggaaacauuuggaaacucuuugaagggcucuccacaagcugcagggcagaguccaagccucucuggacuuuguuacucuuccugagcugcccuuugcucaauccucuggcucuccacaccuguccgagcugaguagcaccaaccacugcucccggaugcccaaugcccuuucuccuucuuuugccugauuugggggguggggagugggagaggugcuuguuuuccuuauagucugagcuucaaugucaccuccuccgggaagcuuccucugagcuguuuacauaaaaagaaaggcacgagccaaggaagcucucaagcaaagcccuccaggaugcagaggacacccaggcaauccuggccucaccuaggaggaacccaccuugccagcucacuagccauacaugcaggcagggcccuugcccucucuaaggccugaguuccuuuaucuauagaaagagacacugauaauaccaaccuuguaagguaugguaagaguuaacaggcuuagaaaagacucuagcucgauauggugccaaacaccuuuaauuccagcauuugggaggcagauucucugugaguucaagaccagccugguccacauacugaguuucaagauacccagaccuauguguacugagacccugucucaaaaauaccaaaagagagagagggagagagggaaggaaagaaggauggggggggggagagagagaggaaggaagaaagaaggagucuaaagcaugacacaucaaugauaaacuuuagauaugccaggccaugguggcacaugccuuuaaacaaacuacucaggaaacagaagcuggugaaucucugaguuugaggccaaccuggucugcagagccaguuccaggacagucaaagauauacagagaaacccuuucucagaaaaaaaaaaguuuggauuuuggaagauuuccacuuugauacuucgauguuagggauguccaaucucaauauuaauauuaauaauuauuauuacccuugcuugcaaccacuacuaacaaucauaaauuaucuuuauuauguuacauuuuguuuauuuacuuauuuauucauuaauuuauuauuaacuauuuacaaaacagcacuuaaacccauccaaggcuccauuaauucuuguccugauuuccuuuuaccaaacuagccuccaaagucggucaccuuccuggcacaccuagagaaaugcuuggagccggauguuaaggccccauaggcagcugucauaggagacaaacccucguacguuccugcagagaccagacauuagcuuuaaagggacuccuccuuaucagugcccggugagcaccugagccccagcaccuggcagcaugaauuugcauucucugucacugggccuccgcucuguacacaaccucucugcuugccuggcugaucucccaucuaaacaaauuuugucaaauggcaccaacuucuucuugcugggccaaagcuagccuuuuuuuuuuuuuuucuucuccagcugcaauggggaacagagcaggguuugagcggaauacauuugacagacuucucuugguuguagcuauggauacuggagaauuuggaccccucugcuaacuuggaggaagccccgaauccucagagucacagcccaguuaacauucagguuuaguaaccagaaacagaaaaccaaacgccggccaggugugguacacaagcuuguaaggccagcacucgggagggaagcugaggcagaaggaucaggaauagggagcgaaacccucaucucaaaaagggaaagcaaacguguagcuagcuggcagcccaggcacugugacuccaugccagcagccuugagauggugcggaaacugaguuguaugaccccaaugggguuggaaagucaacugucacuaccaagagaguacagcagugcucucagccaacacagccuuuccaggaaaccuggcucuuaccuaccuggacaggcucuggccacuuccuggaggaacguucuggugugugaaccaaagggaaguuggaauacaagcuugaguucagcuguguucaauuguacugucacaucagagccuguagagaggagacaagaaaugcagucaccaguagcuaaauacuaaaauguauuaagaggagacucugcgagcuagagagcuggcucagcuguuaggagcacuuaacccuuccagaggacccgaguucaauccccagaacccacauagcagcuuauaacugucuguaaccccagugccaggggaucugaugcccucacagagacauacacaaaggcaagacaucaaugcacauaaguuaaaaauaaauauuuuuuuaaaaaaagaauggacucugccugguggagguggcacacaccuuuaauccaagcacucaggaggcagaggcagacacaacucuguaaguucaaagccagccugguguacagagcaaguuccaggacagccaggccuggaaacagagagaaacccugccuugagaaacuauuuaaaggagaucuggagagauagcuuggagguuaagagcacuggcuauuuuuccaaaguuccuaaguucaauucccagcaucccuaugauggcucacaaccaucaauaaugagaucugauguccuauucuggcaugcaggcacauauacaggcagaauacuguauauauaauaagucuugaaaaaaaacaaaaaaacauaaaaaaaaagagagagagaaucugcaaaauggcaaaucagaaagccuaaacuugggcuagugaaauggcucagcaguuaagaacacuggcuacucuuccagaaguccugaguucaauucccagcaaccacauguugcucaugaccacaugaccaucuauaaagggaucugauggcacauaggugugcuugcagcagagcacuccuacauuugggggaagaggagauugggagauugcugugugauugggauguaauguggauuuaaguucuccagcucugugaacugaagagcaugcagaagugcacugcagcaccugccuaucugcugguccaccguagagccaggcccugagaaugacaugaugaggagaaaagacuacacacaggagaggcccaagcugaaagauguggcacuuacaagagcaggggacccuggggccacuggagauggcucaacagguaaguguuugcugccaagccugaacgagcuguccuuuggucgccacacagacaccaugguaauucaaguacacauacacacacucuaaauaguuagugugguaaguuuuuuuacauuaaagguagguuuauugggaagcugcuugggugggggcucacugguucaaaggacugaggccaggcgaaucaccauggggaaagguacagggggaaggaaguuagaaagggcucagggagagaaggggagaagaggagcaugggauaguuuuuuuuuuuuuaagaagagcgaacuggcggggcagugguggcggcacaugucuuuaaugccagcacucagaggcagaggaauucgaggcuagucuggucuacacagugaguuccaggacagccagggcuacauggagaaacucugucuuggaaaaccaaaaagaagaagaggaggaagaagagaaggaaaaggagagggagagggaguagggggaggaggaggaagaagaggaggaggagggaaagaagggggaagaggaacagcagcaggagaaagaggaagaagagaaggaagaaggagaggaggaaggggaggaggaggaggguuacaacuuguggugucugaggugaugauggagcccaccuggaggacugaaacgcacugacaaggggugauuaaggaaaaagagcugguagaggguagcaccugauucuuagucaccguaguauggacaccaggaaaguuuucucuagaguaaaagcccagaagcuggaucuuucauucuaccuaguggguucugggacucgaacucggaaaguuggucuugacagcaagcaccuuucuccacuaagccguuccaccaacccaagaauuuucucuuuugguuuguugucagucuacggcuugccuagaacucacaauguaaguccagacugaccucaaauucaaggcaaucccccugccucaagccucccacaugcuaggauuucaggcaccuagcaucacucccauccaggcauguucucguucaucuuucugucuuuggaaccugucccauugaccuaacagggacccagauugaaagggcuacucaccaaggauguagaguucaccaucuggggacacugagggaaggaaacgagaaugucuuuagcaacugaacaucccugucccacccacauagccaccacccucccuuacagugagggcagagaugaguugggggccacccagaggagagcauaccacccggcccaacuggcaccuucuuccagcauaaaaucuuuugagaguggcacuaucugguccagagauacaucgucuccugugauggccauccuccgguguguauacaggaagagacuaagggcagaaaugaguggaaggcccagcuuagagugcuuguggucaccugugggucccuagugcuuagcuggcagugcccuagccauacgcauggcucaggcccuuuccaugcacaguguccagugaugcaagagcaguacacauuccaaccaucucuucaaccccaucccuucccuuuuugagguagggucucacucuguagccuaggcugugcuuagaauguagcccaggauggccuggaauuugugacaguccugccucagcuuccuggugcaugugcucgcucguucccaguucaacccucuguacuuuacucuggguaaauggagcuaugaagaacaauuugcauaggauugcagcauccggauuuaaacucgggcacucacacaaacucaaaaucuggccaaguuugauauaacugccucuccucuaaaagcuuccacaucacaucuugcugauuauuaaaggcuuagaacacgguguuccagaacacuaucauuguguuaauuagucuaggagacucagacagaaugacugaaguccagcuggaggauacugaagaaccacccauggcccacacaggcagucugagcccuacuuacgcaugcuccugggcgucauuuuccagccgguaccucaccagcccgagcaggcggcucugccggcuaucucccuuacacagcacaccuuggacugccugcugcucagagugaagggaaacugaaagccaaagggcgaaacuccccauccggcccacuccaccacgcugccuuucccucucccacuggcaaacgacuucaccucucugaguuuuccucaucugcaaaauggguauaauagucuccaacuuugcagcugguugagaaaauagcuaccuauguaaagcaccugguagagagaccagagccaagugaauacuugguaaauauugguuuaccuuuucccauauggcuucgagagaaauuuuuccacacccuccaucccaccucccaaggcugaagcaggcacgaucuggauggcaaccuacaacugggaaggauaugaugacgcaguauucccccucaaccagggucuccuggauugccacagacugguccaugcugagcugucaaacccugggguagggcaggugggaaccucccauuccguauuagagcugcuucggggggcuguggggaugaagaaaggggccuuuguggagggaaaagagagagccuggucaucucucuucuccuucuggccuuccccgucuuuccuacaaugggucucucaacguuuccagaaaauggguuucuaccccuuugccccuugcucggugucgccccagauguucccaguggaguucaguaugcucucuggucuccuugcuucuggguacagcucugaugcccucuucagggagcaguugugguccaucuggcucuucucugggaaagguuggugguguguccaaauagggguagggagacagccuucgccucagucucagcuaggagggucuuauucuggagaaauaacccagccccgcugcucuuuccucggagccugugggugucccguugcuccuugccccucaccccacccaacaggccccguugcaucagcagcagguuaggaguguccauucuggcacccacaggacaagggccccagcaaccagcuugcaagcccccucccacucugcacuuauuucagauccuugucauugcagccuaccucccgagcugucaccggugggccugcaggacaccuccguuccagggcagauuaaggacuacauuucccagcggcccuggcgucacaggacggacagccagccugcaagucccagcaugcccgagucggacauggacgaguaggugggucuccccgcccuuacucuauuuaaaaaucuagaaucuacagucuguauucaagcauacucgggcgucccaguucuggaaagccugcgugaggaacgccuuucucagcccacuaaaucaaagggccaaggcccauguccaaggcagaaggaaguggucauguuacccuaacggaaaaaaugauguuaacuuuuauuuucaaguuaaguccauccucaacucuucacaugcagaaagggacagcuuucuauuauucugaaacacuuccagauaacuaccgugcccuggcuucauguaugucaccuucuccacuugccagguggagaaacggaggaacagagagacaaaacuguuugacaaaguccguagccaauaagugcugggugcccagagggaaguccaacuccaauuccugugucauuuucccgucuaggaacugcuaaauguucuuaagaccuaucuagcuuuucugucaauggaacuugaaauguguggcaucuuuaucugugacacaguaaugacaaccaccaggcagcgcggaggacucuucuuaacagcggaggacgauguggcccucuuggcucuuuauuucuuuaaagaucuguuaguuuuuaauuuuuuguguguaugugugugugcuugcaugaauuuaugugcaccgugugugugugugugugugugugugugugugugugugugugugugugcacgcucaccuaagaaggccagaggucaucagauccucggggcuggugacaggaggcugugagacaccugauguguguggugggaacugggucccaagaaagagcaauauguucucuuaacuaaggagacaucucaccgcaaugcccagauagacagcccugagcagguuuuguccucaagccccuuagccacauucuauuggccauuuacccugacaggaacuauucucuuccagacuccauuguucccuucuagguaaagacuauauauagcuaaaccggggaugguggcacacuccuuuaaucccagcacucgggaggcagaggcaggcggauuucugaguucgaggccagccuggucuacaaagugaguuccaggacagccagggcuauacagagaaacccugucucggaaaaaaaaaaaaaaaaaaaaaaaaaaaaagacuauauauaacucaagacaggacaaaagaagcuagcucagacgagagagucuagaaugguugguuuuuucucaacugcugacuauuucgguaagcuggaucccugaggacugggcugaaucuugcccuuacacuccugugcaguuucugguauaguggcucugagacuuucauuuauuuauuuugagcaguccugaggauggagccuaggaaccggaacccagggccucacagcugccaagcaaacacuccaugacugagccacaucuccaucucagaacauguucaccccaauuaguuagcuuuacugauuuaagauugcuucucgccgggcgugguggugcacgccuuuaaucccagcacucggaaggcagaggcagguggauuucugaguucgaggccagccuggucuacaaagugaguuccaggacagccaaggcuauacagagaaacccugucucgaaaaaucaaaaaaaaaaaaaaaaaaaaaaaaaaagcaagcaguugggccaguguugcagaauggauggccacuguaacuuuuuauugcuguuguuuugagauagggacucacuaguuagcccaggcuggcccaaaaugugccucaaacucauagugauuuuuaccucuaaacugucucauugaccccacacccaccccuguaaccuuuaaccugccccccuccuuuuuguuuugaauugaacucugauaaccaguucaaccugcauguugcaaacuccucccagacucuuccugguugucucuuucuagaaacauccacagcacaacuggaguucaaguugauugggcugcaguuuugaagucaaaugggggaugaggggaaagggcacuaguuagagaucaaggcacugaaggucacugaaggaaggcaggaaaaccccuuaaagcugaucguuagagaggaggggcuggggagauggaaugggcgaggcuaggcggucuuuacagaccgaacuaucccugcaggauuugggggggugucuucccaaaauguaggucagacaaguauauccuccccacccccaaaagucuaagccuccucuugggauuggggacaaggacccauguucaaggcccagacccugugaguggggaagggggaaccuggacuugguaagucaugcucucuaaagacacagcuccaggguuuggagcagggagaugugaaggcuugcaguguccacaaauucuuuucagaugucacucucugauaacugcugagcccagguaguggaccagggacaggaacagagcaaagggaggagcgucuguagcuacacuggggauccagggcaggggguuccuggugacucuuggaguggccuuguugaaguuaagggucccaucuggcuggaggcagccaccugaggccaaagcuugacaguacauagguagcagggaccagccccugcucccugacucuugagugugccugucugucaugcagaccugucugcagccagcccuagguguagucugagcuggaccauuugagcuacaagaauagacaggaccauucauguuauccuuguccuucccucagcucuugaaggcaagaagucuuagugaaacuagaacugagcugagcucagcuuccccaugaggucagcuccccaugaggucagcucccaugaggucaggcugucauuucccagaaaaccagucgguuagaaauaaggggccacauucuggaaaauuccaccugauucccccaaguugaggugcuaugcaaaacagagagggucuggcuugcucaaccccaugcaggcuggcucuccacaaauguagcucccucuagauuccacugcugagcuauuucagucuggcagcucugaggaagcacugucagcccacuucacagaaguucaaguccuuggggcacauggcuggaguguccugcccuuugaaacaggcaucccccuuugcaggaagacaggguauagguuaucuccugaaagaaaauggaagguuugaagacuuaaugcuagacagaggagguaggggggagcccugcugugucugagccacugcugccccucccuuccacuucccccagcaggcagcaauguacaagacacaucucucugaggaguggacucagugguggucaccaagggggacauggggagcugccuguccucugugaugcucagagaccugcuucuggaaacaggacacuuugcccggggaaguguugggacaccccaggaugggaguacagcgccucugugaagccacagccccuaccuggccccucuaggauguacaggaagcuuacaacccaacaccccucucagcugccacucucgacaagcacaggcaguuguuccacaaugaacaguagguggagugccucuccacuauagcaguacaggggugagggcuggacucugaguccuuggacagcagagaagggcuagacuccguucaucucucacccuacaacugagcccaccaggccuuguagugggaagcguuaaguugaaucaccugaaguaaacauagcagaaaucccaggccuguggggcuuuugccagccagagggcauaucuuaguuucucucaucaucacaagagggacucuucucucucucccauuucagaaucucuguccccagcuguugaaaugacccccuaacgcccuucaccuuagaguggugucucuucuggauccuaucacauccugcccccuaccuugcaguaccauucccuagauguccauccugccgccugguaggagccccucaccuucugggagaacacagcucccaagcaauggaagcuacagcaggucuguggcugagcugagugcuguggccccauuucaagcggagggcaucagucaggaaaggucucucucuuucacaugcugcuuacuuggacuggagcagggaucagcugaccucuuuucagacucugggcuuccaggaagaccagcaguagaacuggcuugaggaagaggugacacagcaggaaguggcuagagcaaaggucacaggucagggaaaagcuacuggaguuaaauggaagaguugggagaagcagcaucguccggucuagcaauaaguccgaagcuaggaauggccccaggguccaagcaaggccaggaucucagagcugaggacgcauaccugggaguaaagucauccuguggcaaccauuggccauagaugucuucugaguagguaccacugugcugcagagaguggagcuccagcccugagcagcuugggagagacugcagagguucuuaugauugcauuauacagaugaaugaauugaggccggggagcaggggagacagccuauaaggaauaagaggucccaggaagucaauuuccucccuggaagucauacugucagaggggcaaaaagacagaagcaaaaagagaccugcauuuuagaaacagccccucugagaauuaaauguugucauggcaacagcagcaucucaagccugaauagagacagcauuggggcaggugcagggacaggaaguaggaaucuggugccucuaaucuggauucauuugccuccaacaucugagguuguggggaggaugguaaacugggggggggcggggggaauggaacccaggccaggaaaacucaggaucacaaaggaccuuagaagacucuauccugagguccaagaguuuggggguggagauucuuccucccucgcuaagguaaacccgagugggucaagggcagaaguggauccugaguuuggggaucccagccuccauaggaucugcccuggaaugguuaaaucuguuaaaccgugccugagcuuuccccugcaggguagaaaacuucuggagaugggcagggacacauuauucccauuaugcacaagccuucagaacggagcauagccugguccccagcacucccaggaccaccaagguuucugugccucugucacacacucagaucugucuguuggggauaucuuccagggugauggaaugcggccugcacuaaggacccucuguuugcggcauggaugaagccaugcuucggguugacaaaaugcuaagacaaagcaugguuauugucacuuuggggaauauccucugacacgguuucucuggagacccacggaagcuacaugcaaaugaaggaaacccaacugaugucugcacuguaaucaggugaagauaaagccaguccuggcagaucagaggaccaacagcccagucccacuggaauggggaggugucuauuugacuagauuggucccugacagcugcagagggcucucaggagagagcauaaaaagcauucaggcagucagggaccuccuggaguucauaugcugcugaugguaccaaagggaugaugagggaagggacaguuaucauagcaaguacuagaaaaauauaaaaggaaggaggaaaaaaaaaucuuaaaucagucuaggcuguaaguacagcuuaaagguagugucagagaccaucccgugagaaagugagcccuucacaaucucccuaacaggccaaauggccuuguacuaagagcugguuaucaccccccuuccucccucccuauuccuuucuuggcaccugaggcuguaaaagcugaauuauaguccccucuucccuaucucuuccugaguucccaugccauccaaggacaugaguuacgccugagcccagccugacccccaaggcugucaaggaggaucgauguuccagagauaagauccagagugcccgcugccuggcgccugacuucggcccccaugucagcagaugcccacuucuuuguucuuuguauaauucucccuugaccccucccauauuccccgcgauguaugcuuuaaaaagaaggcaccucagccuaauagguuaaccuugauagguuaaau

SEQ ID NO: 2105 - RNA, 1248 nt, Mus musculus
cuuccggcccgcgaggcucggccccgccuccgcucccggccgcuuaaagggaccgcgacccccaggcgacuugaaggagaacgguggggacggggcggggcucggcuuagcggacuccucgcgcggcgcggggggcggacugcggagggguggugagcggguggcacgggcggcgauggaguggggucccggcgcaggcuggucacgggggugagagcgggccggcggggcgguggguuggggccgcgaccucgcgccgccuagcgccgggcccugacgccgucucucucccgggcagggaggcugccggcguggaccgugggaaggcgggguuggggcucggcgggaggccacccccgcagccgccccgagaugaacgcgcccagcagcugcuggacgccguggagcagcggcagcggcagcuucuggacaccaucgccgccugugaggagaugcugcggcagcugggccgccggcgcccagaaccggcugguggcggggucagugcccagugcccucuccgggcuggaccuggggaggugggcgcuucccacucacugcacuggucuagcucgcgcuccccacccccaccccgcuccaaaggaggcagguggaagagcauccccaccgcuuaacuuccuuugaucugagcgagguuuugaaaaagcaugguacugucgagaugccaaguggccuuauucuuguggggccuaacuuaaggccuuuccuccgggcucauccccccuccccccuuuucuguuccaacuagaacgguucagccaagucuggagcgccgccccagccaucuguaucggccagagguggccuuccaaaggaugcuggcgauggagccucggagucuugaucauacccuagccgggcacccugacuucugucccuuuccagggccaguggcuggacugugaccaacucccuucacuaaaaggggccagucuucacgggcaguugcugguacuuggcccucagccugggauggcaacucuacuagcagcuggguucacucccacgucguccuggcugaaggcaguacugugcuuugaaauggagccaacaaacauccagucuugaguacucggauucaggaagccagcagugcuggccagaguggucuggccugcuuuggggguuccaggugguauuacauguucauuucaugcuuugggggcucucagccccacaaaacacuugagcagagucuugauuaaaaggaaaucugcagacccuggu

SEQ ID NO: 2106 - RNA, 4486 nt, Mus musculus
guuuguagaagcaauauuuaauaacaacaaaagaaaauacaguucaaauaccccaaaauaauuauguaaauacuugguagacauaugaacaaggauaaaaggcuucugcauaaacaaagaagcuaaauaaauuacacauaaaacuauaccaauaaauuagaaagucaccggcugaaaaaagucaagauuuuauuuuucaauauuucacuugggaccccuagaauaauuuccccaauaaccacuccccuguacccagacagcuuugcccucggcuccuagacuuugcugcguugguccuaagacuucuauucuagacugcauuagugcuucuggcugguuugacaucaaaugucacuguuccccagaaagcagcuuuuaaugcauucuaauucuguacucaaguuacuuaaagggggugggggugagagggggcacuuaaaauaauaaggccacucuaagaacauccuucccuccauuuaauucuuggcugacaaauaaauguacagaauaaauaaauauaaccuucccccggggacaaggcucacccugcagcuucuggcuggccuacaggauucagagccaaggaugcugccuaaaaagcuaggcuauagauguaggaaccucaggcagugaggcuuugccauccaguagcagacacauaguauccagcaugguccuuggguccucccaaguuucaugaacaggaccccugugaagggagcagcccauauuucugcuggaggaucgauguaguguuuuccagggcacugaggaagauagaagguaguuaagaguuugacuucucagaagauggaguacaccaaagucugaguagccuaauucuaauuacugucccacuguuaaacaaacuugaugaaucuuaaaaagccagcuauaccagcaaauuuagucccagcccacuuaacaccucucuguggcagcccuuaguggucccuuuaaaaugguaaugaagauaugcacuuuuuugguuaaguuuuuguuauuuuugcuuucaagacaggguuucuauguguagcccugguguccuggaauugcuuuguagaccaggcuagccuugaacucacaagagaucugccugccucugucucuuaagugcugagauuaacggcgugaauuaacacugccuggagaaaaccugcacuuuaaaucuucucuuuucuccaaccucccucacauuccccagaggcacaggaaagauacuuaccagccugggcgaauaaugccaaacuuuccaggcacagauaagucaaccacaguagagccgaggcgacacucagggcucugacuauccccaauuggccccccaucaaugacaagggacaaaugaggccagaggucuuggaacuccugaaaagaaagaagguuagggcacagcugaauuaucauccugaauacacagcucacauuuaaauauaauuaucuuccuuuaagcagcauagaaaccucuuaguaccgucagcuaagucaagggcacaauuaacaccaggaucugauauguaccacgucugaagccuccuuagguaugcacuccuuaaagaaaaccuuaaugcaauaagaggaauuccaaguacugcagggaugggggaggcuuagguccaaaaaguggcgugcuggguaugagccagucuuuccguaucugugugaugcauguaaauuacuucacucaggccccuaaagcaaagcucuagcagccugauccuagaccucaguggaaguuaagaacuguauaaacacaugccaccagcacucagccccuaggcuacaggguguacuguuaacagagcuugauuucuucuggccccaguaaagagucuucaaugcaguuaggcagggaaccagcuauaaaucaagcaaugacugugcuggucuagggccgcugacaagguaaaaacuuacuccuccucugggaagauucccacccacguccacaguguauagcuacccggagcaacuaaagcagauacuacauuuccaauguccccaggucuggcauagaaaaccccagcacuuuacugcagcuaauguuaaguguuggaagaacagaacaaagcuccuuugccuguucauuuguccuaaacuacacagccaacacaggauuacaaugaucuuaucucaggccuaucuggcaggcaaaaauaaaauaaggucaggagucaaaaauuaggugaggccaggugugcugguacagaugcaaaacuggggaggcccaaggguccugacugugaguucuaggccagccugggagacagaguggauccugucccaaacagaaacaugcccccuccaaaaagaaagaauucagagagaacuggcaauuaguugggacugucauuuaaugaccaugugacagaacagcgaacuaauguuucaaagccccaaauuuuucucagcaugguugucaagucucugacaaccacuucccucacaaagcugucuguauuuccuauaaucuguucuuuuucuuugagacagagucucucuaugaacucauucuguaaacucagagggccuggaacuccgcaaucagacugcuucugucuccugagugcugggauuaaagaugcucaccaccacuccgacaucuuuucuauuaucaucgauacaaaaaaccacaccugcucucccuuggccuaucaagauaaaacaauuccaacacuuucuaaagaaaaauaaguaaagcucccaggggcaaagagauggcucggcagucaagagcauugacugcucuuguagaggaccaagguucaauucccagcaccuacacagcagcucauaacugucuacaacuccauggucgggagaucugacaccaucaccaacuccauggucgggagaucugacaccaucaccuagacacacacacacacacacacacacacacacacacacacacacacgcgcgcgcgcgcaaaacagcaauguacauaaaauaaaaauaaaucauuaaaaaaaaguaagugucccuaaauaacuaaggcugacugagauuuucuuacccuagccuccuuguccuggccuuacaaguacaccaccugcccccuuccaagauucauucggauacccuccucuaaccaacaccaaauggguaaccuucucacccaugcaccaaaggcccaaauuucugccaggcaaucccauuacaguguuagccuuguugauuuuaaggaaacagcaguuuaaccugcuggggccaauucucaccucaacacucagagaacuggccugggagcugagguuggcacuagugagugcaaguggucccccaaacaucugggccaaguccagcaugaaggcauggucaggaauccggaugccaacaagcugggaagcaagaaaagagaacgugaggaagacaucgagggcuugcaagcgucugauuuagaucgcaggaaaagggaaaacucuugacucacacgaguaaagggguucaggucuuuguugagcuccucggagcgcuccaucaccagggucacagggccugggaacaggucuuccaggagcucccuagguacucucaccugacaguaccugcaggcaaaggagcacaaauccucuccaaaucacccugauggaccuuuccuggggacuuaaggcagaugcuggagagggguccccuucgcguguauaaugaacgagaucuaccugacucucuacucccucuuccucggaguucuggcagaagacagacuccacagaguacccugggcuuuaagucuauccgccugucuugggggacaaaaccacagcgccguggcacguggauacaaucucaauccguuuaaucaucuggaaggcguuaccccgaaacgggccuccccuccgcccaucacaagggcaccgggagaagagugccaugcucgccuaacucagcuucucgaccgacugucuagagcggaucuuggcgagccgucagcgcucccgaccaaucuccaguuccggauuccuccucggggagcaaggacaagccccucccgcgcucggcggacgccgcggucucccgaggcugucaccggaaaccccucccgcggggccgcccccagcggggccgccucaccuguagacgucggccacgcggcccaggcacacggccagcggcuuggccucgcugcggccuuugaggcgguacacgcaacucagggccgccgagcugcucgccgagcaggccaggccguagagcgugucggucgggaccgccaccacggcgccggcgcgcagcucggccacggcggcccgcagcgccucgguccagccggagcgcucggggcucgcggcuuccacgggcucgcucuccggaagccgcagcagccgggcccccggcagcgccggagcgggcucaggagggcguaggaggcggcagccgcggccagaacuagccggcccgucgcucaaccccaugccggccgccacggcggcccucagccccgcgcacggacgcgccguagacauccgugccgagccgcuuccg

SEQ ID NO: 2107 - RNA, 7983 nt, Mus musculus
agugcccuggaaaacacuacaucgauccuccagcagaaauaugggcugcucccuucacagggguccuguucaugaaacuugggaggacccaaggaccaugcuggauacuaugugucugcuacuggauggcaaagccucacugccugagguuccuacaucuauagccuagcuuuuuaggcagcauccuuggcucugaauccuguaggccagccagaagcugcagggugagccuuguccccgggggaagguuauauuuauuuauucuguacauuuauuugucagccaagaauuaaauggagggaaggauguucuuagaguggccuuauuauuuuaagugcccccucucacccccacccccuuuaaguaacuugaguacagaauuagaaugcauuaaaagcugcuuucuggggaacagugacauuugaugucaaaccagccagaagcacuaaugcagucuagaauagaagucuuaggaccaacgcagcaaagucuaggagccgagggcaaagcugucuggguacaggggagugguuauuggggaaauuauucuaggggucccaagugaaauauugaaaaauaaaaucuugacuuuuuucagccggugacuuucuaauuuauugguauaguuuuauguguaauuuauuuagcuucuuuguuuaugcagaagccuuuuauccuuguucauaugucuaccaaguauuuacauaauuauuuugggguauuugaacuguauuuucuuuuguuguuauuaaauauugcuucuacaaacaguuguaaaugguuuauuuuucuuuugaguuauuuccuuagaguaggauuucucagucaagauauaugugugcauuauggcuguugauguagauuagucuucagaaaaucugagggugcuugcuccuuccugcugccuugcuguauccacaauauauaugcaggguuaaauccagcccuuucaacuaagcugcaagcuggguggucagcccagcugaucugucucggggguuaagugucggugacugggcugguuguccuugcagugaccaguauuucaccuccuccaucugcagccauuucccagaguuaaaggcucagcuuuagccuguaaaccaguccagaagggucuagugaacauuuccuuuucaagaaucuugcugaaaauauucaucagguuuuacuuuaccaaggauccuugcaaguagcauuaguuuauuugugaguaagcacuggcucguuaacucccuagaaaucuuauguaaacuagucuuauaagcagauccaucuccacugugcuaaagcuagccagccuagccauacacugaugugucccagacugaccuaguggucagcacuuaggagaacuggaagaggaauguguacuggcauacaccauuucauacuuaauacaaaucacaguagcacugaaaguggcccuagugaguggccuccccggccuaggcagcuaaaaggagugaccuaguccucucugcagcuaaacguucaucugggaaaggcuccgggucacagagguauuaucuuggaggaaaaaauagcugaacucccaggccuggguguagcugcaaagagcgaaaacagccgaggugcuagcuacaguuauaccaaaagcaggauccuguaagcuuugggaaggaaaccuugcucaaauuccccagcaccugacaggcaauaggugcuuaguaugggugcucaguguuccugauaauggggcacaggagucuacuggaaggaccuuaaaguccucuuagaagugucagaugugguucccuguguucagcaagaugugggaagguggcuguccaagggaaguaaggugcaugcuagcuuagaacccugagacccuccuaagcauggcggcuugcgcaacuccauacaacuaccugccucagcugaaagcugagggaccuggagguuccuuaagccauugcagccacuugcccccuccugcuucaucaugucuugcuucccagcaccgccaguccaggugccaggcucuguucugcaugagccagcugguccacccacgagcucccaguugcuacuugggacuagcgagugccuauauccccaacugaaccaguuuggugaucuguuaagguuuguuugcgugagagucccucacaucagccauugcuccuuuuccuugaugaagugcucugcccagcggcgggucagcucuaaauacaggcuggacuggugaggcagguaguccagauacaggcgaguuggcgucgucuuggggacagcuuucucaaucugugugcccucgugccacucauugaaggaggugauagagacuaucucgggccucacagucagggcugccugcagggcugucucauaguacuugccauugacccgguuccgaguauugugguuguuccagggccggaugcugguaucaauguacccaggccccacgcuagggaugaacaucagguuguugguaucacagaaguucuucacagcuuuccaguucugaugggaagagccaaaggagaagccauuggaggcaaaguagguguacauuccgucgaauccugccgcgaggaugucguggguguggcucuccuccacgagcagagcuaugaagaccccaucauagggaguguugcggauagagugaggcccauuuugugucaggaggugggcccaggccucaggggaugucagauaggagucguagauauaaaagagugggaggcucuugcccaugcuauucuuguaacgguagaaugcaccgugggagccauaccugaggagcaggagggagaggcuuagguugguugugguaagauuagcucacagcacucuggaauccagcagguuacauauugaaccugucuaugcauucaaguauuagccugccucccuucucagcaccgugcccccuucccgaagcccaucuucuccccagccugcccaccaucuucaucagaauuucagcaacaaucuccuaauuggcaucuagccuuuauuccugccuuccuguaggauauaaucuuaccauggccuguagggauucccguuucuggucugaccugaccuauuuucagcuacuacacauuagauuccacugccuaacuggcccuucuguuaagcuucaugugagcuugucucaucuuagcacauuccacaugcuaguucucucugccuggcauuuucuccuuucuccagauuuuugcagaucuaacaucaucaucaauauuuuauuugauacagggucuuguguugccuggagcucauuaaauagaccaggcuaaccccgaacuaagaaauucgccugccuagccaggcgugguggcgcacgccuuuaaucccagcauucgggaggcagaggcaagcggauuucugaguucuaggccagccuggugaauuccaggagggccagggcuauacagagaaacccugucucgaaaaaccaaaaagaaaaaaagaaaaagaaauucaccugccucuaccuccuaauugcugugauuaaaggcuugugccaucaugccuggccagagcagacauuuaaaaaaacaggacaaggaugggggauagaucugggaggaguggagagggcaaauacgauuuuguuuguuuguuuguuuuuugaggcaaauaugacuuuuuaaauuacuuuaaauaugcguuuuaaaagaaccauuaugcuagaaauggcuugaaauuaaaaguaaucgcugugcccccggaaucugaguucuguucccagcaccuacaaucaaagcaaguuguaauaagcuuguagcccccgcguccucaucuggccucugggcacacacagacacacauaugcauauuauaaaaaaauaaaaccuuuuuuuuuuaaaacauuggggauugagucuacugaguccagggccucuggccugaugucgcaugccugcagucccagcacuugcgaagcuucagaucaacaacagcagaaaggaucagggucaagcucagggacagaaagagcuccaggccagccuaaacuaggcccacucauucccugcagcuuaacaaccacauuuauaucucagcucuaggcgcugggaaguccaagaucaaaguaucuaucaagguugguccuuggugagggcucucucgcagcuggcagacggccaacgaacuguaugcucacacagaaagcaagagucagcuucucagaugucaggucauaaccuauccucucagagaagcacacaucaccauuuuagaguaauuccuugaaggcugggacagaaggccuuuuggggcacauuuuuaacacaaaacuucccuuugcuuuuuguuguuuuuauuuauuuuuucauacuacauauuacugugguuucucacuucuugguuggggagcucugcugcacccccaaccacuagauuauaaguaccaagccagaaacuuugcuaaagacaauagcuauaccugugggcauuggacaguauuuuagugaauauguacaagcauguaugaaacacuuggauacuaaagauucaguuauguucucagaaccagaccugaaacucagcuaccugacucaacccagcacccucacugggaaacaacugcuugggacacauguauuccagccuuguacugccuggccuggcccuccaucccuucugucccuacuuccuucuagauucccccaucuuacgugucaaugauguacuugauguugucguggacagugaugucaucccggcccuuguaggguuggauauggaaggccaccugccacaaacagaggaguuggaggucaugaauauucuggaacacaacacauacagcuuaaugcccccagcccuggcuuguaggaggggcugaaugcaggaaugcuuggcaaggauuggcucaauaaagcuugucacugcccuucagaucaaaaacgaaggguagagauguguccaugucacacggcagggaagccaggaaucauucuggguaguugcaggauggcauccagguuuccaucucugucagcuccagucaugagcacaacgagacgugugccuacucucugccaauggaaagugugccaagaucgguuaaaccugccagaggugaccuugaagggagggggcuucucggucauucaccacaaaagcaucacugacguccucuauugauguguuugaggaaaauggccauacgcauauccuuccacucaaaagcgaaccugcuuauggaagcucagcacuguccuccgcgcuauggaguggagucuagaguucugucugccgguccauuugguucuugccugcccaggauccaagaucaggcucuccagccuagccuguauuacuuaauaaaagugaaggagcuggagagacggcucagcgguuaaacgcacuggcugcucucccaaaggaccugaguuccuagcacacacaucgggugauucacagcuagcuccguggggaucuaauggcucuggccucugcacucaccugcacauauucacacagagagaaacacaugcaaaauuuuuaaaauagaggucaauauuagaaagugauacuuagauagucuuccauuuguccccuguuuaguuuucucaaaacuaaagaugguaacagcugacauaggcacagccuccuagacccucuuccaguacgggacacucacuaugugucugucaucccuagccacccacaccaaccuuauggcagagaaggggcauucucagcauugcagugguggcacaagucuuuaauuccagcacuuggaaggcagaggcaggugaaucucugaguuggaggccagccuggucuacagaacaaguuccaggacagccaggaagauacaaacuaugagaaauuccagaagaggaguaggggaagggggagggaggagaagaaagggcauuuuccagaaugagagaacccaccuggauguuguacugaugggcaguguccagaauggcagguaccaggucaucuguggguucuccauuaucaucagccaugccagguggauaccaggagagaaccaaaacuccugaauaauacagaaaccucuucaguggcacacagugcgccaccuccccucuccgcagagauuuucuuaucagaaauaauuuccaacugcaugcuuccugaaaaccucgagccaggagccugccagguuccuagggacagauccgaggcccagagcucagcuggccuuggagcuguccacuccagcagugcugaagugcugacgccaaaggagccaggcuuagggagugcuucaucaaguagcagacagaaggggaaagaguggccaugccacgcugaucuggaagccacagcccuaccucugagguccuaccugaagagaagucuuaugcucaugcuuccuaugggcgagaggucuugccuugagugacugccugucuugaaaguaagccuggacagaauagcccacauccuaauuaucuuuguauaugucccauaccccuccuuauuuguuuaugcguuugcucauuuauuauuuuggagauaccuucccauuguguagccuggcugcauaguuggcuagcuucaaacugggaauccugucucacccucccaaccgcuacgauucuggcacgcaccacuaaaccugaauccucaccuaguggcucuccuuccuauuuauaaaccacaucaaggcauaacaagguauccuuaaaaguuagcagaauucggugacaaaaucuaaacuaaaugaaccuccucccccaccccagccuguaaugugcaagguucuccagagccucugcuggcugagcacuugaugaaaaaauccuguguuguguccaccccucagcccagcuagaugggccgccccugaagggcugggacccccaggccucacucuccuaaaaccuggaacagacuuacagcugcucuuuuuaccguaccugccucaggauagcucugcugcacacacccccaacaacccuauggaaggguccugggguuguugagggucagacaggcccagaagguaguggaaaauuggaaggggcgguaguguguagugggcccgggauaagagugggagggaaggguuacaaggacagcguggcgggagagugggaccagggacccuguggcgggacaucaagaacugugguucaaggaggaagggcgaagcugggggacagacuggccaagggaacgcaggggcucaccaauggcagcuucuuugagcugggucaugugcucucguagcacgucggggucccgcgagcuguaaggccccagcuccggguagaagcuggagcccaagucaucuggagggcuguggcggccacgcggguaacuggccgagaucuuggggucccagugcggcaccaugacauggucccaguggauauaguggcccucgcgccgcgggcucccguaccacgaauaguaaaaagcaugcagaucggaguagacgcgcaggcucugccugggcgcaggaucggccucggccgggcccagcgaggcgcgcggggcggcggugcgcggcgggggcggcggcggcgcggcgggggcagccggggcgcgggcgggcgcgggguuccccucgggacgccucucgaacggugcuaguuccgggccugggcccagcgccggcagcccguccggggccuugagcgugcgcagccccaugagcgugccgaaggcgaagagcagcaccaggaagagggcgaugcaggcgcggcgccgccgccgggccauggcuuucccgcggugcccgccgccgcgcuaacagcuccggagucgcgccauuccgcccgcccgcgcgucccagaccacagccggcgagcgccgugcgcccagggcggcuccgcgccuguccccgcagugcgggcgggcccggcacacacaagaugcaguggcgccgaccaagugaucgcgaguggagggggagaccaggcggaggaacgggaacucccacccggccccagcgcguccccggccgagcguaccugagaucugggucgggugcggaaccggaccuuccca

SEQ ID NO: 2108 - RNA, 7983 nt, Mus musculus
ugggaagguccgguuccgcacccgacccagaucucagguacgcucggccggggacgcgcuggggccgggugggaguucccguuccuccgccuggucucccccuccacucgcgaucacuuggucggcgccacugcaucuugugugugccgggcccgcccgcacugcggggacaggcgcggagccgcccugggcgcacggcgcucgccggcuguggucugggacgcgcgggcgggcggaauggcgcgacuccggagcuguuagcgcggcggcgggcaccgcgggaaagccauggcccggcggcggcgccgcgccugcaucgcccucuuccuggugcugcucuucgccuucggcacgcucauggggcugcgcacgcucaaggccccggacgggcugccggcgcugggcccaggcccggaacuagcaccguucgagaggcgucccgaggggaaccccgcgcccgcccgcgccccggcugcccccgccgcgccgccgccgcccccgccgcgcaccgccgccccgcgcgccucgcugggcccggccgaggccgauccugcgcccaggcagagccugcgcgucuacuccgaucugcaugcuuuuuacuauucgugguacgggagcccgcggcgcgagggccacuauauccacugggaccaugucauggugccgcacugggaccccaagaucucggccaguuacccgcguggccgccacagcccuccagaugacuugggcuccagcuucuacccggagcuggggccuuacagcucgcgggaccccgacgugcuacgagagcacaugacccagcucaaagaagcugccauuggugagccccugcguucccuuggccagucugucccccagcuucgcccuuccuccuugaaccacaguucuugaugucccgccacagggucccuggucccacucucccgccacgcuguccuuguaacccuucccucccacucuuaucccgggcccacuacacacuaccgccccuuccaauuuuccacuaccuucugggccugucugacccucaacaaccccaggacccuuccauaggguuguugggggugugugcagcagagcuauccugaggcagguacgguaaaaagagcagcuguaagucuguuccagguuuuaggagagugaggccugggggucccagcccuucaggggcggcccaucuagcugggcugagggguggacacaacacaggauuuuuucaucaagugcucagccagcagaggcucuggagaaccuugcacauuacaggcuggggugggggaggagguucauuuaguuuagauuuugucaccgaauucugcuaacuuuuaaggauaccuuguuaugccuugaugugguuuauaaauaggaaggagagccacuaggugaggauucagguuuaguggugcgugccagaaucguagcgguugggagggugagacaggauucccaguuugaagcuagccaacuaugcagccaggcuacacaaugggaagguaucuccaaaauaauaaaugagcaaacgcauaaacaaauaaggagggguaugggacauauacaaagauaauuaggaugugggcuauucuguccaggcuuacuuucaagacaggcagucacucaaggcaagaccucucgcccauaggaagcaugagcauaagacuucucuucagguaggaccucagagguagggcuguggcuuccagaucagcguggcauggccacucuuuccccuucugucugcuacuugaugaagcacucccuaagccuggcuccuuuggcgucagcacuucagcacugcuggaguggacagcuccaaggccagcugagcucugggccucggaucugucccuaggaaccuggcaggcuccuggcucgagguuuucaggaagcaugcaguuggaaauuauuucugauaagaaaaucucugcggagaggggagguggcgcacugugugccacugaagagguuucuguauuauucaggaguuuugguucucuccugguauccaccuggcauggcugaugauaauggagaacccacagaugaccugguaccugccauucuggacacugcccaucaguacaacauccagguggguucucucauucuggaaaaugcccuuucuucuccucccucccccuuccccuacuccucuucuggaauuucucauaguuuguaucuuccuggcuguccuggaacuuguucuguagaccaggcuggccuccaacucagagauucaccugccucugccuuccaagugcuggaauuaaagacuugugccaccacugcaaugcugagaaugccccuucucugccauaagguugguguggguggcuagggaugacagacacauagugagugucccguacuggaagagggucuaggaggcugugccuaugucagcuguuaccaucuuuaguuuugagaaaacuaaacaggggacaaauggaagacuaucuaaguaucacuuucuaauauugaccucuauuuuaaaaauuuugcauguguuucucucugugugaauaugugcaggugagugcagaggccagagccauuagauccccacggagcuagcugugaaucacccgaugugugugcuaggaacucagguccuuugggagagcagccagugcguuuaaccgcugagccgucucuccagcuccuucacuuuuauuaaguaauacaggcuaggcuggagagccugaucuuggauccugggcaggcaagaaccaaauggaccggcagacagaacucuagacuccacuccauagcgcggaggacagugcugagcuuccauaagcagguucgcuuuugaguggaaggauaugcguauggccauuuuccucaaacacaucaauagaggacgucagugaugcuuuuguggugaaugaccgagaagcccccucccuucaaggucaccucuggcagguuuaaccgaucuuggcacacuuuccauuggcagagaguaggcacacgucucguugugcucaugacuggagcugacagagauggaaaccuggaugccauccugcaacuacccagaaugauuccuggcuucccugccgugugacauggacacaucucuacccuucguuuuugaucugaagggcagugacaagcuuuauugagccaauccuugccaagcauuccugcauucagccccuccuacaagccagggcugggggcauuaagcuguauguguuguguuccagaauauucaugaccuccaacuccucuguuuguggcagguggccuuccauauccaacccuacaagggccgggaugacaucacuguccacgacaacaucaaguacaucauugacacguaagaugggggaaucuagaaggaaguagggacagaagggauggagggccaggccaggcaguacaaggcuggaauacaugugucccaagcaguuguuucccagugagggugcuggguugagucagguagcugaguuucaggucugguucugagaacauaacugaaucuuuaguauccaaguguuucauacaugcuuguacauauucacuaaaauacuguccaaugcccacagguauagcuauugucuuuagcaaaguuucuggcuugguacuuauaaucuagugguugggggugcagcagagcuccccaaccaagaagugagaaaccacaguaauauguaguaugaaaaaauaaauaaaaacaacaaaaagcaaagggaaguuuuguguuaaaaaugugccccaaaaggccuucugucccagccuucaaggaauuacucuaaaauggugaugugugcuucucugagaggauagguuaugaccugacaucugagaagcugacucuugcuuucugugugagcauacaguucguuggccgucugccagcugcgagagagcccucaccaaggaccaaccuugauagauacuuugaucuuggacuucccagcgccuagagcugagauauaaaugugguuguuaagcugcagggaaugagugggccuaguuuaggcuggccuggagcucuuucugucccugagcuugacccugauccuuucugcuguuguugaucugaagcuucgcaagugcugggacugcaggcaugcgacaucaggccagaggcccuggacucaguagacucaauccccaauguuuuaaaaaaaaaagguuuuauuuuuuuauaauaugcauaugugugucugugugugcccagaggccagaugaggacgcgggggcuacaagcuuauuacaacuugcuuugauuguaggugcugggaacagaacucagauuccgggggcacagcgauuacuuuuaauuucaagccauuucuagcauaaugguucuuuuaaaacgcauauuuaaaguaauuuaaaaagucauauuugccucaaaaaacaaacaaacaaacaaaaucguauuugcccucuccacuccucccagaucuaucccccauccuuguccuguuuuuuuaaaugucugcucuggccaggcaugauggcacaagccuuuaaucacagcaauuaggagguagaggcaggugaauuucuuuuucuuuuuuucuuuuugguuuuucgagacaggguuucucuguauagcccuggcccuccuggaauucaccaggcuggccuagaacucagaaauccgcuugccucugccucccgaaugcugggauuaaaggcgugcgccaccacgccuggcuaggcaggcgaauuucuuaguucgggguuagccuggucuauuuaaugagcuccaggcaacacaagacccuguaucaaauaaaauauugaugaugauguuagaucugcaaaaaucuggagaaaggagaaaaugccaggcagagagaacuagcauguggaaugugcuaagaugagacaagcucacaugaagcuuaacagaagggccaguuaggcaguggaaucuaauguguaguagcugaaaauaggucaggucagaccagaaacgggaaucccuacaggccaugguaagauuauauccuacaggaaggcaggaauaaaggcuagaugccaauuaggagauuguugcugaaauucugaugaagauggugggcaggcuggggagaagaugggcuucgggaagggggcacggugcugagaagggaggcaggcuaauacuugaaugcauagacagguucaauauguaaccugcuggauuccagagugcugugagcuaaucuuaccacaaccaaccuaagccucucccuccugcuccucagguauggcucccacggugcauucuaccguuacaagaauagcaugggcaagagccucccacucuuuuauaucuacgacuccuaucugacauccccugaggccugggcccaccuccugacacaaaaugggccucacucuauccgcaacacucccuaugauggggucuucauagcucugcucguggaggagagccacacccacgacauccucgcggcaggauucgacggaauguacaccuacuuugccuccaauggcuucuccuuuggcucuucccaucagaacuggaaagcugugaagaacuucugugauaccaacaaccugauguucaucccuagcguggggccuggguacauugauaccagcauccggcccuggaacaaccacaauacucggaaccgggucaauggcaaguacuaugagacagcccugcaggcagcccugacugugaggcccgagauagucucuaucaccuccuucaaugaguggcacgagggcacacagauugagaaagcuguccccaagacgacgccaacucgccuguaucuggacuaccugccucaccaguccagccuguauuuagagcugacccgccgcugggcagagcacuucaucaaggaaaaggagcaauggcugaugugagggacucucacgcaaacaaaccuuaacagaucaccaaacugguucaguuggggauauaggcacucgcuagucccaaguagcaacugggagcucguggguggaccagcuggcucaugcagaacagagccuggcaccuggacuggcggugcugggaagcaagacaugaugaagcaggagggggcaaguggcugcaauggcuuaaggaaccuccaggucccucagcuuucagcugaggcagguaguuguauggaguugcgcaagccgccaugcuuaggagggucucaggguucuaagcuagcaugcaccuuacuucccuuggacagccaccuucccacaucuugcugaacacagggaaccacaucugacacuucuaagaggacuuuaagguccuuccaguagacuccugugccccauuaucaggaacacugagcacccauacuaagcaccuauugccugucaggugcuggggaauuugagcaagguuuccuucccaaagcuuacaggauccugcuuuugguauaacuguagcuagcaccucggcuguuuucgcucuuugcagcuacacccaggccugggaguucagcuauuuuuuccuccaagauaauaccucugugacccggagccuuucccagaugaacguuuagcugcagagaggacuaggucacuccuuuuagcugccuaggccggggaggccacucacuagggccacuuucagugcuacugugauuuguauuaaguaugaaaugguguaugccaguacacauuccucuuccaguucuccuaagugcugaccacuaggucagucugggacacaucaguguauggcuaggcuggcuagcuuuagcacaguggagauggaucugcuuauaagacuaguuuacauaagauuucuagggaguuaacgagccagugcuuacucacaaauaaacuaaugcuacuugcaaggauccuugguaaaguaaaaccugaugaauauuuucagcaagauucuugaaaaggaaauguucacuagacccuucuggacugguuuacaggcuaaagcugagccuuuaacucugggaaauggcugcagauggaggaggugaaauacuggucacugcaaggacaaccagcccagucaccgacacuuaacccccgagacagaucagcugggcugaccacccagcuugcagcuuaguugaaagggcuggauuuaacccugcauauauauuguggauacagcaaggcagcaggaaggagcaagcacccucagauuuucugaagacuaaucuacaucaacagccauaaugcacacauauaucuugacugagaaauccuacucuaaggaaauaacucaaaagaaaaauaaaccauuuacaacuguuuguagaagcaauauuuaauaacaacaaaagaaaauacaguucaaauaccccaaaauaauuauguaaauacuugguagacauaugaacaaggauaaaaggcuucugcauaaacaaagaagcuaaauaaauuacacauaaaacuauaccaauaaauuagaaagucaccggcugaaaaaagucaagauuuuauuuuucaauauuucacuugggaccccuagaauaauuuccccaauaaccacuccccuguacccagacagcuuugcccucggcuccuagacuuugcugcguugguccuaagacuucuauucuagacugcauuagugcuucuggcugguuugacaucaaaugucacuguuccccagaaagcagcuuuuaaugcauucuaauucuguacucaaguuacuuaaagggggugggggugagagggggcacuuaaaauaauaaggccacucuaagaacauccuucccuccauuuaauucuuggcugacaaauaaauguacagaauaaauaaauauaaccuucccccggggacaaggcucacccugcagcuucuggcuggccuacaggauucagagccaaggaugcugccuaaaaagcuaggcuauagauguaggaaccucaggcagugaggcuuugccauccaguagcagacacauaguauccagcaugguccuuggguccucccaaguuucaugaacaggaccccugugaagggagcagcccauauuucugcuggaggaucgauguaguguuuuccagggcacu

SEQ ID NO: 2109 - RNA, 7617 nt, Mus musculus
caucuuuucgcgacuccagagucgugcuaacuggaaguagaguggugaguucguucuugugaauaagcgcgguguaguuuuugauguacucagcguugacaucgcaggauuuacguuuuccuguugauuuagggcuggaaaucuuaaagagaggcgacaagacugacuccagaagcacaggucccggaacagacagaccccagagacucgcagucuaaagcagauugcccugucgugaagaaaccccuucggaagacccgaagcaacggucuuccugcagagagaagguaagaggaccgccagaaucaauauucuugaguguccgcgguuacaagacagagacacagcuccacucugcagcguggggaguugcccuagccuuuuaaggacuugagcucaguugauggcccugacgcugaaaagaacucagcacuagcugagcucaguugauggcccugacgcugaaaagaacucagcacuagcugauuuaugaagcagaguuacaugaacauauuugcuacggggccucaccauauaacgcuggcuaucuuggaagucucuguguauacuaguuuggccucgaacucacagagaucugcuuguuucugucuuuccagugcuaggauuaaagaugcauucgacaacucccagccuauggcuguuuuaaauacaggcauaagcacaagaauuaagagagagaggcaggcaccuaggcauaaaagacacuugcaugcuccucagagaaucucagaaaguuagacauagccacguggguaugagauucucuagggagaucagcaguugauuuucuuucuuuucccccaguuucuugagaccaggcuggccucaaacccaaaacccggcucugcuuccagagggcuggaauuaaagucauguuacauuagccacaauuacuuauuuugguggcuuucaguuuacaucucaaaaggguuucuaaaaacccuugugacucccuucaaacaagaaguuguuugauaagagaaguaagugagguggcuuucaagauucuuugaugguauuaaauccuacagauguaaaugggguaguguguguccuuucucuguaaaugggauuccuggugagauuucuagaacauggaagauuuacagcaggaaggaagaaaggcuguucacaguugguaaguguacuugcaggaauucuuccuucauuguuggcugaaggugucagcccacuuccaggacuaggaguucuuguuugugucccccaaagucucccuaccuuucauuauugccuugggacuauuugaagaccaacagcuggucuucuccugaggucggaaaugacgcagccuugaugcaggcccucccuucugguacccugacucccuuuuguuuuguuuauuuuuucccagaaaauggcucaugaccagccucugcugguugugcaggaggcccugaggaagugcuucccugugguggaggaacagcagaaccuguggcagagcacccugcaggacugcucgccccuccuguccucucucaguaaccuggcugagcagcugcaagccgcacagagucugcgcuuugaggaugugccagcccugcgucccuuuccagacuuacaggagcgguugaggcgcaagcagcuggaggcuggugacguuguucuggacaagcuagcugagcggcuguaagaggcucuguugucccccuuuguugauggacagaucuuaaugccgcauggcaucccagccucagucaggggguccuacagaaaucgacaaaagcaagucaggaguaaucaugcuggagcuaaguugaaugucugugaguucgaggccagccuggacuacauuguaagaccaugcaugucuuuaaaacaaaacaaaacaacccaaaucaggccagguguuuaaucucagcacuaaggaggcauauacaagcagaucucugaguucaaggccagucuggucuacauagagaguuccaaggcaaccagggcuacacagauaaacccagucucaaaauaaauaaguaaguaaacaaacaaauaaauaaaaauaaccccaaaccaacuaaauaaauggaagaaauuacaaaagcagaaaagaagaggguggcgaggagugcagcccucuucugucguuguccuugguguacugcaguucagggagagcugggaguaaggacuguguguccgggaccuuguacaccucugccuuauaccugucuaugcacuuggaagcaagaaaagggaaacucaaacugauuguccugaucacagaguccgugagaaauagagccaggaaucugaagugggccugccacuuaagcuggggcuucuuaccaccaccugguucuacacacaaguggauacauguguaacuaaguagcccaagaaacaguaacaacacagguguuacacagauacucuguuuucugcuuuuuuuuuuuuuuuuuuuuuuuuuuuugguuuuuuuggagacaggguuucucuguauaguccuggcuguccuggaacucacuuuguagaccaggcuggccucgaacucagaaauccgccugccucugccuccugagugcugggauuaaaggugugcgccaccacacccggcuucugcuuguucuugauguuagucaucgacuauaagcaggucuuacacacuugaggauuuuggauuguuuccuguuuuuacaccauaagccacaguaggauauuuagagcuagcguucugggcuagaggaucccuuguccauugggaaguugcagccuuuguuuuagugauggguuccuuagagucagcauucgaauacuauguagccacugccaaaggcacuuuacacacaucauaguauuuaucuuuccagugacaauucauucacugauuguguguuugcuguucuugggaaacacagugagcaaugaagccuuuaugcacaggggaaauaacucacauucucaagcagucugugcaugucgagcccacauugccauugaagaacuggccagacaagggcaguuaagauggcuccugggguagaggcacuugccguguaagccugaugaccuggguucaauccacgggcccauggaaagguggaaggacagaguggaugccacaaaguagcccucugaucuccaagcauacucugucaugugcaugcccuucccucauacuaaauuaacaaggguauagcucagugguagaccgcuucccuaacacgucuaaggguuugaguccccucugaaacaaaacuuaacaggacaguagugguuugagaaggcuuacccccuaucuuuuuuuaggauacugccuaacacccuccuuuucccacagagccacccuccucaagguccguaacaccaucaacagccacguggagcagguguuucaggccuacgagcagcaugcggcugugcuagacauugacaccguccugcgccccucaguugugagccccucuguggcugacauguuggaguggcugcaggacaucgacagacauuauggaagcucauauccuucgagugcuuccugacugacugcccagagccgccccuagaggcugcagcaggugcagacuucacagggucagcaggcuguauaauucacagggucagcaggcuguauaauucacagggucagcaggcuguauaauucacggggucagcaggcuguauaauucacggggucagcaggcuguauaauucacggggucagcaggcuguauaauucacggggucagcaggcuguauaauucacggggucagcaggcuguauaauucacggggucagcaggcuguauaauucacggggucagcaggcuguauaauucacggggucagcaggcuguauaauucacggggucagcaggcuguauaauucacggggucagcaggcuguauaauucacggggucagcaggcuguauaauucguugcaguucucuagugcucagacuuggauucuucuugcacuugucuuuuguuaacuagucauuccuuagaguuuauuuaucugcuaggcacuacucuuaagugcugggagcaggcauaaaaagggggacugcauagugucagauguggugaguguuaaauaaggcagagaaggugagggggaaugugauuuuaauaguguggucagugcagggacccaugaggcagugacauccugagacaaugaugcucacagcauuugagccaaguuugcaagagggaaggaaugagccauguggguguuuggaagaagagugguccaggcagaggcuacauggcgugagcuugucugguacauguaagaacugccauaaagccagugggggcaagggcagggcagggccgggcaggaggagagugacagagggccuugauuuuugagaaggaucuugaagguuuuggcuguuacucugaagucaaaguucucagaagcuuuaagcagaaccauguggucaaggccugugcuuaacagugcuguguucugaagaacaguuggcauggcgggaagcaagccugagagcaggaaauuagccgcaguccugaccuuuucuccauucgugcccauggcugucaucugacccugguuuugcuccuggucuugagucucaguuuccugugcugccuccagcuggcucgcuuagugaacuccaaauucaaguuuaaagcugaacauggaccagcaaugcccacuguguuacugauuuucauguugugauuaauaucgaacacgaagcaggacagacagauuuauuucaggucauagcugagggauauguccgucacggagggaagcgcacagagacaggagcuuaagccacuggucacauugcgccugcaucaggacgcagggacugcugacugcuggcgcucuguucacuuucuguucauucugggaccccggccuguggacugacaccguccacauucagaggaguccucccacuucaguuaaaccuuucuagagacaacaucacagaugcaaccuguaucauguuuccaugacgauucuaaauccagacaaguugacaaaggagauugucacccaaucuagauauguagggacgaucuuccuccugucccucuguuuccuauuauaacugcaauagugguacuaggugugcuaguggcgccgcuaacccugauaucgcuaagcacugccauaggcuaggcgcuggaggcccugguuggcucuacucuccugccuugauuucuaaucacauuacugagauggaccacauucaacaguagucccauaagagcauaugaccuagugacacagauaucuuguaaguuccuuuuucuucugagcaguccuuaacuucugggaagguaccugaagagaaaguaccuccucuccuccauccacuggggagacuuggccagcauccaagcacugcccaaggccugggaccagauuucagaaaaugagugccaaacucuugugucagguacugguguccgucaguccugugcugccucucuggagagguuagacacacccccuccgugcucuugggccuugauaaaccugaugcuuugucccuugcuuccuguucuagauguccuggugagugucuccuucuuccuggaggagccaggaggcugugcagcgucuggagaucuggagcaccacagcugagggcugccauugcuacacuaggcuauuucuaagugagggucagcauugcuaccugacucacuggaauagcagugccuaggacuucuccgugcuaggccauggccaaggguccaugacagcugcaccuaugacucugagaagcagauagaggcugaggagacaggaaaggcagugcugauaaacaguguccaccaaggcaggaaagggcagaaugcaagguuguguggccaccgcugccuaugucaucugaaccauagucucugguuggcucagguccugauucugugugugucaguaucugaguccuuaauggcuuaaagauaggagugggucugggaguccagggcgggagcagugugugugucuggggggagggggaaaguugggggacaaagucaaucaccugcaaaaccccaaaaaggaaaggacugaagaaaagggaacuuuuaaaauguuuacuccuucaccgaagcucauuaugaagccaguuuccauuuccaaagucagccaccagggggcgauggugcagcgugagcgguucugaaugccuuguucuugagggagguccccuguugcuguuaaaagccacugaggugucuguggggagcuggguaucccacccaggacuagggaggcaaagacaggugggucuuugugauuuugagaucaccuuggucucuauagcuccaggucaaccaaggccacauacugagacugucucaaaaaggaagacaaaaagguaaagggaccuugcauuggccacggucuucugaguuugggguaaccggccaggggagggaaugccggcugugaugguugguuuuuaugguccacuugacaaagccaccucggaagggagucucagugaggaauguucuagauuugguuggcuugcagacaugcaagauuuucuuaacugaggugagaagacccauccugaaugugaguggcagcauuucaugggcuggagccaggaucaaaggagaaagagcaggcuaagcacuuagcaggcauucaccuuugauggugaguaugcugugaccagcagcugcuucagguuccugccacugacucuccuguaguaauggauucuaacuucaaauuauaagcccaauaucugccaauagguguuaucauguuuuaggguucucuaaaggaacaggacuagugauaacaugaaugaauauaaagagagaguacugagggcagcaagagugagggccggcguaccuaaagcaaaagcuuucuucuuccauaugaugauauguggacucccaccacaggguguggcccagauaugggguggguccuacccccgaaugauccagauuuagagugggucuucccaccucaaaugauccaaucaagaaagcccucacaggccugccuaguugcuugagucuuaguugauuccagaugucaaguugacagcaaagauuagcuaucacaugcagugccgggaaagagacugagaggcagccuggaguggugccgacccuugccuucugugccacagccacugcucgggggucucagcuucccaugugcucuacgagucagggcugccguguacagggcguagugcagagaauggguuuauuuuagcuuuugauuuuacaagauuggguuucucuguguagcccuggcuguccuggaacucacucuaaaccaggcugaucucaaagauccaccugccucugccuccugaguacuaggaucaaaggcaugcgccaccaccacccacccagcuaaggauggagacuuuuaaaaagaaaguggcuuuguuuucuuacuauauuuuuuguuuucaauuaaagaaaaaauuuaaauacagaaaaguauaauguaaaacccacccuaauauuuugaucuguaucccuuuacuguucuucacaaauuucaaaacaaagacauugacacaaacucauuguuucuaaauuuguggauaguuggacaucuguaaauaagucaauaaaacuguacuauauaggcuauaugaca

SEQ ID NO: 2110 - RNA, 39895 nt, Mus musculus
uguggcccaugagacagcagaaucacuuucugauaccagcccuggaaggcagacuuggcaaaaguggugaugacgagggugucacauucccagagaccauucgaaguauucuucuaaggacuggggccuggcacgagacagaggaaaagaagaaagcuaaagugaugggucagugagugguggcccaacuguccucaggccugccugggggaugaggugcacccuaggauagacaugugggcaggggcaaugcugugccaccaugccaucuugaguguuacgacagggggugaugugacaucaaggccaaaggcagagcaacuucgagacuguuacaaaaucugacguuuguguacaugccaggagcaugugugugcagauguacauguagcuguguguguguguguguguguguaugugugaguguguauguguagacuagaaaaccaccuugguuucaguccucaggagcuaauuacccugaguuuucaguuucuucccuggccugaagcucacuaaauaagcuaagcuagccagaaagcuccagagaucugccucucucagccuccccagugcugguuauuacaagcgcaugccaccaugcccagaauuuuaauauggguucugauggcccaccuccaguccucauccuugcaagguaagcauuucacugacccagcuaucucccggcucggacccugacaucuuuauuuacuagacuugucucugagggcccuacaugaggauucggauuccugacuguggcauggccugcuucugacugcucuuccugaagggcacuggacugaucuggacucgcguggcugggcucacuguagugcucagaaguccccaguggggacacuggaaccaacugaagcuggagccacuugcucuccgugggcucuggaguaggagcccaacucacuccaccagcuuaagagcuguguuccuaguagaagagggcguccacgccucccugccugauaaaaacugcuugugccagguugaaauacacagaacaaaucuggcccagaccuccgcuaugcccucgaggcucggagacucuggcaacggcugccuugaauauccacuuggccucucucccaagggcaggcccguugccgauagacugugcuugaucucuccccugcccucgcauucauucucccaagauauuuuauuguaagagguauuugccuaccacgcauauuuacaauucuuucccugccaccaaaccaacaaaguguccacagacaucgagucucgcucucucacaaacacauucucgccuauucccauggcuugcccuucuccuguuuccaccaguucguucucuuuucucaaacgugcuucauccucagauccuucugaacccucuccaugccggcugaguugggcuucucugcucuucuggagagccguaaguguccugugcaccacaagccuuagucugcuuuaugucauuuuuaaagugugcucuugaaaguucuucggguuauggugaugacuuacuuugcccauuuguccucuggauauucacccgaugacaucugccuucugcuaucaccgacuaaauaguggauagaugggaaagagaugauuaacgagaagguuccauuugcuuuuuuuuuuuuccucuuguguacguaguacauacaggcaugcacacagcugugugaacguguguguggaaggugaaggucagccuuggaugucauugcucaggagccaucugcuuguuuuugaagacaagaccucauuggcgugccacuugcuaauuaagcuaggcuggcuggccagugagccccuagguacucaugugccucccaccuucccagggcuggugccacaagcaugugcuaccacacccagauuuuucacguagguucuggggauugaacuuggguccuuaugcuugcaaggcaagaacuuuauugacugaaccaccugucugggacagagccguuuugguuuguucuuuccuuuuaucaccugucacuggagaugauaauugcugaugcuucugacuccucuuuccuucuaggaguaaagggggggugguggagagagguagggugaguacugaacaccauuggaaaacugggccccaacaccccaacccuccagggguucugucugcugcucccgucuccugucccaucuucucuucucauuauucacuggugcccaguauguuggguuguuuuguuuuguuuuuuuugcuuuuuugucaacuugacugacacaagcuagaguuaucugagaacaggaacuccaguugagaaugugucuccaucagacuggccuacagguaggucugugggggcauucucuugauuaaugacugacaagggaggauccaguccacugugggugaugccaccccugggcagguggucuggggguauauaagaaaguaggcugagcaaaccauggagauuagggcaauaggccacauuccaccauagccuuugcuucaguucuggccuccagauuccugcccuguuugaguuccugccuugauuucccucaccgacaggaugggaacaggacauagaagccagauaaacucuuuccuuuccaagcugguuuuggucauagcaacagaaagcaaauuaagacagggaccaucacgugucaauauguuguacaacaauauguuucugccccauucacaucuguagccacuccucugcuucuuaacacggaacaaauugucauccuguguagagcacuccugcccuuugcauugcuguggacuguucauccauuuucaacuuaucacacucucuaauugaauguccccuccugauaucagugcuugagccccuucugucuggugagauuggcuugggguggcaaucucagauaccugaucucauuuuucaugucauggacuccuucacuggaaagaugaucaauguaccuaaaacccaaagggcuuuauguaagauauguggcaagcaucagccucagagugugaccuaguguaagaagggcaaggauuagggaguccuugcauacccaaggaaguggcuauaucauuggaagcagaauggcugucguggucaaacaaggccaguuuucuaaaagaaaacccaaaccacaagaugacgaugcccaggcugagugugucaagcuugacugcagaucugagagguugcagcccuuaacaagugugaauguuuuaagcugggaagaaacaagaggagaaagggccaugugauccaguucuaaaauuuguguuguuugagaggaaaguauugaagcaauaaaaaaaauuacuuguuagaaaauaaaauuaucauuagucaugaaggaaagaaaaggaaggaaggaaggaaggaagaagaaagaaagagagagagagagagaaagaaagaaagagagagagagagagagagagagagaaacagagagagggagggagagaagaaagaaggaagggggagagagagggagagacagacacacacagagagagagagagagagagagagagagagaggcagagagagagagaagugcuugcgguauucacugcuugccuucccugcccagcucuccugaggauauccaugcaacuggaaacuuaaguacagcuaccauuuauaugaugcuuacaccugcucaaccuuggccaugcaaugcuucacuugacccucagcucagccugugagcuggacuugacccucagcucagccugugagcuggaauugacccucagcucagccugugagcuggacauuaugccuguuuuauagaugaguaaacugaggcacggugcguggaaaggauguaaccaaaggacacagcaguaagugggaaaguugggaucggagcucaguuagcuuggcccugcuauugucuggcuggagauagugaaauguguuugcgaagccuguuugccccauauguaugugucaguauccuacuuguucagagucuuacucauucccaggaagagggcuuccauggguuggauuauguguccucauaaacaauguccaccguucacagauccuuuuaccagccgccuccucuccacucaagcccaucuguauccguggcucgugauugcucgagaugggcucaccauggcuguagcuggcaguaugugucccagaagcugccuuggccugaagaccuccgugugccaggaccagguuagauaagccaaucuuucccugcaugcuuugacucugggucaccauagucagucucggagaauccaggacuuuuugacuugcuucuugaaguccucuucuuuccugagaucagaagugggaaacccugggacguguugggguguggggagagcucacuaccucauagacccuauuuggccucuagacagccucucugccucuccucgugaaaccuaaaccucggcaaagagcccucugcuggcccacaagagcaucagcuacacucggauguacaaggggugccugcuuugaauuuccagagccuucaggguuggggaaagaugggggggggucggggucgggggcucaggagguauuccacauuggaauggcgaccacucucaaagaacaauagcaucugcaucaucuguucaugccaugccuagucagcucugagaaugcacaucaguguguccuuggauagggaugugggcaagugauccuguaaggggccagggaguaaaaauauuucuaggcucuguggaccauauguugccuguugcggcaauuccucucccccuuguggugccagagcagccaaaggccauauguaaacaaauggaguggcucuguuccaguaaaacuuuauuuaugaacccugaaauuugaauuucauaucacuuucaugcgucauaaaacguuauuuuuguuuugacuuuuucaaccauuuaagaaacuaaaauccauucuuagcuuuagggccauauaaaaauaggcagugggugggauuuggccaguggguuguaagucugccuacuccugugcugggaaauaggcuaacugacuugguucuucuucuuuuguuuuaaugggcaccgauggugugggaggggagacucuugguggaaauccaaguaccagguccuggacagaguggagaggcacccuagggucacagacaacucucaauccuucacauuuauuaaaaguaacuagaaaguuccucuauccucauuuguaggauguguuaggaggauaguuuguuuuuuuuuuuuuuucuaaagaugaaggaccggucauauucuaaucaggacucuuaaagguuauacaggggcugggaguguuggagcagccuuuaauuccagcacuugggaggcaaaggcagauggaucucugugaguucaaggccagccuggucuacauaggaguucuaggacagccagagcuauauaaguguaacccugucuuuaaaaacauuuuugcuggggaaggaaaugacuccagagauauaaagccuucauugcaauagcgagggccucaggguuuagagccccagaacccucuuaaaagccaggcagacaugguauccuuuaguaauuccagcacuuagaagguggagaugaggccucuugagcaagcuggcuagcugcaucauuuuggugagcucuggguucaguugagagacccugacucaauauguaagguagauaauguaggaaauaagaugcaugagaaggaggaggggggggaagggggaggagaaagaggaggaggaggagaaagaggagguggaggagaaagaaggagaaggaggagaaggagaaggagaaggaggaggugccuacuucuaaaguguggagaagauucuuauuguauauguaagagaaaaagcaugcagaagaguccaggcuaaacauggcugccaguccaaaccaaaccaugaagcuggggggugggggguggcagguggcagggguggugagggagacccaggcuaagaggccagagacaggugcagccaaaauagcugaguuaaauagggaucaggcuccaggcagggaaauggucacaaggccccaggaagaggaagguuuaugguagcggguggggugggaaguguugggaggagccacagguacugagggaugccaggagagcugacaccucaauuagccauuugcccuggguuccugagaccugacagaaaaugaucaagaaaaaucccuaaugucagucagaugcuugugcaccgguguacaccggcacccaccccuacacagacauacaucccaccccaucccacacagugcauauacauggaaguacuugaaaacuugcgcaaauaaggacugggccacuuuuucacuggcugcuugagaagucaguugccuugacuuuucuucuacacaucaacauaaauuucugcuucacacuuaagguuuugcccccagucuagaccagaccagacaugggagcaagaaggauggaggcggccacggaaaaccucaguaucuucuuagggagacacugcccuaaggauaagacuggccaucugagagaguuccccagggacacggggguuuuaaggauugguuucucagacucuucagugugacaguauucuucuggagacaagccaagggaccuggugaacauuuuuuuuuuuuugaaaaguguuuuucuaaggaaaaggggggaggugggcagaggagggggagaauuacacaaagauuuagucuaacagcuuaaaaaucaaaagggucacuggacagauagauaucaaauauaauaagaaacacacugacccuggagagaugacuuaauaugggccuccaggcuccuugaagcuuaacaaguaucuagaguuuggaauuggacuuccaauucccacaucugaggaugcagccagugucuuggaguuaucugagccaggccaaaaaugaaaggcugcuaacaguaccucagaagggcacuucacagguuguuuauaagcaucuggagacuacagggacccagcaauaggaaggagcaaaagaucucuguuuguuauuccaaaguuuaaucuagggaccuuuuugaagaccuuuuuuuuuucauaauuuuuuauuaauucuuugugaauuucacaucguguaccccccccaaaucccacucauuucccaauccuuccauaucugcccucaacucauuuaaccucccuccacauaaaaaaauaaagaauaauaacaaucucaccacggaagcucaggugugucacagugugucacacaauuuuuuucgccuaaacaccuucacuugcaaauguuuauuucagugagucacuggucugguuccaggccucuggcuucugcuacacuagcaauacuggauccucaccagaacucuucuuggauauccugccguugcccugcgucauggagcucuugcagcuuugguucugcaggaccauucccuucaaaugcuccaacagcucacaggugggaguggaugggaugggccagcucaaagccuuagaucugggccuggguuguagcugaguuggucagccugccagcucuccugcucccacgccaccaggggcuagcucucucuagcuguauggguuaggggugaggccagcucaacaaugcucuaggacaccgguggcagcccagaucacaggcaucugcuuggccuuuggagguagcacaucaacacaaaccucugcugcaacagagccacagacccagacaugacccauggguggcagcacagcgguaguggguggggccuuugggugucucuugaagaccuucuaacccugacauuugagcaaugccaagaaguauuugugucacuuuaaggagccacccugucagcuugcgguguccuuaucuaaaaacuuacuggacacucuaaauuggaacuggaggcagggggcuggagagacggcagggucgggaggagcacuugaugcucuugcagaagccgggauuggcucccagcaccacaucuggcaacucacaaccaucuguaacugcaguuucagggaaccugaugcucucuucucuucuccaugggcacuacaugcacaggauacaugugugcagcgaaacacucauacacagaaauaaacuaaaccuuuaaaaaaaaauaaagacccggagggugauuugacuagggaaucccuaauuuaacacaccuugcucuuacacuuccugguuaacuguucgguguguguacaauggaguuucguguguuuguuuccuacagauaaaacaaagcaacgaaugggugaggcaguaugaagacuccuuuugguuuagcacuuccagcuuuggcauguggacgguuucacauccaguggcagucgcucuagauucggcuuuguuuguuuguguguuagagcagagucuucuguaugccaggccagccuccagcuggacuuguagcuaagaauuaccuuaaacuucugcuucucucgagugugaggucacaggcaaugaguaccuuguuggguuuucuguaccguugggaguggacgcuggggcuuugcacaugcuuagcagacacuacucucugagcuacgucuccaguucucucuccauuuguuuguuugcuugauuggaaauaagguuccuuucuuaucuucuggcuggcuauguauucacagcaaucuuccugcuucagccuucugacuucugggauucuggaccugcagcaccuggcucaucugagggugcaacuucccccagcagcugggaaucugcugucauugagagaccuaaagggacugagugaggagucucuguggcagcucaauuugugagguacaagccgacaagcuggcacuaauuacgagcuaauggccuuacaguggagcauugccaauggauaaggauccugggcuguggaguaaacacagacccuuggggcagauccaagacagauuuucagaggacacuagcacccacuccagccuuuuccaccucagcuuugcuggagaaaacgacaggaugcaagacugcugaagaggaaacccggucuugcugggcuggcuucuggucagguuaucagggagccacaagguaacuuucaggggaggguuugcuuuucagagcuaaaacuucuguuagggguugcagaugugagucugucaacagagugcuugacuggcagucccaaguccugguuuucauccccagcauggcauaaaccaggcaugguacauaguaugccucuaaucccaaagcaucgggggugggcacaguagaggcaugagaaccagaaacucugggucagacuggagagauggcucagcgguuaagagcacugacugcucuuccaaagguccugaauucaauucccagcaaccacauggugucucacaaccaucuguaaugggauccaaugcccucuucuggugugccugaagagagcaacaguguauucacauauauaaaauaaauaaaucugaagaagaaaggaagaagaagaagaaggaggaggaggaggaggaggaggaggagaaggagaagaaggagaaggagaagaagaagaagaagaagaagaagaagaagaagaagaagaagaagaagaagaaaagaggaagaaaagaagaagaagaagaagaagaagaugaagaagaagaagaagaagaagaagaagaagaagaagaagaagaagaagaagaagaagaagaagaagaagaagaagaagaagaagaagaauuagcaguaguaguucaggucauccuuagcuccaugccuaggcuauaugagauccaguaucaacaaaacaauaacaacaaaaagaggaaaacaucccaauauacaagagucacuaggguagcuaggaauauugcuuuaguagucgaguguuuaacaagcauggauaaggcccuaugcuaugugcaaucccuaguaucauucgggguagugggacauggcuguguagcucagugguagacacuugccuagcaugcugacggccccaguuugacccuagugcuggaggggaaaauagaucauuaaaagguagguuauuagccgggcaugguggcacacaccuuuaaucccagcacucaggaggcagaugcagguggauuucugaguucaaggccagccuggucuacagccaaggcuacacagaaaaacccuaucuggaaaaaacaaacaaacaaaaaagguagguuauuuuuuacauuugagccccuaucuuuaaucaagugggagcuggggagagguucaagaggcugcauuuuuaacacccccccgcccagugauuuugaugccagugguccucagaccacucugaaaaaugucuuccuuagaagcaucugcuuuuacccaccggacaucaacgacaagauaaaagugaggccaggcuucucugcugccugugagaacagcagcauacagccaaggcuuguuccagaaaagaggcauggucucugagggauucuccccauccaucgagacccguggcuacaagccagaggauuucagaggaugaggugcuaauccgggucuggagagagagagagagagagagagagagagagagagagagagagagcaagcauugcuucugcacgcuauggacugagucugcaauguguucauguaccauaaacuugaggaaccacccugcaagcuuucaggucguuaaauccuucucuguuguauguggucuaugaguauggcagaauguauggagaacuguguuccugcgggugucuugccuccucuaguugccuggcauuaaggagaaaaaaaaaugagugaaauauagucacuguauuauaacugugggaaguagauuagucgaagcgcaaggguaacgugaguguaacuggccucugucaggcacuucaucugcugguaggacggaggaugguugucaggcucagcaaaugcuguuugaaggguugauaggucaggcuguaaaaguagaugggaaauuuguacagugaacauaagcaggguaggugaguagaagagaaacaacccaccauaucaucugggaaaauaaaacucuuuggcaagacuucauaacagccugauucaaaauuucauaaugaaauuaugucucugaucaaagccugcaugagcucaugagcugauuuuugccauucguguuuauucugguuugcaccaaguugaagcaucagaaacacauuaaucuaaucuucuuucugggaggaggcucuuguacccucaucuggggaucaaagggauggaggauugcaaggaggaucuuuagccccucacugaaugugcacuuuugauugguucuuugaguccccuuaggcacauaugagggguagggccuuccuaggagaguugagucuccugacacuugcccuugaggcaagaaaagcaaaguuuaagaagggaaagagacucccaucucuccucuggacacagucugcuuuugcucuagaaagaauauuucgggguuuguuuguuuuagacucagagaagcgcucaacuguaccucuuucaacuggagcgcuucaccacagguuuucuucuuacaaaaugaacucagauccaauggccccacacuucucauggaucuuacucaaucagcauuuuucugguccuucucgaaggcacacagauaggcacuccugucaacucaagucccaacagaaaaggcacuugguugaaaucugggaaacagaauucccugggucucauggggcccuuuagacaagagguaccccccccccaccucuguccuuauucauccaagaaagauuuaguaaggccuuauuuuaugucagaugccuguucaaaguguuuuuaauuuuuaagcccaggggaccuuuacauacuuaacugcaccuuugugacagucucucucucucucucucucucucucaagauaaugucucagagggcugugguggcacaccgccacacuggaaguggcacacacuuuaaucccagcacucuggaggccagcauggacuacagagugaguuccagggcagcuagggcuacaaaaaggaacccuaucucaaaacacaagcaaacaaacaaacaaaaagauaaugucuuuuucuacaguuuggcuuguaucuuccuauauagcccaggcuagacuagccuugaacucacggcagauagucuaaccucaaaugcugagguuagaggcucaugccaacacacucagcuuuguuacguucuggggacacggaggugaauaacguaccugauuuccauuuuccuaagcuuauggccuagacccaagaaagcagccaaugcucuugugaacagagucauuucggguaguggcaugugccgugaagugaggugggauggaauaacaggaagagaguggcugacuuaaaucaguaacucagcaaauacuucugccaaaggagcugcugccagauagaucaagagaauguaguuccauuuaaaaacaagugaacagugaaaaaaaucuuuugguguagggucucucuauguagcucaagcuggauuugaacuugugacaauccuccugccuuagccucucaaguauaucauguuuccuuagauccuuuaaguuauccuaaacgaugauuggaauauaagcuagaaaguguguuuauuuauuuuuaaccugaaauucaaauuucacugucuuguauuuuuuuucuugauguucuccucccccccuccugcuucccccuccuccuccuccucccccuccuccugcuccuacuccuacuccuccaccuucuuggagacaagucaugcuauauaauguggacaagucuggaacuccuuccucugccuuuugagcauugguauuauaggugugugucaccaugcugaugaauuugcuaguguuugcaauccuauggauagaggauauuugagcaggaacugaccagaaggaaccagcgaugccgauucagggaaugugugaucaaacagagcaacauucaguguaaaugucagaagagggagaaaugaggucagaggaacggagccagaucacaaguuuuguagggauuggaaggaguuugaaucugucucucuuugcgauaauaaaccauuggagaauuuaaaaucucucucucucucucucucugucucucucucucucucucucucucucucucugucucucucucugucucucugucucucucucuuucuuucaagcugaggcuugaauccaaagucuguuguuacuaaaaacugcucuacuccagccuaaaauuuaaaggcagguaugaccuguucugauauuugcccgcucuugcuggaacacuuuuagaaagguucagagggcaaauucccaucagcucaugcacugggccgagaacaggcuucucucuuuuucucuuucucucuuuuucucacuaaacccaggacugcccggugcccuggacguugcuauggaagggacgcuugacgguugcuagacccgggggaggcgggagcaggacagaggcggagccgggucagccuuaggcaagcgccgcgcgcucucaggaagucgcguagcgcgagcggaagugacgucgcgcguguucaggguccaacgugcuucacacaggacgcuuucccggcugggaagucgugaagugguuuaccucgcgaguagcagagcggugucgguacugucgucaggauggugaagcccaaguacaaaggacggagcaccaucaaccgcucggcggccagcaccaacccagguacggcggaccgggcgggaccaggccgcaggagccgucggggacggaggaaggcccguuccggccugggcggcggacccgaggucuaggcaccugcucuaaaguugggggaugagucacgccagccucuggcagccccgaggccucucaggaggagguguagagaaaggcaaguuaaaagugggcuaggguccuggaguccuggcacaugccugucaucccagcacuuaggaagcugaggcagaggggaucacgaguuaguggcuaucuggacuacaggguacagacugaagacacagaguggaguagguuggcccagguggcauuuuacccuuaaccauagcauucgugccaccuuagcuuugaccguggaaucagaccaugcauaagcaacacuucagguaaauauagugauuucaauagaggugguuuugagauacgagaaauucccaucuacagggcaaacaaaacaggcuuucgaggagucccucccacuuugauuuagcuacuaaaacuguguuuaaauauggguuagucauagaggggcuuggugacgcaucccuguaguucccaauacugggaaggcaggacagacagaucucuugugaauucgaggccagccuggucugcauagugagacugucucaaacugguggggggaaaaauuagguauacucuugucuccguaaggcugcaaggauagcugacuucuguaucuccuuguaauuugcauaauuaggguuuugauuagauuuuuuuaaaaaaaugaugaaaacacucagagacuggagagaacauggggagaauaagagcucacucguacugcuguugcaggaggaccagaguucaauuccaguucaaucagcucucaccuaccuggaaguucaacuccaaggggaaucugauaccucuggccuucaaggcaucuacccacauauauccguauaauguuuaguacuguguauguagcaguacuaaaggagaacaugcaggaaaguugcugcguuacuuugugaucuuuuauaacuguauuaagucacauaauaccaugcauuuggaagauucacuugggauugguuggugauuagugugaugauguuucuaagcagggguuaaguuuaucaacagcugaaaaauguagacggaaaccuugaggguugguaggaagagggacucaggaaaaggauagguagccagaugugugugggccgacuucucaggagagcccuccagggguuuaguuugauuuuggguucucucuuaaaauuuagagugggaggggcuggagagauggcucagggguuaagaacgcuggcuguucuugcaggggaccugcagugauucccagcacccaugauacagacgaccaucuaucuguaacuccaguuccaagagaucugccacccacuucuggccuucacugacacgcuguguguguuuagugcagagacaugugggcaggauaugguauuacauauuauacuuacauaugaaguauaaauaaauaaaauuauuaaaaauuuaggacaagagaauuaguuaugaauucacaaagaggguuucuagauaugcugcuucuaaccucagaagcugugggaaucaguccuauaagccaugauuugugugaaauuuaacccaacuuuuagaacccaucaucaucucuugaaaguuaagacaggugguggcucacaucuuuaaucccaguaccugggaggcagaggcagguggaucucagugaguuugaggccagccuggucuacagagugaguuccaggacagccagggcuacacagagaaacccuaucuugaaaaaccaaaccaaaaaaaaaaaagacuaaaaauauuuucuuuuuaaaaauauuuauuuacuuuauauuugaguuuugccuacauaauauguacacucuguuugcuccuauagaugguugugagccaccuuguaggugcugggaauuaaacccagguccucugcaaaaauagcaaguucucuuaacugccaaaccaucucucuggccuacuccuuuaauuuauuuuuagauagggucucaguuuguugccucugacucaacguuuggccaaggauaucuucuagcuuuuuuuuuuuuuuuuuuaagauuuauuuuauauauaugaguacacuguagcuucuucagacacaccaaaagaggacaucagauuccauuacagaugguugcaagccaccaugugguugcugggaauugaacucaggaccuacuggaaaagcagucagugcucuuaaucaccgagccaucucucuagucccuguuuucuaacuucuaauccuugcuucuagugcuggaauuaguggcugugccacaauggcugguuugugcagugcuagggaucacacacagggcuuuggagugcuaggcaagcauucuacccauuuaacuacauggcuauuguggacauaguagugguuacacuuuuuaaagauggauauugauuuuauguaaccaauguagauuaugacuaaggauuaaaaauuaaauggcagccagacauggugaugcacacauauucccuauuuuuagagaaauaaaagcaccagaagucuaaaaauucaguuuguauaagacugaaugagaaccuuaauguuugauauuccaaagucccuuuuacuuucuucauucuggagcaaggcaaguuaaaugagaagaauagcauuccuauaugucagaaucuugaguuacgaguugucuagaugaaugugccugagugugcuguaaaguugccauguggggcucuuuaugcugcugcucaggaugguccuugaaguccuuauuuaagaaaggguucagaagccaggcagcgguggcgcacgccuuuaaucccagcacuugggagcagagacaggaggauuucugaguuugaggucagccagggcuacacagaaaaacccugucuaccaaagaaaagggggggggguguucggagcugugcaugauggcacauaucuuuuaucccaggagccagaggcagaucucuugauauugaagucaaucugcucuacagagugaguucuagaacagccagggcuacacagagaaaccuugucuugaaaaaccaaaaaggagagagagguggagaaauaugagggggauaggguggggucuguaguacacugcuuuauuuccucaugucaagacauaagaggcaggcuaaucuauaugaguuuaagaccagcuggggcuacauagugagaccuugucucaagcaucacaauaaaaaggacagauggccuggagagugcgugcuaacuccaggauguuucuuuaaagauuuacucuguguaguuccugcgccccccucccccaaaucucuuuuuuauucgguuuugccaauuuuguaacuauuuuuuaagauucaaaaaauuuauuuuauauguauuuguguuuacaugcacguauauauguguaccacuguaugugcuuggugucuacagaagcaagaaaaggauguuagauucccuggaacugagauauaguugucaacugucacaugaguacugggaaucgaacccagcuccuuuguaagaacagucagugcucuuaaccagcgccuauuuuugcuucuuuuuguuauuguauuugguuuuguguguuuuuuauuccauucuauuucuuuguuaaacugagaccuagaucaauguccuuuguaguugagagcacagaauguaucaaaugcuuguguuaacauugugacucugccagguaauagccauauagcgcauaacauagcucuuuauaugacuguuguguggcuugaggucgguaguggggaucauggugagguuagcauccugcugucagauguccauuucucuuggauguucagaaguggaacucagcuuuggcauagcacauugcucuuagucacuuauuagagcagcauauggagagaguagacauucuuugguaagguuagcuuggcuaguuggguaagcacuugguuagcacauuuuaaacaaugacuauauuuaacaguuacuggauaucaaaaggcuuauuauucauuucuagaucgaguacagggagcuggcggccaaaacaugagggaucggggcacaauucggcgccugaauauguacaggcaaaaggagcgcaggugagcauuggguacagccagccuucccuuuccuucaugcccuggauuuauaauugagaccuguuaaggcuuguucccaucaucuccuaggaguguugcuguggugauauaguuaauaugguuaaagucauggguaguagauggugaaguggugauuguuuccuaacacuuccuggcaaguggccauccuauugcucagauacugauuuccagcacuguagugucagaucccagcuaaauacccaucagccacaaguccaaaguguguaagacugcuuacgaaaacugccaggaaacuuggcuguuagagccaaacacagaucacagcguuguggcacuaggaugcucaucccagcccggcguucugcugaggcagccuccacuccagggacuugcugagaguggcauuuugcuagcuggucuuaauuuguuugguaauuagauucauuucuuuugaaagcuguguguaagacacagucaguaaccuagccugccucagucgcccgcuuugcaguuuguuuuagaauuuugaguuccaggauaaaucauccucuacuuaaaauucauuuaaaccagccuuuaaauaauuaccaaaaaaacucaaguaugugauuuuuuuuuuuaaagaaaacaaacaguaaauggauuuuuaaacaucagcauuguuacucaucuagcagaaaucauuacgugcucuguugcaagagguuaaacggcuuuugggcaaucuguuucaaauguagaaggacuuuuuguuuacugaagucuguauuucaugaucauuuuaaauccccccaaaguccuuuugauggaaagcaugucugugagccagacugugcucuugcugccucgcuucuguccucaacccaaaucuguuauuuccucaacuuaggaacagucgugguaaagugauuaagccacugcaguaucagucaacuguggcuucuggcacaguggcccgaguggagccgaauauuaaaugguuugguaaguauccuccugugauguugaguggaaaagacucagauguugaaacauccacaagaagguucugguucaugagccugccacugcuuaggaaaaggcacugaagaguucccgcguggacaccgugccuuuggaagagagcuaguucauucuuaguuggaugugagcccacgugagcacagaggccguuagaucccugcucauggaaacaucuaccaaccaugggcuguucaucucuuuguuucuaguuggcuggggagauggcuauauaagaaguggccuugcggaugcucuggucccuuuaccuaguggcagauggauguccuuauuaguuguugcaggaguggaaagagucuguccagucucaggaauuugggucuucuuugggaacacugcuuuccgcuguaauguuuagauagucacuguuuggcauccgaccucugugcuaggugaaguggccccugccugucacuguauuaaugccuuuugaugggcugcccccugaggacugaaacagaaagagaaucaaaauucuguucaaggacagaauggggggagguggggggagagugcucgucuguaugugcagagugcuagggucuauccccaucuccggaaaaggagaugaauguuggugugagugugugugugugugugugugugagugugugugagugugugugugugugagugugugugagugugugugugugugugugugagugugugugugagugugugugugagugugugugugugaguguaugugugugugagugugugugugagugugugugugugagugugugugagugugcgugugagugugcgugugcgugugugugugugugcgugugugugagcgugugugugugugugugagcgugugagugugagugugugugugugagugugugugugugugugagugugugugugugugugugugugugagugugugugagugugugugugugugugagugugugugugagugugugugugugugugagugugugugugagugugugugugugagugugugagugugugugugugagugugugugugugagugugugugagugugugugugugagugugugugugugagugugugugagugugugugugugugugugagugugugugugugugagugugugugugugugagugugucagggaagacuggagggauuauuuaccauggagcuggguauuuagaaucaaguuguauauguggcuagaggcaaguuauuaagucucuguccuuuaauuuccuaauuucuaaaauuggaauaagaauggcaguaucucaagaugguuguggugcgggcaauccuauaauccuaacacaugagaguuggagguaggagaaucagaaguuuaaggcuagucuggaugacuugaaauucuguuuccaaaacaacaacaacaacaacaacaaacaaacaaaaaaccgagaguugguauggaggcucgauggugaagauauuuacccgcaagccucacaaccucgguucugucucuggucccuacagaauagaaggcagaaaggggauaacaaccccugcaggcuguccucugaucuccacacagguacuauggugccccgucacaaauaaauguaaaaagaagaccauguaacugcugcuuagcauagucccuggcaaguagugaguguugggcacuugacccuuguguuugcaucugcuguuguugacuugaaugcugucuucagcaucaaaggccuggcguucucagcacuguugccuucuuggauguguccuggauauuuuaccagucccuucaagcccucuuaacucugagguuugggguucuuucucugugugaacugaucagcugugauuggcuccagguuucuuugccaggacuggcaggaacauuugucaaaucucaguuccauucagcgauguuuaauuuuugcuuucauccagucaggaaguugggcucugaaaacuguugaaacccauuaugugucuuaguuggugggugaauucacagugugugagugcgagagaggcgcguuuccccgcuuuucucaaguuugcagagaguucuaaggagugaugaauguguaggcucugggggcuugagaauggagauuugccuucuuccccugucagaaagcgcacgcagagccagaaccaaucucucuauuaaauggcauguucucuaucugugaaacaggaaauacucgugugaucaagcaggcaucauuacaaaaauuucaagaggaaauggauaaaguuaugaaggauccauacaaaguugucaugaaacaaagcaaauuaccgaugucucuucugcacgaucgaauccagccucauguaagacaaagugccacgucagugcugugguuuuuagggccagcucugggcagauagauaacggcuuuaguuuggcuuuggcuuucguaagcagcacugaggguuuuaugaacuuuagguguucuccuuugucacccuuacuuugucacccuuacugugaauugaguuuggcucaggaggcgcaguacuguguggauccaaacaaggcuuugcagugagaccugaauuucugucuucacucagcccuccuuuuuucuuaguuaugguucuccaugaaccuuaacuuccuugccauaaaagagaaugcacuugucucuucauguuuggauacagcugaagcaccuguaaggcuuggucuaguaagcgugcaacacccuucccaaggcuaaagagaugauagcuuuuaguugugugugugugugugugugugugugugugugugugugugugugugcgugcaugcaugcauucaugucuucacauguacaaguggaggccagaggacaaccucgacugucauucuucaggacuaucuaccuuuucuuucuuuuuuuuucuuuucugagacagguucucucacuggccuagaacuuaacuaaguuggccagacuggcuaggaagagccugggguugucagugcuaguucaucaucucagggagauguagagugaaggcugagauggaaggaggccuucaguguuuugugaacuccuuggagguuuuuuucagguacaggaaagggugcucuugcgauuguugguugcuggaguuguauaguacaguaagggcugacucuggccugagcagaaggaguucacacagaacaaagaaguggcuuaauguuugucugcacauuuuaaacuugcauugaauaauaauucccagaaacccagccagugcacaugcuugagugccagugugaggaggggagggaaacauugacaugcauacaaggauuaaacaguucaaagagaaguguuuacuuacagaacagaaucaaaagccaagcugcuuauugccucagguuuugucaauuauguuguguuuuaugauggacuugaagaauggcaccuauuagugagugacuguuuccuuucaggaaaacagaugaguguaauucaugaaccacagacaaguugcucauuucccuuguucucuuugucucuucucccuaaagccaucuucuaaccaacuauugaauccauuucugggaagaacagagguucuauuguggauuuauugcuuuguugcuugcuccaguuguucguugcucagauaucugauguaugaaaugaaggaaccuucaguuucaggagucagcuuguauuuugauggaggaaaauacucagaauaauuggugggcuuucugcguuggcuuugaaaacccuuucuauuuuaauccaguggcuguagcaugguauggacucuaguucuaaaaugcuucuacacaggggagucaaaucagaucuauucuaacuuuuauacauucaguucuguguguuagauguauuucuguaagaauggaguuaaauaguguaacuuugcaugugcacuuuaauugugaaguauuacaguaaguaagcugauugguucaaaaccauagguuauaagauuuuuuuuaagguuugacuuuuuuguuguuguuguugguuuuuuuguuuuuguuuuucgagacaggguuucucuguguagcucuggcuguccuggaauucacucuguagaccaggcuggccucgaacucagaaauccgccugccucugccucccaagugcugggauuaaaggugugugacaccacgcccggcucaagguuugauuuuuaauuugugugugugugugugugugugugugugugagagagagagagagagagagagagagaugugucugugcaugugcguucgagugcccuuggaagcuagagguaucagauucccugguuuagauguguuacaugcaguggugagacaagugaugugaguguuggaaauugaacucggguccucuggaagagcaguguguguccuugauaagcuaucucuccaacccaguuauaagauuucugaggauaauauuugcuaacacuguuaguauaauuaauaugguugugugucacuugucuccacccaccaucuccugggauacaaacuaacacuacugcaucuuuuuguguaguuuuuuuuuuuuuuuuuuuuuuaacauggcuucuggggauuaagcuugguauuuacccacugagccaucucuacagccuagucauacuuaauuuuuacucacugacuucagaacccauugccacagaaaaugcaguuuuccuuguggacagacauucccucaguuagaagcuagcaagagaauauaagccacaagcucagggaguccaggucaaugaggccaccucgggaggaucagugauguuuggaagccguggggcugauccaucacucaugagcuccccagcuggggcuuacccagggcccugugcuaagggaggaagguguguguguuguguuuguuuuaaaggagagucucugcagccuuuaacauucuguuaacguuaccacuaacuccacuuugacuuuuauccugcuucaagaauuccuacgccuguaacuccuucacagcgcaucaaguucuaguuaggaucagguuccuuuuaucacaucuaaccuauuauuuuggacuuuugcuagauguuuuucaucugaagcguuuccaugugcauuuaauaaaaacguuaccuaaauuagggaaaauguuaucugaaacuaaaaugcaucuuauaaaacaagcaauuccuuuuagccaugagagaaauuaauuuccaagaaaaaguuggcauuuacaguugguuuaaaaaagaaaaaaacacacacacauuuugacugauuguccuugacaaaaccugugaauuuggcgaauuuuaugcacuuguuuggaagcuccaaaaaagggucagaaaagaucaguuaauuuucaucguuguagcacugauuauaugugacuggagucugugaugggugaaggaaagcagaguuuggcaagucucacauggcuguucuuacucggugucuguguuaccuuuacauacugcagggaagcucacagcauuucagaauagaagaagcccuugugcaauauaaacacgcauuacagauuugaaacuucacugagucugugcucuugugguuuuuggugugguuugagcuuuuuaguuuacuuuggcucaguauuuuucuuuccugagucuuaccugcacuucuccuuugucuuuagaacgcaaaaguccacauucuugauacugaaagcuuugaaaguacauuuggcccaaagucacagagaaagcggccaaacuuguuugcaagugauaugcaaucccuucuagaaaacgcugaaaugucuacugagagcuaugaccagggcaaggaccgugauuuggugauggaggacacugguguaagguacgcauuugaggucucaucuuugcuacugugcuacagaauguuucccuuaugcuguggggacagggauugcacacacagcuaguuucuucuucccucagacuagaggcaucaaugcacuagaggccagaccaaaaauacuuuugcaaggcuucaucaccacauaccccucuugguuaccaagaaaaaggaauuauguuuucuuccuugcaguggugugcauuguuauuccuaaauuucagaggguaguuauguuggaaauugacacuuugucuuccugggucucuagaccacugcaguuuauaguugaucuuuuucugacccuccaaugauaauaugaaaagugauaaaccugcauaaaggucaugggguuuguuugcuuguucaaauucguguuuuauuuuguguaugcauauuugugguagaugaguggucagaggaguugauucccuucuucucccacguggguccuggggaccugacucagguugucagguuuggagcaagcauguuuacucacuaagccaucuugccagcccuuuguuuauuuuuuaaguuagugcacagaguaaugaguuucauugugguguuuucauaucuaugcauacuuugugugaugaguuguuuuuauuuucacuuuauauuuguuugggaaagaaaagaucguuaguuuucuucauucuuguggggauccauaaaguaaagauuacaaauugccaaaagggguuccccugcccugccucucuuuugugaaauagggucuugcuauuuggcccuggcuagccuggaacucagauccucuggaggagcaguaagcccucuuaacugcugagccaugacuccagcucccuacuccccaaccccuuuuguuuuugauccagggucucacuguguguaacucugguuggccugaaacucaccgagcucucugccucugcuuccuuagaucaggagcuaaaggcgugcacugacacacccggcaguguccuucccuuuaagucccuccauugugcacuugcaccacaucagcuugaucugcugucggagcuuugcuucagugacuuugcagagucaccugcauauccuucccuuuguuauacuuugggguuuuuauguuuugggguuuuuauguuuucguuuuuuuuguuuugguuuuuuguuuuuugagacaggguugcucuguguagcccuggcuguccuggaacucacucuguagaccaggcuggccucgaacucagaaauccaccuaccucugccucccgagugccgggauuaaagacgugugccaccacgccuggcuguuuucguuuuugagacagagucuuauuguguaguccuuuuuggccuggaacuuaacuguguagaccaggcugcuaagucacagagcucugucuaccagcucuugagcugagguuacaggugugaacuacuaccauugccuuuucuucuugauagugcuucaguugcucauuucugcuccuuucucacuuagaaaugaagcucaagaagagauauauaaaaaagggcagucaaaaagaauauggggagaacucuacaagguaaggaucguggcucucacugaggagcaggcacaguggcugcccgauugaaggccuuggaugaaguaaugcuuuacugcuucccucauccucuuuuccuccgugaaggagcugugaugugcacucuagugcugugcuggaaaggaagagcacuuguguucuguugccugucaguccuguacacugccccuuaggauguaccccgcaugguuagugcugccuaagaagguguaaguuacugccagugcaugccuuuaaugcagcacucaggagacagagacaggcagaucucugugacuugcaggacagucagggcuauaacacagagaagccugucucaaaaacccaaagggaggugcggggggauuguaaguaguuacuuagccucacuaucucggucugggaaggguuaauaccuuagccagccugccuaacucuguggggaaggaaagaaaggcuuuguguguacuccugagugcugacccagugcuuuugaacugacugucugggggcugugggggggugguaauauaaaaagcuccaggcacuccauguaauuaaccauaauaggaaacuaagaccauaagggaaaacuaggcaaauuuaauuuucuguaaaauaacacaaacccauacacaauaccugguacuugugaaucagaugggcuugaucuaagccagcuuuccuauuugaaauuugacaaguuuugaaaauucuugaccagcuuuugaauucugaugaguggacauugagaguggcugcuguuuacuccccuugcagacuguuugcuuccaaacacgguuuugucccucugggcucccauaaauguccccuuuauuuugugugcacugcagccaacuguuccugccucuuuggauuugcaggugauagacucaucagauguugucguucaaguccuugacgcuagagauccgaugggcacucguuccccccacaucgaagcuuacuugaaaaaggaaaaacccuggaaacaucucauuuuuguacucaauaagugugaccuuguuccaacuugggcaaccguaaguucagcucgugacccuaaacccacuguggaggccaguagggcaagccauucacuagcacaucaguacauagauucuaaacagcaggccaucgaagugucacacucuggggguugcccuuacuguccuuacugacagagagcuagcacaugcacuggcgcugggcagagccaccuuccgucuccuggcgggggcagcugcaggcuuuuguguccccccaguggaggcaguugccagucacugacuacguccccauuguguuccauuaauugcauuuaguaguuaaguuaguuuuuggaauauuguuuuguagucaguuguuaaacaaaagacaaagcacuaacugucauacuugaaaaagcaucucaaagaauuauagcugcuguuucccuuaggcaacgcuguauuugaagccauccaguaauuccaacucugauucuucugaauauuguaaacaaacagcuauaauuuaccagcguguuuucuccuccccuuagaaacgauggguugcugugcucucccaggacuacccaacacuggcuuuccaugcgagccucaccaaucccuuugggaagggagcauucauucagcuucugcggcaguuugggaagguagggaggcugcugcugcuagcuugggcuggcgugugugucccaaguuguuaacauugggucaguaccuuggagguagaggcaggaggaccaaaaguuuaagccagaaugggcuacauaaugaaaucucgucucacaacaacuguuuuguucacuucucaguguuuucuagagguauaaaaaacccgcaggcgcucuggaucaggaagggucugaagcauuuucucaucacaugaccuguucugccauaucacuagcaccagguaguucuuucagccuuugucacaggguagcugcccagcccaucacuucagggacauucugaacgucccagagccuucucuccugccuggcucuaacaaagucaugcuucccgucacacccuuccucauuucccagaaguaguacuuuugacucuuggccaucacgucuguuauuucaauacugugugcuguugguacauacugaugauuuauuucuugauucccccaacucuuucccguauuuuuacauacuuauuaaauguuuccugcuuuaaaauuuuaggguuaguuugggggggauucuauuuuuuuucuccuuuuuuuuuuuaaaguuagacauugaacccaaagccuuaaacaugcuuuuaagcacuugucaguacuaagcuaugacuuagugcguguggcucucacacacgcucccccucuuccccucuugagcucacuguuuuauggaaaaggguuucauuuugagguguuuugagaacagauggaacugugaugcaggguagcuccauagucacuguguagugacuuugcagcagccauccugccucaggcuccuguagccuccugaugcugggugcggugagguugcuuguguccaucuuccucacauacaucucucacucacucugcuucucaggccaagugucauuuggcguucacagucuucugacggaggugccguugagagcaguguacucaggugcucucaugcuccucucugguacagggguuuguuucugcuucacgucauuugcuuugucauuuauuuguauguuuaacauuugggcagacagaugguagagaagcugggcaagcaaguagucuacuuuucagccagcccucucuaguaggaacugucugcucucagucuguggucugccuucaaguacuaagccaaaagcuuccagucucagcuacucagagacaagacuccucucucccaaaucacuuuagcucaggagauugaaacugcccugugcaacagagaacugguaucaaauugaaagcaaaaguacccacaacucugauagacucuuggugucuuuuugguguggggacugcuagcagugguggaucucacugaagcggguaguguuaauuagggacacaggcauuuucuuuggguuugucguugucuccagaagagacucuuccaguuucuagauuuagcucugggagcacuuggggagcagggucuagaggaauggucucacugccuuguguuuagacuugguugggacuugaacacuugccuuuugcugugcuccagccauguucagacacacaugucuccagugggcaucucuuaggcuccuucccuaaagaugucucuacuguggcuggugauacacugugaugaggagauggacaagcugucuccuccugaucuacauccuguuaaccuagagcaaagaugcuuuacgugggugccugaggucacggcucacuccugacaugaaaauacacuguaucuccugggcugugaggcaggcuuguguugaggaugcguuaaaugcucuuugcuauagaaguccuuccauuagccaaauaacacagugugaccgaccuaagggagcuaacuauggccgaguauauaugauagauauucuuuucuuuacuuuuuuuuuuuucacaguugcacacagacaagaaacaaaucaguguuggguucauuggcuauccaaauguaggcaagagcucugugauuaauacauuacgauccaagaaaguuugcaacguggcccccauugcuggagaaacaaagguauguauggguucuacucuguuuuauuucuaugaagacuugacuguuuaagauauggagaucuccccucucuucuucccuuccuccuguccccuuccuuucuuuaacaguacuggggaucaaacccaggccacacacaugcuaggcaaguguucugcaguggacauggccccuguccugcccccucucaggaucggugcacccuguuggcuaaugcuggggugugauuugguuauggccuacauuuaauuccuuuguaaauugcccuuguacucuuuuuuuuuuuuuuuaaagauuauucauuuuuauuuuacauguauaauuguuuggccugcauauauguucacuguguauguaucucuugcuaacugaggucagaaacagacacuagaucaccuagaaccagaaauauugaccguugugagcugccacguggaugcugggaacugaaccuggguccucuacaagaacagcaagugcucuaaaccacagaaccaaccccccguaucucuuaacuccaaccuuuugcuuuaauaaaaccaacccaagaauauuuggugucuggguuaagaaggaaagaaaacaugcuggguguggcuuuaaucccaguacucgggaggcagaggcaggcagauucugaauucgaggccagccuggucuacaaagugaguuccaggacagccagggcuacacagagaaacacugucuagaaccgccccccccccccaaaaaaaaagaaggaaagacacccggcgaaaacguggucuuuagauagcuucuauuauuuagaagcagcagccauaacagaguuuugggaacagcguuguucugccuugugacaaagaagcuagcgucucuguguuucugaauguuuucaagacgugaagagguucacugugguggcuuugcacaagaccaacuagaaauccugccucugccuuauucuuggacucucagugauggaacucuaguauguccuugguggaaguugucauacuuaaguaaaggauaggcucuggccugauuauucagcagguugcuuuauagcuuaauaugacaaugucacagaucagugaaguuuagcucccaguauuugacuuugacaaacuuaggauuuucugucugcaggucuggcaguauauuaccuugaugcgucguauauuccugauugacugcccuggugugguuuacccaucugaggacucagagaccgacauugugcucaaaggagugguggguauuuguccucaacaauucuguuuucguuuguggggaucccuaagagccuuugccauuccuuguugagaaggcagccuggggucagccugucuaagcagaugcagaaauaugaugcugaacagagcagccuccuuuccacucagccuaccucaggagguugaggggcugugggcauaucuggucagugucaucccacaguagugugcaguuaccacaugguauccgaagggaagcagggcuuguuuaugcuuagugauaauucaucucauggguuuauggauugagucaucuuggaacccagucauuuccucccuuguuucugaauaugacugaaaacuuaaaugauucccccuaaccauaaccaugcuucuagcauaaguucucugcacauuccucccguccuucugaaauucuuggauugcuuuuuguguucuggguucugggaguagcaggcaucuuaaccguuccugccagugagugacacagagcauuccaaguucaaacugccuguggaggccgcacacagucugugguaaagcaggauuagaguugagcucugggcucccuggcugcggucagcuuucagggguguuccuugcuccugccaaacuaucacagacacagcaaaguccuagucaccucgugauaaagaaauccauuucacuuuauacaaaucacugaguuuuccugucuaugcaaaagaauugaacacagcauuucuauuauucucuagguucaaguugagaaaauuaaagcuccucaagaccacauuggugcuguccuugaacgagcaaagccagaguauaucagcaagacguacaagauugaguccugggagaacgcggaggacuuucuugagaagcuagcucuccgcacugggaaguuacugaaggugagccagcgucuuggggauuggcacugggauacacggaccugccauugugagagcggugggaacugugucagcuggauggugaggagcagagugacuaaaguggcccucccucauccagaagagcuuuugcucugggguuuaacugggaaggaaccuguccugucuuuuuaggguggagagccugacaugcugacugugagcaagaugguucucaaugacuggcagagaggccgaaucccuuucuuugucaagccgcccaaugcagagcuaccgaccgauucccagguaagaagagggugagcacagguccuggaaaaugggcucaagugaccccagugugguguaacucaagguuguuuccuucguggaaugucuucauuuuugguacgugugugucauccauuauauagacuugcugaagagcauuagagacaaaugagcagaguaagacagaacugugagaguagguaccagcuguggggcaaggaggaggagaagaaauuaauauuuguuaaauuucugucuucugugggagcagagguguugccaaaguucauucaugaagaaaccuuuuuucagaccaaccacagccacagagaacagauggguaaauaggagcccuugcucuaaagagaacugggagcucacaggcagagcggaguugauaacauucuggucaggagguguugggcuuagggacugagcugggacacagacaggaagcugccuacugccccauagcuuuuacccuugguggcuuggccaaagucucagucuuuacacauggcuuuccuguuucuagguccuuuucagaauucagcgggucucuggaagugauggcuuuggguuuuguuucuguauuccaucauugggauccuuauagcucuggucuccuggaaauaccucuuaacuaaagcaagauggcuccauuuggguaucuuuuuccagcaugcuguuagguggcaguggggcacacaccuaaagucgaggcggaccagccaaggacacacagagaaacucugucuuaggggaaaaaaaagacucaguguuccugagauugacauuaucuggcuuucuucccccuucucucaaaaccacaaccaaccaaguacagcaguuccccugucucucugcucuguaagugguaucauucauucacucauuaauccauucauuuagcaaccagaguggagcuccuagcccucuggggcagaggggccaccaugaaaagcaggcaggucccugcccugauauacuuagauucuaguaggguguggaggucggguguguaagugcaaguacauguguguaguggaugucagauacguguaguagauguccacucuacuucuacagguuucugacucuagugagauucugauuuuaacuucugaaauuaguggagaccccacaaaucauggacuugagccucacagccugcuuccccuuagcauuacaguuacacucagcuacaaauucaaggcucuggggugugauuugcuagaagagaaacuuagcaaaguacuuuuaucugugauuaccaguucaucacaaaggcuaaugguuggagcagcucaauggaagcccugccuaaggcaagguagagaacagcuguagaggaaauaucuugugucuguguggauauggccuaucacuuuggcagguaauaguagguggagcauccuguaggcuaaaggauucugggauaguuccaggcaugggagauucacccaggaagaugucaggagacagaggcaugguaucugagcacagguaaccagccaugugacaaaauguagauuggaguuauuugaaguuaugaucuaguaagagaagagccuaaguauauggccaagguauuuguaaauauauuuugagucugagucuuauuccugggagccuggggcuggggggcagaaccagacagcuauuucuguucuggcacuggguaggcauaucagggucuucaccauccuagaaaagucuuucuuuuuucuuucuuuuuuuccuuuuuucuuuuuuuuuuuuuuuuuugguuuuucgagacaggguuucucuguguagcccuggcuguccuggaacucacucuguagaccaggauggccuugaacucagaaaucugccugccucugccucccaagugcugggauuaaaggugugccccaccauugcccggcugagaaguguuucuuuauauaggugaaucaguggcuauagaugauucagcucaguuucuggccccucuuuuuuccccaaagguuggaggugaaacugaguguugccugaaucuuucaagugagcaggucuuaucugaagucagcuagguuccccaccuacagcacauuauuccuuaugcauaugggaagacaauacaucccucaggaguguccagaggauuuaggcccucagugccaaggauguauguuuauuaugcuuggauacagcugaguucauggaauugaggguacugugagcacuccaccagaauaagggguugaaggaaucagaggaggacuugugaguggaaguuggggaaggcuucugaggaacugguaccuccacagagaucuaacucuucagcacaguuagccuuauucaggguuucuccuuuuuauuuuuaucuuuggggggggggggguucauucuccuuuucuuguugguaaaguaguaauuucuugaagaucagaaaacuagaaaucgcuaguggugauggcucauaucuuuaaucccagcacuuggaaggcagagucagguagauuucugaguuugaagccagcuuggucuauagagcgaaaucugggacagccaaugcuacacagagaaacccuaucuggaaagaaaaaagaaaucuagaaaucacuacaaaacauacaaacuuacaaacucaaaacuaguauguguaugcccaugugcguaugcuuguguacacacaaacguaccaugguguacaagugagaaucugagaacaacuuugggaaguugguucuuaccuuucacuaugugaauucuggggguugaacucagguugucagauugggcaacaagcgccuuuacaugaugagccaauuugccaacucaaaaauguacagacuuuuauucaguuuccugcauuuuuauggacucuggauuuguuuagcauuuuacccagccacucucaacuuuggagagucauuaugugaguuugggucacagggauaaaaugguccaucugugaaauguggaaagcuuggcacaugcugacuuugcauggauaccuaaaauaggccagucaucucaguguuucuagacucugugcucauucugaacucuggccucaccacaucucuccuuauacuuccugguccuccuuuagccucgcuuccacuuucuuggauuugugucuucuauuuuuuuuuuuaugugccugcucugcacacuuuuugcugauacccaaggaggacaccacugucuugguuucauugggucaguucccuuccuccuaaaccacagcucuguccuuuauuuauuuuuucucuuuuaaaauacauuguucuuauuuuuuuaaagauuuauuuauuuauuauauguaagaacacuguagcuguccucagauacuccaucagauuucguuacagaugguugugagccaccaugugguugcugggauuugaacucgggaccuucagaagagcagucggcguucuuaaccacugagucaucucgccagccccagcucuguccuuuauaaaggaucaaaaaaucaaaagauccuuuauagcgcuggcugcuggguagaguuccauuggcuuagaccugaaaggaggacugcuuaucugagagccaguagcaauugaagcaggguucuccuuuuuugauuccauuuuccccuucuccuacaucuuuugguccucauuagcuuccaccauccucaccauuggaaguucccacagaaacaacccagaacaacccagaagaagagaccacagaaacagaaguugaaaggucagacucuaucacugaaaaggagccagaaggagacuguucucaggauagaaacucagagaugcaacagauccucgcacgaguucgccagaacuuuggcaaaaucaacguggggccucaguuuucugcggaugaccuggugccuguggagaugucagacuuggaagaucuggaaagcucuggggaagaggaagaacaggagcaggaacagccaggggaggaugccgaggaagagcgcuccccagacacucaggaggaaccagugggaaacgacaccaaggccgugcucagagcccuggaugagaagauugccaaguaccagagguuucuaaauaaagcuaaagcuaaaaaguucucugccgucagguaauauuuucuccuucuuacuaauuagcuuaccuguucuguucucacuugccaugagcacuggcuuuggcauuaggguuugguuuauuuuuuaaagauuuuauuuauuuuauauauaugaugaguauacugucacuaucuucagacacaccagaagagggcaucagaucccauuacagaugguugugagccaccaugugguugcuaggaauugaacucagaaccucuggaagagcagucagugcucuuacccgcugagccaucucuccagccuggucuuaggacagaagccagggccugugcaagggcucaggcaagugcuccaccaccucgcuccagucccagucugaacagggaguugggaacggcugcuuuaaggaaaaucuguacauuguucaccuuuaggcaccugaaguacauggagcuugguuaccuaguguucuggccuaggagcuguacaaacugcugggcauuggcuguaucacccagcaccaaugugguggaauuuccuuuucuuuccgagugucccaccucuccagauuggccuuuucagagcaguuaaaaaggaacagcugugugacuuugcuuuuauuuuucagaauauccaaggacuuaagugaaaagguuuuugcaaaauacaaagaagagaagaaaacaucugcagaagacagugaugcaggugagaucaauucuuugaaccauuuagaugugauuuguagcuuugggauaauuuccuccauacaggcagguauuuagcaucugguuccacauucugcuuaccaugcaaauugagcucuccacuugagaguccuuacauuuuuaaagauacaguugaugguuuaggaguacugcuugacaaaggugcacauuaauagcuucagagucagacagaagagccugcagaauugagacagaggucugucuugguuacuuuucuauugcuguuauguguaguaccugaccaaacaagcagcaguggacuggggauuuuuagccucaagagcccagcucuaugacacaucuccuuuccaagcaguuccaucaacugaagaccacguguucaaacauuaugagcuuaugguggcuguuuucauuuaaaucaccacagauacuucauaaaguuacugauaguuucugcaugaugcaaguugaaccccacuaugaccaugacugcuuguaaccccgcaucugucugccuccuuacacagggcuuguuccuacaguaguccagauuuugaaaugcuguuucuauuguuaaucuucucuguguuuuauguaucauaaagcacccaccaaaaaggcaaggaagugggaugcacagauggaagaagaaccuucaaauaagacucagaggaugcugacguguaaggaaguaaguauuuuuaaugagauaugggcacaaaagguaguguacuggugcaugcccaccaugcucuuaguucuagucagggaggcagaggcaggcggagucugugaacuugaggcugccugguuuacacagugaacgaguccuggacagccagggcugcauagugagacccuguauuuggugugggacgggguugggggggaucaaaagagcaguagaaguccauuuugagauuuguuuguuuguuuucauuaguuuuguguguguguguguguguguguucaggcauuucaugacauggugagcaccuggagcucaaaggacagcuuguuggugggucccgggaauggaguuucugagccacuuuugacuauuuagucuuuguuuuugaggcagggucuugguaugcaggcccugguuaucgucagacucgggcagucuccuaucucuuaucaccucgaguggugggauugcagguguaagcuaucguacccagccacaguugcaguucccaggaccuguucuuucugaaaccagaauuuggagcuggcaauccuaggaaccucacguguuagggaucugauggaagucaauuaacucgggucgggaaguggccacagaaugaagguccuugagucuaagucuuaggucucaggcgucuuagguuaucaccuucacacuguguccuguuggccugaagaacuggaagaguuucuguggcuucaggagcugaaguagagcagagcuggaagggacagcuuuggaaaggagcugaacugggcugaagcagccccacuggggagagggaugagggccaggccagugagggucugcugcuggucuucaggucugaggugcacacucccccagcucugcuuccauggcugugggagccgcacaggcagggcgggggugaccgucagugugugacugguuuccuuuguguuguguguuugcagcggaggagagcagcacggcagcaacaauccaaaaaaguuggugugcguuacuacgagacacacaaugugaaaaacaggaacaggaacaaaaagaagacgagcgacucagagggacagaaacacagacgcaacaaguucagacagaagcaguaacugcgagaaagcuguuuauuaaauuauacaaaaauaugccauuaggaacuguguucgcuuucuugugcccaguuggcaucucuaaggcacagcacacuugggaagcuuaguggugagggcgcaccccaguucuguggcaacaggaaguccccagccccagaguuuuuuaaacaccugaccuggcccuuaguuccuccagcaugucuugugugugucuacagacaugcauguuccucuuacacuacugaguagcacggggcuaggagucuacagagcuauaaauaaagcacacgugcuucagagacaucaggcaagguuuggaggcaggagugcugcuaggcaccgaugcuuuccugcaccgcccacagagccuguggcacgacgggaacauggcuucaccgacagguugugcuaauggaggccuaguuccucaggauacugggugaggguccaagauaugacuuguagaauaagaucggaguauugggauacagucaacucagaacagccguugggguucauaggccuugcaguaagcuuagacugggauggaggucagagcugcaguuuucaggaucuacaaauuugccuucaguccauaauucaucuagaacuacaugugagauguggguaccuccuuagcuauuccuuuauagcuaucuagggaguguggagucaggcuuugcuauccagcagaagguauucaaaugguguggggaggaccugggugcagacagcucucaagacacugggacuuuuguaccucucagugagcauggcuuugacucugcugcuguuuuccuccuggagcuggggacacuaaggacaggguccugcugacucagcgggugggaaugagacgcuauaguccaaaaccaaacuccgaaacgaggugcagaagcuuacauuagagaggugauguggaagggugaggcuagagaagcccaagguacaaggugagcuggaaacugaacuugaugcaaagguggucucuuugaggaaacacuugcucccuaaguuagugagaugacaaagccccaggccaauuuaagcugcacauggacaccggguucucccaccuuccauugccuagccaggaaccuggcuuagguguuucaugacucugggacaacaguuguaac

SEQ ID NO: 2111 - RNA, 11479 nt, Mus musculus
ugcagcggaggagagcagcacggcagcaacaauccaaaaaaguuggugugcguuacuacgagacacacaaugugaaaaacaggaacaggaacaaaaagaagacgagcgacucagagggacagaaacacagacgcaacaaguucagacagaagcaguaacugcgagaaagcuguuuauuaaauuauacaaaaauaugccauuaggaacuguguucgcuuucuugugcccaguuggcaucucuaaggcacagcacacuugggaagcuuaguggugagggcgcaccccaguucuguggcaacaggaaguccccagccccagaguuuuuuaaacaccugaccuggcccuuaguuccuccagcaugucuugugugugucuacagacaugcauguuccucuuacacuacugaguagcacggggcuaggagucuacagagcuauaaauaaagcacacgugcuucagagacaucaggcaagguuuggaggcaggagugcugcuaggcaccgaugcuuuccugcaccgcccacagagccuguggcacgacgggaacauggcuucaccgacagguugugcuaauggaggccuaguuccucaggauacugggugaggguccaagauaugacuuguagaauaagaucggaguauugggauacagucaacucagaacagccguugggguucauaggccuugcaguaagcuuagacugggauggaggucagagcugcaguuuucaggaucuacaaauuugccuucaguccauaauucaucuagaacuacaugugagauguggguaccuccuuagcuauuccuuuauagcuaucuagggaguguggagucaggcuuugcuauccagcagaagguauucaaaugguguggggaggaccugggugcagacagcucucaagacacugggacuuuuguaccucucagugagcauggcuuugacucugcugcuguuuuccuccuggagcuggggacacuaaggacaggguccugcugacucagcgggugggaaugagacgcuauaguccaaaaccaaacuccgaaacgaggugcagaagcuuacauuagagaggugauguggaagggugaggcuagagaagcccaagguacaaggugagcuggaaacugaacuugaugcaaagguggucucuuugaggaaacacuugcucccuaaguuagugagaugacaaagccccaggccaauuuaagcugcacauggacaccggguucucccaccuuccauugccuagccaggaaccuggcuuagguguuucaugacucugggacaacaguuguaacaaugacaugaguggugaccagggaagggguggcuuguucacucuggaaacuggcuuuuauuacaaugggcuuauggggcaaggggccugcugagacccauguggaaaugaucacuucuucggugcgauaaugccuuccaguugggccugaaacacaagaacaaaacuccauuaacauuugcaucuugcaccuuaacauguagcuaagccuaggaggccuagcccacaggcuucgagcauccccucuucugacccagcuccacauuuucuacauuagcuggauucaggcuuggcaugauuuuguuacaugauccgaaaccagagcugaccugguuuccauacaauaauaacucaguguauuauagcccagaaagggaaauggaauagaaguuguugaaauagugguuuuccauagcuccuacuuuaagccugaguauguccacuaaguuaaacauuuggcucucuggguuaguacauggagcucugcuggaaccagaagucuuagaaaacagcaaauuaucagccacugugacaacuugacagucaauuagaggaaauugcuaccagucaguagagaaagcuaggagacugggggguuauuuacucucuuccucuagcugccagcacggugauuuacauggugauacacacacccuuaaggucuauccugcgcggacagacccuuaaggucuauccuggcgacugaaaacacuguuuucuuuguagugcagcuuugagccaauaaaagaacuugcuuguaaagaacccuuugcccuggggauuccagggcugccuuuggauguuagaaggaugcuaaaguauucagcuuuacucuuguuggaacuaagaaaccagcuuuggaaucugcugagugagucaacgguuuccauugccuggggaagucucuagcuuugcuucugauagacucuucagcaacuaucgaaaucucuccacugcuaauggcucaugcaaagccuuccuuaucucgagcucaggaacuuuggcuuuaagugaggaagggaagagggagguaccauauuuagaaagugaagcucaacccucaacaagccuuguuaagcugcacuauagggcacaagcccuguagcuucugcucagcauaucugggguggccaauacuuguuuauaagcauuguccuguagcuuuuaauccuaucaguugggaggcagaggcagauggaucuuuugaguucagggucagccuggucuacaguuccaggacagccagggcuacacagagaaacccugucucaaaggggcggggggcggggggggggggguggaguugcccugugauaagcagugguacuuguccagggcucagccucugcagccuguaaucccuucucuuucccaucugguccucucccaggaccucaguugggcugaggaaaaccaccuauagcuggguuccucugucauucaccuagggagcuucccccacacaccuccucucaaaagccuucucugcugccacagugcaucaagaugccgggguuggggggaggggugguggguaacauuccuguuggagccugccgagaggacucccaugaccagcuugaggggacagacacuauugcauccucucugguuaugauaucuuuuuccccggaggaaaauagagauuggcaggcacgagacggcaucacaguggagaggcaggcugagguacuuuuuauuguugagaauaggccuccuucacaacuaaaggcauaaagaauguagaaaaggagccacacccuacccuggucagccucccuuacuccuuggcaguacaagugggccaacauuuaaaagccacgggcacagacuuguaaucaccacuacuggaauggcagaagcagaauuucaaguucaaggccucccugaguuagagugaauucaaggaaagccagggacacuuggguccuguuuccaacugaaaacuaaaaggagggcuggugggggguggggggagagacuuuugggauagcauuggaaauguaauugaagaaaauacguaauaaaaaaaaaagaaaaaaaggaggguuggaaagauggcucagcagguaagaguacccauggcucuugcagaagaucuggguuuguuuccuagcacccacgagguagcuuacaaccauccagcaguuccaggggauacaacaagcauagcguaugagcagcaggcaaaacauuugcauagauuaaaaaaaaaaaagccuaaaaacucuuuaaaagaaaagugaagggggguggggguggggggggggaagauggcgcuuggcuguaaucccagaggcuaagaaguaagaauguaagcuacaugagacccuaucuccaaaaaucuaaacaagaaaaggcaaaaggagggcuggagauggaguuuaggaggaucauaucugccuaauguucucuacgacauugaaucuccacuacuucaagcaagucaccggugggaaacacucuaggucuggccccguaggcggagccuggcccugggccccuuuuaccuucaguugcugguugguccguuucaggaacuggaucuccucguugugcuucuucuccuccaccugucgccucucacucucccgcuucucgguggccucgcauuucgccuucuguucauucacuugccucuccaagucccucuuuucugucuccaauucuguaaucugaagauagaauggccaucauccugggacauccccaaguggaugagcauugucagaggcugggcgagguaacuugggacaggacaguccgaccuaaggcaaugccagggugugcacugccacccagugggaagucagugacugacauggaguguccuuagacaagaccacuccucacuggggccuugcaguauuaguguggaggacacccucagggccagaauucaggguuacaaggacaacugcaggccuugagauuuacagaagcaucugggagccauggaaacaccgucaucccacucacuuuccucuccaugucugacuuccccuguucggccugcagugccuuccucaugccaaaugccacgcugcucucauacagagucugguaggcagcgauggucauguggaucucgucccggacacgcagcaacagcagcccucucucugcgcaguugauggugaccucccggaucaguucgucuuccaacaugcacacagggagauaaaagucauuggugagagggcaugcacuuugucuguagcaagucaccuuugcuugggaaggacuugggauauguucucagaggcgugggucuguggcaaugacagcuggugaagguaggacacccuacacccauguaaaaaggcaggugcaguggcacgcggauguaaccauagcccuggggagguggagacaaaguucccuagagcuugcucaucagcuagucuugcuaaaucagugagcuccagguucagugaaagacccugucucaaaaaauaagguagaggggcuggagagaugacucagcaguuaagauuagugacugcuuuuccagaaaauccaugguuggcagcuaacaaccgucugugacuucaguuccucaguauucaauacgcauuugggucuccucaaaacugcacagaugucauacauagguuaaaaaaaacauccacacguauaagguuuuuuuguuuuuguuuuuguuuuuuuucugugugugucucaaaagaagaaauagagaaugauagagaaagaggccugacauugacuucuggucuccacacuugugcacacauguucaagcauacagcacacacaaaaaccaaauauaugcuuuacaggaaggcacuaugagacggugcuuucugugacccagagaacaggccacacaaccacuccucuuagaaaaagcacgucagcgagcuuggcauggagagggagacaagaaccucagguuuguuugugauaaauugguccccuugcuuccauguucaggcacaaaguagauagaggacgaacugguauucucgaauggugguguugaauaguacugcuguuaaguccgggagugguggcgcacaccuuuaaucccagcacucuggaggcagaggcagacagaucucugaguucuaggccagccuggucuacagagugaguuccaggacagccagggcuacacagagaaacccugucugggagguugggggugggggcugcuguuggcuuguuugggacuaagaacagcagggucaagaacuugcuucucccccuuuauaagucuucaaauuggagggcaaaccacacucauacugagcaggcuaaagccaccuugcuggagcugaagcugccugagagauugggagaguuugcaguugggagcccauagcauuagggcagacaucgguaggcagugggaacaucuucaauucucauacagacaucgguacgcagugggaacaucuucaauucucaugccguccaacuacaaacagcagcagcauuuuucuggaguguggacugaguauuauuggauagacauagaggucauuauuaauuuucugauuaaaauauuagcucauuggacuggagagcuagcuccauguuuaagagcacuggcuaguuuuccagaggaccagaguuugguuccuagcauccaugucuaugguaguucacaauugccuguaacuccagcucuaggguauccaaugcccucuucuguccuccacaggcaucugcauacacagagcaugugugcauacacacacacacacacacacacacacacacuaagaauaaaauaaauggccaggcaguggugaugcauaccuuuaaucccagcacucgggaggcagaggcaggcagauuucugaguucgaagcuagccuggucuacagagugaguuccaggacagccagggcuacacagagaaacccugucucaaaaaaaauggugugaaaauauauuuuauuuuugagguuuauaaaaauuauaucauuuuccuuccuccaacgucucccauguacaccuccccccaguguuucaaauccauagacucuguuguuguuguuguuguuguuguguguguguuuaguaaagauuuugguuucuuuaaaaaaaaacacagacauuuuauaagaagauguuuucgaucuaauuccaggugugggguaugaggcugcuucaaguuguucaccagcugacuaugauuugccucaugcucuagcagaggcguggguuugucagcugcagguaguuucuguaaccgugugauauuuggaauucugggaacuuuucauacauacuagggccccaagauucgggggugaagguggguuguugguuguuugcuguugguuguuauuaaguaguugugcacaaaaaaagaaacaaaugggcuggugagauggcucagcggguaagagcacugacugcucuuccgaagguccugaguucaaaucccagcaaccacaugguggcucacaaacauccguaaugagaucugaugcccucuucuggugcguuugaagacagcuacaguguacuuacauauaauaaauaaauaaaccuuaaaaaaaaaagaaacaaugagaagaggaaacuagauauccugugagaagauccagcuggcucuaagcaacuccaugccccuacucagcaagaaguacucuaaugauaaugucacccccuuuccuuucuauccuucuuccucuccuaucuaguguuaggggguugaaagaguggaaaaguggggagaagggaggaagaaaaagaacccacaaaguagcaaagaacuggcuacauguguuaguuccucugugugugugugugugugucuguaucuguguguguguguaugaauuuauauauuucuugcucaguccauauuauguuaguuguguguauaaguuuccagggauguucauuugauuaugaaaaauaaguuaaaaaaaauaaugccaagccuggagagauggcucagcgauuaagagcuggcugcucuucuggaggucuugaguucaauucccagcaaccacaugguggcucagaaccaucuguaauguuaucugaugcccucuucugguaugucugaagacagcuacagcaaauucauauacauuaaauaaauaaauaaauaaauaaauaaauaaauaaaugauuuuuuaaaaauguaauaccaggaguaaugacacacaccuuuuuuuuuuuuuuugguuuuuuuuuuuuuuugguuuuuugagauaggguuucucuguguagcccuggcuguccuggaacuaacucuguagaccaggcuggccucgaacucagaaauugugaauagagucgggugcucuaaguguugggauuaaaggcaugugccaccaugccuggcuuaugacacacaccuuuaacccuaguacucaggaggcagaggcaggcagaucucugugaggccaggccagccaggacuagauauugagaccuauauuagcauagacuuauuauggaaaucuuuggauaaaaaaaaaaacaaaacaaagacucaaaguuaaaagucuuuuuuuagagguagccuuggcuagccuggaaaucacuaugcaaaucagacugaccucgagccagaaagaucuaccugucccugccucuaccucccaagggccuguauuuuuuuuuugaaagauuuauuuauuuauuauauguaaguacacuguagcugucuucagacaugccagaagagggcgucagaucucauuacagaugguugugagccaccaugugguugcugggauuugaacucuggaccuucggaagagcagucgggugcucuuacccacugagccaucucaccagccuguauuaaaggcauauaccaccauauccagcuaaaauggaguucuuaccuuacuccaaaaaccuaucaaagggagggagcagugagauggcucaguggguaaaagccaccaagccugaugaccugagccacucccuagcauccaucuggcagaaggaaaaaaucgacucuuguaaguugugaugauuuccgaaggggggugguuggcuugggguaaccagagcuugguuuugugcuagaaggaggcagagaguguguggugcucacaccaccaaggcuacucaccaaaacacugggaguagaguucccugcgcacagggcagaugccugucucccuggccugccucugcugcagcuucagguccagcugcuccuggagaugcaccacauccauucuggugcugggugugcuggacaccugcuggauccauagcugugugucuuccacccacucccugugacacagauacaagucaccgaaucugagcagagggcccuuggaacucugccugagcaggagcagggggugggcauaggcagcauugccaucaugccacccccacuuccuacucuuucccaagccacgcccacucugccgccuccucaggacaccuaccuuaacauuggguagauggacagucucuguucuccacaagacuacaacccucuguuccaggucauaccugccuagcguguugaggacagauguguggucauguugcuugauucgaauagaagaugcaaugggaauuccccacacuggcuuaugguggcgacacagaacaccauaaaccucaugcaagccacgaggaagcauuuguguguguugggaguguggagguucugaaagugcuguguuugcaauggcugcccauagugaauucugugcuggaggaauacccgaauucugcagugacagacuugugggcagaacggcaagagagggagaaacuucuaaguuggugggagaggauccacuaguaaaugacaccucucucucuuggccuccaucucuggagaaguucacagguucucagugguucucauuggugugggcaugcauaagacuauuagguggaggguuuuugagaguucuagcuaggcuguguagcccaggcuagcuucaaacucugauccuccugccucugccuccugagcucacugggccuugccuuguuagacauuuaugggcuuuugcgacacaacuuugcauguggcgcuagccggccuaguacucccuuuguaguccaggcuggucuugacuuugaggcaauucuccuauguccugcagagugcugggauuaagcacaugccggcacaccaggcucucuaugaggacucuugauggagggaccaaagaauggaguuuagaaggaagaggacuggucuagaagaccuauauguuaaagcagacaucuaaagucagaagagugcucagaacguggagggcauggauuuagaggguaccugcuuggcugcaaacauacaaccauacugagaccccaugaacuccagaaagcugagaggaaacccaagguagggcacaggaagacaccuauguucuggaccaagagcuuagaccuuccccuagucacugugggcuccccaccaccaucucucucucuaccuuggaggcaggauggcauuuaagauuucuucugccuguuugguaggaucugggacacaggaaguugagggcagcuuggccuuggguggcugugggcuuguacuagaggguccaggcugcuggauggugacuuucaguggccgagccuaagaagagacagguugaucagucuaguaccuccagauuuuccuaggucucuuguacagccguccccauuuccagccuauuucccucaucugugaucuuaaaggaaauaugagcuggagauaucccacgagggauaucuggcucugacccuguguuugaacugguguuucuagaaugaguggucaggccucuguucugacucucuagacgaagguaagucacuaccagaccucuucuuggacuugacuaccacaaaccccaucuuuuccaugugacuuuucucaucuuaaauuuguccucuaaggucauagcuaggcuucuuguucucuucucccaaccuccaucccugucccaauucccuuggcugucagccccagcaaucuguccccugaaauuccagagauccucaaagcugggaugucuuuuccccaugggaguuuguaggaucucgcguccccugagacgccuguucauaccguggggcuccguuucucuguauuccggcucaccaacaccggggugucauauuugagcagagagucugcuggggguaucaugguggcaguagggguaacaacuccguagcggccccuguggagucuuguuugcgaucaccauggaaaccccuccucuccuugccccauggauggggcggggccucugaggaaggcggugccggccgcgugcaaguuuuguucuacugugcuuucuccgcaagcacuaaguuucuuaguaaagaagacuggaccccuagcguuaggucuguuucgguuuaugaugaaauggacagaccaccuuugauuaaaacggaagucaucuagugacucuauagaguauuuggcgacgauuggcauuuggaagccagaggcuggcagaucuuuguggauuccaggacagccaaggcuauauagagacacuauuucaagaaacaaaaaagaguuucacauuguugagugucuguguuucguaacuacuaauaacgcgcaaggaacagagcuggguuagcuuucccacagguuuuuuucuuuuuucaaaaaaaaaaaaaaaaaaaaaaaaaaaaagcugggcgaugguaccacacaccuuaaugacagcauuugggagucagagggaggcagaguucaaggucagccugguuauagagugacuucuagaacagccaggguacacugaaaaccugacuaugacggggggggggggagauugucauauauauuuuuuugagguucuggggacuaauccagggcuucguacucgcgaggcaaacgcucgcucgguaacuaagcuacaaucucagccuucccuccccuuuuaacucuugauuucuauuuggcggugcugaggaugaauucagagcuuugcgaucuauccgagcuacaacuuuuucagauuuugagacaguuucacuaaauugcccagguuggccucgaaauuacugcgauccuccugcuucagccucccgggggguuggcccugccuuuucaguacuccagccacaccucccagcagcggggaccccguggccacucgcgccggcguccccagcgucugagacucaaacaccuggggccccgcccaucaggggggccgacaccgugaaggcuucugggauagcg

SEQ ID NO: 2112 - RNA, 7460 nt, Mus musculus
cggaagugcaaagcuguccgucacuuccuacggcucaaguggcucaacggaccgugcaagugacucucggucgggccgcaggaugaaggcggggaaaagcgagcgggagcggagcggccggcggcgacaccggucaggcgacgcucugacgaccgugguggugaaacaggagcgucugagccccgaacccgucgcgcaccgccggcccgacgcuccagccgcuagccuguccccgcccgccgccgagccuggccacucgggucaccgcgggagccgagcccgguaagcgagccggugauugggcggaggacgggauggcgcgggggccgguggugcgagcggcucuggagugcagagcaccuguugaguugaaaugagauuucccccgccugcccgcgaguggauggugcgaguggcuucuccccucgucugccuacaaagacacguugggucuuggcgacuucuucgcagcacucauucgccaaugccuccauguggcaucgauuuauugagugcguaguguggguuaaagaucaauuggagguacugggucacaaggcaaagaagagagaugcuuuuuccuuggcgaaguugggcaggcucuaacucgaagaaggaaaacaacaaauagauaauuucagucaguauuaaagacagaucaaaacggcagugugguagcgagaggcuggguagaaaaaagagagggcuuguacagaggugcuccuuaacggagaccuggcugguaggauugauccauucucuugagucaagagucuuuuagcaaagacuccaggaaggaccaacccacuguggucgggcaugcuuguaacccagcagaggggaugcugagacaggagguuucugaguguauacacacaaacacggcgcgugcacgauuaugacagaaaaauauauacauagaaccugagcuggaauucuguuuguuuuagaaguugaacaacagcagcaacaaaaacaaaaacaaaacagccagcauaucuggaauugagagauggagcagcauuguaggcugguaggaaggaugugggauggaggacagggcagggcccugagaccugccaagggauugguuuugguuguuggagaagggaguuguguuagggaaaaaaccaggcuagauuggcuuccuggauaguagugccagauaguaggauggcgcauccggagaagaaagguuucugaggcguugggguuggagaauaagguugucuaggugagaaggcuuagcaggccauuguguaugugguugggagaaguguuuaugggaagugaaggccugcuguggcuacugaucucacagauguguuguguuuaguaggugagccugauccuggaagcuaacuuacuuucgggaaggaacuuugagguaaaaaauccuguguaccauucucuguaaagguccccagccaagaagaaaagcaaguccucugggagaagaagcaagucaccacggaccaagagaagccagaguccccacuaccccauggucaaagugaagcaggugagugagugagugagugagugggcagggaccauggguggaaagcuccagcccagagcuguugcugaaccccaagagguuggcagccagguguggacaugcuuccuugucacugcagugggcuuuucuaaaaaugggauauguauuuggggcuguuuuuccugaaauuuuaacguuuggagacaauuguugauuugauucugauaacucuugucagaaauaauacggagagauguacauauccauguuucucucaauggcaacuucucgcacagcuggacagugucguggucaggacacagacguuucaccaccaucaaggugccucaugaugucugauacuucuccgccuuuauccuuccuuaccuccuggcuggccgcuucucucuuucuauuguucuggaugcacacuuaagcccagggucuuuagguuagaagauuguccuuggugcuguugaaaccagcacagaugggucacguugggucugugagugcccaugugcuguaggaccaguuuuucuuuuucuuucuuuuuuuuuuuuuuuuuuuugagacaggguuucucuguguagcccuggcuguccuggaacuuacuuuguagaccaggcuggucucgaacucagaaauccgccugccucugcucccgagugcugggauuaaaggcgugugccaccacgcccggcuaggaccaguuuuucaaaggacauugguugucuccauugaauuauuuuacucccacauugaaacucagucagguauaugucuauccaugcagacucgauuacugcacuugcauaguaagucucaaacugaauguccucuuugcugcauaugagcugccaugugggugcuaggaauugaacccagguccucuggaaaaaguagccaaugcucuugucuguugcgccaucucuccacaccacccuccucuuuuucuuuuuuuccuuuuagcuguucugguucuuucgucuccaucucuauguaaauguucgagagugugugugugugugauaaaaaucuuuuaaaaauaguauuuuuuugcauguguaugagugcuuuccccgccccugcauguauguguaugcacuguguaugucuggugcccacaggguccagaaaagaguaccagagucuccagaacuugaguuaaggcuggcugcaagccaccucauggguucuagcaacugacccagcuccucuggaagaacagaaagugcucuaacuguagaguuaccuucuagauuccuuaguaacaucucgaaagaggcagguguuguggugcgugcauguaauucuaugcugaggcaggaggaucacaaguucaauacugguuuuaaacaauuacugagaaacugucucaaaaguagaaagagcuagggauaaauuuagaaguugaguguuuccagcccugaauccuagucccauuaccauuacauauguaugcauauuaaugcaauauuagccuuacaaggaagaaaauucugacacaugcuacaaaaugucugaacccugaugacuugcuuaauaaacugggaaaaauuugcaugauuucauauuuuuguaguugagacaggguaucuaucuccugcuaauuaggcccugguuggccugaaacuugcuuggcagcacaggcaggccuagaacgcuuaaugauucuccugccucggccuucugaguacugauauuaaagguauaccaucaacugaacuucaccagcaguguguguguugugugucugucugucugacugucuguccgccccuuuggagacagguucuuguucucauucucucucuaaccccuagagauccaccuaccucugacuacugaggcugggauuagaggugugcaguccuuccucuccugacaggaauugcuaaucugagaagauuccuauuuccuuuagcauuggugcucugguuauuagaacaaaugucuucaggguugguuaaguguagguuucuucuggaaacugcugccgucaugcuuugcccuuggagcuauugcaguacaaguggucucucauuggucuguuguucuuuccacacagguuucucuguguagccucagcugcucuggaacucuuuguacaccaggcuagccucaaacuuaagaguucugccucugccuccugagugcugggauuaacaaacggugugugucacugugccgagagcucacuggucuauugacucuguguauugcuguuuucugccagguugauuuucaguauguguguccauuuugucaggaguuuggaaacugcuaaguaguaccuucuuguagguuucuugaggcguucacauuucuuagguuuauccauagauguuugaaucaucucuauaauugcugaacugaagcuuuugaaauuauuucaauuccuuuuggccuaugaggaaguuagccuuucccuuuacauaucuuaaaugcgacugcuuuguuuucuacaccugcugcccugugagugccugcaggugacugagguuugucgccuuguuuugagggaucuggaugugggcuugaggaagagugugguguauggagucuaacuggcccuucgggggaagaaccacacugauagccuuguguggauaggaauuuguucugaauaccagaauccaggucacagauguguuguuguuguuugagacuguuuugccuauguggguguuuugccugcaugccugucuguacaccacauagauguagugcccacauuugccauaagaaggcauuggauccuuuuggaacuguaguuguagauggcugugaacagcuuugugggugcugagaacuaaacaugggucauccggaacagcagucagugcuuuuaauugcugagccauccagcuccugcagcuuguucacagaguggaugccaucuuuccuuuacugaaucccaucugacuuucaggaacgugaggaccauccucggagaggacgagaggaucggcagcaccgggaaccaucagaacaggagcacaggagagcucggaacagugagcgagaccggcaccggggccauucccgccaagggaggagcucugaugagaggcccgucaguggacaggaucgggauagagacagccagaaccugcaggcccaggaagaagagagggacuuucauaaugccaggcgccgggagcaccgccagcagaaugaaagugcuggcagugaggcucaggaggugaucccucguccugcugggaacagaagcaaagaggugcccguuaaagagaaaccaagcuuugaacuuucuggggcacuucuugaggacaccaauaccuuccggggugugguuauuaaauacagugagcccccagaagcccggauccccaaaaaacgguggcgccucuaccccuuuaaaaaugaugagguacuuccagucauguacauccaucggcagagugcauaccuucuggguagacaucgacgcaucgcagacauucccaucgaccaucccucuugcucaaagcaacaugcagucuuccaguaccgguagguagaccagagggagaacuggcaagggagaugggugaaugucucacuuaguauuccuaaggcuggcuggcuguguggaaaugcuacugagcccauuaccccuuguagcuaaugagccggacugaaggaguacuguacgucuuaacaaccugugaucuuugaacauuuguaugaggggcuugaacuuggugucagaaauccagauauuaguucuuccacugcaugguggugcaggccuguaauccgggcucucgggaggcuaagcaggauugguaguauauccucuaaguguagguuauauaccaugaccccaccucuaaauaaauaaauaaauagaugaaaggaagaaaaagaaaagauuccugccauggucuugaccuguuuccaccugccccuagggcuuuaugaggaccaaauagaaauaaaagccagagucagaaugccagauauaccuaugcuagcugaaccugcugcuugggaauacaucuuuaccguuugguacuuccccugugaggaaagcagggccaaugguaccauccuuuaacaggugagaaaccacggcucacacaggcccuguuugcaguaagccaucuucagagcacaacuguccacaucuaguccuuggcucucaagucuuaauucuguuuuuuccucauucgggcuggugcuaaaauacauaaaauacaacauuggagaaagucuauguguaaccauagcaagaagccuucugcacuggggccuuauggcccuccauucccggccacagccucagccuaccuuucuccuagguuauguaaagugcucugaauuuccccaucagggcaguacuuccccgugacauuccagaauuuucauuugaauccuguucaagccaagucauugccauuuagaucuguagcauagagcuuuagaaaagaaggcagguggucucagguaggaugcucacaugcuucucuccuuggucucuccuaggcuuguggaguacacccgugcugacggcacgguuggucggagggugaagcccuacauuaucgaccuuggcucaggcaauggaacauucuugaacaacaagcguauugagccacagagauauuaugaacugaaagaaaaagacguacuuaaauuuggguucaguagcagagaauaugucuugcuucaugagucuucagacaccucugaacuugacaggaaggaagaugaagaugaugaggaggaagaaaugguaucugacagcuagcagcugagaggcagccucuacuguuagaaaccgucccuaccggaggcugugguggucacuccagcgccucuucuugccuuaagucuuuucucuguugcugcccagccuauguugcaguaugagaacugucacuucauguuuucuugaaguuggcacagcagcugccugcuugugggcccuuguuuucugaacagucucaccaauuacagcaugucgagucuggucagagcguguggugggcaccuucagaacugcugcauagcaaacugcccuuggaaaggggaugguggcuucuucucuuuguacaguuuccuauuuauauagcuguugagcuuuguggaccaggaguuuuguuuuggggacaaauccuagaguagagaaucuuagucagcuuugguugucaccaaaacagccuccagccuauaccaaagcuuugaccugauucagcucuugagucauagaaguugauuuugcacuucguuuugggggugacaguuuaccacgugacuucucuauuggcugucuucgauaaacagacacucugugcgaugucugugugacaagacuguagggaggucguggcuucuaccaacaggagcugcugucauacugugcacuggucuguagaucugcacccugaggauuccugauuucuucaugaagcagacaucauaguuugaucaucuggucuuuuucuuuagcuuugaauuuuuauucaaaugucgccucucuucucccuuugagaaacaccacacugacuuuguaggaggggccuugcuguggccuagggauguguguaugugucuaaacgagguuguguagcuuccacacuuccaguucaucuuugaccauguguucauauuuuccucccacggguggaaaguaagagacagccgagugucugaacuucccaccugggaucugugaguagaaagauacuccuuacugacagucugugugcuucagagcuaugugcuggguuucauaugucaguguuuugcgauauaaauaauaccacaugauaggcaaaggccugucugcauuuggagagcagguuuucauuuauauguauuuuugagauuaaaaaaauaaaauuuguaaauauagccucauuuuagaggguauuacuuuucucacauaaaugacuuguucauagguguguuugcuucuaaaggaaucuuuauaaacuguucugaggua

SEQ ID NO: 2113 - RNA, 2532 nt, Mus musculus
caagauggccaagaaauuuauuccugacauucaaagccgcuacaucugaaaguccauccacguucuccaccauguuauguuuaaagaggggcuggagcaauggcuacgcuggcaggagacacagguugcauuccuagccccgacaugcuggcugacaacugugacuccagcucucucucuggcuuccacugguaccaugguacagacacuugcagacaaaacagaaaagaaaaagucugaaaaaauauauauauauauuuaaaaagcuaaggauggcugggcaugguggugcacgccuuuaaucccagcacuugggaggcagaggcagguggauuucugaguucgaggccagccuggucuacagagugaguuccaggacagccagggcuacacagagaaacccugucuaaaaaaaaaaaaaaaaaaaaaaaaaaaaaaaaaaaaaaaaaagcuaaggaugcugagccacaaaggcgacauguuuaccaugaccaccacccuaaggcuuaggggccauuucagacggccagagccagaggucggggaggaaugaggugagcagugccuucuccacauggacaggucagggcugcuguauucaggagcccagcagcuguagcugcuuacaaaagacuggccuaagaucaagccagucaucuuggcagcauguaggagagagaggugcccaagccuccaucccuagcuaagaagcuaucaacagugggugacuccugugggggaagagucagcuuuaaggugugggcccugguagguugaucacuuuccauuggaugaucucacaccuauaaauauaugggcaucucaaauugggacucagucauuaaaacggggcagggggaaaagcuggagagaggauggaucagagcucucccccaggacccugguucaaucuccagcacccacauggcagcuuacaacuauuccuccagucccaggaggaucugaugucuucuggucuucuugggaauugcaugcauaugguacagagacauacaugcaggcaaaacacucauagacauaaaaagaaaauuuccaaggucugauuguuauuuuuuugagccuaggcuagccucaaauucucuguguaguugaggcucaucuugauuuuuucccccucaaaacagcuguccugucugucuucgaguccccugagugcugggaauaaagacaugugccaccaugccuggcccugggagguucuucugugggccaggcuggcaggaaaggaagagaugcuagacucaaauucagggauuugugcaagcuugggcuuaggcagauauuuuaccaacugaguuucaucuacagccuugacuuucuuuuuuggggggugguggugaaacugucuuauauagucuuacuggcccaaauacuauguaguaccuugaccuuccugcuucuuuuaccgcggccucuugggugcuagaauuauaggcauguacuacuggagaggaacaagagauuagugaagagguuugugagagagaaaauuaggcaagaggaguuuuagaaaauugagaauuucucauaccuguugaacaauauacaucuagggcauagaaacccaaggacauccacccaugggggcaaagaacgccaccuaaacuacgagugacguugcugagcacugagaaugcagaggugggcucaggguguaccuguagagugcuugcuucgucuguccugagauccauccccagcaccuauuaacagcgggcaugcucaacacauggaaucccagcagugggaaggcagaggcaggacgauaaacucacggucuguuucuguucaauaccagccuggauacaguucuggaucugaagauagaagcuaauucuuucauaauccuuccccuccggcaaaccacguacaacaggagaucugcuugccugugcuaaacccagcaagauguugguuuggggaucuucucugcaacccgguuggugggcggaaccuugcucagguuuuccaccugcaguugggugguguugcaaggaccucgucugccgggagacauauggaauacucaacaggccuaugcugcagcuggguucucgauguagugaaugucugugggugucuguuaagcucagaggcccacaguggagcagcaaggaaggucccacacguacaagcgccucuccgcgccggcuuucgcgcgcugagccggccagcuuccccggaagccgcgcgcgcaggcgcgguguggggggucgcgcccccuggcggccagcggcgacagugcgcaggguccgccuacuggucgcgcgccgccgccuccgccgccgcuugagcccaacauggcgaugcacaacaagacggcgccgccgcagaucccagacacccggcgggagcuggccgagcugguuaagcggaagcaggagcuggcggugaguggccgaggccuggacgccguccccacuuggccucgcaggcagcuccggaggcgaggacggcgggcagccagggucugggcgcucugggcggccgggcgcggcgcgguucccugcg

SEQ ID NO: 2114 - RNA, 547 nt, Mus musculus
aggcagauuucuuuuuuuuuuuuuuuuuuuuuuuuuuuuuuuuuuggaagucaguggacucuuuauugcuuccgggguguggggcucaggagcucuugguggggcggguccguuuccucuucaccaccacaggcuucuggcuucgaaggauggcacuggcccugcggauggccgccauacgcagaucagggcaguacuuguucuuucggaucaugugucugaugcugcugaggguagcccgagcauuuuuguugauggugguccucacauaagaaguggcagguuuucgcugaccggaucugcguuucauaacuaccacgaccccuuugccaucggccgccggcuccacuccgacggucuugcggugaauuagcccguuguagcggaaggaguuucgggcuuucagauuauuuggcuccgugcuguacgucugcuuauuccucuugaucaagaaacuggagcaguuccggacgaccauccacugcagaugcgcggacauggcggcggcuccucucccuauggcggccggagacggggacaggcagau

SEQ ID NO: 2115 - RNA, 3902 nt, Mus musculus
cggaucacaucugauccagagguggacacagagauguuagcucggcgaugcagacugcgucguggaagcccaugucaaaccccacaggauagccaugcggaugucacagagaacagguaugugccacacaaagucagguccagucuccucacuacauacaguuguacaagcuaaaccgcagcacacacuaauauguaaguggcuggcaggccauguuugucaacacauucccaguacuaguuauucuguauguguuuaagccacacaugccuuggagggacagggcuggccauguucacccacaggcaucacugaugauguugaaauguugccugcuagaacccagagggucccauccuugcuccugccugguuuuccucucaucuugcuggucugcuguagaggagaccccuuaauguauggguucaggggcugaggcuuuagacagacucccuucucccuguucucuggaacugggugacccaccuauuuccaggaugcuaaucucaucuugucuugccugccucgaaaacuaucuucacucaaaacuauguccacacagcaacucccuucagacuaccaacuccuccuccuccuucuucaccaccaucaccaccacccagaccacuccuuuccugaauauuugcaacacuguucucucugcuucuacuguuuguucguuuuguuuuuuuguuuuguuuuuuggagacaggaagggauuugggucuacaugguacauggugaauuuucugagauuuuuuuguagaccaggcuggccuccaacucagaaauccgccugccucugccucccaaguucugggauucaaaggcgugcgccaccacgcccugcccucugcuuccacucuugcccugcuguggccaagccuaucuugagcagcuucaggagucuuuccaauguguggcguggggacugacacucucuaacuuaagccuccagggguuaucacuucacuuccaaugaaauccaagcuccugagugaucugcaaauccuguguggucuccgaucaguuacuuuccccucgaaccucucaugcuagcuccgucucugcaugccagaaacuccacucaugcucccauccuacccuuugauccugccuuagacaggcuccccgagauccuggcauggcugcccucuccucaggacugagcucuuaccuggggcgucucugugagaguuacucaagauguucuccaucacauuaaugcauuccacuaccuucaugacaccucacagccccuuugaagaugccugccuccugagggcuuguaaccucugaccucugcaauuccuuuuuuuuuuuuuuuuuuuuuuuuuuuggguuuucgagacaggguuucucuguauagcccuggcuguccuggaacuuaugccacacuaaaaugcugaggcagcauuauaugcaaauagguaaguacgcaugggccaacgcaugcuuacaaagcagacuaaacacaaaaauacccaggucugagccagcuugguccuuucuccaucuccucuugaccccuacuugaacccaggcgggcuuggaggagucggggucugcagcuugaacagggaagggguuaauggccuccaggcuucaggcagcgccuacagcuaugccugcaauuuccucuggccauucuuucccuccuccuucccaagauucccgccaagaaggccucccccucaccccagcuccagcguagggaggggaaggggguuggccaggagaguaagcagaaagaagaggccagcugcagaucccccccagcgcacuucggucccagccuugagcccagguggaagcacacgugugacucugggcagguccggcuagcaaagcaagcgaggcuguucccuagcgccgaggcccccgcuggggucugcaauaugcugggaccuggcucaccgccgaguccgacaaucauuaaccuugggugaccacagcagcuggacacacucagccagggcacugggaggaggggcugagagaucccuucuccgaggaaaaccaauaaggacgcgggggugccggcugccucuacuaggucuaggaaggucuggaaggaugaagggguuuggacccgccucaucccaggaggagccaggcacaggaaaguaguuuggagccugcgcgcuagaguaagagcguuguggguucaaauccugaccguguggcaaaggucuucaagaucuuugacucaguuuacuucauuugcaaauuggagauuuaaugguagccacauuccaggguuggcuggcuuaaaugaagggaugucuacgggaagcgggaggggagguaaccugccgccaggggcuccaggccuuagggauguuuaguaacuaauguuguuguuaguacuggcgggggcggacccugugagcgcccuccccagcggcuuccuguaggggagcaggggccgcccccucuccccuuccuccaggcgcucuuccuccccgccucuccuccccgccccgccccgucccuccucuuuccucggaggaaacuuuccgccggcugguccgucgcgguguccggccgcaccgccgugcgaaccugguaaggcggacggggcggcccggccuggguguaugcggccaccggggagacgccacugccggggcgaggcugcgggacgcugacgggugagcgagccgggccggccgaggccccgcggguggaggggugcaggagggagguggaaggggagcccgaggcaccgccucgcccuuccgugcgcugggccucgccuggggaccccacgagggggcggagcgugugcgcccucuccgccgcucccggggauggagaggcgucugcgggggaacaaggacuagcagaguccagaucugcgauccagugaggcgaaccgcucccucgccccaccaccaccccaggguggaggagcuacgcgaggagcgagcgccuugggcucuggaagaccugaccugggugaccucgcaggcugacaggcgagcugcaucccagcagcauggaugccccaagaagggacauggagcuacucagcaacagccuggcagccuaugcgcacaucagaggugagggccaggccugggggcacggagcccguccaucauaacccaggcagcccuccacuccuagcugcucacccuguccuugcagcccuuccguuccuugccccaagccuagcuagacccuggaucucucccagaugggacgacuccagccugucagggcccccugugaccuccgcucccugcucccuagcuaaccccgagagcuucggccucuacuucgugcuuggcgucugcuucggccugcugcugacccuaugccugcuggucaucagcaucuccugcgcgccucgcucgcgaccccggaccccugcuccgcgccgggacccccggagcagcacccuagagccggaagacgaggacgaugaggaagaugaggacaccaugacgaggcugggucccgaugacacgcugcagggccaggagcuguccacagagcccgacgggccccuuagugucaaugucuucacgucagcagaggagcuagagcgggcacagcggcuggaggagcgugaacgaauccugcgggagaucuggcgcacugggcagccagaccugcugggcaguggcacgcucgggcccggagccacggccacgcugggacgaaugcacuauuacugacacccggccccucagcguggggccagaguacuggauaugggacugccucagggccuucaaaaaacugccucugcccccaaaucucuuuggugcuauugggcgucacaucgccgccugcuaagcacucuucauagggcaggugugggugggaaaagaaugccagcucccaccuucucccgauaauaaugaccaaugaaagguagucuuggcgacuca

SEQ ID NO: 2116 - RNA, 24179 nt, Mus musculus
guuuggcagaauuuuucucccuuuauuuccggagaaguuugaucagauguaauaacacugauuccaggcgaggacagggggcaucaccccugaagcaaccaguauuguguggcccgaggugccccuccauucccagaccuggguucccccucgguuacaguuaaauagaggaagaucugcccagggagacuugggagggggguucugccuccuguacccuacccgccucuuccacauagcacaagcuauuuacaguauucacauccacuguaccccagcaaaccaaggcaaauacuacaagugguccuuccccagggggaagaccagagaggcuaugaguguguguguguguuguguauggggaagauggguguccgagcguguaagcacacggauguacugaggggcaguccugcuuucagccaaagacaucaccagucuguaaggugcggauuaaaaacaaagaggaacucugcccccagggguccaccaggccacuuccaucuuuguucugucucuuucucuuccagacacccacgagcugauauggaggaaccuucacagcugcaccucgguccaaggcaauuugcuuaaagaacuucuaagggaagggagagggauaaagguuaggcccggggagccccaggcagggaugggugggaugcagcugggugccagaaccagggucccuagaguccccaccugugaccuguggaggcugcaccacugcuuucuugaggaaggcuucugccucugcaaaugggaggagccccucugcugugcgacccagacucuuguccccagcgguucccuuuggggagaagccguucuccuggugcgcugggagaggcugcaggccauuuaccagggacccuggcaucuccuugcuuggcaggcuguggauguagggguucaggguuaacaccucaccucccugggaagcccagaggaguccacagcucuagccugcagcugcuggccugggagucccugggauugggagcugguaccuccacuguggcuccuggggggccagcuccucuuucugcauagaauccuucuguagcccagagggccgagucucuacagcuuucacagggucuauggcggcaaagaaauggccaucaguuaggggauguugaaggguggaacuggagcacaggggugaccagggcaaagaaaaugcgugguggcuuuaccugggccggaauuguuagcugcggucuccuuugcauccugcuucugguuugaaaaggaagagcuaucaggugccagggcuauguggucccguugaccucggaacugaauucccuuuuggcccagacacagaagagccucccucacuguauccuuccucggcucuggaggcuucucugcagccuccuuuccucaccccaacucccgcuccccaaccugagaauccugaccuugguuucggcggcuucugauuuccgaguccucuucauuaucuccuccagccgcuguuggaggaggccccacaucaguuaggcucaaacccagaccuaguccucaacuucccaccugcuggcccuauucuagagcucaguucccucccaacccacacccguccuuccuuauccgaucuucuacaaauccaagccugggccccacugguucacagguacaauuaauuuccaagaacuggagcuggagccaggccccgccccggcaaggccccgcccccaggucccaucugcccuggacaccuuucuucgcucuugucucuccuguuccuccuucugaaagugcuuuucccgcuccuggcgcuggcgcucagcuucuucccgggaccgggcuucggcuuccucuuucugccaaaggccuccauaaguuucggauucucuguuucagccuucccucccaggcaagcccaccgauugccagccaagaucugcccgcccgccugggcaccugcuucugcagucgcuccugcuccuccugcucagccugcgccuucucucgagccuccugcuccucccgucuccgcgccucggccucacguucagcccgggcuucagccucccgggccagcugcuccucucgcauucgccuggaggacccaggaaacucaaguuuggucugcgccucuucuucaggcacucuagggacccucacaguccccgaggucacacucacuugucccuuucagccugcagcuuccgcuccuguucuucgcguucccucuguucccgagccuggcgccgcuuuucagccaggagccgcguggcuuccucucggucuguggugcccgccauggguuugcuaggggucaccgagggagcagcgguaggaggggcagucggagcagcugggacagccgggacagcaguuucuagaggaagauccaagaccaggaguuaguacacaccaguacaggccccuccaucagcccugugcgcccccaugcuuucaggacuucagcuaugcacgcauucaauucaauuguugccauuacgggugucggagaccugggaggaggucccucuuccugucccuugugaccagugucuguuggcccacuucccggacauaggaaaagcuggcacaucucugcccugcccacccucacuuccuguguaccugcagggaucuguguugaggauugcuccuucugaggcugggcuggggugggcgagggcaccggugagggcgcuggugaggcuggggcagcuggcuccuucuccucagcggcucuacucuugcggugguuuuuguccucaggccccgacgggcuggggcucucuuuugccuccuccuuccuccgaacccgccccuugggugaugcaguggugccucggggggauggugguuuuggaggaagggcauguccugguccugggcuggggcagggggaggcaggucugugccagguuguagagggagaggauggccgggccuuggacuuagggcuaagagagaagaaaaggguuagaagcaaggcagagcaccugggcaggcacgccccucccccaacaugccacuucuuuggggaaguguucccuuaaaaaaauauauauaucguguggagaguguagugugcaugugugagcaugcgugugaaagcaacuucguggaagugcuucuuucuuuccaucuuuccauggauuccagggauuuaacucaggguacaaggcgugcacagcaaagguuugcuuauugcgcccucucaccggccucagccuccgcaugcugccuuccacaugcaggcuggguuguaucccaccucaucacucaguguuaccacuuccucuuggugcgucuaucucggcuugcaauuacaaguucacuccugagagauuuugauuaacaccugccuuccccacacacagcauguacacuugguagagcaaacacuaggcaugguuuagccuaccagaguauuuucagcaccuagagcacccggucagcugcuuacuuagauucuugaguuuuagggaaaguggggguggggguggggggugggagggguggaggaagagggagagaagaaaaaagaaaaagugaaagcuaggguuuguggcuagcccaggcuacacaauuaguucaagggcauccagggcuacaaaggagauccugccuccuaaaagcaaaacaaacaacaaaacaagaggcucuguugaaauguuuguguagacauguuucucaguugguagcaugcugccugagccggcacacaguccccuaaugccaggacuuggggggaggaagagacagaaggaucguaaaccgagcucaucacuggcuaucgagcuaauuacaggccagucuaggauguuaagauacuucuacucaacaaaaaagggccagcgagauggcucagcaagcaaaggcgcuugccaccgagccuggcaaccugaguucaaucccugaaccuccaugguagagugagagcugauuccucugaccuaugcaugcacacacacugagaaagugcgguggcacaggucugcuguaaccccagcaacuaugaggaccacagguucagggcugggcaacuuagugaaaaggggcggagccaggguggcacaggacucuaauccuagcacuugggaggcagaggcagucagaucacugugaguuccaggcuagccugguccacagcuagaguucaagggcagccacggguacacagagaaauccugucuugaaaaaccaaagacaaaauacugaaaggacuggguauauagcucagugaugggggugauugccuagcgugugggaggcccgggaaucuauuucuaguccuaaacucauguagguaagaauauggugagggcucaggaguuggagacuguuucaaagggaaaaaaaaucaagaaaaagagaaauggagagacaagaacacggaaaaaucugcucuuauuaaaaaguacuugggaaugauugacaagagugaaaguccaggugaggugagccccgcccacuugagcucagcgccccgcccaccugagcucagagccgguggagagccgaggucugauagacgcuggcagcgacuggcgcuucuugagguuccguucgcgggccagggcgcucuuuuccuucucguuuucccgcuccuuguccuucuucuccuuuuucugcaccuggaggcgaaggauggaagggaggaggaggaggaggaggagaagaagagguuagguuagguuagcagagcccgcacuccagccuggaggcagccuguucccaccuuagcuguggccacucaccggcguggcuuccagccggcggcgcgccagcgcggggcugccaccggcgccgggcuugcgccgcucugggcgcuccccggacggggugcagcggugcgcgcuccgaggggcgcuacaaggcgucagggggcuggcggaggccgagcgcgggcacacuggcacggcugcagagggaugagugcggucgggguguggcccgggcgcgaggcuggccccugcccgggcccucguggggcgucucccagggccgcugccccuacccuggucccugccguugcggggcagugugaccgcgcugcgacuccgagccaggaaggagagggugggcgucaucagacgauccacaaugcugcucucccaugcgcucagcugcaggcugcgaucugggggacaacaucagacagagcaggucaacacaagaggcacagaugguggagacgaggcacugaacccacgaugagcccaaggacucucaagaggacuguuacccccaccccaagucacgcggggucacgcuuauuuuuuccuaagaucuggugcuccuuuugcagacacaggcaacaacacacugagcgagggacugggaauauaucucagagguagagcgcuuggcugucaugcaagaggcccuagguucaauucccaacaccagagaagaaaaaaauaaaccucccuaggccaacacccugcauccacuuuaagagugccuccuaccagucuccccagaugagagggcucaaaacugagagcaaaggaaggagccauaauaggaucuagggaagacccaacugcccucucccaggucccacaguagggccugccucuccuguuuucaucaugcuggccugcgggaggcaugcuucuuagauuuggggcagugaggguccuugugcuccuccaaccagccguuaggagugugagacagaggcagcuagagggccugguugcccuaggccaccccacucugucccuucagcugcuggguuauuuuuaagcuucagucaggugggguugguacagcagcugauuugguugcuaggcaacagagcaaccaaauaaaagcuggagaaacuuuauaaauaacuuuaaccaugguucuuucauauguaagcaccggggcauggugggaacgcaggagcugugccaccuugguuggucccaacuuuggacccagccaaggccaaagcaggugcucuaaaggcagagauggcaggguugcacggcccuccaggguggagccagaauacccucacccuguauccaggcuagccugacagaugggggcaaagccaccugucuaagguuggcccaggccagcuagcugugguuagagagaaagcugguugccuguuaccaccccagucccuagccuaaccucuugaggccccugccaggcuuucuguccucuaggccauuguccuuuguuucuccuacaggacacugcuauguccugggaggguccagacccaaaugcuggcuccccuaaagggcacagagcccuggguggaauagagcagggcuggaccuggagucauagggagagcuccagggaugaguauucuugcugagcucucggggggcuggcuauaaggggcucuggagggggaaggcugagccuucucuuacuucuacugggggaguuccagagcguggcagaggacuuugagagccgcuuguugauuauagaguccacguguuugggcagguuuacugccgacacggagcaccugcucccaccuggaggggaaaagacacacggcauuagggccgggccagacgggagccagggggggcacugaggccuuccaugcaggaugcucugagggcaggaugggagaggaaggagcgggcaggcuaggauggggaagaggcucgauuuggcccugggagagggaggggacaaggaagaugaucagaaacaaccuugauugagggagccaauggaaaaggagcagagggaggaaauggugggaaacuagaacuacagccuucuuggccagaccaaaggaagccauugccuagggcugggugcugcaccccuccccacagccacccgacaucggcacuugcugacacugcccagccaaggcgcuauggauacaacacccacauacugggacaaugcaaaaaacgcuccuaaacagaagaccuacagagcucacggcugcuugcacaaauccacauacccacauuuuuauccagacacacagagacaaagacaugcaaacacaggcauacacggugucggaugcaugcacacauguauguagacaugcacagagaaacaugaaauaaccuaacgugacaguugaugacugcuuaccacgggccagacacugugcuggguaccacaugcaugucaccuuacuugauccuccaaacaucugccuacaaccuuggaggcaagcagugcugggauuccccccauuucacacaugaagagagugagguuugagaaguuaaaggucacacaaggucagaguuugaaucuaagucugacuuaggaguccucacugagguaugcaauuccaaaacacagccucacagagugggcuacacaagacaucuaugagcacacauggcaggcgagauccaugaaauacagaaccuuguccuuguauaaagacagccaagcacaguggaaugaauauacaugccaggaaggaagcagaccaaaauccagaauguaccuauuaagaaaacucagaaaaaaaaacaaaaaaaacaaaaaaacuaccuuccaaaacagaggauggcaguucuuuuuaaguaccaggucugcagggcauuaaagucauaucaauauauggcuuuauauaucauauauauuuuuauauaucaucaacgaacaguaacugacaggagcgaagcauuuagcaacuccuaagacgacagagguuugaggagcaaaccgaguugagaguauccauuucugguuugauaguggaaggccuuaggaaaggauggucuggcuuacagaccauuccagaagacacaagucacacgaagcaagacacaccuggugcagggaguagugaacgaccgaccgccuuguguauaguguuccuguccacagcccugcccaccuacccacccgcccgucugccagcacuuccagcccacucacuggucuuacguccaggggagcuguggugcagggccccugcccaggaccagcgcuguugccggaucucagcccacgucuucuucacugaccgcuggauugcugcuucauagcgcuccugggggccaaugggaaaaagaucugggcucaggaucagccaccauaccuggagaaaguccuccccaauccuaagcaauuccugacucacuacaggcaaccaaaguuccugacuuggcugugagucaagccuaugugugauagaucccuauccgaguucuuggagagcuuuuuuuuuccccauggacuugagucacuuccuggguguaugaguugcuucucugaggaugggugggacucuucuuugccugggauuccugggcagggucucccuaguacugaggguccugaucuuggugcuuucauguccuucuuggcugaggcuaccagacaggacuggacuaucgugucuuccaaagccucaacagugcucaaacuagguuuuaucuacaugguggaugugucacaggcacaugugggagcaaauguaucuguauggacauugucacacagggacagagucacagagcaugcaguugggguucuuagaacacaugggaacauguguggguguggaugugcgcuacacuagaccugaagaccuguggggacucuguugagacugcuaagaccguaccuuguuuuucucaagcuucugccucugccgcuccuccagggcagcccggcgcuguucggcuuuaagccgcugcuccuccagccgucggcggcgcuccuggaguugcuuuucccggagcgccuuggcuuuuuccuccuucuccaaccacacugccuucuuggccgcuaaggugggaacgaaggggcaugaccugagggguuuugcggcaggccugggccagaagaugcucccaacgacagucggguaccucagaccugggcaguccccuucccugccugucucugugaagaagccuccacucucaagaugccccguucguauuucagaguuuccauggagacaggccuaaggaaaugucucccacacuggcuggacgauaaaugaguucaccagugugacaccccaccccaccccaccccuguacaugauccggaggccaacuggauaguuucaacauauaguaguauauagugguaaagaacaguaguucucaacuuuccuguuggugagacaccucauguuguggugaccccccaaccauaaaauuauuucauaauuauacuuuugcuauucucaugagucauaacguaaauaucugauauacaggauauuuauugauauucagcaauuggauauugauuuuuuuguuuguuuguuuguuuucgagacaggguuucucuguguagcucuggcuguccuggaacuuacuuuguagaccaggcuggccucgaacucagaaauccgccugccucugccucccaagugcugggauuaaaggcgugcgccaccacgcccagcuacaauuggguauugagaaucacuggcucagagcaccacugguucagagcacggaucuuagguaagauacagggucugggccugaaucucagcugcucacuagcucuuaggcaagugaugucaucuuuuccgaccugauucuuccuuaaaaugugcugaguggacuaagugagaucagcacacacaugguauuccagaagggucugcacuauuuauucucggcaggcugaggaauggcgaagagacgauaaugccauguaaacacucacccagguacuuggcccgcucuucucggcgcucuuuggcaagcuugugucucucuccugccuucuuuacaucuaagcagagggaaggacagagucaaaaggucuccuggggaaacuggcuucaggcuuucccuucaggccucaccccaccccaccuucccauccucauccucacagcaaggaggacuccaccagugagcaaaccacagggucugacauugaugacagaggucacacaccuugcuuggcaggagggcugucagaggcuggcacuguggugggggaugguuggcugcuucuucgagaaggcuuggccucccgugguccuguggcuguggggguggggccccugcucuuggcuucugaggacgggcauucuuccugugggggagcuggcugaggugagaucugcccugugggauucccugguuccagugggagcugcuuaggauucguggcagucuucagggcaggaggugugucugggggagugucaggaaccaaggcugacaucgguguuggcggcggaggaggggaagggucaccuuccggagacggucuuggcucuugggggauccuggcuaacacagcugaaagaucagugcaagagagaagggagggucagaauccacauauguauugucaguucacacagcaaucugcccuguccaguggauucauucauucauucauucauucauucacucacggauauucuauccaugugccaggccucauauaucccagauauuaauggcauaauggugagaggaagaaucaggauuccugucucuagggagcucagccuccaggagggcagacacauggcugcagggggaagagcaacauacagcauagcucagcugacauggucaaccugaacacgaacaagugucacugagcugcuaucagaagggugagcuggaguuggcagagcaaggaaaaguggcuggcaggggagagcuagcugccaaggggcagacggagcacggcguguuggaaaaacagagaaccaguuuauagcaccaacugggccucucuuucucuuuccuuuuuaaacagaauuacauuuauucacuuauguauauguggguguggguaugcaugaggggacaugccacggcguguguggagguuggagaacuugugagaguuggcuuucuucuuccaccguguggauccuggggacggaacucaggugaccaggcucugaggcuggugcucuacccacugagccaucuuguugcccauccacccucucugcuucggggcacacucuccaacccaaagucugguucauagaguagaccagggcugggcacacggggccagcuaagaggaagggcaaaggccugugggauauuugcacugccacagucaucagugggguacacagccagcuauagauaugucuaucugcaaccuuuucuuccuacucacccucagauuuauuccuuaaagauaugaagaucugaggcuggagagcuggcucagugguuaagagcacuugcugcucuugcagagggccuggguucaguucccacaacucauaugguggcucacaaccaucucuaaugcagucccagggaucugaugaccucucuggccucuaaagccaccagguacccauguaguacacauacauagacaagauacucacacacauaaaaauaaaucuuuaaaacaaaggaaaggaauaagguaugaauaucggagcugggcagugggcaauggugacacacgccuuuaaugccagcacucaggaggcagaggcagguggaucucugugaguuugaggucagccugguuuauagagcaauuuccaggacagccagggcuacucagagaaaaccugucuccaaaacaaaacaaaaccaaaccaaauaaccaaccaaacaaaaaaccccgccgauaugaaucuugcuaaacauugugguggcacacaccuguaauauuaggaaagcuaagacaggaggacugcgaugaguucaaggccaacuugacuacauaauuaguuugaaguaagccuguguuaaauucacacacccaugcaugguggcacagaacuguaacuccagcacuuggaaggcugagggagaaguguugcaaacaggccagccuagcuacacaacaaacuguagaccagccugcuucagaaagagaacuuguuauuuugccuccccccacaccccagcugaggaccgaacccagggccuugugcuugcuagacaagugcucuaccacugagcuaaauccccaacccugaaagagaacuuguuaaacguuacaccagaggacagguaaaaaacauguuagccucauucuaauuuuugccaucucaagacagaggggaaggcuuuucacaugccaaaccucaguuuucccaugcgugaaauggguccaaggagcccaguaaagucaagccuacucccaucucucuguaggucuuaugucaccuccagcucucccagagagaacuuuucucagguugagcccuuacaucaucugcagggacccucaggccacucagagaaugaggacacaguaucaacagauggggacaggcaguaucacaggaccccugccacacaaaguccucuguuuuggaguucuggcucucaggacggguaaacuccucauuccugggacaaauguuugcagggaggagacaccccagggaacugacuuugggauuuuagauauccuuccuuaucuaggagguaggcaucuaauggcuugggcucaaagccagccgauacaagcauggauccuggcucucccgaagacugagugacucugaacuguugucaaccugcugugugcuacagcugcucuucuauaaagcaugacuacuacuuaggccacagcauugugagauuagccauugagauucacauaugcaugaauauauauauauauauauauauauauauauauauauauauauagagagagagagagagagagagagagagagagagagagacugggucucuauguagcccuggcugugcuggaacuugcaaaccagacuguccccaaacuaacagagauccuccugccucugucuccuaagugcuaagacuaaaagcauauaccaccuucaauauucauuaauauucauguuauacugagugcuuccuacauggaaagcuauccucucuuuacaugaccuguucuaaccucacuguuuaugaagaagauguuaacaucucuuucacaaacacagagaaagcaaagcaaagcacaggcuagggagaguccuuuuuguuuccuuugagacagggacucucucacuaggaggucuagccuggccuggugagaacugcuguucucuggccuccuguuuuuccaugcugggauuccaagcaugugcuaccacauccaacuuugagaucuuguggcuaguaagggacccaauguggauuugaacccagggucacuggcagagccuaggccagcaguucucaaccuauggguugugaugcccacaggggucacauaucagauauuuacaguacuauucauaaccagcacaauuacagcuaugacguagcaaugaaaucauuuuaugcugggggcgggggggggggggacuguauuaaaaggucccugcauuaggaagacugagagccacugguccuggcucuucugcaccgaucucuaccaucagcguagaagaguaugagggauggaugguaggcagcuaauuacacuaccaccccaguuucuaccuuccucccuuccucuuuccucuucugcuuccugggcugcagguaagagcccuagcugaagcaauguuuucccucauaaccgucaacccugccaggccaggccuacgacaggugacccagcucuucacaccagccucagguaugccuggucccuuccuagccaggugcaaauuccuuaacuaacuuccccacccaguacuaguaguguccacacagugaggccuggcugcucacuccauggggcaagcaaagguccucccugaaaggauuuacucagggucauaaaagucauauuugcugggggaggauuugaacucagggcuguccgaggccaaagcuuggguggguaagucuuagcuuaaaggccaagggugaggcuuauguaggauccuuccucaagcaccuguaugagcuaacagguguugcaaggaaauugguaggcgggugucugucuacacccaggcaaaucacacccaccagguaagacuguggguaucuaagugggacccaaauacugagaagcagagaagccaagaguggggcaucaggugcaguucaaguuucuggcuauagaguggacaggcugauccuucugugugggaacccugaaccuccgaucugagcuucccgccucuggguccugaguugcugguacaaauguuaacuguggacaccaucucugucuccucaagcagcaccuaccugugcugaagaaguccuccacguccccucugccagaccucucccaggccacuaaggcaugggcuccgugucucuuucuuaccugccacacagacacagccaacccuguggugcuucuuggagcccuggucuuguucggcuaccgagacgacacacuucaggguugggcucucccggcugcuuugcuggcugggacuugugucucuggcggccccucccugacucccuaaccuuuccaugcuguccugugccccagggcugucaggcaggagcuuaccuuuucuguccccacacucugaggugaugucauucgacaucaucccugugcugacagcaaccaaauuuguuucuccagcccagacaucuccccggagggaggaccaguuucaguccuggaacucccuacccaacacccgggauguuucauagacaccccacauguaaccacucccccacuucaggucuccccagcgcagcuacggcagcuccucagaucugagucauuucacacugucuaauuccagcaaaucuuuugggcuuguauuuucagaauguaccccaaguuccaucacuuuucacagccucccauucuaucgccuuggcccagcccuguuccauuccuggcuccacccccuagcuccugucucaacacaacagcaggggagauggauuaacaguaagucagaucacaucaccauuucccugaaauccccaacacaccccaucucacgaagaugagaaccccaaggggccaccccauucuguggcucucccucggaagccuguuacuucuugggcgccugucccccauuccccggaguucagacccuccagccacagucccuuaugccccucucugccuugggcugcaacuugcaaguccucuguaggaaagacugccuccagaugcaacuaggcucauucccuaaccccaccugucucgugucucagugaggucugccuuaacuacaagcggagugagauagcucaguggguaaauacacuugcugaacaagccugguagguaacuugaguuucaucccugaaucccauagaaugcuaugucaguguaugcacacauaucauacacauauaauaauaaacuaugcucuacguaagcauuaaggacauuuuuucucuagggcuugaauccgaagccgcugacacucugagcaaguacgcuaccacugugcugugcccucagauuuugugacuuuuaucuugagacagcgcuugacuaaguugcccagccugacuuuugaacucauucuagagcccagacgggccuugaaauuuugauagcucugcugcuccagacagcugaguaacugggguuccaaacccgugucagcaagcuuccccuguuccuuuuagugauuuucuaaaaaugugugugcgugugugcgagagagacagacagacagacauauguccaugcaggccauaagagaucccuggaugcccuggaguccccacaguugugugccagcugacaagggugcugggaccagcucugauccucuaggagaacagcagagagaauuuccuacugagccaucucuccaguccccuguuuucuucauucacauuugucuuauuauuuugugguaaaaaucauuuuauuccgaggcaugagagcgggaaggggcagagaucagugagcucugaugucccuggcaaagcaggaucuucuagaacuggucaccacagaaagccuccucuucagugcaggguccugcaucauauguggccuaggcugcugguguccaccucgggaguuccagccacccuccugaaaaccugggacaacagcagugcauuuacgcauuuggcucacaaaccccaucuuaacaacauccccacuaccggccuaugaucccccagggggacaacugucucaucuuaucucuagcaucaacagaucuggggaccuauaugcccuauaaacacuugguaaucgacggagccccacccuggcagaaagcauggccaguucuuaccuggaggagcucagagcccugcucuaccucacccaccccuacucugcuccccacugaacucgcaaccucaauggugucccacuguccugaggauacaggugagaugcuggagcugaguccccaagucuggugaagucuuaaagccagcuccccuaucccuuuaaaucccugcuugcccacugaacucuacccacagaccucucuuuaaagucugacaaccguccaagcuccuucuugccacagggcguuugcucugucccuuuuuuccauuguuaacucuugcuucuccucugguuuagucgccauuuccuccgagaggccuucccuggcuucucugaguggcacaauguccuuuacuacacacagcuguggcuucccagcgucucuuuggagugcugucagacugucagaacccacaucugcuuagcucacugcuccagcagcagcagcagcuacaacaaugccacguuuaaggagccggucacaaagagcuuugaaugacaaugaaaugccacaccaggaggccacccuagccuagagcaggugccugagaaggaaacacaaagaacagaucugcuggaugugguggcagacgccuuucauuucagcucuccucugugaguucgaggccagccugguuuacacggucaauuccaggauagccaggaggacuacaaagcaaguucaugacagccagagcuauauaauagagaguccccgucaaaagaacgagaagcaaacaaacaaacuaacuaaaaccaaacagauauguggcuauggauuuugaaaugauaaacaucgaaaggaagaaaagacucucaucauaacagaguuugggaggcucccuggacaaaggcacucagguagacuuucacaaaaauaaugaauguuuacuccagcagccaaacaagaaaaacuucucaagaggcaaacaggacgcuuggaacuacuuuugugaccuggcaggcuacugacccugaauacagauauucccucagaauucugccaacccugacaaaaugucaccgggauggcauuaucuggaacaaccuguguuaagccaaauuaauuccuggguuaauuaucuauacaauaugguugauucuuuucugauuauucaccucaaucaaauaugaucuuagguuacuuaaccuuaucuugcuuuuggacugugccaggcugggaggcuucagccacugccaguuucccucugcuguguugcuauccaccacaaguauuugcuaagaacuggauaagcaguagauaauuuguauuuauuucuuggcacaaaaaaaaaaaaaaaaaaaaaaaaacauuugcagggcaaaggugcaggaucugguuguguggugaugucagaaggccccuucuuuccaggagccccuaaauggacuucugacaucauuggggucugcugagagaugggggucaaguccccaguggaucugcugcauguguggggugcuacccacucguaguccuuucagacaagguuucugcugcccuaacuccgacugggcuaaugguccuucacagcucuggucucagccucacuuuucugccugccugccugccugccugccugccugccugccugccugccaucugcacccaucaguggaaaacucacugagaggccgagccuuaguccucucuguaguacaugcagggcaugcccaacaaacauaggaacccuggguucguucagugaacaccuaaauacauggauggauggacaaacggauggacagauggaagaacggauggacagaccuauggugggaaacuaccuauacauuguguagucacccaggaaugguaguauaugccuauagucccaguacuugguaggugaaggcaggagacucaaguguucgaagcuagccucagcuacaagaaacccugucuuaaaagacaaagcaaaugcagagcagugguggcgcaugcccuuucaucccagcacacuugggaggcagaggcagggggaaucucugaguuugaggcuagccuggucuacagagcgauuucuaggauagccaaaacaacacagagaaacccugacucaaaaaaaaaaaaaaaaaaaaaaaaacccaaaaccaaaacaaacaaccaaacaaacaauaacccaaaacaagacaaacaaucaaaaagcaaaaaagaguagagaguaggaccuccaaggugcuuccgggcagagaugucucucuaaacccuaagugucuggacuguaugaaggcccugcuguccucugccaaguccuaagcuauguucucuuaugucacucgauucuugugacuacccuaaagggaaaguacuaaauauccccuacuccuucacagguaaguuaacuguuagucauacugacuagcguggcugugucggggguaggguuugaaccccguguuaccugaugacaaaaucuuaugucaugcuguuccugccuggugucaugacauccuuucuccaggcuccugucugcucccuaagaaggaagugacuggcuggcucccccagggagguucccccacaaaagugaagggugcagauggggcaggcaggcccugagcuaagagcucaggaaugcaggguaggcaggcuccugcccaggcuggccaacaggaggcagggagugaggccccagaccaaggaguggaagggagguccaccuccacugaggcagagcagagcagucugucaagugagagcugagggaagcagcacguuuauccugggagggaggggagcaauagggaggcuggagcgggaugcaaaggaggcaggacagacagcuaaguuauccagaucgcgaaauggcuucugaggugucaacauuagaccuggcagaugaggacaggaggcagggagagagcaaagacaaagaaagacagguauacacaucagagaaagacagacagacagacagacagacagagacaaaaagagacacacacacagagacaggagagagacagagagagagagcgagcgagcgcaagucacagagacagagagaacccaagagagaaagcagaccacauagacaagggugcacacaaugaugggcaagccacucuugugucucucucagauaagagacaugggauucagaacuucacaggcacagaaauguacacaaggcuugugccauguccauuaguucauccuuuguuuccauccuuaggggguauacuauuaccccacuuuacaaaccagagaagcagauucugagaauuaagacacuugcuagggccacacagcuggugaaggauaaaggugggguuugcagucagguuaacugucccaucugcucucacugcuaugggacggggugagggguguucccagguuucuccuccuggaaagaucugggcugggagaaggugauggcugggaaggacaacgcccgggggaugccuggaugcugggccaggacagguguuccuaaagagcagcauagccuggccuggaggaacuaggcaguuuuguaagcuguacacugggaaaggccagccucccccagagguaggaggcaggguccugaagcuaggcugaagcuucugcagccuuagugagacagaggcucugaaggagagcccuggcaggccuggcggccauuguucccuagccuccaaucaggagcacccacuuccuguuauuuuaggcggcaggaaaugaccccauccagcggcccaggccgagucccucccucagccccagcccauagccuggagaacuuuagcuagagcuagacuaucauucaccacuagaguucaauuuacucagccuccaaccugacaggauucacagggaacccauagcgagcgaccagugucugccaggagaaacgacagggggcaccguggaccacaaggcccacagaaggacauuuuggaagagaaguggccagacccugucacuggcuugcuuggucacgaugauucuguauucagauuuggugcugaaucgucaacuccugaggcugccaguuccuagcuauguggcuuugggcgagcacccuuaccucucugggucucaucuauaaaauggggagaaaaugagucccuccucauaggguugucaugaggaacgaaggagagaggacacugcccuggcacagugaaggucgugaacaaauggugggugacagggacaggaacaagaaauggggguuuagagagccaaggaaucaccuccuucccuagguccacgucuccccugacaacucaggaggaucagcaauaucauguucccuacuccaagcuccccauuucccuugggggaagagcuacagcugagaggugauggagaaaacacuggaggcugugccccggggugccaggcagagcuaccaccagccaacaaagcuacauuaucuaagccugccucgcucauggacucccucccuggcccagaggggacccaaggacaugacucccaugcuuaaggccuccguucaagcucagucagacuugagacuaacuacuaacugcucugagagccuccacgcuggucuggggcccugcuuucgggcuuccggcucgcuugcuuaccucugccccacuaguagccaguggccauccgcagggggagaagggcuaagcuggccuauguccuuauuccucauuugcauaugcgugacuucacauuagaggcucguuaaaggccucacacugagcccaccaguccagugagggggacuguccggcagugggaggcaucaaccauguuggcuguugcauggauaucugcaguccauugggccggucuccccaacuucuacggggugugccacaaagcccaugcucugcggcaccacauuggcaggcaaccauggugcuugcccuucuucagagaacacaucugcuccccaucuaagucagaauagguucugacugacugcauucaccaccucagcgcaaccagcacccugcugucacaugguggggccacaggacaaugugcagagacccgaguccuguuuucucuccuccugccaaggagaacuucucucuuguccaggugcccuccagcuccucacaucagucuaggugucccucgccugguauucugcccuauuuauaccaaccccucccccuuucuuucuuucuauuuauuuauuauauguauguauuuauuuauuauauguaaguacacuguagcugucuucagacacaccagaagaggaugucagaucuaauuacggaugguugugagccaccaugugguugcugggauuugaacucaggaccuuuggaagaucagucggugcucuuauccgcugagccaucucuccagcccccucccccuuucaauucuaaugggggguccaucugagguccucagaccucugacagaauuagaaaugauaucaauaaaacacaagccuaggcuggcauugaccaaguacuaacugugugccaggggcuaaguuaaagagccuggugccccuaaggggucauuucuagcacuauucuuacuuucuagauggaaaaacuuaagauuuggguuaagaaacagccccccccccaucguccaguggagguuaugacguggaacucaucgauucuagugucuacacucugagcugcuucccaauccccgcccucccccacaguucacgccuccccacuggcaccaguuguaaugagccuaaccacaauaaugguaaucacacuuuaaggagggugucuggugccugcaugccagcuuccuuuagguucaucaucgcccaucgaccacaagaggcucacagcgcaaacccugauccauguuuuccccggggaacagaaucccuagguccagggcacuagucaggaaacagcugucugggauuuccauccaggccuucugacucuaaaggggaugccacccuuguccccuuaccccaugcugucuguuacagcucgguguacaacuaagcaccugaagaaagcagggucacgucaccaacacucagagcccuagaccacugccccauauucuccccggaccacugccccauauucuccccggcgcauacuaugggccugucauuuacucucaggaagucuuggcuuuggucacuuucagauucucaauguauagagaaacaaggcaugauccugacccaaccuguccuguaacuccaucuagaucccugugaauagaagaguuuucucauccagaccucugcauguggccuuccgcacucaccuaggcccucaaguacagccaagcaucccaccccugcccccauacacagucugggccacucauccaagugcccuaauuauaaaccagccccggcuaaggcugugucccugcccucauuugggcucucgugcacaccccagugccaugaacucucaggugcaaaauaccaguaagcagauggcuagaccaggcugggccucccuagguguccccucucaggcuccguggaaccaagacaaacuggaccacccucguugccagcacagucuguaaaccuccagaagcccaccaaucuccaccuacaugucauagauccccaccaagcaccacgaagacacagggaggagcccacccacagccaagcagcccccaccucauccugggugcucuccaccccuauagaugcucucaauccggggcuccacaccccagggggcagggaggugacaggauuaggcugggaacucucuggaaauguggggaugacugugugaguggaucaggacuuggguccucaguaaucaagcuuuucccuccccuuccaggaagaaagaguccucccuccaacacggggcccaaccagaauucuguccccacccccucgucagcugcucccagauagaaugggguuugcagaaguccagaacacuggugguugguggggugagggguggaaaggagagcuuugguggucuagggcauugagacucuguguguguguguguguguguguguguguguaaagcauccaaaaacccucagucugagggaaugauguggcauguagggagugccauccuugagcggucaccucauucuacagaguccggcccaaagaagugacguggugccggcagaccucugucacuccugucccaaaucagacugggugggcucugaaguaggccuggcuuuugggaaggcggcccacuccccagcucccacccgcgccccaaacaauaccgccucccccucccccucgccuuuauccggcggguuacuuggcagccaccgcuaaagaccucccccucgucucccuccccuccuggucggcccacaacagcaacaggcccuuugcgcggcagcuggacggauggggugggggcgaggucugggccagggccugggcguggggguacgagggccuagcuucgguaugcauaguuccagaccugagaaucugguacccuaacacacauauuaagacuaaggucacacgugcccgcggaggauggagaagacaguagcuccagcucaguaaaagaggaucuucagagucugggguggaucucgaaggagaguggggguggggacgagaggauagcaccaggcugcggcagaagggucaccccaucgaaucccuagccggguucccacggaucccgaugccccgugcuucccggcgcggagguuggggggaggaggcagcugucagaagaugcguccguggcccggagccucggcagcggccacagccuuuauuuuuaaacuucuaaguggucagagggcgcgggggggagggguccccgcccagccgccagccucauccucggccgcccugcggcuacucggucccccuccgggcucgcucuuguguggcucccggcuuaccugcgggugcgcccgggccgggcuccacacgcgggccacucuccauggcugcggcgucacuggagguuuugggggagggucucagccgcgacggcggcgacggccggaggccaggaccagggucccgcggcgcaucccgcccggcccgcccagcgggcaaagacccagaggcggcggcguuccgagugggagagguagaggccgguggcuaacgaagcucugaguagccagcuacccgaggucgguccuccgcgaccgcgauucugcuccuuugccccgcgccggcccaguccuggucgcggcccaacccuauuguaccgcccgggcu

SEQ ID NO: 2117 - RNA, 13561 nt, Mus musculus
agccgaaccacaagucccgggguccucugcgccacaccgcgcaggcgcagugaggaggggccggucaguccuagacgcugaggggccgcggcuggguugaaucggcgacucccggggucugggaucuggguugugaggaggugaggugaggcggcacugaacggugggcaccaugucgaggcaggcgaaccguggcacggagagcaagaaaaugguaacugagcgcgugacccggcgggccgggcggaaucgaagcuuccugggaaggggccuggugcuggcgcuccaagugauugucaaaugaguccugcugugagcugugggauggggaagucccagugugggucauucccuaggcguccggcgcuggggcagcuuggggggaccccugaguugccccuccgcccgcuacacccaggucucucggggucgagugcuaaaccaacaacagcgacgguaaucaauaacaguaccaaccauuuacugaucucuuacugugcguuuggugcuaggcuauugcuuccauuaugucauuaucacaagguaaccucuucuagguggauaauguuauggcguuuuacagcucagugaaguuuaugggacauccagauuuacacuucggaagaguuaggauuuaaacccaugccccuccauuucuacagugaauauuucagcuuuucacuaugcuuuaggcauugugagacuuagacaguggucuugucagaaggggacuugccaucuaacauuaaggagugagccggccuaaguauucaguggccccuguaaugguugagaggauaacugugguuccuucccuaaccugggaguagugggacaggauauaaucccaaaaggcugggcugggcuggacugggucuggagagucagguggauaucaauuuucuccgaaucccaaggaaagaggcuuucuugucaaguguuuuuuguuuguuuguuuguuuguuuuuaguguauucuuuugcagaacugcccaugcugugccuuugcuuuggaguuucaaacugaacaucugggagcggaacuguagcuccaguugguagagugucugcuuagcaugcacaaggcccugaguugaauucccagcaccacguaaacuaagcuugcucaugcaugccuguaaucccagcccucggaugguagagaaaaagggucaggaauucaggguuguccuuagcccgagauaagauggaggccagcguaggcuacuugaagcuacuacuugaaacuauuuuuaacacacagaguguuggggacgugggguguggggcucacaucagguuugggagguaacucagugguaggaugcauaugcaggauacucugaauucagacuucaaaaaacagcgggaccaauccgagguugccugccugcugacuagaucuggaaaccuauguacuccacucuggacaguaugauucaguaugauuagacuuugugucuuauaccaggaacagccagcacagguggaaucccuguuauuccaggcugguucuuccccaccccaccccaccccacccccagagcugagacucuaacccagagccuugugcuugcuaggcaagcgcucuaccacugaccuaaaucuccaagucccuaggcugguucuuuauaacccucggaccacuuucaagacacaaugacagcaaugauucaucucuacacaaauauuaaauuacacaaacacgaacucagugaucaaagcugaguuggauccuagcaccgcaaacacaaaaugcaaaaacccgacaucauauacacacauuucauauacacacauuuguuuguauuuuccagggauuugugugggccucagcauacucuggggaugguaaguuaagaaucaguuuuaggggaccgagcaugcacacacacacauacacacgaugggggagauuucuggaagaaauaacaguaguugagaguuuugugcuagaaaacaaugucaucuagaagaaaauauacacauguuccuuggcauuuucaagugauuauuaguuucuuuagcuacaaaaugggggcugugguaccaaagacuagaggaaagaguguuaaauuuaaggggauggaugguguuuccuuggugaugggagcagacacuuauuccuuagucuuuguauccuguuaucaguauuuguuugauuucuccuggacucaguauugaugugguuuguucgagccagggucucucuacauagcccuggcugaccuuaaacuugcuauguagaccaggcuaaccugcuccuuuuguuuucauuguguccuaugagaaugggaacucaagcagggcaaggguuugccccuuccacugcuccaguccuagcaucuagaacagugccugccacugggaguccguccggcgagugaaugaaguuagggacugcauuuucuuacuugguuccuacugauucuacucugggcuugccucgugcucucucuggcuaccuguguguguuugagacaagguuuuucugaugauccagacucgcuuccaacuccuguuucuccugccucuuaucuuauuuccgcaggucugggguuacaggcauaccuagcucacuuuuuuuuuuucuuacauagauuuacuuauuuauucgcagagggggcauauguuaggguuacuauugcugugaugagacaccaucaucaaaagcaauuuggggaggaaagguuaaaauaaucauucacaguucaucaucaaaagcacugugggcaggaaagaccuggaagcaggcccugauacagaggccauggagggggcugcucacuggcuuacucaucacggcucccacagccugccuucuuauagaacccaugaucaccagccaaggaauggcaccgucuacaaugggcaggccucuucaucaaucauuaaucaagaaaaugcccuacaaucuuauggggacauuuucucaauuaagauuccuuccuuuuagaugacacuagcuuguaucaaguugauagagaacagguaggauaugccacaguauguguggaggucagaggacaacuuagaggggucccuucucucaucccaccauguggguucugagaccuaacuuagguuaucaggcauagcagcuggcaccucugccuaugagccaaaguaccugguucugacaugucauucuuuggggacaauaccccucuaguggcccucuuccagguaguccagccuugagcacacaauuacuguauuucacauaaaccuuccaagaccuaaaggguuaaugugcccagguuaucugaugucuacuuuuuuuagucccugauaaccagaacauuggugguccaucuguccaucaaacucuaccugaacaccaacugugagcagagcuccuugguguuccagccuaccugcggugguaaaugcagaaaugaagcccuagacucuuaacuguucccaacaacagggauauuguacuggcugggacuggguccuguuuuauugcuuauuugcugacaccuccuccccacaaugcuggggauugaacucagggccuaggcacaugcagggccaguggccaccacugagcccugucuucaguuucuucauuguuccaaacaccagccagcuucagcaucuuuugaaauuuuccugaccucaggaugguagcagugguagauaugacauuguagggcugugggagaguaacuaaaaauguacguaaagcugucagcauacuggugacacugucagcuggccuucuuaggagcauuauuaguccuuccccacauucaggucuucacacuacaccaccuuagugagccuucccugauguuuguuuuuuguuuuguuuuggguuuuuuguuuguuuguuugagacaggguuucucuguauagcccuggcuguccuggaacucacuuuguagaccaggcuggccucgaacucagaaauccgccugccucugucucccgagugcugggauuaaaggcgugcaccaccacaccuggcccuguuuuuuuguuuuuaacugucucauagcucuacuucuauuuuauuuauuuuaugugugugaguguuuugccagcauauuugucuguauaccaugugugugucuggaggaggccagaagagggcauugguucccaugggccuggaauuauagacaguugugagccuugaagccuucaugugggaacugaacccagggccucugggauagccaccaguguucuuaaccacugagccaucucacuagccccacaccacuucuguuuuaaaaguauaggcuuuuacguuauauauucaaauugcgcauuguucuacauaggcuagguucauaucugaggcuggagacagacuugcauauuaauagaaaauguggguaaccggagucaggagccccauucucagacuccaggcaugucuccuuuguggccgugagcacagcuguccaggacucugccuuuucucaauggugaaccgggggagcugcguguguaaggagugugcuaacauuguaauuugcauauaauuuugcagucaaggagggcggaggcucuuggagucuucaucuaaggacucauuaauaauggaaggaaacucuccugauuuagcgcucucgugccagcucucaggacugguaacugcuggauugucuccauccauucaugcuuaggccuuuccagugccaaaccccugacuuuacuaaaaaccgacucccucccuaauagccucccuucagucggcguaucuggcaaauggucucuuggagacaccccgcucugacuguuuuaguugaguucagagagcuuccugcacccaacauugauuuucuuugacucuagugcagcuaagauuuguuuuaauugaggggcuuauuaauauugcagcugugggguggaguggacacauuggacacugccugggaagcauuugggguuugugccccgagauuacuuguucaggucguaguuguuuaacuuugagcugaccacuccucaguccggucucaguguccuuucuggauggauuccugccuuuccuuuacugaguucuuacuggaggcaaaaugagauaaugaaauguccuguucuggccaggcauggugggggauacuuuuaauccuagcacuuaggaggcagaagagguggcucucugugacuucaaggcaugccugaucuacagaacaaauuucaggucagucagaauugcauaaugagacugucucaaaaagagugagagagagagaaaagaaagaaagaaggaaaaacagaggauuguucuugcaguaaucccuccacaaggcacgugaugugggagaacacagaguuauaagauccuaggccuuaaugcuuuggauuuuuuuucuuggaagucuugcacaagccucuauucagaaaggaguagcucaggggcagggaguagcucaaaggcaaucuugaucaauggcucacaaccaccuguaacuccagcuacaggggaauccaagaccucuggccuccuugggcaccuacacucacauggacauaucuaccaaugacggacacacauacacauaauuuagaaaggagcgggaggagaagccagccaggaccggguaguuuacugcaguccaugaguacugaguuugcuccacaauaucacacucacacaccauaaaaacagaaaaaugggccaggcgugguggugcacgccuuuaaucccagcacaugggaggcagagacaggaggaugucuaaauucaaggccagccugaucuacagaaugaguuccaggacagccagggccacacagagaaacccugucucaaaaaaacuaaaaaaaaaaaaaaaaaaaaaaaaaaaaaagaaaaaaaaaauagaaaaacggagccagcaaaacggcccugaggauaaagguaaacaccccacaugcccacaagccugaugaucagaauuugauccuuuggcuccacauggugaaaaggaagaaugaauccugcaaacuauccucugacucuucagcaagcaccaugugugugcacauaaauaaauaacugaaacacacacacacacacacacacacacacacacacacaccagacaguuacaugaaacaagugugugagaggaacugcagauacuaagaugcuaagaccaagaauaaaaauaccaaguagaaaaggcaguagaaaaggugcuauuggaguugaacugagaaauguguuuguggugcugaggauugaacccaggguguugggcgugccuggcaaaugcucugccacugagguacaucccagcccuggaaacaaacacguuaacaacacauucagaccaguggauucccucagaaauagcccauuuuagcucuugaauaaagacccagagaccuguuauuuuuauuaacaagcugcgugcacuaagcugggcaggcucggagcuauucuaagccguagccugcccaguucccagcccugggucacucuggucuguguguauccucauggcugcucucucguugcgaauccuggucccuccacauggucucuccacaccuucuccuucucgaggucuuucucaaccuucuguggucucucuggaaccucucacugggauuggaaguccugucccagucucuuuugcucagcuaauuggcugaucagcucuuuauuaaacuaauuagcauagagaagaauuuuacauaacucugagacaggugaugcuucaaaaaaauaacaauaccaaaaucuggccuguccucaaauuuccauccagaaaucagcauuugaauaaugcagagacaaucuuuacacaauguacaaaccuucccccaacauuuccuccuuuuagcccaauaaaagauucuuucucuuauauugauaaacuauauacaauaguaacaauuaugaaaacuugucagucaauuaaauuacauucacaaugucuacuccauuuguauuugguaaccuuagaaaaaguacucuauuaucuauccaucuuggugaguuuagaguucuguacuuaaaacauuuucuaucaaaacuuguacauauaaaccuaagaauaacauguuagacccuaaaacauuuucucaaauccaaaacaauuuaagcuuaguauaagacuaauuagccuucaacugugucagagaccugagaaagaauaaauacagaguaugcaggaaaugcagagcaagcagcuuccaaaacuaagggaaugacagagacagcuggcugccuggacagucacccacauucuuuucuuugucguuggagcaucuaucuucggccuucuagcccagaauaugacagacuuuuuugugaagcaauaauauugaagggcuugcccaccuugcccuugcuaaguucagcagucgacuucccugcauccuuucuguccaguuuggacagcauucuguguacaguugaagcaagggcagugucuugcccaaugucuagcugaccacaucuggaacagacucauaaggagguucuuaaugcccaucaucaucuucuucgaaguagaaugggggugcugccagggacagacaugccacugucaugagaagccuuuuauuaaaacaucucuaaaugccauauucuguagaucucugagguuuuugaagaccaucugucugucuaugauaugucugaaauguuuguuucuagcaaucuacugucugcuuaacuuugaaaacaucuauagcaagcuaaaugaaacuuauuuccauauuuaacugaacuagugucuaacaugaccauaaguuugauugacuauuaacuugcauuucuuauuuauccuaaacgguuuguaaaguagcuuucaaagggauuagaauuuaacauugcauuuuuaagaaauagguacaauaccuaaaacaagaguggaaacauauauacguaguauguuguaacaagauauaaccuuaaaucuguaucaauauacaaagucuguaccaaauacaaaauauuuggcuuauuaauggcuuuuggucuaagaguagauucaguagccgggcgugguagggcacgccuuuaaucccagcacuuggaggcagaagcaggcggauuucugaguuccaggacagccagggcuauacagagaaacccugccucgaaaaaacaaaaacaacaaaaaaagguaaauucaguaaucuaugcuuuaaccaagccuggccugcacccacucuuccaguccagaaaucagcauuugaauaacgcagagacagccuuuacacagugcacaaauccaucccccaacaaaccucugugauuuuuaacuugguaggucugucauagcagugcccgacucccggaacugacucacuguccuaguuugcuuuguacugaugggauaaagacccuggguaaaagcauuuuggggaggaaaucauuuauuuguuuugcaugauccaaucacaguccaacauugaggguaguaagggaaggaacauggaggcaggaacugaagcccagaccaaagaggacgaaaugcuguuuccuggcuugcucuuucuaucagcccagggccaccugcucagugucaccacugacgguagacuagcccccucccaugucagucauugauuaaugacuaauuaauaaugauuagugcuagaguacucaguggugaccaggguucaguucucagcucccauacagugguccacagccaucccuaacuccaguuccaggguuagcguuugcccucuuuuguugcccauggguaccagguaugcacacggcgucacaugcuuacaugcaagcagucacccauacauacaaacguucuuaaaauguuaaaagucguuaaucaagaacauauccccaccugcuuaccuacagacagucugauggaggauuuuucucaguucaaguucccucuucucagaugacucuaguuugugucaaguagacaaaaacccuagccaacacaguaauagaaaccaguuuggagcagccuuguguuccagguauaugaaauguguguucuuggacugcugagauggauuaguggguaaaggugcuugcugcuaagucugacagcuugaguuugaucucugggacccacauaauagaaagaaagaacuuacuuucaaaaguugucuuccgaccuccauacacaacccugguaaguaugugugugugcacauacacacgaacacacacacucacacacacucacacaaaugugauuaaauuuuauuuuuauuauuuuauuuuaacuuuuuuaguuuucuaagacaguuucucuuuguagucguggcuauccuggaauuuguucuguagaccagguagacucacacugccugccucugccuucuaagugcuggguuuaaagacuuaugcccuauugccuggcuuuauugguuuuuuuaagcuuuuauuuauuuauuauauguaaguacacuguaacuguuuucagacacuccaggggagggcaucagauuucguuacggaugguugugagccaccaugugguugcugggauuugaacuccggaccuucggaagagcagucggugcucuuaaccacugagccaucucgccagcccccuauuguuuuauuuuuaaagauuauuuaauaucuuguauaugugccugcgugagucuauguguaccaugugucugcaggugccugccaaggcaagaggguguuggacccccuguaaagggagucauagguggcugugaaccaccagauguggguucuaggaacuaaacucaguugcucuggaaaagcaauaagaacccuuaaccaaugaacuaccugccccccaauauuguauucuuagauuugcccaauuuuuauacauauaccaauguuucaaaaggaucauuaauucuccccaccccuaccccauauuguugauuuugaagagaaguugcccuuaggguaaugggcucucgagaucuuccuucucugccaacucagguucucccacaguugccagcuccucccaugagcagcagagaucccaagccuugggaguacaggccaaguccaugucaggacccucucuaaggugaggggaaaccagccauuggucacaccugcccugaaacagaggcuggugccuuggcucugucuuucacugacuccagugaguggcuguuucuuccacuccagguucaggugacccaaacuggcagcuauggcagagaccagguuagcagaggccgcugcugucuuagaagaugacugugaagugccugaugugccaucuauggccaguucacaguggguguggcugcauuccuguggugcuggccacuccucaggggugauguccccagacagaggcaucuagguggcuuucccuggaaucccagugguugcagccaggcugguccagacacucccugaaccuuuugugcugcuuggucccaguugccuugugcaucucuuucagaguucugagcuguucacgcugaccuauggagcgcuugucacccagcugugcaaggacuaugaaaacgacgaagacgugaacaagcagcuggacagaaugugagugagcgucucucacaagaggcagccguggcuccggcacgcugcaucuggucgguucugugaagcuaacacuugggguacacuuaugaggguguggggguguuaucccaucuccuccuuuagccgacaucaguaucgugcuuaaauauaaggcguuuugaccuugaaauggccuguucucugauuuccuuccaaggggcuacaacauuggaguccgacugauugaagauuuuuuggcacggucaaauguuggaagaugucaugacuuucgggaaacugcagauguuauugcuaaggucguuucccugggccaccugucccccugaagcuugccauuguggaccccucucacugucuccuuuagucucccaaaagauggauucgauuaggcagcucuuuggaccaaagcaaccugcuuaguccuucuuggugguuugggaauaaccaccagccaagaguggcugggcucuuacuuguguuuugcagccucgguguagcucuguguaauggcgugugccugugaucccauacaugggaggcaaacugcagaguuacagcaagucucugguuggucugcucuguaugugaguucuaggucagccauggcaacacagcaagauccuaccuacaaacagacaaagccagcgcgugugucugccucacugaaauuaaagcccaauuucguccccugugaaaguguagccgagugcuguggagauuugagagugugcauuuugggcagaugugacucaggccuauaauuccaucacucugaagacaaccguaggacaguugcggcaaauucuaggccaguauagacuguguaguaagcucugggccagccugagcuauagaaaaaaguaaagcaaagauagcccugcucagugagacuucaguucaaggcagcggccuuccgauggggcaggcaggcaggcaggcagugagucagugcuuugcuguauggugccugaaggagaaagagggaguccucgugggcgcuucucuuuccccagaucucuaaagauucagaggccacggcuuuguccuccgaccccuucccaauggcauaguugucaccguuccccauugugcuguuguguguccccgacagguggcguucaagauguaccugggcaucacuccaagcaucaccaacuggagcccagccggagaugaauucucccucauccuggaaaacaacccucugguggacuuuguggagcuucccgauaaccacucggcccucauuuacuccaaccuccugugugggguguugcggggagcccuggagauggugaguagagcaucucuaccuccuacagcauccgagcucgcuggcuguuugguagcugcauggcugagaggaggagagaaagggcuuuggcuuacccagccuccaagggaaucgugcugccgagacaagauccaagucagacaccucugccuaggcacagucccuccuuccugacacugccgagacagugcugcucccugcaaacguggacgguagcccugucucccacugguuaccuggucacagucuaagaggcuugagggcucuugcuugcuugcggugucacugucuuugguguuagaguauuggggcuggcaauccugucucugugggaaggaaucacucccuuuaaaaaaguuuggaagcuuuauacauuuauagagugaauuuuagcugcucgcgcacacgcucucucucucuccccccucucccucucccccucccccucccucucuccucuccucucucucucucucucccucccucucccccucccucccucucuccuucccuccucuucccuccuucucucucucccucccucccucucccccucccucccucucuccuucccuccucuucccuccuucuccucuucccuccuucucucucucucucucucucucucccucccucccucucccccucccucccucucuccuucccuccucuucccuccuucucucucucucucucccucccucucccccucccucccucucuccuucccuccucuucccuccuucucucccucccucccucuccccccucccucccucccucccucccucuccccccucccucccucucuccuucccuccuucucucccucccucccucccucccucuccccccucccucccucucuccuucccuccuucucucccuccuucccucccucuccccccucccucccucuccccccucccucccucucuccuucccuccucuucccuccuucucccccuccucccuccccucccucccucccuccaugggcauuucugaccuagcuucacugaggggucccacaggcuaugguuuggcaucuguccauucuauuccucagguccagauggcuguggaggccaaguuuguccaggacacucugaagggagauggcgugacagaaaucaggaugagguucaucaggcggauugaagacaaccucccagcuggagaagaguaagcaucucuaggacuugggcagccaagaggaugccugcugggaugagagaggcaggcgcucgcuuccucugccccuggaacucagugacuuuuaaacugauguuauauauucuucuaaccuuauuuccauccuccaugcuaauagagagcagacugauagucuguuugccccacaaauaugcaccucagaaggggguucuuugcuccauuucccuucagaagggcaggauguacuugcccuugguuggacuaagagagcucaaaccauuuuacauuccugugaauuuuccaaagcaaagcccacuuugaccccauuaagggacgagccugaugcaucuguuccugcgacuucaugacgccauuggcaaauggcuguagggaaucuuggguuguggaggggagggagaacgcugggaagggguggguaagaauuguuggcuguagugacacuguagucugccaggccacggaagccaguccugccggaaacaccggcuucugggaagccgcccaggucucauuccucccugcuguuuggaggcaacaucuccucuuuuuacggaggguccauccuuuuuucuuacaaauucuucaauaaagacacauucuugagugaagcccaau

SEQ ID NO: 2118 - RNA, 3946 nt, Mus musculus
cuuucacccccaacuucagggguuucuuggguuuguaucuuaagcugguggcauaguuguugagcuugcgaggucugguaucuucccuaguacuacuagaacacugauuucucaacacuggggaagaaggugcagaggauucuggcggagagcccacuguggaauuaucacuggcagacaguguacauauaauaggucuagcaguccucuggaggccaaguguuaugacuuugcaaauuauaacacuaagccuuugguuaccaccugucaaaucccuuugggauauggccgccuagacaccaggauccuucuagcugcaaaucuuaaaggaaguugguugaacuugaacaacauauuccugguugaaauaagacaaauuuauuuuauuuugguuuuucaaguuaggguuucucaguguaccagaucccgaacuauccuggacuugcuuuguagaccaaguuagccuagaacucugcauugggauuaaagguaugcaccaccaccacccagugacacagaagguguuuguuuuuuuauuuugaaagacuuagcaauccguugcuucuuauagaacccaggacuaccagcccaggaaugggcccucccacccuucaucacuaauugagaaaaaugccuuacagcugaaucucauggaggcauuuccucaagggaggcuccuuucucugugauaacuccagcuugugucaaguugacacacaaaacuagccaguacagauagccuuuuuaguacugguugaacaaucuucccucuugccuuugaugcuagaaucuuacggcaguuaggguuuagagguuaacgauauagugaaagaucguacuuagaaguucuaagccucggccaugcuuuaccaggcugcugucaauaucacuucaguaaugaugcauuggaauacuaaacggacucucauuucccagacauuguuuugacucuaggcugaggaagguuuacacgcuugggaagauaugcagagaacaugaaagaagcaauccuucaaagcagccaugucagaagauagaaggacuuuuuuuuccccuuacaguguuucuuucuaaaacaaagaaaucuuccucuggaugcccuugcaauucaggcuucaugucucacuggcucauuuucucaugccacugggaaagcagcaaagucauccuuuauaagacuuacauuaaugggacuuauccuuugcaucguaaggacuaggaagguuaguuaugucugacaagacagaagcagguaaggaccuuuggguggguaccuuggcuuauggagaguaguagagagccuucagccuuggcuccauguguucuuacagcccauguuuuauauuguguuuguugcuggugauccaaacacaagucauucuagaaacgacuggugggggcugucauuuuuuaguggugugucuucccuaacacaggaaggagacuacagacacaugaagggcuguagaauaacaguggcaguugggaagaaagugaguauucuuaaaucccugaaucucauuuggaggccucaaggccuuaccacacguuacuguaggaaguuugaaaugcacugagcauuugguauuuuaaugugcuuugucauggcgacucauguauucguguaacuauuugauacccugguauuuuuguugggugguucauguaguuuacuccuuuuuaaauuugguuguuugucuuaaugagcuaugaaagcauauaaaauucaagaaauaaguucuuuguuggagauaauauguguauauauacacauauguguacauauauauguaauuuuuccuaacccaugucuugccuuucguuaugaauaggaaaaaaacgucccauuuuuauguccaauuuauuaauguaaaguuaaauuuacugucuuucuaacuuuucuaguucaugcuuuuuuuagucguauuuaaagaaaauuugcauugucuggcugagguggcugcugggaugcucagugcacaguguucacugcuuccucugcaccugagacuuuguacuguuuuauagaucuuccuucugagaaccaucgaugccaucaggcauaagccacaguuuuauccuacuucuugagcccuauccuugaaaacaauccagccagccagccagcaaauaguuaaugugcucuuacaggacagcaacaagcauugcucugguacugaagguguggcaguuaacaagauacacaaaacuuuauguccccaagauuaggcucauuuggaaaucaguuaccccaaacaguauuuggccaggggaaagucucauacaacuuuucaucggcaagaaucuccuagaccuuuuugccucccuacuuuaaauuuuaauucaugaguuuuucauguggguuuacccuaaaacaguaaaagcaaaaguagauaggaacccaucacagauauuuguuggauuucacugacucuaaggacgcaaaucuuccuucaguguuaaaaaaggcagcaccuucgaaaagaugaaucagugguuaugaucacuggcuguucuuccagagaaccuaagugcuucccagcacccaggauggcucacaacuguuugaacaguucucaggaaucugccacccucuucuugccuccaagacaccagaagugcagagaccagacaccaccacacacauuugaaaacaaauaaaagcaugcuguuugucaccacaccauguuuuucuggaagcuaguugagcuugcauucauucaaagaacuaguuccagaaucaagagauuggggguaggauagguccuuccacaagucugagauuuaguucuuauggcuuaggucaauauggauuguauauaaucagagcuugaacaugacuuuuaagaugugcucauucaucugaggaugugauauuuuaaaagugauaagaguauuucuuuucagucaacaggaagagaggcagaauuggugugcuagauguggcuuggagucacuuccauguauuaaauguuuauuauguagucagcauauuuauuaaguaccucaaaauuguaacuauuguaaauauuuuuguuacuaacauuugggagguuuuuguuuuuuguuuuccuuucaguuuuucugaugaggaaacuaaaguccaaagauaaagugacuaauccaaaaacccaaaacggggagggaagggaucgugaaaauaaaaucuuucucaauucucuuuuuuaaaaaagaaauauaugucaaaacauuacugguucauugggacacggggaaaaauacugaaucauugcuaagcuugcaugaaguaucugguuucacgaagccaaguauuuuuaaaagacggacuauuugccggauaaugagcugggucuagucucccaaagguuccaagucagcagaaaagcaccagacuggaucggaucggggaaacuggaggcugaccaauuuagcuguaaaagucucgagucccaaggaagagaagguuuagcagguguuuaaacaccggaaggucguuuagguuccucaacguauugggagacuguuuaaacauaaacguaauuccaucugguauacauggaacaucccguuucuuguucauccguuuaaaaacuauauugaacuuguggucaccgccuagugcacgugcuccaagcggguguggcagacggagcugggagggaggaugcccuuggcuggucacccgccacucucagguaggauguaccucagguaagcuccgcgggcaggcagcgaugucgccucaagcagcgguccucacccgggaggcuggcacggggaaagcuggccucucgcucgggauugucgccgucaggcacagcgggugcagggcgaccgcccauccgcggcuccgccccagccaggcaccggcucacccgcccacagauccccagaccuuguugcucccgcaaggcucuggcuccaggcgagcugccgacccggagggagagcggggcgggauccg

SEQ ID NO: 2119 - RNA, 348 nt, Mus musculus
aggaguugaaaagucaagaauuuauugucuucauaacaaaaucggcuuagaacuggaucaccuggcccuuucucuucuugucgccucccaguucaaaaugcuugcaucucuuaauagccagcauccucuuagaucugcaguugggcucaacacacuccagucucagcacaaucuucuuuguaguuuuagccuuuuuaccauagccacucuguuuccugucauaacauacgccgcuuucccugggcauaaaaagaguccuugcccuucuuguacugugucaccuugugggccgggugcuucccacauuucuuggagaauguccggcgggucuuaggcacguucaccaug

SEQ ID NO: 2120 - RNA, 3681 nt, Mus musculus
ucucucucucucucucucucucucucucucucucucucucucuuucucucuccucuuucuuucuuuuggguuucuauauguagccuggcuguccuugaacucacucuguagcccaggcuguucuggaacucagaguuccaguugccucagccucuugagugcugggauuaaagaugugcaccaccagaacccagcuaagaggacaguuucuuauaucuuucuuuaucuccacucccaccccugcugcagccuccgccacugugccaguucccucccuugagaccaauucuccacaaauuguccugugcacaggaaggccagugcagccaauaaaucucugaaccggggcuaggugugcagcucagugguaggacauuugccuagcaugcacagggcucugggcucaauuccuuguacaguaauaagcaaaauaaacaaaaagcaaccaccccaaauuaaaaaaaaaaaaaaaacucuuaggaacaagccaacauuagggacaguggucuuagagcaagguuggaggggaagggauaggaaagguagccugggaaacugcaggagaacaggucagccacagcccucagaacaggagaacaggccacagcccucagaucuaugacagugggagaggcuucuaucucuaggaagcugggaggugagacucaguagaauauaaggcugggguagacuuugggaacacaggagauggguggacgcccugcaggugcaauugaacauacauuuacacacaccugcccuuaagucucugcaaacacacacauuccuagcacauguuucuuaugccagcacuggaacguguaagucucaacacacacccaacacaagccuguacauauaaacugauacacaugcauauauaucuuuugucucuacauucaggaauauauauacacauuccuggguaccuagccacacaugcauacauaaacacacaugccuuacauaccugcuuacauguuagcauauagauauucacuuaugcuuacuugcauacaugccagcuaauacucacauccuuccuuguguauaaccacucaaaagccugcaaaugcacacacuugugcacacacacacuugugcacacacacuugugcacacccuuagcccugguccuggugccugcaaggugcuucccucuguugcagacagcggauaagcuccuuccgguuguccaggauggugucaaagcucucuugcagucgggccugcuggucgaccaacuggugcugcagagcccggauccacuggagcagcgccaagcgccgauacaucaccaaaugcgcgugguguuucuccuucuccuguucuuuguagcgcuccugagccugcagcugcugcacggccugggccacggagggcagaaggggauccagagggcucggaccucgagggguaucgcagacagguucuggacugcugcugaagcugucgaugcucaaggaacugcuggcauagccaauguccuccagaggagagcagacacugcuggcaccgcucaacuucucuggcucagcaccagggaucuccgcacccuccgggggacugcggacuccggccucagggagccugguggcuuggaagaccugguuaucagagggugacucagaggagcuccuuaucagaauaggauccacuuugccuggcacaccaugccaguucuuauuggcauccuuagcacucuccacaaaguuggaguuauugucugguuggaggucugguuggcauacuccaggaggcaggcucccuggguacugggcccccucugcuaguccuggcuggauggcagcgaacaucuggacugggaaggagaaggagaaugagacagagcaggacaggauagaauggcaaccuagagcccaagaaccuugcaauggugucccucccuucucucugauuauuuggucugucucccucccaggguuuucccucuaaggcucaccaucucuucacucuacaaacuucucccaaggucacuucauccuguuauagcuucaagaaccauccuguguaggugacucucagaucuguguccagcccagauucaaccccuacucaacccuaugaccuaccaccaguucuucagaucuacacauccugacagcucuccuuccaggguccuugggcaggacagcucugccaucugaagacaagucuaucuagccaugccuaggagcacccuggauuacugacccuccucccaugcccaccucacuguccacauuuugacaaacucuccuuuggcccuggucauuuugaccugggugauugccacagccuuuccacugacccucguucaauuaaaaauauaaauuuaggagcuggagauauggcucagcaguuaagagcacugguugcucuuccagaggacccauguucccaagucagaugguuuacaacuguaggcaucgcuggcuucacaccagcccccaccccccagccucucuguucacccacaugcaugcaugcauacauacacaugcacacacacagauaugcuaauauuuuuuuuuaaaaaagauguccuguuaaauaacaaauaauacuuguaaaaggaacauaugucuacaucuauacagauguauagauauagacagguauauuucauaaguccacagaaaaccacaaacauuuccaugaugucucauaacaguagcaaaauuacaguuaugaaauaggaacaaaagcuaagugguggcggcgcacgccuuuaaucucagcgcuugggaggcagaggcaggcggaucucaugagauugagaccacccuggucuacagagcgaguuccaggauagcaagagcuacacagagaaacccugucuggaaaacucagaaauccaccugcuucugccuuccgagugcugggaucaaaggcgugcgccaccaugcccggcuacugaccacauuuguaugacuugaagaacugaggccucgugagugagacauacuauuaagucaaucaagcagcuacuaagaagguuccccuauaggguggcagcgacccuccccacacccagcaaugggcagaagucaugaagagagacugagguugggacagauguuucacuccuuuggcuugugagaaaaggccugaagacaccaccaccaccaccaccaccaccaccaccaccaccaccaccaccaccaccaccaccaccccaccccuccaacucucuuucccucucccucucuuaaaauuuguccuaaaucuggccacaaaggaagcugggguggggcggggcuaaggauccagguucaaaaagucagugaaaugagugcagacauccuaagaucaggauuuucccaaguuaacccacaguaugggggcaugggagcggcuguagcacggggauuggcggacuuggcagugguccgagcucugcgacccuaaucucugcagaggcagcucccuaacccgcuuuccggcggcugggccccaagcccuccaucagggcccggacucacggccuagaggcgcccgcuccugcggggcuugcuacggucccucggguccugcucgcugcagggugggggauuccuggaccugcgcgugcacgcguggugacgcggcugcuugguccaggcacagcggcccuagccccagcccgggcugcggaguccagcagcgucugcgcggcugggcggagcggucugacccacg

SEQ ID NO: 2121 - RNA, 32088 nt, Mus musculus
ugacugggccgucgcgcgucuugcgucacccccagcucaguccgggugugcugucucacuggugaggucguguacccgggaagugucccuguccguggccucugcagccucccgcuucccggcaccauggaguaccucauuggcauccagggcccagacuauguccucgucgcuuccgaccgaguggccgccagcaauauuguccagaugaaggacggugagaggaagcagggggaggcccggcgggccuggcuggaggggcagucggcgggaguuggugaaggggaccgugggccucccucugggcagcuuggaagauggagcccagugugcucugcccugcuggcacugcaggauugagaagccgggggagccggcagacaagcuuagggcucuaguuugggauucugggucagaugaggcuugcuaggugagaguugcucagcgugagggaauuaaguuuaugagagcucaagugugugcccggcgccuccaauuucugaauuucuggcaaguuucagucgccccagauagaaguuauaauuugugggugcccuaaggugggaucuuggggagagugagacuccccagaguuuggcauuuccacucugcuuccgcugucuucaguggcucaccucagagccucuuccgccuuucccuggcugcuagauuuuacuugucguuaaauaguggaaugcagcagagauggccucucuuuauuugcucugugaguuuuguacguuauuuuuuuucccgugcccagauuuucuuaucucucaaauuacuaauaaccaacucaaaacuuguugagaggauugagugaaggaguuagcauuggacaaacacuuaacaaacugaagcauauauguaucagguguguccaucguuaacauuuuaauuuguuaaaaguuuggcucuacuaugugcccuucuugcaguuaguuuuggagacagaauauguauaacuaagauguauagauauaguauauauuauauauaacacacaugcauauauauguguguguguguacauauaugugugcguauacauaucuauguauguguauauauguauguguguguguguauauguguguauauguacaaaacuuucuuaaggagauguugaaauaacucaguaguaaagaugcuuuugcccaggcuucacaaccggaguuuggucccagaacccagauggcagaggaagagaccccaccccaacauccugcagguuguccucugaccugugcaccuguucuguggcaaugugcaccugugcagaacaagagagagagucucuaaauaaauaaauaaaaauuuuaaaauuaucaaagaaaaaguuucuaagcuuacaggugguagaaccuagguucaaaucuguguaauuugggacugagucuacaauucaguggcaacauauguuucgaccauauacaaggccccagccucagcacuccaaaaacaaguuaguagacauuaugcaaaaugaucucuuuuacccuuaacaacuucacuaccuuuauagugacaacugacccacagaaucuugaguguuuucaugacugaucauaggcauguuacuguuugaaagauaucuagcuuuuguucaguggauuaaaaguucauuugacaaguuucaugccucucuguguucuuuacagugcuagggacugaaaagaggaagaaaaaaaagaauacuauguaguugggaagauaguugaguaggucagugugcuugcuguguaagcaugaagaauuuaaauuccaaguacucacuuaaaagaaaaaagaucaaacaggcauggcugugucccuacuugggagcaggaaacacagauccugggagcucacugaccagucagucagucagucaggcccaaagggugagccucugcugcgugagaauaaggugagggauggccugauguccuucucugucccgggugagacagguacacccauacacuuaugugugacacacacacacacacacacacacacacacacacacacacacaauguuaguaauucaguaaaagucagauguguguuaaaauaacuguaacacaaacuagaaaguauuugcugaguugagacuagagcagucaagcuuuggagacuuaagaagaagaggaggagacuuuagggauggaccguggggagagauuagggaaagcuuugaaagugaagagcagugaauccuagaucccaggaggaaaaaggcuuagaucuggagcuccuugaagugcguugucagaacugaaaaagcacaguugccacaaccgaucucacaaagcaaaggcaccuaccuaucuggugugagccuggcgcuuccaucuggggauagagagagaaugcugugagcuuugcuugcauucuguucuuucugaaggacuugaaaucagaccucuaugguauuaauugucucucaagagacuuuaugaaauuuuaugauuaguuuguagaaguuauuuugugagccagucuccaaagguuuaaguucauuuugagaguaaauugguccauugcuuugacagcaggugauuuuagcaugaagaguagguggagcggaugucaaguugcggggucucuguuuccucacagugacuguguggauggcuuugaaaaggaggaugugcuccaugccuuuauccauaaauguuacacgggauucaagccaagacaaggagagccaggcauagcgcguuccuauaauuucaucccauagacaggaaugcugauuucuaguuggaggcuagccugguuucacagacauuguaggaguacauacugagucagccagucugucugucucugucugucuuuaaaagaagcaaacaucgaagaaaaaaaaccaagcaauaaauacaagauguuuuuuauguguuagaaguauuacuaguuaguguuaggcuaguuuuuaaauuaaugauguuagaaguaaguuguuagaauaggcccagagaacaaaaagauuauuguaugggaaaaaaagauggauuugaguaguucuuuaaaaagaguuguaaauaauuguacucaacuaauaaccuuucucugguaugaaaaacuuaggguaggaguuuauaauugucugagggaauuuguguggcauaguuaagaaugcugaacagaaguaauuuugagggagacguuuuggcucugugaaauggagucuugcuauguagcucugacuaaccugauacauguaacagccuccaagaccuagaguacuaggcaugaagcaccacacugguucacacugccuguugucauuuuucaucaugcuacuugggaaaauauguugauacuaggaaagagauguuuuccaaaaacuucuugcuuauacagcuaacugguacagcucuccauuugguuguaaaugugccacauuucaugccuuuugucucuuggccuaaacagaaugacuuuucuccucugagacaggguuucuuuguguagccuuggcugucugagaacucacucugcagaccaggcuggccucaaacucgcagauaucuugcugccucacccuuucuagugcugggacugaagguguucaccaccacgccugcccagcggcagaaugacuuuuaaauuacucugaugucuguugugacuuccuacaaccugugugauacagacugcauuucuaacacugaguguaacagguuuccuuaucugugaguuagacuuugguaagugauaguuacacuauuuuaaauaguugauaaccagaguuuagacaggcaaaucacuuucccacugugucugaccagaacgaugucuaguggguucugguuaguuugacugcauggcuuaucauguugauacucauuugguuauguguguuuguggaucuuguaaguuuauugacaagugaagaccuuccucaaacuacaggcagcuucuuguacaacucaggaccaugcguauccaucaguucuguucugagacgucaccucuugcuauucacugagcguguucacgguuuaaacuaaguaggccugguuuacauuuauuuaauaauuaauaguucgcugccuugaaucuuagccucuuuuaugaagugugacauaaaacuuauucucccuagaagauuacuuuugcuccaauauuuaguguguauaugcacacagacuugucgcagcacauguguggcggucaggggacaacuuggaggaguuauuucugucuaccguguggguucuggggauugaguuggggguggggcaaggccuuuaccugcugaacuguauugccuaucugcuuuuuuuccccuuaaaaacaaugcaaacauauuaaguaauuucucuuacaaaaaugaaacuuguuaacuauagagauuuagaaaauacugauaaauaaaggacggaaauaaaguuugcucagauucuugccacugucaagaauuuagaauauauacccuucuggucuuuuucuuugcaacauaugucuaaaugaaucuucuuuuuagaacaauuuugcaaacuaacagucuuugaauguguaacaugaaaauuuguuuacuugggaauuuuaaggcaauucaacauuaucuaucuauaggcguguuuuaugugggagccaccaccaggccagacacccacauuauuacuaucuacaacucuccaacacuuguagaguacuugguaguugcauuuguuccuuaaauccuauuaagagauuuugacauuucagaagcuuucauacaggaaaacaugucucccaggggagauuauucagcacuauuagaaaaaugaaaagugaaagucggguaagauaggaagaauaaagcuuuucucugaagcugcaaacuaaauacugcguuuccuccccaggcaacaauuacaaccugaguaucugucuguuuaaucggaguacgucugcuuuagcuagauaaggcuacagcauuacgguuuucauuaguuacuuagauaguucacuguuagcacauucuuuaaagugucugcuuuggcaaccaguuuucuuuuuuucuuuugauaugaagcugguuuacuuuauacauuaauuuggguucucagcugauauuuuuuucuucuuucuugagaagguucuuuaacuguagaauucauucuuuucaccguuuuuauguuuauuugacauuuguauuaguaguaauguuucagaacucuggacuuaacucuugugccucuagauaauccccauaaucuggauuccuucgcuguuucucaccuucccauucccuguauuuuaaauguucuuaaauugucuuuguugcuuguuuguuuuugucuuuucaaaucaagucucacugugcaggcugcccuguagcauacuauguagaauaagcuggccucaagcuuauagggcucugccugucuuugcuuccagaguguaaacguaucuuuuauucuccugauauaauugucaucucugagguuuacugccucugucugcuaaccuaggccuaauccugggaucuucuauccucuguacaaucuucuggcuccuucucauucucuggcuuguucuguuuuuaccugugucuagcuugcucucucuucaaccugucucuaaacuguccugcuaaaacugcuucuccccacccccaaccccccuccacccuuucugugcugcucucuaaguaguuucucuuucccuuucccucucuugagaguucagcguguccuguucugucaagucuuugucugguuugccacuuugccgcgaguuagacaucaauuucaagcaugggugcuuccuucuacaaacuaauuuuaccuucauuguuugggauuaaaggugugucuguauuucagccagaggaauuaaauguguuuucuaagggcugagucacaccacaacuagaaaaagguuuuuuauuaaauaacauaaucucgggguuuguagugugaucaaauauccugcaacaccagauugcauggauuaaagccaagcuuaaauuuuauuuuuucauuaaguaaguaagugguagagauugaacucugggcuucucacacacucagcauaugcuauaucacugagcuacaucuauagccccaaauuguaauuuuaaaaaauauuuauuuuuauguguauaggugcauguaugucuguauccaacauguaugcaauacucugaggucagaagaggguaugggauuccuggaacugaaguuauagauggcugugaaccugaugucagugcugggaucaccugggucauccacaagagcagcugugcucuuaacugcugagccaucuuucuagccccaccuuuuccugcaauuguaucuugaauagucugcuuucauauauaauuuucaauauaaauuaacauuaauaaaauauguaguuaaccuguuggcucgugaaacuauuaaagucuuauaauaacaaugacuguuuucaguauauacuuaauagacccguuuauacuugcauauauaaauagcuuuuaguuucuguggucaaaguuucuaauaugaauuucuuuuccuuugagcagaucaugacaagauguuuaagaugagugaaaaaaucuuacuccuauguguuggagaggcuggagacacuguacaguuugcagaauauauccagaaaaacgugcaacuuuauaaaaugcggaaugguggguaagaggguagcuuuggcuggugcauuaguuuucuagggucaccacacaaggucccauagccugggcaguuuaaacaacagaacccuuucauagcucuaacggcuacaguugugaggucagggaauuagcagagcugaauuuuucugaggcuuucucuuuggcuuguaggugacuuuuccuguauucucuauccaaaucuccuauuauaaggacaccauucacauuggaucggagcucacccucauaaccacauuuugacuuaauugucucuuuguauacuaucucuagauacagucacaguuugagggucuaugauuagggcuuuaguuuaugaauuuuuggaggaugcuauucaguauauguuuaauuuugaacugaagauggguguucuuuauugacagucuuacguacuguuggauugaugggaucacaguuuuucauuuaacucuuccuaccuacuuaaaaaaaaaauuagaggcagguauaugaccccugaguuuuacacuagacuaaucugcaaauugaguuuucaaaauagucaguacuauacagagaaacccugucucagacaaacaaaacaaaaaaaucuagaaccuaaauucuaauuguuuuguccuuaaagauuuucuacuaacauucuaucguaacacugauauauugguguuacaaugcaagaaaucagauuuuuuuuuaaguccuuuguuuuauuucauguguguagguguuuccuugcacacauguuaguguaucacaugguggccauaggggccagaagacccucuggagcuggaauuacagaggguucugggcuucgggaauuaauccuagaucaucuggaagggcagguccugcucuuaacugcugagccaucucuucagcuccgugacuuuacaguaucacauauagcaagucauuuguccucucugggacuuuauuuucuuuaucuaaaaugggauuauacuuauguuaaugagcauguuuugaugaggagugguggugcaugccuguaaucuuaccacuuggaagaugggggcaggaggaucaaagguuaaaggucaaauucagcaguucagcuacacagagagugugaggacugcaugagacccuggcucaagaaacaaaacaaaauagccagacagugauggcacaagccuuuaaucccagcacuuuagaggcagaggcaggcuaaucucugugaauuuaaggccacccaggucuacagagugaguuucaggauggccaaaacuacacaaagaaacccugucuuaaaaaaaaacaaaagaagggcuagaaagaggcucaguguuaaaagcaccgacugcucuucugaaggugcugaguucaaaucccagcaaccacauggugacucauaaccauccguaaugacaucugacacccucuucuggggugucugaagguuucuacaguguacuuauguauaauaaauaaauaaauaaaucuuuuuaaaaaaaacuucuagguuuaaaauuuuaaaaggggaaaagaaagaaagaaaagguuuugacuggcuuggggauauagcucuuuggcagaguacuggcugagcaucuggcugaugccauggguguaaucuuagcacugcacaaaagaaaaaaaugcuuuaugauuuuuguaauuauaagacauuguacauuuaaaagcaucuucuggggcuggagagauggcuugagcugcuuuugcagaggaccagaguuugguuccagcacccacaugauggcuuacaaccgucuguaacuccauuccaggggaccugacacccucuuuggcaccagguacacaagugguacagaccaaaccacucauacaugaaguaaaaauacaucuuuaaaaaaaagccuuagagucaggcgugauggcgcacaccuuuagucccagcacucaggaggcagaggcaggcggauuucugaguuagagaccagucaggucuacagcuuaaguuccaggacagcccgggcuaggcagagaaaccuuuuuuggaaaacauaaagacuuagaauacagcuuagguuuaaguuuuauaugguuacuuauguaaaaugacuaaauuaauauccauucauacauguuuuuaggcaguauauuuaguuagcauuauucccccaauagccuaaauguuuugaaggucuuucuuaccaauauucagcacugugcuuaauacuguagaaacuuacugggugaucaagaccccgccauucaggaccuaaaagcaugcuacuugggauuacacauacucaggugaagggucugcgaugcuuccgagcuguggugcugccucaggacagcugagggagugcggagugacuaaggugaacaggaagggucgcuuguuacgcguguauuaggugcuaagucagugcccagaagaaaaauuguguuuguuuaaacuaacccuuaaagacucuuaaguuagucacuuuauuaaguacaguuuagaagauggagguugaaggaucaggaguucaagacuauccucaguuguauaaugaguuugaggccagccugaugacuggagacucgaguuacaugagaucauguuucaaacaacauaaauaaauaaaaauggcuuuuaacaaugaucacaguuauaguuaggguaggugcggugguacacaccuguaaucacagcauucagaaggcagaaacaggucaaguuuaagaccugucucuaaagagaaaauguauagagaagcgauuugggugaagacuguuacugucuucugcgucccuucaagugugacucuuuaugucuuguaccaggauaugaauugucucccacagcagcagcuaacuucacacggcggaaccuggcugacugucuucggagucggguaagcagcuugcagccagccuucaacagcagaaagcugugcuuucacauuccuguuugacaugaacaguaguuuuggcauuuuugacuuuccucaacucuucucauugcuaaucauucccuuuuaguccccuuggguauguuuucucuuuggguauugcugcuuuuuacaaucuaaaucugucgcuugggaggcuaaugaaggcuaauaaacuccaggcuagcccgggcuauucaaugaaaauaugccucugguuuuuuguuuuuguuuuuuguuuuuuagauuuuuauuuaucuuauuauguauguaaguacacuauugaugucuucagaaacaccagaagagggcauuucauccuauuacagaugguugugagccaccaugugggugcugggauuugaacucaggaccucuagaagagcagucagugcucuuaaccaccaagcuaucucuacaggccaaauaugccuuauuuuaagaacaaaauuaaaaguguuuuaacauuuauuuugcauguggugugggguggguauggagguaggagaacaguuacaagagcugguucucgccauccacuguggccugcagggaccaagcucaggcgggaggcuucguggccuuuacuugcugaacugucucucuggcccaaaaggaagguuuuuuuguuuguuuguuuuuguuuuuuaauuuuguuuguugggguauacuaacaugaaggacugugauaaacuaccccccucccagagacuuuuauuuuuucucagcaauuuuaggcucacagcaaaauuaagagaaaaauacaaauauuuuccccauauaaacucagcccagauacacauacauagcauccuguauuaucagcaucuaccagaaugguguauuucuacaauuaaugaaccuauauugacagcguggguuuauaguuuauauuaagauuuacucaagaggcaugcauucugugaguuuagauaaauguguaaggaccuaaauccuucuguagcauguagaauauuuucacugcccugagcguccucugugccccacccauucucuucaucugcugaaccccuggcagcaucuaacgcucuuacuguuugcaugguuucccuuucagacugucauagcauagaguuggcuucuuggugacaugauuuaaaguuccuucacauagggcuggagaaguggcucugguuaagcacacuugcugcguugcagaagacuugaguucagucccuggcgcccaugguacucaguucacaguaaucugcacagcugcaggggaucugaugccgcuggcuucuucaggaccuguacucauguacaugaccuacaugcagguguaugcacaaauaucuuaaaauagacuuccuccguguaacccuggcuguccuggaacuuugucuguagaccaggcuauccuugaacugauagagaucugccugucucugccuccguagugcuagaauuaaaggcuuguaccaccacuacccagcuggguuauuucuuuaguacugaguuauauuccuuugucuaaguguacugcaguuuauauauccuuuuccuacugaaggauaucuuaauugcuucugguuugaggcgguuuauauauggaauuucuuuagauguguuugcagcuuuuuuggguaaauucuaaggaguaugauugcugguuuuuaugguaagaauauguuaaauuuuguaaagaaaguaccaaacauuuuugaaguguuuuuauuuuuguugaacuguagcugaaggucccugcacgguaauggagguauaucuuucugugacuguuuagccaaaguauggggaguuaucuuuuuuauucuagucuuguauauuguaguguucucuaucacauguaaaaggaggcaucauuuauuuaaagauuaaaugcuuaaagauuguguagaauguaccaagaaaguucacgugauugucaaggguguauguuuucccuacgggggcuaaguaaauagucuuaccaugugacuucaccccaugugccuauuuauucaucuaugauauccagauaacuuccuaaccccacaggagugccaggaaaaugaauguuuguaaaucauaauauuuagcauucauaugacuuuugcccaaagcauucugcuuaauaauuuaaucuacucacuauuccacugagacaaauuguaguugauucucuugcugauugagugaaaagcauaaaguggcagagggacuaguucagggcacauagcaggucagacaaagccaugguaauuggaccaugauuugacuguuugccuuaagguggacucuuugauucuucaguagcaguuuagaaaauuagugcucuuggugauugggguuucaucugccuucuuaaacuuagucaugugucaucagaacaaauguggguauuaaguucuuuauaaaccugcuugcuauggauuguuuagaagacuuaguuuuaaagacguguuuguguuucuguguaugaaugugugcauaggagugcaugugccuaaggagaccaaugacauugaaucacuccagagcuggcuauaaauaucaggcugugagccaccugauauuuauaaauaucagccaugugugacauggauguugggagcaguaaggacucuuaaccaaugagccaccucuccagaccuacuguagaucucuaaaguacuuauuucccagugccuaguauuagaccccaagcaucucacuaaggaggaucugucccacugcuugcuuugaucacgugcuuugcagucucagugaucuauaaacaauuuuuacuguguaucuuuugccugcauguaugucuguguacuauguucaugcaagugaucauuauauuugagaagaaaucagagacauaaugaauugcaagguacagacauauuuacauacauuauuuugaucugggugaaaaauuugggaucuuuuauuuaauccuugagggagaauugugggucaaauacuagauuuccuaccacccagaagugccugaauucuugaaggagugugugugugugugugugucauggcucccuuuguagaauguuccucugauuuaccaagcagaacuggaauaagaauuccagcuuugggcauaauaaaagcuuuaccauuaaaugcugcagacauuaagugaauuaaucuccuuuuagaauugagauaaaguggaaauuugcuucaugcaaauguaguagugaaucuaccuaaucuucuccagugacagagauguuugauguuuugaacaaguaaauguccuuugcagacaaugacuggagcucuuaaguggugauugccccugccuugugcugcuuuggucuucuaguuccuuaucaaaguagauuguaaaauaagaauuuguacuuuaguuagaguuuuaguuuuauguauaugugcgugugugggugcacaugcuuccacauguguguagguaccuagggaggugggguuaucguuacggaugcucaugagcugggcaaugugggugcuaagaagagaacucagguccucugaaagagcagcaaaugcucuuaacugccgagccaucccucuaaccccaguacuuuauuuuauucuagagagagaaaugauaaucguuuuauguauuccuuauauaaugucacuauguuugguauauuuacaugguaacauugguuggcacaugauacauauuuuggguuagccagauuuuuuuuuuuuuuuuucgagacaggguuucucuguguagcccuggcuguccaacucuguagacuaggcuggccuugaacuuagaaauccgccugccucugccucccaagugcugggauuaaaagcgugcaccaccacgcccggcuugguuggccagaucuuauguauaugaaauuucauauagaugucuauagcugugagugugugacuucauuuacucuaugugugugcgcaugcccaugcgcucgcuugguugcuuacucaugcuuacuggugguaucagguuggaggacauuuacuacagagugcauaaucaaucuuauaugaaauggaggcaauuggaaugugguugaauaauguucagacaauugcuagcuguauguaugucuuugaacagguucuaagcucaacuuuccuauuuacaaaaugauaguacuucauaggauuauuauaaggauuaaaacagucaugcaaagcucgugguacacuauauaaaacauguaaugaauggauuuuuuuguuuuguucuuguuugguuuaagcaauuuaauggcuauguuaucuuuauagggaauuaauuguugaauuauuuuaauugaacugauaagauacuaaagugggggcuauaggaauuuauuaguauuaauggacaauguagaaauaaucuaacauugaacaucuguuucauguuaauauuuguucuagauuuacucaguaugugugaaccacuaacuauaaaggguuauuuaaauuccaauuaauuaaccccucccucccaugccaucugccaccauuauugaaccuaggaccuaaucaaauauuucaaugcauuuuauuaaauaagaaagucgaggaagauguguaauugguuuuguuuuguuuuguuuugaguaagaaaguuacguuucuuaguuuugggguuuaauuagccauaggcaugcuaacuacauguucugucacugagccacuacacuccaagcaccaacauuugugugugugcacauacauaccauggcauagcuguggagcucagagggaacucuggggagucaguucuuuaaucauuuaggucagggauugaacucagacuauuaagcuugguagugaaccacuuuaaucccauugagucauuuugccuacuggccccacuguggcauuauuuauaugacuguauugucugauucccuugagcuccuugucagugaugagguugagguaugagccagcccgcucucguguccuugggacuguggaguuuuauguugaaccaucagcaggaugcuggcuggccucuguaguguggagucuuccaggcuuuacuaccgccacugaacggucagugcuuucauagaacguuuucugacauaagccuuuggggggggguacacacgcauguguguuucucucucucucucacucacucucucucuuucucaugaauacuuagcaaauaaacaauaaaaauaacgaaaaguaucaaacuugacauacuggcuuucagcucuaguuccauaaauugccauugaauguguaccaggaaagccuagcgagauuaaacuucagcuuguucaugcauauugacucuccuuucaucuuucacauguaggaauuacauguaaaaguuuaaccugaaaaaagggcuucaccuuucuuuucccccuguaguuuaaaaucuaauaguuagaaucugccgugggagguuuagaccugcucuaccuacuaugagccaguugaaaaugcugagagagcugcagcugauuggaucagaucgcacaucuacaggucuagugguagggaguguugcucagcaauagagcaugaauuuacuuagcuaagcccuagguuuaauccuggguccaagaaaauaaacauaaagaucugaugucaacacuugauacaguuuuuucagugaaaggaaaagaaauguaggaaagaaaaucuuuacuuuagaaucuugaaaaucuuuuacuuuagaagugaucgcugcuuaucucugcucagcaugugaguguauuuguuuuggguaagggggugggcagauacagagagcucccuuccaagaauccuguugcagugaggcuucugcacugaaguuauucucuccaggccuuauguggcugguguagagaccaucuccuguuuauggguauccuugggucaugugacccagggaacagcugaaccaggugaaaccuugacuuugcaagucuuauccucuaaacccaaccaagcauuuguuacaugugauuaaaauaucacuaacaaggguaauuucucgugcuuuuuuggcaaauguguuuagcaggaugugacaugacgaagcacugccauuuccucucugugccaucucccuugaggccucaucuuccccgcucgcccccaucuugccgugcccaggcuugccuuccagcucaccugcuccagauggguggcacagugggaggacacuggcaaaggcagauguguuuauuuuccagagacaaaauguugagcuguugcagauggcagugccuuggagcaaguggcagccuuugacaccacugccacacagccugggcaucuugacagacagagcuggcuuacucuuggugauggggaaacugaagagaaaaacaaaauugaagcuguuaaucaauuccuggacuuuuggugcaaguagcaguuuucugcugguggggaguaguuuucuucccccacaauugccucagucagcuagucggcuaacuggacuuucauugugggucgggaguuaaguguguuugugacaucgguagaacagacuaaaagcuggaacagggcuccauuuagauagguauucuaauuguaacugcaaaacauaucccacauauccacauaucccaggucacagcagucuccuaggauuggggacggcuccugucugccccacuggagaugcuaccguucuauuuuuaguggucauuuugauuauucaaaggcccagggacaggugugccuugaaguugagguaccuuaauuaauaugauaacacuaugcuuauaguguuuuuuuaccagagugaaaauucugacagcuguccuuuuaaguaguuugcuuauuuagucauuagggcuugacuaaguccauuaagacaaagagugguuguugaaucauuaugccuacuggcuccuaaggaaaagaaaauggcuucaaaauggcuuugaagcuacuggcuuuauuugaaaacccuuuuccccacuucuuuaaaaaaaaaaaaaaauuaugugguguuuuucccagccccagugcugauagaguuaggaguuugcagguguaaaguccuccccuccccuuccccaucucucuccagggggcuguaugugagaagguguugcuuucucacucagagagcauauaugugcuacccuguuggaugccugcugugagcagagagaaccccuguucuggcugaaagggauaagccuauuggauggcuggaguuguacaaucccauaaugccaacuuuucaccuaaaauaacuuuccuaagcacaauggaggugaaauaauauggguaauugguuuaaauuuauauuguuuuaaaacauaugucuuuaaaaaugaugugguuuccuuuggagguuugcuguaggcuagagcagcagagugcagcgucugcuuaguaagagcaguguuuaccgcuagaaauaccaauuuacccuaccuuuuacgaucacuuuaaaccagugcccuagucgggguaggcacacuugugggcaaacccuaacacucggacaggaacacaauaagccccggcuuuuuggugacucuuuaucuuugcagaagcacauaguguuaugaauguaaggacugguuccaaaacccuuuuuauuaucugacaaaaaauguauguaaacagugaaaaaagacuuugaaguagaggaagaguuugcuuuuuuauuucuuaaccuggaaaguaguuacauguguaucuauuguauguauuaagcuauacauguauguuuuauguguuuauauguuauucauaaaaggauaauuugugaaaagacaaaggaaaggcuaaacaaggaagcauaacauuuuuaaguuaaaaaugagaaguuaacacuuuaguaaauauaaauaacagacuggaaagaagaaagggaagaggcagguuauaauuccugugugcuaauugccucugugugucugugugugugucugugugugugucuguguguguguuagggagcugaggaucaaaauuagggccugugcuugcugggcagaugcucaccacugagcuaaacccccaaccccaauauagucaucucugaguaacuguaauguagugcuagaaucucuuacuucccuuucugguucccuuugaauaggggugguuuuagagccaagaugcucuuuaaucacugguagucguuuguccagcaguucuccagccugcacugucuuuggggcugaggaaacagguacaaaguugaguaugugccuucagguggggaaauggagaaguguaaaagucacuuguacugcaaagugaaaguguaccuggggugucugggaacagagcuaagcuguguuugaaagacagaagggagacuggaagcacagagcagggugugugagagcauguuagugcugcggguguucagggcaacaagagacacuucugauccacucacucguaauucucucuguuuuaaguacuaggguucaggguacaaauuaguguauuacugauuuuuuuuaauguaaauagaugacacauucucuuaguauauaaaagucuguaguuuggugaguaaggcugagugguuaaggaggacccagguuucaguaucuguaucacagcucacaagcaucuguaaccuaaguuccagugacucugauucccuuugcuggccuccuuggguacaggcguacauccaguauacauaaauacaugccacagacacaaaauaggaauaaauaaaucuaaaagcacaaaacaaaaaagcaguggggccuuucugaaaagcuguugguuagauuaauuggcugcucuuuggacuguuugaggaaagaauugagguaauaggggaauuaugagcccacauauccacuguggcuauagcauacuuaaauuggacaugagguguugauagggaacacucuucucacagaaugguuccuaaauagucucuuuuccuuaggaauucaucguuacuuucauuuacacuguucacaucugaaaacaccuacaaccuuauauauucuaaguauucucucccaggagaccauacugucuguuaacucagggaucuguuacacauucagcauugcuggauaauauggacaugcucaguauagacaucuaaugugugcccaguguugugugugucugugugcagcaaagcauggcuucugcauuuggguuuuaggaaccacuugaauauacgaggagcccagcauuuguccuagaaacuacuggucccugagaaaggauccaggcagcagcugcagacguuuggugauuuugccauugcagggucagcaauuuuauuuugauguuauuugggagaaagcaguauuuuugauuagcaaguaaaauuaauguagaaaacaaauacuguguuaacuaguugguauaauaaggcaucugugccauguugcauuucaacucauuaaauuucucaacuucuaauuacaguaagguuacagcuuuuaauagaaucagccaaacuugagcuuagcaauggcuuuagagaaauaaaauugauaacauuuuguaugguaaacuuuaaaauccaauuuucuuaaaauaaacguugaaauuauaugcuacuuacuuaauuucuuuuuuuuuuuaaacucauacaauucagauuuauuuaguacuuacuguucucuucuaggaacuuuuaaugcagguaagcacugugauucuucauggcaugauugucauuugaaguguauugcuuccuuuguucuuaguguagcauaaacauuuauagacauugaguuacuagagaguaaacauagggccucauacaugcuagggaaaauuugaaccacugagcuguacccgaaaugguuuaugucuuuuggcuugaggcugcuguuguuucuuucaagacaggauuucucuuuguagcccuggcuauccuggaacuugcuguguagacuaggaugaccucaaacgcagagacccaccugccucugccaccaccacccagcugguuuuaguuuguaagauuuuuuguuuuuaaauuuguuuuauguguauggcuaguuuauuuuuauguauuauguaugugugccacauguaugccugcucccuguggaggucagcagcaguugucagauucuguguaacuggaauuacgagugaugugaacagcuguguggcugcugugaauugaaauugggucuuuugcaagaacgagugcucuuagucaucucuucagccccagauuuaauuuauuuuaaaugucuuuuagacuuacuuauuuuaauuuaguguauaugaguguuucgccugcauguguaucugcauaccacaugugugccuaguuccugaagaggucagaggagggcaucggauccucugggauugagccaccauguugguguugggaucagaccuagacccucuuuaagagcaacagguguucuuaaccacugaaccacuuccugaggcaaaauuuauauauuuuuaauuauguguauugggggcagguacagaggaguguaaguagccuuggaggccagagaugcuggauccccuggagcuagaguuaugaauaguugugagcggucacugaugcugggaauugaccucugaauucaucugucucucucccgcuucccucgcucuucucucuauuuaaagaaagggucccucuauaguccugguuggccaggaacucacuguauuguguagcccaggcuggccuccaacucacauagauucaccugcaucugccuucugagugcuaggguuaaaggucauguuccacaacaccuaauacaauaugcacucuuaaccaccaagccaucaauccagaccuguguuuuguuuuguuuugcuuuguuuugguuucucuuuuuucucccucccuccuuccccucuuuccuuccuucuuuucuuucuucccccaaacaagguuucucuguguaguucuggcuguccaagcuggccucaaacucacagagauccccuugccucugcuuucaagugcugggauuaaggacauucgccaccaucacccuaaauuuauguguaugugaucauguggauagaggucaaaagacauugacugucuuccucagugcuguguuuccugguuuuguuuguuugcuugccuccuugcuuguuuuuaaagguaaaaucuuucuaacuugggacuuagcacauucagauaaacuggcuggccaugggcuucauggacuucugcugcccgccugaguacuccauaucuacucccauccccuucggccacacguuaguccucaguaucugccaucuagacuacuagggaacauucaaauggucccuuuuauuuuauccuaguucaucguacauauaaaugucaguuacuauccuaaaauaguaaaauuucacuucuccucugagguuacauacuauugguguuucuucuucuucuucuucuucuucuucuucuucuucuucuucuucuucuucuucuucuucuucuucuucuucuucuucuucuccuccuccuccuccuccuccuccuccuccuccuccuccuccuccuccuccuccuccuccuuuucacaaagauuuauuuauuuuauguauauaguacacuguagcugucuucagacacaccagaagagggcauuagauuacauuacagaugguugugagccaccaugugguugcugggauuugaacucagaaucucuggaagaacagucagugcucuuaacugcugaguuaagcagcuuaggcuggccuuaaauguaauguuuauuaggguaacugaauuccuaguaccccugcuuccacuucccagaugcugcuacaggcuugcaccaccacaccugguuucuccugagcuagggaucaaaugagacuuguugaauaucuucucguuuccugucuuguaacuccagagaacuuuuauaggauuugauuaaagguuuuauaaacuguuuaauacuuaaaguuagaagagguugacuguacacauggucuuguuuggauguguuggcucgugccucuaaucucaacacuugggagggcugagacagaauugccacaaguucaaggcaaacauggguuauugagacuccugucuuauggaaaugauucuuaggaguagaaggccauaauaguuuagauuaaguaaaacuauuuaaucacaauaauuagaaguuguuaaauuuuaaaauguuuggagugaauuuuauucuaaauguggaaaucuguaauuagggcuagcaagauagugcagcaaguaaagaugcuugccgucaugccuuggugugauuucuggaacuuaaaugguauuaagacauaauuagacucccgcagguguccauguguguacuguggcacacucaugcacggacaaauauuuuaaaucugcuauuaaaauggcagaauuagaauuuuuaaauuauucucugaaaccacccagagguauaaauucuguugacuauugagaacaagcuccugauucgaaguucagagcacugguguggaaaaauaauaauugauucgaucugcuuaguaaugaagguaaaaauagauaucagcaaagcauuugguaucacaaguauuugcuaaacaacuccuacagaugcuuggaaacuuuuagaagaauuacugcugugacaucuccuaagaugauauuggucacaauugaaauacagaacaauaggugcuaguauaaaaaauuggggaacauuugaguaugaaauucacaccaaauauugaauuuaccuaauuuacuguuauuuccauuuuguggaggcagagugguuuccugggaaagcacauggggcuuaauacuugggaagaaugacuccagguccugacugaugcuugggacccaugugcacugcagccucuucuuugagcauugagccgcacguguaagagggaugcuggagaagcucgguaagcucagcucuccaaguguacaaacuacauuucaugagcuauccuaggaugaaagauggccucuucaagcaugggcuggcgaaucucugcugaagcgugcauuuagcaugcagaagacccuguguuuaaguccucccaccaccugcaaauaguggccacaguguucuuuuuuauauauauugucuguuuagaauauuuagaaguccauucauuacaaugcucaucucacuugucccauggugguuuaguaucuacuuccaccuuacugacccaccaggcauagaaguagacgaauucccacacugcuuagauuggccccaaagaaacugcaucguucuucaagucccucagucauaguaaugucaucccauucaauuagagguggcagaggcuggccuggcuccaaaagaagacugucaauuccucucccugucuguguccacgcucggcaggaugcuuccucacgcccaccucucucccccuugcugugacuuuggcuuccgccagaugucacaccgcugcuugucaccgcccagacucuguagucgcugauuuuguuguuucaguguguuugucacaacuguucuccuuagcuguaaaauuuauggaauuucaagcacuuguuaaucacuacaguguuucuuuuuccugauagaggaaacagacaaggagucguaugcacaaaaguuagaaggaagggaaugguccaucuaauuuaagcaagucucuguguaugauacacacucuccacuuccaaaaguguaagaaucucaggagaauggagcuuggcucuguaguucucgggugcggagacacuucugcaggaagaaguacauaaaagauccacuuuauggaugagacccaguucaauguuacccccuuggcaaccauaagaaaguagagaauucucugugauagcaucuucuggauuuuuguauuaucuagucaaagcuuaaaaaugagcaggugggguuauuuagguuuugauauuacugcauauaggcauuacacugggugcuucacauguauuuaagccucaggaaaauuuaaaauggccuggaucucuucacuugguaaauaagcucaugucugaccacacccccacacaccucaacacaugcaccuggaauaagggguuuguuuguucuuuuguuuuuuguuuuuggggggggguuugguuugguuugguuugguuuugggguuuuuuguuguuguuuuugaagacagaguuucucuguguaucccugguuguccugaaacucacucuguagaucagacuggcuucaaauucaagagaucugccugccuccgccuccgccuccgccucugccuccgagugcugggacuacagguguagaacacuaccuccuggcccagaggcaaaauuuuuuaguugaguaugaugaugcauguccauaauccccacacuggagagaugagacaauguuuacaaguucaagaccagccuaaucuaccgggugaguuucagaccagccagggcuauauaauaagauccuccugucucuaccagcuucccaaaaagagaaaggcagaauuguugcaauaucuuaguccagaggcuaaaagcuauuuuuaaguccccagaaugauuuauuugauuuuuuuuuccuuuauauauuauacacaauuuuaaaaccaaacauguugguauuuauaaacuguugguggugauucucgggcuauuauuaaggaguguggauucauuuacaagauggacaguugaauauuugcauuguuuaaaauauauacaacauuccaucucagccuuggcuauagaacauggcuaguggucuaaugcacaggucuuuacuggcagacagaccucuuaacuuugucuuaugucuuugacagaauagagguuacuugcuaaauuguuauugguguuugcacuucucaauaguuaggcugauucuuccaugugauacugugcacggaaaaguacauaagcuagagaguaaugcuuaggauagacacgucugcaagagacagcauggaaaugcuuaauaugugucgacuagguuuccaaauaacaggucacauuuuuuucuggggaccuaggggagacugaccauaacacuguaaguaagauaacacucugucuaauaucgcugucaaccuuagggcguggguaaggaauccgaacguaaaggcuaagaaacuuuguguuuguuuguuuuuucaugacaagguuucucuguguaacucuggcuguccuggaacucacucuguaaaccaggcuggccucgaacucauagaucguuuuccuaccucugccucccgagugcugacccugagguguguaccaccacggucugcugagacaaugaaacuucauuuacugcuuuaccugcauguuccagguaacgugcugggcacuuugaggaaacaucucucugaauccuuuuauaaagauacauccuggaaggaauuuaccuugugccaggagugcuugggcuuccuaauuacuuuuaauuucaucgauuaguuuauuuccuugauaguaauaucuaccacuuaucaggccugucccugugcuuuagauacuugucaagcauuaucucugacccuucacugcagcccuuuuguacuaggccuuauuuuaguugagcuucuagaauucagacuuuuccuaaaguaacauauuaauagaaccagaauucaaacucauguccaggacuuuguuacauggcuuguuccuuccugaguuguuuuuaugcuauuaguuuccucuuuauuuauuacauaaugucuaacuugcuuccuaagcuuuuuauccuuagcaacucaugucuggagggaaguuggaaagaggcaacagaucugcuugcuuauggagaugcagacauuugacuugaacuugaaacacuucucagaaauggggcuuuggggacuggagcacuguuuuuggcagaggaccugguucagcucccagcacccacauggcagcucacaacuguagcuccacuuccaauggauccaauaccccuucugaccacugagggcucuugucuacaugugcugcacacacauacacucagacguauacacauauauuuaaaauaaauauuuuuaaaagaaaaaguagugucuaucacaucuuugcuuugauuuaguuguuaauguuugcuuguaauauuaagcauuaaccauacauaauaaauaaagcgugcgauguuuucucugguguaugaggacucacucauuuaacaaauguuuauuagcuacaggcuguguaccugucugucauugaacaagacagaaguacuccugccuucauagaguuuauaauacauaaaauauuugugaauaggugaauuguauacuguuucacucaucacaccacaagaagucacgcuuguguaaguuguugaauacaagaacuauagaaacuuagagcuauuaacuuuuguguagaaccauucagaauagcacacaaaugaauuacuuagaauugaucuaacuucaggaaaacagugacaacauacaaaaauuuguuugaaaguuaaagaaaaaacuaagaaacuagauaagucaaaaagucuuagcuggagcuuugucagaguuucugaaagugcaguugucacacagauguauugacuuaauuagucgauaacaccgcucaguuaugcuucagcaucucacacaugcacaaguugguaacucgaagucacacaauauuugugaguuaucuucuauaccacaaguuuuagugucugacuaccaacuucucugaguguauauaagaugcuuaagcauaaauaaauuauauuauguagcucaagugagaaacacaguugcuuccgaacuuguguuugcaugggguuucuuauaaaaucuucuggugauauggauuccuaauauaccauacaacuuuguaaaacuguuuugguuaauuguccuaaggguauucuagcugcauggaguugggaagagugagcuauauauauacuuggagaaaagauuaaacuuacucugugauagguaagaaguuuaucaugccagguggcagaagcaggcagaucuuugugaguucaaggccagccuggucuacagaauguguuccaggacagcuaaagcuacacagagaaacccugucugggaacaccccaaaagaaaaagaaaagaaagaaauuguaucauacaugcucuuggagaagaaugcuaauugaagacacuuggcuauucuuuaucucccuauccccaauuugucuccuaauuuuaacuauaagaacaucacaauauucuaugucugugagaauuuguaguacuguucucacacuuuauauauguuuuuauuuuuaucuuuagcuaacuuaagcagagcuuuuguuguucaaaguaugaguuacauagaaagguuaggauguagcuaacauucuagagauguggguaacaguuccugagcacagucaaguacagcacacugacugggaauguggugggccaguagcucuucucccagaacuccucacuauuaguggcuaagucuuauuuuugugagcugucuacuauuuuauucgauggauaggcaccuguuuggaaguuggagcucauguaauuuucaagggacauuagcaacuuccuacuuaguagaacaacugggcuaguaggauuccaguaggguuauucauuugcucuaccacgagugucuucaagccaccaggcgcccuuauuggucagugugcaaagaauguguagugucccuuuuggauccauugcuuguuccaaaaucauguuucaugguauuucauuuuauugaacacaggcauauguauggggagaggcacaaaccacagacaaggcuucauugaugccacugaagcagacacacgaacaaacaaaaagaaaacccacaaaaugggauucccaccacuagugccuggagcguagacagggugaauuuaauauggcaaguacucagcugauacagaaaaaguaauccuuuggaaaugaaagcaaggcagacuuagucaagacucacuguaauaacuugugguuuuacacuuggagguaauaugaagacaaauacuaaugcaagucacagccauuuuuuaauguuucauugaugaaaaguagauuuuauucaucuuaaaggagucuuguuauauuagaaagguguugggcuaaugggauggauggcucaguaggaaaaggugcuugcugacaagccugauaaccuuagcucaaucccaaaacccacaugguggagggagaaagccaaccccacagaguuguccuccaaccuuuacugacacgaaaauacaauaaguaaguggaguuuuccaaaaagaaaagaaaaauguuuuacaugcucacauauauaugauaaauaaaugcaguuugugacuucagcuuaaauauuugagaccguuugauaccuuguuuugugaucaaggcuuuaugugguaugagauguuuguuuuuguuuuguuuuuguuugugagcuaugccucacucuguugcccugacuggcuucaguccugaacuccuggacucauuagcuugcuuauuuugaaugacaugauuggacucagucucuggccugacacauaauuguguuuguuggucucuuuuguuguuguuguuguuguugucguuauaguuuuaguuguaguuguuugaaauagcgucucaauuuguagcuuugacuuaucuggaacuuacagagaucugccugccuuugccucccaagugcugggauugaaguauaggccauuauuccagguucucgguuucaaugaaugaaaccaaguaaagaaugacccaggaacaucuaagccuuugaagugguuuuauaucaggcucuuaacacccccucugcgcgcguggggggggggggagagaaggagggagggagggaggaagggagggagggagggagggagggagggagggaggggaagguuuuaggccuggcuguaagucaagcccccuuaccugcugagccuugucaacucuccauaccagguucuuuuuccauaggcuuuaaguagaaacaaaaaagcuuuuuguuuuaccucugacaauacuagaaguccuccagauagguguuuauuuuuauuuccacugugauuuagucaauguucuuauuugucaagagcucucauccccacuuugcugugugcuuccuuugcagaccccauaucaugugaaccuccuccuggcuggcuaugacgagcaugaagggccagcccuuuacuacauggacuaccuggcagccuuggcuaaggcuccuuuugcagcucauggcuauggugccuuucugacucucagcauccuugaccgauacuacacaccuaguaaguacuagcacucuagggagagagcagugcacagcugugcccuuagcuuucucagucuuggaguuggcuggcuaugcccuagguagaggacagcuccucucuagaagcuguucucucuuuuguggaucaaugcagucuucaaaaaccuuauugauaaaagucuucccgaccaccaaaauaagauacuccugugucuggugcuggguuuugccgugcugaaguuagaugcuggaguggaugucagcgugagugagagcucuucuguccgguucucuagcuucacucucguucauucuccucccuaggugauuguuaacaucucagcuguagaaagugagccaagcaguuuauguuuugaacuugugaggacuucuuuguuuaaacaaagcuuuugaaggccauucuuaccugcauauaaaauuguuucuucccuuguaucuaaacugauagcuugacaaaacuugggauaagcaguguuuuugugcugaguucugucuucugacacgaaucucaugcucucuguagccacuguggacagagaggacuugaauccagcugucacaggcuaggacugcagcaguuaaccacucucuccuuacgcucccaucucccugucagcagcaugacaacuggcacaguuuuuucuuuuugaugcugcccucauacucgaccucagccaugcuagagcuccaggccacguccugaaaagaauuagccuggccuccuggugacugucuccugauuuggcaucugucaguaauacagcugauucccccaccaaaauaaccagcagccacccuugaagccuaaugcauaauaugucaucccaguuagccaugccuaccaacaaucccuuuggaucccgucuagaagccccaagcccauccucuaauugucuucccauuguuaagcugagacccagcugggagaguaaggauggaacucgagccuugccccucucccugacuugcagcuggcaaaggcagauggaauugauuuaagcccuggacuaaaggauuggugagggugagccaugaaaaagaggggcuggcugcuggacuucuucagaggcagguccaggccgggagacagaauuccgucaugcuuacccuccucuguagcaaaucaauucguaauggcucuugaccgugggagcacugggucuggggcgcccuccucugcauguggaguaagacugucguaggcuagaaggcuggacacguuuugucuuuuccaauuguguggccccccgaccugaggaagcugaaacaagcuguugagugcaggacacagacagccuucagugcucagccucuguuuucucuuucagccaucucacgugagagggcaguggagcuucuuaggaagugucuggaggaggugaguagcucccagggcauccuggaggaacggcuucucucagucugaagcaucguuccugaucuuggcugcuuuuuucugcuccuugccagcagguaguaauaagacccucugaccaaaugugaacuugcuaccagugauggaggcugaugugggugaugggcuuauucucucaugggucacugccucauuaauggcagguuuacaauuuaauuacaauuaaauuaaguuaauuacagcucauuucuggaucauccagacuagugauucuuaaaauucacuguagguaagaauuaucuuggggcaccuuuccuuuucccuggucggccccagcacccaguucugaaucuucuguaguugguggagacugagucucugguuuuaacuggcaaccaagugauuuuaauacuggugcugaucaggccuuugccguaagagagaggccgucuggaugucagacacucccuacugugccgccuagaaacucugcuccuuuaacugugcauuuggaugacccuggaaagcaccugggaaguuuugggucagagguagagaaaaaucuuuuguuuggggaggccaagaaccccaaaucugaugguugcaguaagaguguaaggauauaggauaaaguggccaaaacucgccuuguuguuagaccuugucauucuuuuauuuuucucauagcuuaagaaugggaaugaaguaaguguccagugagagcaggggagaugaugggugucagucuguguguuucuuagccauucagcugagaaacaguauuacccauaaauauucuaagggguagccgggaagaagacacuauaauaucagguggucuugaaauuuuauuucccuuagaucuuaaaaaaaaauuagagucaggcauggaaguacaugccuuuagucccagcagucaaaaaucccagaggcgugugggugaauuuuucuguguuggagaccgacuugguauacauagcaaguaucaggccaaccaaggcuacaagugaguccuugucuuuaaaaaaaaaaaaacauuuuuaaaggaaaccguuguuugcuuauugucacccuuucuugaacuuugaccuugauucuagauaugagccgacagccagagagaacuguggaaaugaaauagacuguuauugccugguccucggccgcagaggagauggacauuagggcgggcggucagaagccugaggucauuuccaaauagucucccaaggaaguagauggagagccgaugucuucuggaggcucuuagagagguguuuagcaaggacagccacagaagugaagauuucugagcugcacuucucaguagucagcuuccauggguguagacuguuccucuagagcagccuuuaccuggacugggagggccaggauucuguggacagcaucccagcaucccugcagcuacacacacucccuuauauagcucuucucacacagggaaaugacuacauaaacuguugagaccuaagauagccagcccguguggguccagacuugguucuuuguuccuugcuagccgcuaccugaagacuuuuuaaagaggcaaguguguccuuguaagcugauuggugucaggcugugggggugaacauuggauugucuugugcaccagcugacugaccagagucaggcucacagcuaccauuucacagaacuuggucacuaccuuccagucagccuccagcuacuuucuagacacucuuccauggcauaguaccagcugccccuaguagaauauugguuugguuucacaaagagagguuuuacacuugacauuuucucuuagaacagaaccugccacaugguuaguauucaguaaauguuugcugacagauuucuuucaugucccugcagcuccagaagcgcuucaucuugaaucugcccaccuucaguguccgggucauugacaaagauggcauccacaaucuggagaacauugccuucccuaagcgggacuccuaacgucacguccuucccucccacucaccagggaacuuuuuugaugggcucauuuuuuuuuuuucuacucuuuugacguucacucuugauagaugguuaauucaaaauaaagcugaauauagcuaaauugauc

SEQ ID NO: 2122 - RNA, 32088 nt, Mus musculus
gaucaauuuagcuauauucagcuuuauuuugaauuaaccaucuaucaagagugaacgucaaaagaguagaaaaaaaaaaaaugagcccaucaaaaaaguucccuggugagugggagggaaggacgugacguuaggagucccgcuuagggaaggcaauguucuccagauuguggaugccaucuuugucaaugacccggacacugaaggugggcagauucaagaugaagcgcuucuggagcugcagggacaugaaagaaaucugucagcaaacauuuacugaauacuaaccauguggcagguucuguucuaagagaaaaugucaaguguaaaaccucucuuugugaaaccaaaccaauauucuacuaggggcagcugguacuaugccauggaagagugucuagaaaguagcuggaggcugacuggaagguagugaccaaguucugugaaaugguagcugugagccugacucuggucagucagcuggugcacaagacaauccaauguucacccccacagccugacaccaaucagcuuacaaggacacacuugccucuuuaaaaagucuucagguagcggcuagcaaggaacaaagaaccaagucuggacccacacgggcuggcuaucuuaggucucaacaguuuauguagucauuucccugugugagaagagcuauauaagggaguguguguagcugcagggaugcugggaugcuguccacagaauccuggcccucccaguccagguaaaggcugcucuagaggaacagucuacacccauggaagcugacuacugagaagugcagcucagaaaucuucacuucuguggcuguccuugcuaaacaccucucuaagagccuccagaagacaucggcucuccaucuacuuccuugggagacuauuuggaaaugaccucaggcuucugaccgcccgcccuaauguccaucuccucugcggccgaggaccaggcaauaacagucuauuucauuuccacaguucucucuggcugucggcucauaucuagaaucaaggucaaaguucaagaaagggugacaauaagcaaacaacgguuuccuuuaaaaauguuuuuuuuuuuuuaaagacaaggacucacuuguagccuugguuggccugauacuugcuauguauaccaagucggucuccaacacagaaaaauucacccacacgccucugggauuuuugacugcugggacuaaaggcauguacuuccaugccugacucuaauuuuuuuuuaagaucuaagggaaauaaaauuucaagaccaccugauauuauagugucuucuucccggcuaccccuuagaauauuuauggguaauacuguuucucagcugaauggcuaagaaacacacagacugacacccaucaucuccccugcucucacuggacacuuacuucauucccauucuuaagcuaugagaaaaauaaaagaaugacaaggucuaacaacaaggcgaguuuuggccacuuuauccuauauccuuacacucuuacugcaaccaucagauuugggguucuuggccuccccaaacaaaagauuuuucucuaccucugacccaaaacuucccaggugcuuuccagggucauccaaaugcacaguuaaaggagcagaguuucuaggcggcacaguagggagugucugacauccagacggccucucucuuacggcaaaggccugaucagcaccaguauuaaaaucacuugguugccaguuaaaaccagagacucagucuccaccaacuacagaagauucagaacugggugcuggggccgaccagggaaaaggaaaggugccccaagauaauucuuaccuacagugaauuuuaagaaucacuagucuggaugauccagaaaugagcuguaauuaacuuaauuuaauuguaauuaaauuguaaaccugccauuaaugaggcagugacccaugagagaauaagcccaucacccacaucagccuccaucacugguagcaaguucacauuuggucagagggucuuauuacuaccugcuggcaaggagcagaaaaaagcagccaagaucaggaacgaugcuucagacugagagaagccguuccuccaggaugcccugggagcuacucaccuccuccagacacuuccuaagaagcuccacugcccucucacgugagauggcugaaagagaaaacagaggcugagcacugaaggcugucuguguccugcacucaacagcuuguuucagcuuccucaggucggggggccacacaauuggaaaagacaaaacguguccagccuucuagccuacgacagucuuacuccacaugcagaggagggcgccccagacccagugcucccacggucaagagccauuacgaauugauuugcuacagaggaggguaagcaugacggaauucugucucccggccuggaccugccucugaagaaguccagcagccagccccucuuuuucauggcucacccucaccaauccuuuaguccagggcuuaaaucaauuccaucugccuuugccagcugcaagucagggagaggggcaaggcucgaguuccauccuuacucucccagcugggucucagcuuaacaaugggaagacaauuagaggaugggcuuggggcuucuagacgggauccaaagggauuguugguaggcauggcuaacugggaugacauauuaugcauuaggcuucaaggguggcugcugguuauuuuggugggggaaucagcuguauuacugacagaugccaaaucaggagacagucaccaggaggccaggcuaauucuuuucaggacguggccuggagcucuagcauggcugaggucgaguaugagggcagcaucaaaaagaaaaaacugugccaguugucaugcugcugacagggagaugggagcguaaggagagagugguuaacugcugcaguccuagccugugacagcuggauucaaguccucucuguccacaguggcuacagagagcaugagauucgugucagaagacagaacucagcacaaaaacacugcuuaucccaaguuuugucaagcuaucaguuuagauacaagggaagaaacaauuuuauaugcagguaagaauggccuucaaaagcuuuguuuaaacaaagaaguccucacaaguucaaaacauaaacugcuuggcucacuuucuacagcugagauguuaacaaucaccuagggaggagaaugaacgagagugaagcuagagaaccggacagaagagcucucacucacgcugacauccacuccagcaucuaacuucagcacggcaaaacccagcaccagacacaggaguaucuuauuuugguggucgggaagacuuuuaucaauaagguuuuugaagacugcauugauccacaaaagagagaacagcuucuagagaggagcuguccucuaccuagggcauagccagccaacuccaagacugagaaagcuaagggcacagcugugcacugcucucucccuagagugcuaguacuuacuagguguguaguaucggucaaggaugcugagagucagaaaggcaccauagccaugagcugcaaaaggagccuuagccaaggcugccagguaguccauguaguaaagggcuggcccuucaugcucgucauagccagccaggaggagguucacaugauauggggucugcaaaggaagcacacagcaaaguggggaugagagcucuugacaaauaagaacauugacuaaaucacaguggaaauaaaaauaaacaccuaucuggaggacuucuaguauugucagagguaaaacaaaaagcuuuuuuguuucuacuuaaagccuauggaaaaagaaccugguauggagaguugacaaggcucagcagguaagggggcuugacuuacagccaggccuaaaaccuuccccucccucccucccucccucccucccucccucccuuccucccucccucccuccuucucuccccccccccccacgcgcgcagaggggguguuaagagccugauauaaaaccacuucaaaggcuuagauguuccugggucauucuuuacuugguuucauucauugaaaccgagaaccuggaauaauggccuauacuucaaucccagcacuugggaggcaaaggcaggcagaucucuguaaguuccagauaagucaaagcuacaaauugagacgcuauuucaaacaacuacaacuaaaacuauaacgacaacaacaacaacaacaacaaaagagaccaacaaacacaauuaugugucaggccagagacugaguccaaucaugucauucaaaauaagcaagcuaaugaguccaggaguucaggacugaagccagucagggcaacagagugaggcauagcucacaaacaaaaacaaaacaaaaacaaacaucucauaccacauaaagccuugaucacaaaacaagguaucaaacggucucaaauauuuaagcugaagucacaaacugcauuuauuuaucauauauaugugagcauguaaaacauuuuucuuuucuuuuuggaaaacuccacuuacuuauuguauuuucgugucaguaaagguuggaggacaacucugugggguuggcuuucucccuccaccauguggguuuugggauugagcuaagguuaucaggcuugucagcaagcaccuuuuccuacugagccauccaucccauuagcccaacaccuuucuaauauaacaagacuccuuuaagaugaauaaaaucuacuuuucaucaaugaaacauuaaaaaauggcugugacuugcauuaguauuugucuucauauuaccuccaaguguaaaaccacaaguuauuacagugagucuugacuaagucugccuugcuuucauuuccaaaggauuacuuuuucuguaucagcugaguacuugccauauuaaauucacccugucuacgcuccaggcacuaguggugggaaucccauuuuguggguuuucuuuuuguuuguucgugugucugcuucaguggcaucaaugaagccuugucugugguuugugccucuccccauacauaugccuguguucaauaaaaugaaauaccaugaaacaugauuuuggaacaagcaauggauccaaaagggacacuacacauucuuugcacacugaccaauaagggcgccugguggcuugaagacacucgugguagagcaaaugaauaacccuacuggaauccuacuagcccaguuguucuacuaaguaggaaguugcuaaugucccuugaaaauuacaugagcuccaacuuccaaacaggugccuauccaucgaauaaaauaguagacagcucacaaaaauaagacuuagccacuaauagugaggaguucugggagaagagcuacuggcccaccacauucccagucagugugcuguacuugacugugcucaggaacuguuacccacaucucuagaauguuagcuacauccuaaccuuucuauguaacucauacuuugaacaacaaaagcucugcuuaaguuagcuaaagauaaaaauaaaaacauauauaaagugugagaacaguacuacaaauucucacagacauagaauauugugauguucuuauaguuaaaauuaggagacaaauuggggauagggagauaaagaauagccaagugucuucaauuagcauucuucuccaagagcauguaugauacaauuucuuucuuuucuuuuucuuuugggguguucccagacaggguuucucuguguagcuuuagcuguccuggaacacauucuguagaccaggcuggccuugaacucacaaagaucugccugcuucugccaccuggcaugauaaacuucuuaccuaucacagaguaaguuuaaucuuuucuccaaguauauauauagcucacucuucccaacuccaugcagcuagaauacccuuaggacaauuaaccaaaacaguuuuacaaaguuguaugguauauuaggaauccauaucaccagaagauuuuauaagaaaccccaugcaaacacaaguucggaagcaacuguguuucucacuugagcuacauaauauaauuuauuuaugcuuaagcaucuuauauacacucagagaaguugguagucagacacuaaaacuugugguauagaagauaacucacaaauauugugugacuucgaguuaccaacuugugcaugugugagaugcugaagcauaacugagcgguguuaucgacuaauuaagucaauacaucugugugacaacugcacuuucagaaacucugacaaagcuccagcuaagacuuuuugacuuaucuaguuucuuaguuuuuucuuuaacuuucaaacaaauuuuuguauguugucacuguuuuccugaaguuagaucaauucuaaguaauucauuugugugcuauucugaaugguucuacacaaaaguuaauagcucuaaguuucuauaguucuuguauucaacaacuuacacaagcgugacuucuuguggugugaugagugaaacaguauacaauucaccuauucacaaauauuuuauguauuauaaacucuaugaaggcaggaguacuucugucuuguucaaugacagacagguacacagccuguagcuaauaaacauuuguuaaaugagugaguccucauacaccagagaaaacaucgcacgcuuuauuuauuauguaugguuaaugcuuaauauuacaagcaaacauuaacaacuaaaucaaagcaaagaugugauagacacuacuuuuucuuuuaaaaauauuuauuuuaaauauauguguauacgucugaguguaugugugugcagcacauguagacaagagcccucaguggucagaagggguauuggauccauuggaaguggagcuacaguugugagcugccaugugggugcugggagcugaaccagguccucugccaaaaacagugcuccaguccccaaagccccauuucugagaaguguuucaaguucaagucaaaugucugcaucuccauaagcaagcagaucuguugccucuuuccaacuucccuccagacaugaguugcuaaggauaaaaagcuuaggaagcaaguuagacauuauguaauaaauaaagaggaaacuaauagcauaaaaacaacucaggaaggaacaagccauguaacaaaguccuggacaugaguuugaauucugguucuauuaauauguuacuuuaggaaaagucugaauucuagaagcucaacuaaaauaaggccuaguacaaaagggcugcagugaagggucagagauaaugcuugacaaguaucuaaagcacagggacaggccugauaagugguagauauuacuaucaaggaaauaaacuaaucgaugaaauuaaaaguaauuaggaagcccaagcacuccuggcacaagguaaauuccuuccaggauguaucuuuauaaaaggauucagagagauguuuccucaaagugcccagcacguuaccuggaacaugcagguaaagcaguaaaugaaguuucauugucucagcagaccguggugguacacaccucagggucagcacucgggaggcagagguaggaaaacgaucuaugaguucgaggccagccugguuuacagagugaguuccaggacagccagaguuacacagagaaaccuugucaugaaaaaacaaacaaacacaaaguuucuuagccuuuacguucggauuccuuacccacgcccuaagguugacagcgauauuagacagaguguuaucuuacuuacaguguuauggucagucuccccuagguccccagaaaaaaaugugaccuguuauuuggaaaccuagucgacacauauuaagcauuuccaugcugucucuugcagacgugucuauccuaagcauuacucucuagcuuauguacuuuuccgugcacaguaucacauggaagaaucagccuaacuauugagaagugcaaacaccaauaacaauuuagcaaguaaccucuauucugucaaagacauaagacaaaguuaagaggucugucugccaguaaagaccugugcauuagaccacuagccauguucuauagccaaggcugagauggaauguuguauauauuuuaaacaaugcaaauauucaacuguccaucuuguaaaugaauccacacuccuuaauaauagcccgagaaucaccaccaacaguuuauaaauaccaacauguuugguuuuaaaauuguguauaauauauaaaggaaaaaaaaaucaaauaaaucauucuggggacuuaaaaauagcuuuuagccucuggacuaagauauugcaacaauucugccuuucucuuuuugggaagcugguagagacaggaggaucuuauuauauagcccuggcuggucugaaacucacccgguagauuaggcuggucuugaacuuguaaacauugucucaucucuccaguguggggauuauggacaugcaucaucauacucaacuaaaaaauuuugccucugggccaggagguaguguucuacaccuguagucccagcacucggaggcagaggcggaggcggaggcggaggcaggcagaucucuugaauuugaagccagucugaucuacagagugaguuucaggacaaccagggauacacagagaaacucugucuucaaaaacaacaacaaaaaaccccaaaaccaaaccaaaccaaaccaaacccccccccaaaaacaaaaaacaaaagaacaaacaaaccccuuauuccaggugcauguguugagguguguggggguguggucagacaugagcuuauuuaccaagugaagagauccaggccauuuuaaauuuuccugaggcuuaaauacaugugaagcacccaguguaaugccuauaugcaguaauaucaaaaccuaaauaaccccaccugcucauuuuuaagcuuugacuagauaauacaaaaauccagaagaugcuaucacagagaauucucuacuuucuuaugguugccaaggggguaacauugaacugggucucauccauaaaguggaucuuuuauguacuucuuccugcagaagugucuccgcacccgagaacuacagagccaagcuccauucuccugagauucuuacacuuuuggaaguggagaguguguaucauacacagagacuugcuuaaauuagauggaccauucccuuccuucuaacuuuugugcauacgacuccuugucuguuuccucuaucaggaaaaagaaacacuguagugauuaacaagugcuugaaauuccauaaauuuuacagcuaaggagaacaguugugacaaacacacugaaacaacaaaaucagcgacuacagagucugggcggugacaagcagcggugugacaucuggcggaagccaaagucacagcaagggggagagaggugggcgugaggaagcauccugccgagcguggacacagacagggagaggaauugacagucuucuuuuggagccaggccagccucugccaccucuaauugaaugggaugacauuacuaugacugagggacuugaagaacgaugcaguuucuuuggggccaaucuaagcagugugggaauucgucuacuucuaugccuggugggucaguaagguggaaguagauacuaaaccaccaugggacaagugagaugagcauuguaaugaauggacuucuaaauauucuaaacagacaauauauauaaaaaagaacacuguggccacuauuugcagguggugggaggacuuaaacacagggucuucugcaugcuaaaugcacgcuucagcagagauucgccagcccaugcuugaagaggccaucuuucauccuaggauagcucaugaaauguaguuuguacacuuggagagcugagcuuaccgagcuucuccagcaucccucuuacacgugcggcucaaugcucaaagaagaggcugcagugcacaugggucccaagcaucagucaggaccuggagucauucuucccaaguauuaagccccaugugcuuucccaggaaaccacucugccuccacaaaauggaaauaacaguaaauuagguaaauucaauauuuggugugaauuucauacucaaauguuccccaauuuuuuauacuagcaccuauuguucuguauuucaauugugaccaauaucaucuuaggagaugucacagcaguaauucuucuaaaaguuuccaagcaucuguaggaguuguuuagcaaauacuugugauaccaaaugcuuugcugauaucuauuuuuaccuucauuacuaagcagaucgaaucaauuauuauuuuuccacaccagugcucugaacuucgaaucaggagcuuguucucaauagucaacagaauuuauaccucugggugguuucagagaauaauuuaaaaauucuaauucugccauuuuaauagcagauuuaaaauauuuguccgugcaugagugugccacaguacacacauggacaccugcgggagucuaauuaugucuuaauaccauuuaaguuccagaaaucacaccaaggcaugacggcaagcaucuuuacuugcugcacuaucuugcuagcccuaauuacagauuuccacauuuagaauaaaauucacuccaaacauuuuaaaauuuaacaacuucuaauuauugugauuaaauaguuuuacuuaaucuaaacuauuauggccuucuacuccuaagaaucauuuccauaagacaggagucucaauaacccauguuugccuugaacuuguggcaauucugucucagcccucccaaguguugagauuagaggcacgagccaacacauccaaacaagaccauguguacagucaaccucuucuaacuuuaaguauuaaacaguuuauaaaaccuuuaaucaaauccuauaaaaguucucuggaguuacaagacaggaaacgagaagauauucaacaagucucauuugaucccuagcucaggagaaaccaggugugguggugcaagccuguagcagcaucugggaaguggaagcagggguacuaggaauucaguuacccuaauaaacauuacauuuaaggccagccuaagcugcuuaacucagcaguuaagagcacugacuguucuuccagagauucugaguucaaaucccagcaaccacaugguggcucacaaccaucuguaauguaaucuaaugcccucuucuggugugucugaagacagcuacaguguacuauauacauaaaauaaauaaaucuuugugaaaaggaggaggaggaggaggaggaggaggaggaggaggaggaggaggaggaggaggaggaggagaagaagaagaagaagaagaagaagaagaagaagaagaagaagaagaagaagaagaagaagaagaagaagaagaagaagaaacaccaauaguauguaaccucagaggagaagugaaauuuuacuauuuuaggauaguaacugacauuuauauguacgaugaacuaggauaaaauaaaagggaccauuugaauguucccuaguagucuagauggcagauacugaggacuaacguguggccgaaggggaugggaguagauauggaguacucaggcgggcagcagaaguccaugaagcccauggccagccaguuuaucugaaugugcuaagucccaaguuagaaagauuuuaccuuuaaaaacaagcaaggaggcaagcaaacaaacaaaaccaggaaacacagcacugaggaagacagucaaugucuuuugaccucuauccacaugaucacauacacauaaauuuagggugaugguggcgaauguccuuaaucccagcacuugaaagcagaggcaaggggaucucugugaguuugaggccagcuuggacagccagaacuacacagagaaaccuuguuugggggaagaaagaaaagaaggaaggaaagaggggaaggagggagggagaaaaaagagaaaccaaaacaaagcaaaacaaaacaaaacacaggucuggauugauggcuuggugguuaagagugcauauuguauuagguguuguggaacaugaccuuuaacccuagcacucagaaggcagaugcaggugaaucuaugugaguuggaggccagccugggcuacacaauacagugaguuccuggccaaccaggacuauagagggacccuuucuuuaaauagagagaagagcgagggaagcgggagagagacagaugaauucagaggucaauucccagcaucagugaccgcucacaacuauucauaacucuagcuccaggggauccagcaucucuggccuccaaggcuacuuacacuccucuguaccugcccccaauacacauaauuaaaaauauauaaauuuugccucaggaagugguucagugguuaagaacaccuguugcucuuaaagagggucuaggucugaucccaacaccaacaugguggcucaaucccagaggauccgaugcccuccucugaccucuucaggaacuaggcacacaugugguaugcagauacacaugcaggcgaaacacucauauacacuaaauuaaaauaaguaagucuaaaagacauuuaaaauaaauuaaaucuggggcugaagagaugacuaagagcacucguucuugcaaaagacccaauuucaauucacagcagccacacagcuguucacaucacucguaauuccaguuacacagaaucugacaacugcugcugaccuccacagggagcaggcauacauguggcacacauacauaauacauaaaaauaaacuagccauacacauaaaacaaauuuaaaaacaaaaaaucuuacaaacuaaaaccagcuggguggugguggcagaggcaggugggucucugcguuugaggucauccuagucuacacagcaaguuccaggauagccagggcuacaaagagaaauccugucuugaaagaaacaacagcagccucaagccaaaagacauaaaccauuucggguacagcucagugguucaaauuuucccuagcauguaugaggcccuauguuuacucucuaguaacucaaugucuauaaauguuuaugcuacacuaagaacaaaggaagcaauacacuucaaaugacaaucaugccaugaagaaucacagugcuuaccugcauuaaaaguuccuagaagagaacaguaaguacuaaauaaaucugaauuguaugaguuuaaaaaaaaaaagaaauuaaguaaguagcauauaauuucaacguuuauuuuaagaaaauuggauuuuaaaguuuaccauacaaaauguuaucaauuuuauuucucuaaagccauugcuaagcucaaguuuggcugauucuauuaaaagcuguaaccuuacuguaauuagaaguugagaaauuuaaugaguugaaaugcaacauggcacagaugccuuauuauaccaacuaguuaacacaguauuuguuuucuacauuaauuuuacuugcuaaucaaaaauacugcuuucucccaaauaacaucaaaauaaaauugcugacccugcaauggcaaaaucaccaaacgucugcagcugcugccuggauccuuucucagggaccaguaguuucuaggacaaaugcugggcuccucguauauucaagugguuccuaaaacccaaaugcagaagccaugcuuugcugcacacagacacacacaacacugggcacacauuagaugucuauacugagcauguccauauuauccagcaaugcugaauguguaacagaucccugaguuaacagacaguauggucuccugggagagaauacuuagaauauauaagguuguagguguuuucagaugugaacaguguaaaugaaaguaacgaugaauuccuaaggaaaagagacuauuuaggaaccauucugugagaagaguguucccuaucaacaccucauguccaauuuaaguaugcuauagccacaguggauaugugggcucauaauuccccuauuaccucaauucuuuccucaaacaguccaaagagcagccaauuaaucuaaccaacagcuuuucagaaaggccccacugcuuuuuuguuuugugcuuuuagauuuauuuauuccuauuuugugucuguggcauguauuuauguauacuggauguacgccuguacccaaggaggccagcaaagggaaucagagucacuggaacuuagguuacagaugcuugugagcugugauacagauacugaaaccuggguccuccuuaaccacucagccuuacucaccaaacuacagacuuuuauauacuaagagaaugugucaucuauuuacauuaaaaaaaaucaguaauacacuaauuuguacccugaacccuaguacuuaaaacagagagaauuacgagugaguggaucagaagugucucuuguugcccugaacacccgcagcacuaacaugcucucacacacccugcucugugcuuccagucucccuucugucuuucaaacacagcuuagcucuguucccagacaccccagguacacuuucacuuugcaguacaagugacuuuuacacuucuccauuuccccaccugaaggcacauacucaacuuuguaccuguuuccucagccccaaagacagugcaggcuggagaacugcuggacaaacgacuaccagugauuaaagagcaucuuggcucuaaaaccaccccuauucaaagggaaccagaaagggaaguaagagauucuagcacuacauuacaguuacucagagaugacuauauugggguuggggguuuagcucaguggugagcaucugcccagcaagcacaggcccuaauuuugauccucagcucccuaacacacacacagacacacacacagacacacacacagacacacagaggcaauuagcacacaggaauuauaaccugccucuucccuuucuucuuuccagucuguuauuuauauuuacuaaaguguuaacuucucauuuuuaacuuaaaaauguuaugcuuccuuguuuagccuuuccuuugucuuuucacaaauuauccuuuuaugaauaacauauaaacacauaaaacauacauguauagcuuaauacauacaauagauacacauguaacuacuuuccagguuaagaaauaaaaaagcaaacucuuccucuacuucaaagucuuuuuucacuguuuacauacauuuuuugucagauaauaaaaaggguuuuggaaccaguccuuacauucauaacacuaugugcuucugcaaagauaaagagucaccaaaaagccggggcuuauuguguuccuguccgaguguuaggguuugcccacaagugugccuaccccgacuagggcacugguuuaaagugaucguaaaagguaggguaaauugguauuucuagcgguaaacacugcucuuacuaagcagacgcugcacucugcugcucuagccuacagcaaaccuccaaaggaaaccacaucauuuuuaaagacauauguuuuaaaacaauauaaauuuaaaccaauuacccauauuauuucaccuccauugugcuuaggaaaguuauuuuaggugaaaaguuggcauuaugggauuguacaacuccagccauccaauaggcuuaucccuuucagccagaacagggguucucucugcucacagcaggcauccaacaggguagcacauauaugcucucugagugagaaagcaacaccuucucacauacagcccccuggagagagauggggaaggggaggggaggacuuuacaccugcaaacuccuaacucuaucagcacuggggcugggaaaaacaccacauaauuuuuuuuuuuuuuuaaagaaguggggaaaaggguuuucaaauaaagccaguagcuucaaagccauuuugaagccauuuucuuuuccuuaggagccaguaggcauaaugauucaacaaccacucuuugucuuaauggacuuagucaagcccuaaugacuaaauaagcaaacuacuuaaaaggacagcugucagaauuuucacucugguaaaaaaacacuauaagcauaguguuaucauauuaauuaagguaccucaacuucaaggcacaccugucccugggccuuugaauaaucaaaaugaccacuaaaaauagaacgguagcaucuccaguggggcagacaggagccguccccaauccuaggagacugcugugaccugggauauguggauaugugggauauguuuugcaguuacaauuagaauaccuaucuaaauggagcccuguuccagcuuuuagucuguucuaccgaugucacaaacacacuuaacucccgacccacaaugaaaguccaguuagccgacuagcugacugaggcaauugugggggaagaaaacuacuccccaccagcagaaaacugcuacuugcaccaaaaguccaggaauugauuaacagcuucaauuuuguuuuucucuucaguuuccccaucaccaagaguaagccagcucugucugucaagaugcccaggcuguguggcaguggugucaaaggcugccacuugcuccaaggcacugccaucugcaacagcucaacauuuugucucuggaaaauaaacacaucugccuuugccaguguccucccacugugccacccaucuggagcaggugagcuggaaggcaagccugggcacggcaagaugggggcgagcggggaagaugaggccucaagggagauggcacagagaggaaauggcagugcuucgucaugucacauccugcuaaacacauuugccaaaaaagcacgagaaauuacccuuguuagugauauuuuaaucacauguaacaaaugcuugguuggguuuagaggauaagacuugcaaagucaagguuucaccugguucagcuguucccugggucacaugacccaaggauacccauaaacaggagauggucucuacaccagccacauaaggccuggagagaauaacuucagugcagaagccucacugcaacaggauucuuggaagggagcucucuguaucugcccacccccuuacccaaaacaaauacacucacaugcugagcagagauaagcagcgaucacuucuaaaguaaaagauuuucaagauucuaaaguaaagauuuucuuuccuacauuucuuuuccuuucacugaaaaaacuguaucaaguguugacaucagaucuuuauguuuauuuucuuggacccaggauuaaaccuagggcuuagcuaaguaaauucaugcucuauugcugagcaacacucccuaccacuagaccuguagaugugcgaucugauccaaucagcugcagcucucucagcauuuucaacuggcucauaguagguagagcaggucuaaaccucccacggcagauucuaacuauuagauuuuaaacuacagggggaaaagaaaggugaagcccuuuuuucagguuaaacuuuuacauguaauuccuacaugugaaagaugaaaggagagucaauaugcaugaacaagcugaaguuuaaucucgcuaggcuuuccugguacacauucaauggcaauuuauggaacuagagcugaaagccaguaugucaaguuugauacuuuucguuauuuuuauuguuuauuugcuaaguauucaugagaaagagagagagugagugagagagagagagaaacacacaugcguguguacccccccccaaaggcuuaugucagaaaacguucuaugaaagcacugaccguucaguggcgguaguaaagccuggaagacuccacacuacagaggccagccagcauccugcugaugguucaacauaaaacuccacagucccaaggacacgagagcgggcuggcucauaccucaaccucaucacugacaaggagcucaagggaaucagacaauacagucauauaaauaaugccacaguggggccaguaggcaaaaugacucaaugggauuaaagugguucacuaccaagcuuaauagucugaguucaaucccugaccuaaaugauuaaagaacugacuccccagaguucccucugagcuccacagcuaugccaugguauguaugugcacacacacaaauguuggugcuuggaguguaguggcucagugacagaacauguaguuagcaugccuauggcuaauuaaaccccaaaacuaagaaacguaacuuucuuacucaaaacaaaacaaaacaaaaccaauuacacaucuuccucgacuuucuuauuuaauaaaaugcauugaaauauuugauuagguccuagguucaauaaugguggcagauggcaugggagggagggguuaauuaauuggaauuuaaauaacccuuuauaguuagugguucacacauacugaguaaaucuagaacaaauauuaacaugaaacagauguucaauguuagauuauuucuacauuguccauuaauacuaauaaauuccuauagcccccacuuuaguaucuuaucaguucaauuaaaauaauucaacaauuaauucccuauaaagauaacauagccauuaaauugcuuaaaccaaacaagaacaaaacaaaaaaauccauucauuacauguuuuauauaguguaccacgagcuuugcaugacuguuuuaauccuuauaauaauccuaugaaguacuaucauuuuguaaauaggaaaguugagcuuagaaccuguucaaagacauacauacagcuagcaauugucugaacauuauucaaccacauuccaauugccuccauuucauauaagauugauuaugcacucuguaguaaauguccuccaaccugauaccaccaguaagcaugaguaagcaaccaagcgagcgcaugggcaugcgcacacacauagaguaaaugaagucacacacucacagcuauagacaucuauaugaaauuucauauacauaagaucuggccaaccaagccgggcgugguggugcacgcuuuuaaucccagcacuugggaggcagaggcaggcggauuucuaaguucaaggccagccuagucuacagaguuggacagccagggcuacacagagaaacccugucucgaaaaaaaaaaaaaaaaaucuggcuaacccaaaauauguaucaugugccaaccaauguuaccauguaaauauaccaaacauagugacauuauauaaggaauacauaaaacgauuaucauuucucucucuagaauaaaauaaaguacugggguuagagggauggcucggcaguuaagagcauuugcugcucuuucagaggaccugaguucucuucuuagcacccacauugcccagcucaugagcauccguaacgauaaccccaccucccuagguaccuacacacauguggaagcaugugcacccacacacgcacauauacauaaaacuaaaacucuaacuaaaguacaaauucuuauuuuacaaucuacuuugauaaggaacuagaagaccaaagcagcacaaggcaggggcaaucaccacuuaagagcuccagucauugucugcaaaggacauuuacuuguucaaaacaucaaacaucucugucacuggagaagauuagguagauucacuacuacauuugcaugaagcaaauuuccacuuuaucucaauucuaaaaggagauuaauucacuuaaugucugcagcauuuaaugguaaagcuuuuauuaugcccaaagcuggaauucuuauuccaguucugcuugguaaaucagaggaacauucuacaaagggagccaugacacacacacacacacacacuccuucaagaauucaggcacuucugggugguaggaaaucuaguauuugacccacaauucucccucaaggauuaaauaaaagaucccaaauuuuucacccagaucaaaauaauguauguaaauaugucuguaccuugcaauucauuaugucucugauuucuucucaaauauaaugaucacuugcaugaacauaguacacagacauacaugcaggcaaaagauacacaguaaaaauuguuuauagaucacugagacugcaaagcacgugaucaaagcaagcagugggacagauccuccuuagugagaugcuuggggucuaauacuaggcacugggaaauaaguacuuuagagaucuacaguaggucuggagagguggcucauugguuaagaguccuuacugcucccaacauccaugucacacauggcugauauuuauaaauaucagguggcucacagccugauauuuauagccagcucuggagugauucaaugucauuggucuccuuaggcacaugcacuccuaugcacacauucauacacagaaacacaaacacgucuuuaaaacuaagucuucuaaacaauccauagcaagcagguuuauaaagaacuuaauacccacauuuguucugaugacacaugacuaaguuuaagaaggcagaugaaaccccaaucaccaagagcacuaauuuucuaaacugcuacugaagaaucaaagaguccaccuuaaggcaaacagucaaaucaugguccaauuaccauggcuuugucugaccugcuaugugcccugaacuagucccucugccacuuuaugcuuuucacucaaucagcaagagaaucaacuacaauuugucucaguggaauagugaguagauuaaauuauuaagcagaaugcuuugggcaaaagucauaugaaugcuaaauauuaugauuuacaaacauucauuuuccuggcacuccugugggguuaggaaguuaucuggauaucauagaugaauaaauaggcacauggggugaagucacaugguaagacuauuuacuuagcccccguagggaaaacauacacccuugacaaucacgugaacuuucuugguacauucuacacaaucuuuaagcauuuaaucuuuaaauaaaugaugccuccuuuuacaugugauagagaacacuacaauauacaagacuagaauaaaaaagauaacuccccauacuuuggcuaaacagucacagaaagauauaccuccauuaccgugcagggaccuucagcuacaguucaacaaaaauaaaaacacuucaaaaauguuugguacuuucuuuacaaaauuuaacauauucuuaccauaaaaaccagcaaucauacuccuuagaauuuacccaaaaaagcugcaaacacaucuaaagaaauuccauauauaaaccgccucaaaccagaagcaauuaagauauccuucaguaggaaaaggauauauaaacugcaguacacuuagacaaaggaauauaacucaguacuaaagaaauaacccagcuggguaguggugguacaagccuuuaauucuagcacuacggaggcagagacaggcagaucucuaucaguucaaggauagccuggucuacagacaaaguuccaggacagccaggguuacacggaggaagucuauuuuaagauauuugugcauacaccugcauguaggucauguacaugaguacagguccugaagaagccagcggcaucagauccccugcagcugugcagauuacugugaacugaguaccaugggcgccagggacugaacucaagucuucugcaacgcagcaagugugcuuaaccagagccacuucuccagcccuaugugaaggaacuuuaaaucaugucaccaagaagccaacucuaugcuaugacagucugaaagggaaaccaugcaaacaguaagagcguuagaugcugccagggguucagcagaugaagagaauggguggggcacagaggacgcucagggcagugaaaauauucuacaugcuacagaaggauuuagguccuuacacauuuaucuaaacucacagaaugcaugccucuugaguaaaucuuaauauaaacuauaaacccacgcugucaauauagguucauuaauuguagaaauacaccauucugguagaugcugauaauacaggaugcuauguauguguaucugggcugaguuuauauggggaaaauauuuguauuuuucucuuaauuuugcugugagccuaaaauugcugagaaaaaauaaaagucucugggagggggguaguuuaucacaguccuucauguuaguauaccccaacaaacaaaauuaaaaaacaaaaacaaacaaacaaaaaaaccuuccuuuugggccagagagacaguucagcaaguaaaggccacgaagccucccgccugagcuuggucccugcaggccacaguggauggcgagaaccagcucuuguaacuguucuccuaccuccauacccaccccacaccacaugcaaaauaaauguuaaaacacuuuuaauuuuguucuuaaaauaaggcauauuuggccuguagagauagcuuggugguuaagagcacugacugcucuucuagagguccugaguucaaaucccagcacccacaugguggcucacaaccaucuguaauaggaugaaaugcccucuucugguguuucugaagacaucaauaguguacuuacauacauaauaagauaaauaaaaaucuaaaaaacaaaaaacaaaaacaaaaaaccagaggcauauuuucauugaauagcccgggcuagccuggaguuuauuagccuucauuagccucccaagcgacagauuuagauuguaaaaagcagcaauacccaaagagaaaacauacccaaggggacuaaaagggaaugauuagcaaugagaagaguugaggaaagucaaaaaugccaaaacuacuguucaugucaaacaggaaugugaaagcacagcuuucugcuguugaaggcuggcugcaagcugcuuacccgacuccgaagacagucagccagguuccgccgugugaaguuagcugcugcugugggagacaauucauauccugguacaagacauaaagagucacacuugaagggacgcagaagacaguaacagucuucacccaaaucgcuucucuauacauuuucucuuuagagacaggucuuaaacuugaccuguuucugccuucugaaugcugugauuacagguguguaccaccgcaccuacccuaacuauaacugugaucauuguuaaaagccauuuuuauuuauuuauguuguuugaaacaugaucucauguaacucgagucuccagucaucaggcuggccucaaacucauuauacaacugaggauagucuugaacuccugauccuucaaccuccaucuucuaaacuguacuuaauaaagugacuaacuuaagagucuuuaaggguuaguuuaaacaaacacaauuuuucuucugggcacugacuuagcaccuaauacacgcguaacaagcgacccuuccuguucaccuuagucacuccgcacucccucagcuguccugaggcagcaccacagcucggaagcaucgcagacccuucaccugaguauguguaaucccaaguagcaugcuuuuagguccugaauggcggggucuugaucacccaguaaguuucuacaguauuaagcacagugcugaauauugguaagaaagaccuucaaaacauuuaggcuauugggggaauaaugcuaacuaaauauacugccuaaaaacauguaugaauggauauuaauuuagucauuuuacauaaguaaccauauaaaacuuaaaccuaagcuguauucuaagucuuuauguuuuccaaaaaagguuucucugccuagcccgggcuguccuggaacuuaagcuguagaccugacuggucucuaacucagaaauccgccugccucugccuccugagugcugggacuaaaggugugcgccaucacgccugacucuaaggcuuuuuuuuaaagauguauuuuuacuucauguaugagugguuuggucuguaccacuuguguaccuggugccaaagagggugucagguccccuggaauggaguuacagacgguuguaagccaucaugugggugcuggaaccaaacucugguccucugcaaaagcagcucaagccaucucuccagccccagaagaugcuuuuaaauguacaaugucuuauaauuacaaaaaucauaaagcauuuuuuucuuuugugcagugcuaagauuacacccauggcaucagccagaugcucagccaguacucugccaaagagcuauauccccaagccagucaaaaccuuuucuuucuuucuuuuccccuuuuaaaauuuuaaaccuagaaguuuuuuuuaaaaagauuuauuuauuuauuuauuauacauaaguacacuguagaaaccuucagacaccccagaagagggugucagaugucauuacggaugguuaugagucaccaugugguugcugggauuugaacucagcaccuucagaagagcagucggugcuuuuaacacugagccucuuucuagcccuucuuuuguuuuuuuuuaagacaggguuucuuuguguaguuuuggccauccugaaacucacucuguagaccuggguggccuuaaauucacagagauuagccugccucugccucuaaagugcugggauuaaaggcuugugccaucacugucuggcuauuuuguuuuguuucuugagccagggucucaugcaguccucacacucucuguguagcugaacugcugaauuugaccuuuaaccuuugauccuccugcccccaucuuccaagugguaagauuacaggcaugcaccaccacuccucaucaaaacaugcucauuaacauaaguauaaucccauuuuagauaaagaaaauaaagucccagagaggacaaaugacuugcuauaugugauacuguaaagucacggagcugaagagauggcucagcaguuaagagcaggaccugcccuuccagaugaucuaggauuaauucccgaagcccagaacccucuguaauuccagcuccagagggucuucuggccccuauggccaccaugugauacacuaacaugugugcaaggaaacaccuacacacaugaaauaaaacaaaggacuuaaaaaaaaaucugauuucuugcauuguaacaccaauauaucaguguuacgauagaauguuaguagaaaaucuuuaaggacaaaacaauuagaauuuagguucuagauuuuuuuguuuuguuugucugagacaggguuucucuguauaguacugacuauuuugaaaacucaauuugcagauuagucuaguguaaaacucaggggucauauaccugccucuaauuuuuuuuuuaaguagguaggaagaguuaaaugaaaaacugugaucccaucaauccaacaguacguaagacugucaauaaagaacacccaucuucaguucaaaauuaaacauauacugaauagcauccuccaaaaauucauaaacuaaagcccuaaucauagacccucaaacugugacuguaucuagagauaguauacaaagagacaauuaagucaaaaugugguuaugagggugagcuccgauccaaugugaaugguguccuuauaauaggagauuuggauagagaauacaggaaaagucaccuacaagccaaagagaaagccucagaaaaauucagcucugcuaauucccugaccucacaacuguagccguuagagcuaugaaaggguucuguuguuuaaacugcccaggcuaugggaccuuguguggugacccuagaaaacuaaugcaccagccaaagcuacccucuuacccaccauuccgcauuuuauaaaguugcacguuuuucuggauauauucugcaaacuguacagugucuccagccucuccaacacauaggaguaagauuuuuucacucaucuuaaacaucuugucaugaucugcucaaaggaaaagaaauucauauuagaaacuuugaccacagaaacuaaaagcuauuuauauaugcaaguauaaacgggucuauuaaguauauacugaaaacagucauuguuauuauaagacuuuaauaguuucacgagccaacagguuaacuacauauuuuauuaauguuaauuuauauugaaaauuauauaugaaagcagacuauucaagauacaauugcaggaaaagguggggcuagaaagauggcucagcaguuaagagcacagcugcucuuguggaugacccaggugaucccagcacugacaucagguucacagccaucuauaacuucaguuccaggaaucccauacccucuucugaccucagaguauugcauacauguuggauacagacauacaugcaccuauacacauaaaaauaaauauuuuuuaaaauuacaauuuggggcuauagauguagcucagugauauagcauaugcugagugugugagaagcccagaguucaaucucuaccacuuacuuacuuaaugaaaaaauaaaauuuaagcuuggcuuuaauccaugcaaucugguguugcaggauauuugaucacacuacaaaccccgagauuauguuauuuaauaaaaaaccuuuuucuaguuguggugugacucagcccuuagaaaacacauuuaauuccucuggcugaaauacagacacaccuuuaaucccaaacaaugaagguaaaauuaguuuguagaaggaagcacccaugcuugaaauugaugucuaacucgcggcaaaguggcaaaccagacaaagacuugacagaacaggacacgcugaacucucaagagagggaaagggaaagagaaacuacuuagagagcagcacagaaaggguggagggggguuggggguggggagaagcaguuuuagcaggacaguuuagagacagguugaagagagagcaagcuagacacagguaaaaacagaacaagccagagaaugagaaggagccagaagauuguacagaggauagaagaucccaggauuaggccuagguuagcagacagaggcaguaaaccucagagaugacaauuauaucaggagaauaaaagauacguuuacacucuggaagcaaagacaggcagagcccuauaagcuugaggccagcuuauucuacauaguaugcuacagggcagccugcacagugagacuugauuugaaaagacaaaaacaaacaagcaacaaagacaauuuaagaacauuuaaaauacagggaaugggaaggugagaaacagcgaaggaauccagauuauggggauuaucuagaggcacaagaguuaaguccagaguucugaaacauuacuacuaauacaaaugucaaauaaacauaaaaacggugaaaagaaugaauucuacaguuaaagaaccuucucaagaaagaagaaaaaaauaucagcugagaacccaaauuaauguauaaaguaaaccagcuucauaucaaaagaaaaaaagaaaacugguugccaaagcagacacuuuaaagaaugugcuaacagugaacuaucuaaguaacuaaugaaaaccguaaugcuguagccuuaucuagcuaaagcagacguacuccgauuaaacagacagauacucagguuguaauuguugccuggggaggaaacgcaguauuuaguuugcagcuucagagaaaagcuuuauucuuccuaucuuacccgacuuucacuuuucauuuuucuaauagugcugaauaaucuccccugggagacauguuuuccuguaugaaagcuucugaaaugucaaaaucucuuaauaggauuuaaggaacaaaugcaacuaccaaguacucuacaaguguuggagaguuguagauaguaauaaugugggugucuggccuggugguggcucccacauaaaacacgccuauagauagauaauguugaauugccuuaaaauucccaaguaaacaaauuuucauguuacacauucaaagacuguuaguuugcaaaauuguucuaaaaagaagauucauuuagacauauguugcaaagaaaaagaccagaaggguauauauucuaaauucuugacaguggcaagaaucugagcaaacuuuauuuccguccuuuauuuaucaguauuuucuaaaucucuauaguuaacaaguuucauuuuuguaagagaaauuacuuaauauguuugcauuguuuuuaaggggaaaaaaagcagauaggcaauacaguucagcagguaaaggccuugccccacccccaacucaauccccagaacccacacgguagacagaaauaacuccuccaaguuguccccugaccgccacacaugugcugcgacaagucugugugcauauacacacuaaauauuggagcaaaaguaaucuucuagggagaauaaguuuuaugucacacuucauaaaagaggcuaagauucaaggcagcgaacuauuaauuauuaaauaaauguaaaccaggccuacuuaguuuaaaccgugaacacgcucagugaauagcaagaggugacgucucagaacagaacugauggauacgcaugguccugaguuguacaagaagcugccuguaguuugaggaaggucuucacuugucaauaaacuuacaagauccacaaacacacauaaccaaaugaguaucaacaugauaagccaugcagucaaacuaaccagaacccacuagacaucguucuggucagacacagugggaaagugauuugccugucuaaacucugguuaucaacuauuuaaaauaguguaacuaucacuuaccaaagucuaacucacagauaaggaaaccuguuacacucaguguuagaaaugcagucuguaucacacagguuguaggaagucacaacagacaucagaguaauuuaaaagucauucugccgcugggcaggcgugguggugaacaccuucagucccagcacuagaaagggugaggcagcaagauaucugcgaguuugaggccagccuggucugcagagugaguucucagacagccaaggcuacacaaagaaacccugucucagaggagaaaagucauucuguuuaggccaagagacaaaaggcaugaaauguggcacauuuacaaccaaauggagagcuguaccaguuagcuguauaagcaagaaguuuuuggaaaacaucucuuuccuaguaucaacauauuuucccaaguagcaugaugaaaaaugacaacaggcagugugaaccaguguggugcuucaugccuaguacucuaggucuuggaggcuguuacauguaucagguuagucagagcuacauagcaagacuccauuucacagagccaaaacgucucccucaaaauuacuucuguucagcauucuuaacuaugccacacaaauucccucagacaauuauaaacuccuacccuaaguuuuucauaccagagaaagguuauuaguugaguacaauuauuuacaacucuuuuuaaagaacuacucaaauccaucuuuuuuucccauacaauaaucuuuuuguucucugggccuauucuaacaacuuacuucuaacaucauuaauuuaaaaacuagccuaacacuaacuaguaauacuucuaacacauaaaaaacaucuuguauuuauugcuugguuuuuuuucuucgauguuugcuucuuuuaaagacagacagagacagacagacuggcugacucaguauguacuccuacaaugucugugaaaccaggcuagccuccaacuagaaaucagcauuccugucuaugggaugaaauuauaggaacgcgcuaugccuggcucuccuugucuuggcuugaaucccguguaacauuuauggauaaaggcauggagcacauccuccuuuucaaagccauccacacagucacugugaggaaacagagaccccgcaacuugacauccgcuccaccuacucuucaugcuaaaaucaccugcugucaaagcaauggaccaauuuacucucaaaaugaacuuaaaccuuuggagacuggcucacaaaauaacuucuacaaacuaaucauaaaauuucauaaagucucuugagagacaauuaauaccauagaggucugauuucaaguccuucagaaagaacagaaugcaagcaaagcucacagcauucucucucuauccccagauggaagcgccaggcucacaccagauagguaggugccuuugcuuugugagaucgguuguggcaacugugcuuuuucaguucugacaacgcacuucaaggagcuccagaucuaagccuuuuuccuccugggaucuaggauucacugcucuucacuuucaaagcuuucccuaaucucuccccacgguccaucccuaaagucuccuccucuucuucuuaagucuccaaagcuugacugcucuagucucaacucagcaaauacuuucuaguuuguguuacaguuauuuuaacacacaucugacuuuuacugaauuacuaacauugugugugugugugugugugugugugugugugugugugugugucacacauaaguguauggguguaccugucucacccgggacagagaaggacaucaggccaucccucaccuuauucucacgcagcagaggcucacccuuugggccugacugacugacugacuggucagugagcucccaggaucuguguuuccugcucccaaguagggacacagccaugccuguuugaucuuuuuucuuuuaagugaguacuuggaauuuaaauucuucaugcuuacacagcaagcacacugaccuacucaacuaucuucccaacuacauaguauucuuuuuuuucuuccucuuuucagucccuagcacuguaaagaacacagagaggcaugaaacuugucaaaugaacuuuuaauccacugaacaaaagcuagauaucuuucaaacaguaacaugccuaugaucagucaugaaaacacucaagauucugugggucaguugucacuauaaagguagugaaguuguuaaggguaaaagagaucauuuugcauaaugucuacuaacuuguuuuuggagugcugaggcuggggccuuguauauggucgaaacauauguugccacugaauuguagacucagucccaaauuacacagauuugaaccuagguucuaccaccuguaagcuuagaaacuuuuucuuugauaauuuuaaaauuuuuauuuauuuauuuagagacucucucucuuguucugcacaggugcacauugccacagaacaggugcacaggucagaggacaaccugcaggauguugggguggggucucuuccucugccaucuggguucugggaccaaacuccgguugugaagccugggcaaaagcaucuuuacuacugaguuauuucaacaucuccuuaagaaaguuuuguacauauacacacauauacacacacacacauacauauauacacauacauagauauguauacgcacacauauauguacacacacacacauauauaugcauguguguuauauauaauauauacuauaucuauacaucuuaguuauacauauucugucuccaaaacuaacugcaagaagggcacauaguagagccaaacuuuuaacaaauuaaaauguuaacgauggacacaccugauacauauaugcuucaguuuguuaaguguuuguccaaugcuaacuccuucacucaauccucucaacaaguuuugaguugguuauuaguaauuugagagauaagaaaaucugggcacgggaaaaaaaauaacguacaaaacucacagagcaaauaaagagaggccaucucugcugcauuccacuauuuaacgacaaguaaaaucuagcagccagggaaaggcggaagaggcucugaggugagccacugaagacagcggaagcagaguggaaaugccaaacucuggggagucucacucuccccaagaucccaccuuagggcacccacaaauuauaacuucuaucuggggcgacugaaacuugccagaaauucagaaauuggaggcgccgggcacacacuugagcucucauaaacuuaauucccucacgcugagcaacucucaccuagcaagccucaucugacccagaaucccaaacuagagcccuaagcuugucugccggcucccccggcuucucaauccugcagugccagcagggcagagcacacugggcuccaucuuccaagcugcccagagggaggcccacgguccccuucaccaacucccgccgacugccccuccagccaggcccgccgggccucccccugcuuccucucaccguccuucaucuggacaauauugcuggcggccacucggucggaagcgacgaggacauagucugggcccuggaugccaaugagguacuccauggugccgggaagcgggaggcugcagaggccacggacagggacacuucccggguacacgaccucaccagugagacagcacacccggacugagcugggggugacgcaagacgcgcgacggcccaguca

SEQ ID NO: 2123 - RNA, 106455 nt, Mus musculus
cucaggaccgggggcuuggugggaaagggaggaggggcuuguggcgcgccugcgcaucaggggcgcgcgcaaggggcugguuuggagaucccuuuaagaaaaccacuggcggaggaauuucucugagagaaaauaauccuccucacggggccccuuggaggccauuaaccccccgagucccggccccccugccccggcaggcccuugcgcccacgcgcccgcccgugggaccccaggagcugcggcuaagcgcgcgggccuccgccccccucgucacucccgcgccaggcccggcgggggccgagggggaccgaaccgcagcgggugaagcgccggugucugcagugugggcgggggccgagaggggccgcggccgccgcgccgggagccgccgcgguuccgagcggggcccaacauggcggagcgggagguggagaccggcccccgaaagaggguaggugaggugaggccgcgggccgucugcgggcugcgggcugcgggcaggcgggcgggcgggcgggcggggggcggggcgcggccggccccgagcagcccggagcucacggguggcgcgguggucgacggccggagggaggggcggcccgaggcggcaccgggguccccucggcaggugggacaaagcucgguggccggcggggagggggaggggcgggggccgugguccgcuuggcuccccucccuuugccggcgugugggugguggugcguauucggggggggggggagccugggagacgcaaggugucagacuccgcuucugcauccucgaggaaaagggagucuauggaaguuucucuggggagaggucagguggggguagagguggcgggaagaagucguggaggauuggucguuuccugaggaguaaccgggagggugcugcgggaaccccggagccaauucaucuuccugccuccacuccccucccccuugaccguuaucaagccccaaaguggacauggugcucucuucaccuuagaagaagugggguugucgucuugaaguugggggaauguguucugauagccacggauguguuauagucuagcauucuuuaccugcaguuaguaacguggaagagugacaaguuuuguccuuaggauguacccagccagccuugccugcccuagguaaagccuugucuacacaggaguuguaagccguuuaaaaguuugucuugaaacuuuuuuuauuuuuaauuuaguugugauucauuuucuucagauggagaacaauacuauccacugaguaauguuuuucaaggcuuuuuuuuuaaacuuccccucacccagcauguuaagcaucaaguuuguuaaguuuccuaucaggaguuuuccuuuuggaaauggucuccaaaugaugaguuaguuguuaaaccaagcugcuuaaaacaugaaucuuaaccaaaaaugcuuuuucauucagcauaaaugucuauucaaagaugcauacuguuaacauccugagugcugacugugugccugacauugcacgaagugcuuugugaagaguucaaccucacaguaacuaugcagcccauuuguggcugaaauguagauuuauuuccuaucuuacauaauuaaguuugcaaaguccagaguuuugauccgagauuugaaaacagguuugcaaaugcuuguguugguugcauuuaagguuuuuuuuuuuuuuuaauucuucuaguccugucauuggauccugggccuuaacaucugauagacaagccuauaccacugagguagacuccuagccugaggaguuucucuuuuuaaaaauguaaaugauguuucuaacaggucauuagaaaacuuuauaaccaucaauaaaaguaaaaauacaguuuagauucagggugcuacugcauucccaaaccccuagauucuacuauugacaguuuucccagauucuuguuuaccaaaccuaguuauuucaucaagccaucucuuuacccagucauucauuagucuuuuuuuuuuuuuuaagauuuauuuauuuauuauauguaaguauacuguagcugucuucagacacuccaggagaaggagucagaucucuuuacagaugguugugagccaccaugugguugcugggauuugaacucuggaccuucggaagaggagucgggugcucuuacccacugagccaucucaccagcccccauuagucuuuuaaguacacugcauuuuagcauuuuuaauaauuaaaauguaauguugguugucuuagguuugcaaaauguugggcucucuucauauauuuaucauugaacagguuaagcuguauuaauauaauguauguucaaacaggucauuuacaauaaguacugauauagaaugcauauguuuugaaauucugaauuguuuucuaauuucugauuaguaguaaacuaucuucauuaucuugagugaaugcaugugauauguguggucuacuaauuuaacuauaaaggauagauuauaguguaaauucagagauaugcaguuacuagugauaucauuugcuuuauagaguaucuuaggaaaauuagacuguuuaaguauauucuuucucauguauguaaauauuacauuuagcagguggaaaagggauugcagggaauuuuuuuuuuuugagacaggguuucucuguauagcucuggcuguccuggaacucacucuguagacuaggcuggccucgaacucagaaauccgcuugcuucugccucccaaaugcugggauuaaaggcgugucccaccacugcccagcuaguacaguuuucuuuuucuuuuuucuuaaaaauuuuuuuuuuuuuuuuuuuuugaaacugucucauguagcccaggcuggccuugaaauagcuuuguauccacgguuuaccuugaacuccugacuccugcuuccacuuuuuuuuuuuuaauguuuauuuauuuauuauauguaacuacacuguaguguaucuucagacacuccagaagagagcaucagaccucauuauggaugguugugagccaccaugugguugcugggauuugaauucaggaccuuuggaagaguagucggcacucuuaaccacugagccagcucaccagccccugcuuccacuuucuaagagcugggauuacaggcaugugccugcaggccugacauaauuuuaauacauuuuaaauguaauugcgcuuuguugcaguuaucugcauagaccuauaugauacuauaagguaaaugugaaauuucauggaugaagugggauauaagauucuuacugacuuugacuuuuaucaucuuaaauuauaagaaagaugagcuaugcuguuugaugagauacccuaccaugggagccauaccccuuuaaucccaauacugauuuuuuuguuuguuuguuugguuuuuuuuuuuuguuuguuuguuuguuuucgagacaggguuuuucuguguagcccuggcuguccuggaacucacucuguagaccaggcuggccucaaacucagaaaucugccuuccucugccucccaagugcuaggauuaaaggcgugugccaccacgcccggcuccugauuguuuuaaaauaguuguguugacaaccuuaaauuguguauaggugucucauuuuccuguguguguggaguuagaacaaaugauagcaguuggacuauauugauuugauauuuaaucagauuguacaugaauuccauuuucucaguuugugaaguaggggauggauugguaguaccauuauccuucuguguuacauagagaaccaaguucauaccuuucuauguauggguaaagaucagcauauucucucuuugucuuacacuuuaauaccaggauauuuugggaauauuauuuaugaauuauuuuaacauugauuuuuuugucuucuaagauagguguuuuagauugaucaggcuuauaaguaguuuacacaugacuuuuuuuuuuuuaaagauuuauuuauuauuauauguaaguacacuguagcugucuucagacacaccagaagagggagucagaucuuguuacggaugguugugagccaccaugugguugcugggauuugaacucuggaccuucggaagaguagucuggugcucuuacccacugagccaucucaccagcccuauacaugacuuuuaauuguguuaugaaauaacaagucuaaauaugauugccauauuucaauguaaaauugcuauuuuacgguuuauauuacaagauaacuuguaguuguauuuauuuuaaugcuuaacccuuauauauuaaauuugagauacucaguaugcuuaaauauagaaagcauaugcaugaacaguaugcuuauguauuuguaaaauacacuuaucucuauguauguguuaggauacuuguauauuucuggacuuagagaagguuguggauagcacuuaucaggcuuuaggagauagagauagaaagagaugagagaguucagcaguauacuaggcuugagaggugcuuccacaguaaagaacacuggcuacucuuacagaggacaggcguuugaccuaguacucacauggccucacaacaucuguaucuccaguuccaggagauccagugcccauuucuauccucaguaggugguagggacauuagguuccuagacaauacaugcagagcaccccucuacauaaaaauaaauagaucucccuagauggauggcucagcuguuaaagcgaguuuacugcucuucuacaggaccuggguucaauucuuacuaucuacaucagguagaguucacagccaguuguaacuuucugguuccaggguauccaguguccuuuuuucuuuuugggcauguagugcacauaaacucauauagccacacacauauacacauaaauaaaaaugaaacuuaagggccagugagauggcucaguggguaagagcacugacugcucuucagaagguccugaguucaaaucccagcaaccacauggugccucacaaccaccuguaaugagaucugauacccucuucugguaagucugaagacagcuacaguguauuuauguauaauaauaaauaaaucuuugggcccaagcgagcagggaacugagcgaguggaguugaugggagggagcggccaacuggagugagugggguugacuggagugagcagagguccuaaauacaauucccaacaaccacacgaaggcucacaaccaucuguacagcuacaguauacuuagauacauaaaaauaaauaaauuuuuaaaaaaugaaauucaaaguauauuacaaaguauggucuauaguauuauaauaauguaaacauugaacugcauguagacaggaauaagaaaucacaggaauagguagaugauuuuugauuggguuacagacuucuguuuugcuuuuguuuuaauauuuuauaauaaaaauaaaaguuuucauuuggguuuuuagacaagggucuugcuguacauacagcuacauugauuggcucaaacucauaauugacuuuucagccucugucugucuagcacugggauuacaggaaugaaccaccaaauucagcuggaguuuuuuguuuuuuuguuuuuuuuuucuuuuuucuccuccuaaccucuagaacuaaaauggccuuuaacaacaucuauuugggauggccuguacuccccccaacccccaaacuuguuucaaaagagucuuccauucuguuacccaguugacagaaagcaaaaagaaaaauauacauaaaucuuaaucuuuucauaaacauuuauuuauuuuauguauaugaguacacaguagcugucuucagacacaucagaggagggcaugggaucccauuacagaugguugugagccaccaugugguugcugggaacucaggaccucuggaagagcagccaaugcucuuaaccccuaaaccaucucucuagccccaaaucuuuuuuuuuuuuuuagauuuauuuauucgucuauuauauguaaguucacuguaguugucuuuagacacucccgaagagggagucagaucccauuacagaugguugugagccaccaugugguugcugggauuugaacucaggaccuuuggaagaguagucagugcucccaaccgcugagccaucucuccagcccucuagccccaaaucuuaaccauuuuaacuuuuucuuccuuuuuucuuuuucuuuugagacaaggauugucuuugcaccucuggaugucauggaacucacuauguagaucaggcuguccugcgacucauagauucaucugcuucuaccuccugagugcuaagaauuaaaggcauuuaccaccaugccuagccucauuuuaagaguuuaagauggcuuuauaaauauauucaugguguaaugcaacuaucaccaauuauuuuaguccaaauagaaaacuuacacacugaauuguuccacacaguuucucuccuccucccugguaaauucuaaucugcuucugugagguugccugugauggaugcuuccuauguauuuuuucuguggagucugauagauuacucagcacauuuucaaggcuugaccagacgucauauguaucagaauugcccauucucucauauaccugaagaaguaaucccaucauuugugccagacuuuauuuuuuuguucaucaguuggccauuuagguuugucuguuguaauuucaucuguaaauguuguuguaaaguaugaguccuaucauuguuuugguuacauacuugacaauggauuugcuagaugauauggggggauuucuuguuuggagguaccauaggacuauuguaccuacuugcuuuacuguuuugcacccauaagggaugcaugaaacugcagucucuccaugucuacaugagcaccucuuaauuuucuuuuuuggcaauaaucacacuagugaguaugguguaacauuuuucugugauucagauuuguuuacuugcuguuuuaauuuugaaaaggcaucuuuuuuucuaguuuauuuuuaaagguuuacuuuuauaucaguauguaugcugguuaguuucaugucaacuugauacaaguuaauaguccucaagagaggaaggagucucaauugagaaaauaacuucaugagauugggcuguagguaagcugguuggguauuuucuuaacuagugaucaguggggaagggcccagcucauuaaggguggggcuacccugggccagugguccuggcuugagaaagcaggcugagcaaaccaugagaguaugccaguaauuagcauuucucuguggcuugugcaucuuuugccucuagguugcacaaauuguguagccacaagccuuacugaucuuggcuuuuugugcacaaaacccauauucuuauugacacacuucauuuagcaagaacaguuaggaauaagcagagcuauagaagccagaaagcaagguuaguacauguagggauuuuuccagaauuauagacugugauagaugaagucuuuguuacuguuuuggcaaguguuggagucuggagucuguaugcugggcucuuucucagaaugauuagugccuugguagcaucaguuauccuaaggucuugggaccuguuagaguuuguuuuaauuaggguuuuauugcuuugaagagacacugaccaggccaacucuuauaaaggacaacauuuaauuggggcuugcuuacaguuucagagguguagucuguuaccaucaggugggaaacaugguggauugcaggcagacgugaugcuggaggagcugugaguucuacaucuugauccgcaggccgcagaagaggacuguguauuacauuggguguagacugaguauaggacaccuaaaagcccauccccacaauggcacauugaaguggaaacuuaagggcucuucagaaagucaguuguguuggaugguguuuugcugggggaagcacauggaagaauguuuuccugaaguggauacaggugaaaggcuaagguagacaacgaaggaauguuucacugaggcagacacaggagaaaggauguucugccaaagcaagcaugugaaacgacaugugaugagggauucuuuacuaacaauaauaauguguuggucugucuuacauuguaguugaguugcauuuguugagacucuguagagagagacacaccauaaaacuucuugugguguguugcagcuuacugcaguuucuugccacuucugaggauucggacugauuggcugugugaugucagcugaggcaagaccgauggaggauugaugcaugauauuuggagggaguauacauagaacucaauggacagugugaggcagagcuaggcuugcuuauagagcuagcugugcaacgcuucugggucucucaucuuugcugaucuuugcuucgcugagagaagcacagcuaagaacuuuuccuggcguuccucucuggucccuccuguuaccacuguggcuaacccaacucugcugaacuggacugcugguauacugcagguauauuguaaaguguuugugaguggaucgaacugccacugcugacuccugugaacugaauugcugauuuccugacaauuuagauaggauuugcuccaaagaacucucucuaaacaggcccacuucccccauauccuuucuuuuauacuaccucuggugaguggugggcuacaagggaaguuaaaggguuuaagagccaucauuaaaaguagaccuugaaaaaguuaguuauaacacucuucuccaacaaggccauaccuacuccaacagggccauaucuccuaauagugccauucccuaugggccaagcauucaaacacaugagucuauggguccauaccuauucaagccaccauacaguuccugcccuguuugaguuccugaacuucuugauacauaguaaugaugacaugaccuaaguaaacccuuucuucucaaaggugcuuugauaaugguguuucucucaggaauaguaaccuugaggccguaugugugugggcauaugcaugugaaugcaggugccuaaagagcccagaggcauuagauccucuagaagcaggugguugugaguugccucaguguggguguugggaucugaaccuugcuucccuuuaguuuguuuuuauugcauuuauuuuguguguuugcucagacauacccuuguugcacaugugaagguaagaggacaacuuuucagcaguggguucucugcucccacuuuguaguucuuaggaauugaacucaggucauacugcuuggagacauguuccuuuacucacugagccauuuugcuggcucuucuuacaguuuucacuuacuuuacucuuacuuuacuuuacugugugugugugugugugugugugugugugaggggugguggugguaugacuaauugacuguaugcaugugugccuaguacagaguggagauuagaggacaacuuucaggaagcagauuucuccuuuguuuuuagguguggucucugggccagcugguauguauauuucaggucaucugacacaugagcuugugacuccuauauuaccuguagggugugcuuggauuuggguuguggugauuuaauuaagggcauaaagcuuguaugacauaugaaauuaguuuucuggccuggauuugcauuuuucuuuuuuguuuucuuccuuuaacuuuauugguuuaugaauuucacaucaugcaccacaauucacucaucuccuccacuuguaccuggccuccacuuugcaaccccugcugcuccuccaacagagauaaaaaaauucuccuuguggaagcugcagugugucauagugugucccacagaauacccuuuguccauacuuccuugcuugcauauguucauugcaugacucauuggucugguacaaguagcuucugcuacucugucgauacuggaaccucacugguacuccuuggauauuuuguuguugcccugugucauggcgagccuauaguuuugcaucuguaggacaggccccuucaugcacuacagcaguuuauugauggguuagauggugggaugggccaauucagagcccuaaaacugggccugagagguggucagcucuccugcucuucaugcccucagggcuggcucaccagaaacccgcuguacgaggacaaguucuaaccuucugccucggugagguguaggacccgcucuuccaaguguugaggcuggugaaagacauggccaguucucccacucucaugacacugaggccagcucuccugccugucauagauagcaagagaugagugaggggaguagggcaucccuucuuguugugugugucccaacagagacagggcagcucaccugcaagcccaugugcauggccagcucaguuguucugcucaggugagguacaggcccacucucuugagugcuucagaaggugaggggcagagacagcucuccugccugucauagguggcaaggggcaagaguggggaagggcgucccuuccuugcucauguuguuugcgggacccacaccccuacuaucagggucaucucuacugugcuguccaaaugaggggcagggccagcucuccugcucucauaaccuuaugagggccaucucuuccacccacugcugguagcaagggcaaaagggaggggaggggauuucccccuugcugacaccacuauacagcagacaagaggcagggcugacucuccaacacucauguccuugggggcgggcucacuugauaaccccacauucauggucagcucuacucugcugcccaggugagggacagaugcuugagugcugcagcaggucaaggucagggccaucucuccugcuuugaugaccucagggcauuuuuaugaggaggaggaagaggaugaugaucuuguaugugcauauuggccauugauauaccacuuugcuaaaauguacauuuaaagucuuuguccuugucugguucuuaacugacuuugucuuuuuuugcugauuguggaaauuuuauuuguauucuucauacugaauacuuccuugagauaggaucaugcuguauagcauggacuggcuuggaacuuguguugcuugaacuagucugggauuugugaguuucuuaaccucccaagugcuaggauuacagguaugugcugcuaccauuacaccugaucucuggcuguugaacuccucacaggugauuugcagauauuuuuucccaugccugggcuauaguuuuauacuugugaacauaucuuuugaugcacagaagcuuagaauuuuuguuuugguuuuguacuaaguucaagagaaacuuuucccucauuuuuaaaaauuacgugugugugugugugugugugugugugugugugugugugugucuguaagagagagagagucagucaaguguuuugaguauauauguauauauauauaauuuacuuuguguguguguguguguguguguguguguaagagagagagagggagagagaggagugugugugugugugugugugugugugugugagugugugugugagucaaguguuuugagugugcauauguguauaggguacaugugaagaucagagguuggcuuuguucugugguaggauuccaggacugaauucaggccuuccaucaagugcuuuuauuuacucacuaguucccagagaagcuguaaguuacagucugagauugucccaguugcuuauuuccuauucacuuugugucuguauguugguuguuauuuuuucccuuccuuacuucaagggaguaguuuuuguuuuugugccaggaugccuggcugaaaauuuccucuuuaagauaauuuaaaaugggaauggagagauggcucaauggcuaagaacacuguuuuauucaggaagaccagauucaauucccagaacccacaugaugacuuacaucugccuguaaauccaguuccaggggaucugacauccgcuuuggccucuugagugcaccuggcacacaugaugcuuauuauauaugugaaggcaagacaaccauauacauaaaauuaaaaaaaaaaaagaaaagaaaacaaaccuauguuagauuugcagagauuuguuuuuuguuuguuuugaggcaugguuucuuugugugucucuggcuguccuggaacaugcucuguagagcauguuggccucgaucucaaagaucugcuuaccucugccucccaagugcugggauuaaaggcauguguuacuaccuucaggcaaauagauuccuguuuuacacuugacccuauuucuuuucucuccauguuauuuuauaugguggcauacuaaugacuuaacugagagccuugcugcuuuguagucauccuugucuuccaguggagauuguuuccuuagccuguuguuuucuugcacaguuucuucuguaguauuguguguaugugagugaguguugcauuuaauaauugaauguugcucuucagaggcuguucaccguuuuuuguuuuuuuuuuuugagacaggguuucucuguguagcccuggcuguccugaaacucacucuguagaccaggcuggccucgaacucagaaauccaccugccucugccucccaagugcugggauuaaaggugugcgccaccacugcccggcucaccuuguuuuuguuuguuuguuguuuuguuuuguuuuguuuuuucaagaaaugugagacucaccuuguuuuuugagacgggguuuuuaauuggccuggaccuuugcugaguagcauguaucugucugucuggugagccaaguggguggugagcccuagcaaccuaggcaccuguucugccuuccuaucaccggugcaugccaucauacuuggcucuuuuuuuauuuuuuauuuuuuauuuguagguccucuggcuccaauucagguugucuugcuugcaaagcaagcauuuuacugacuuagccaucuuuccuauguauuuaaaaauuaaauuacgugauuuccuuacccuuucuuugccucuguuuuguuucuaaaacucaaaaguacuauuucgccgaaguuuauccuggggaaccaaugaguauuauuaggcuugcuuacuuaggagcauggaugaaggaguuucuuucuggaacauggaccccaaagcagccauacuggaaagucuucaccuagcauaggauaaugguuuucuccacagaaguguaaauggagaccuuucagguaacccuagucuauacacuugagcuccucuggagaccuugaggccauuuugcaaugagggaugaguacaaauggccaggaggagugucuagaaucucaggugaagguucagugauucacucuacccucuccuccuaugaaguaauguggacaguccauuuaagcuugauugugauggauguauacaagcaggcacagcugaucugaagauggcuguuuuccucagcagcccacuuucuacaacaaugguccauuuaggcauuugcagggaaaauauuguuccauaauagauaugcacauauagaggauaaguccauuccauugcuuuugucuccuuaagccugugauuuuuuucaucuucaguauaauacuagugaaacucuaguaauucaacuuuauuaaauaugacuguaauugucuuuaaguuucuaccaacaaccaaguaagcuguuacagauguuaacagcacuuuuuaaaaaauguguuuuaugguuuuuuuuuacuguuuuuuuuuuuuaaagauuuauuuauuauuauauguagguauacuguaggugucuuccacacaccagaagagggagucaaaucucauucagaugguugugagccaccaugugguugcugggauuuaaacucaggaucuucagaagagcagucagugcucuuaaccacugagccauuucuucagcacuucuaucauugaauauuuuuacauguagcucucaggauucuaucucuccucucucucucucucucucucucucucucucucuugaggcaggguuuuguguguguguguguguauguguguguguagccuuggcuguucuagaacuugcucuauagaccaggcuggccucuucacagagaucugccugccucugccucugagcauuggauucaaccaccaccaccuggcuucccugcucucuuuuucauuuuauuuauuuauuuuuaauuuuuuaaaauuuauuuauuuuuuuucgagacaggguuucucaauauagcccuggcuguccuggaacucacucgauagaccaggcuggccucgaacucagaaauccaccugccucugccucccgagugcugggauuaaaggccuguaccaccaggcccagcuaccugcucucuuuuuaaagauagcauuucucuaucuauuuaccguuggccuugaauucaccuuguagccauagcuggucuugguuguaguuguagacuuagugcagcaguucucagccagugggucauggucccuuuuggagguugagccccuuuuacagggguugaauauuagagauccugaauaucagauauuuauauugugauucauaacaacaaaauuacaguuaugaaguagcaaugaaaauaauuuuaugguuggggguuuucacagcaugaggaaguauauuaaagggucacagcauuaggaagggugagaacuagugaucuaguggcaauaucaaaacgauugguaucaguuuugagguaaaugaaaaucuuacugcaaggcauuuauuucacauaaagauaaacaccacaggguuuucaagaaaaggauguucuuguauuaaggauacaucauuuucacugaaggguugaaauuguuaguuucacucugguccaaucacuuguucuguuccugauucacauucuaucucaguaauugcugugauuuggguaaaaccaaaucaaaccaaaacagaccagugacuaaauuauccugauuuguaauuuaauaguucauguagugagcuguaacuguccugggacugacuauguagaccaaguuggcuucagauuuagagaucucacugcuucccaagugcugggaauaaagguuugcagaaguuuguuuauuuuuaagauaauggcaaguauuccucuguccuugaauguuauuugaauuaagcuaauguauugacauuuauuuauuuauuuauuuauuuauuuauuuauuuugauuuuucgagacaggauuucucuguauagcccuggcuauccuggaacucacuucguagaccaggcuggccucgaacucaguaauccaccugccucugccucccaagugcugggauuaaaggcguguaccaccaugcccggcccuacauuuauuuucuucugaaacuguucaagaauacauagaaaacccuucucaaguaauagacuuuguagccaucuuuacugcuuuaacaaugaaguguaguucugagugcuugcuucacuugacauguaaucauacccaauuacaggugauaguggggucaacuuuaaugccacugcuugcuggacauuauuacuauucugguugaguucuauacuacagcccaaggauacaacccaaucaguuuauaguuacauugugucuugucuuuuggaauuacaguuagaggauaacacacaugcaguauuugaguauggaaagcuuaauauuuauaguuagaaaaguuggucaaggugauacacaccuguagucucagcugggagguggagaccuaucugagcuacaugaguacaaaguuagcauggacuguauaagacugucuuaauguccugcccccaacaaaguuguauaauuaggaaacagcaguggacaaguaacuugaagauauaaaucaaacucuaaauaaaaugguagguuagagggaacagcuacggcucuagcuuggacugagguagaauaggaaagcuggagugcauuuggaauaugucuugcuccccaaccuuaagucugaggauucaggucuuguuggagagugugagguccaauggaugcuggcuggagagguuugagauuuugcacacuuuuguugcaaucaugagaccucccaccagaguguuagaagaguuacuaaaaaguuacuuacuaaauuuggcuaagucaucuguugggguauuggcagaauuucugggccacuccccaauaucagggacugaaacugaugaauagcugcucucuggagggucuaacaguuugugaggagacaacgugugugucugauagagaaaugcguacuugcuggagaguugguuucuaggaaggccauuacuggaguaagcggguaaacagugcagugggaagagaagacccuucagaguccuccucuaagugcuguuuacuuacaaagcacuuugcccagcggcaaagggagaagguguacaaguguuaacucuuauaucugaguaacaguuauuuugccuuugcauugaaagcuuuuuucggaagcgggggggcuucugguauuuuaauaaauguuguuucauucauucauucauucauucauucauuuauuuauuuauuuauuuauuuauuuauuugagacaggguuucccuguguagcccugguuccuggcuguccucuaacucacccuguagacuaggcuggccucgaacuuagauaaacauuuauuugugugaguaugcaugugcuuaugugugcaccaugucacacaugugaucagagacuaacuugugguguuaucuccuguguguguuuuggaaauugaacucaucaucagguuuggcagcaggccucuuacccacugaguaccuugcuggcuccuaaaguuuuuaaauuacauguauuauuuauuuuuacuuuuuaugugcuugaguauuuuccauguauguauguauguauguauguauguauguauguagucuguuuaccacccacagagauuaguaaagggaauugggggccaguagaaguaauggaaucuucuagaacugaaguuacagacgguugucagcugccacaugaguacugggaacuaaacauagguauucugcaagaacagcaaguguuuuuuaacagcugacuaaucuuuuuaacccuacuuauuguauguguguguuaguguguggggugagugggaaaguacaugugugaauauaacauucucuauggucugcuuugaauauaacccaaaacuuuuagaaaguuuuguuuacuucaaaauauuugcuucuccccacucuccaagguaucucccucccucucuuccuaccuuuuuuuuuuugacauauuauuauauagaaguuuuuuguuuguuuguuuuuuaaagacuuacuauuauauggguacacuguagcugucuucagauuacaccagaagagggcaucagaucccauuacugauguuugugagccaccaugugguucaucgcucuagaagguuuuuuuguuuuuuuuguuuuguuuuguuuuuuucgagacaggguuucucuguguagcccuggcuguccuggaacucacucuguagaccaggcuggccuugugcucagaaauccgccugccucugccuccggagugcugggauuaaaggagugcgccaccaugcccggcuagaaauauuuuuuaacuaacaaauuuuggcauuaaaauuaucuuguuagugauuccuaauaccucugagaugagauaaaacauucuguuuaaacuuaauuauuugauguuguacaugugguccaguuugugauauagcauggugcucuuucuacauagauuuaauauguaugcuauagcuguuugaaaugugucuacaaauaucagcuaggguaaguuuguuggaagaauuguuuaaaaauauggcuucauuuuuuuuuuuuugucuuguacuaacagcuggcaaauaccauauaucuaguaaauauaguugcauauuuugcuuauuuucauuuuaauguuuuccugaauuuuaaaguuguguuaaaaacuucauguuauagaauuaugucuuacugaugauuauacuaaauaguuuuaugccugcaaaaagcuuucucuuuuugucugcuuuaucugacauuaauaugcagaccuaucaugaagauguuguggaucugguaccauggaggucccaggccagacugggcuucaugggacccuguccuaauaaauuaaaaggaaacgaaggaaucuaggcaaauaaagucuaguaaaccaaaggaagugaaggaaaaaauaaagcugcaagacagucaugugguagcuuaccccuguaguuccagcacuuguaagaccaaggccgcagcauugcaugcgcgcagaccacccuggcuacagacugagacugucucaaacagcaacaaaaagcagcuaaauauuggauaaaagacuugugcaaaauuaagauaaacaugaaaaaaugcucuaacuagacugauugaaggauuaaagaaaaggaaaauaaaggcacaguugcuuuauuagaaaugaaaauagggaacaggacagugguggugcauggagcuuugugaguucaaggccagccugguaugcagaguaaguuccaggacagucagggugacagaaagaaagucugucuugaagaaauagaacaaaugcuuuaguagacccaacuuaaccaaaaauacgauaagaaaugaaaaguuuuguguauguuacuguuuuuguuuuucacagugcuuugguuugaacucaagacuuuacauauccuaggcaaguggucugucauuaagcuacagcucccauaccagaaaucccauguuuaaaaaaaguuauuaucauuguuauuuuuuuaauuuuuaauuuaaaaaaaauuuguuuguuuuuucccuccuugcugugcccuuccuucccccauuagucuuguuuuguuuucaugucacacauauguuccuaucuauauauuguuaaaucuagauucugugugagagaaacaugcuauguauuucugucuucacuauucuuccuaaacucuugucaacuacuugauacuuuccucacucugguuaagacaagcaaucaugugaccugcagauguggcugcuuuguuuccuuuucuguguuuuacacuuuauacuucuuuaguuuuauuguauccacuaguaguuuuagaacaagacaaauuugguaaucauuuguaauaaucauauuaccaugguaauaauaauuagaugauaaauaauugauguuacuugccaacuucaguuaauuguuaauggaugucuggaguuuugauaacaucuguauuuuguaggugugcuguggcugauuaaugaugggaggaaaaguugaguaguaagggacagguagagccaaauguuuccugucuuuaauauuuuuuauuaaauuugaagauccuagcauauuaaauauguuguauucuauguacuuguuaaacuuauagaaaaauacuugugaaaaccaggaauagucaaguagcacagauauuuagcauuaaaaaguggcuuuauugaaaucucuaaggugagcaucaguuaguaucauuuccuaaugugauuuuaacacaauuaaguuguguuaguguuaucuuuaaaaaaucuuuuaucacuaacugucuuugggaaaugcuugccagcuguuguggcuuuuggaauucuagcacuuggaaggcugaaacaaagaagaguaaaugaauuucaggaguagccucugcuuuauuucugccugcuguuuuaaagcucuaggauuuacucagacuuggcucuauuucugucuuaggcccuauacauucaacaggauacaucacuguaacacaauugacuuuugauuuuaagaucagugcgaauuuuucuguaggaguagaaggggaucccaaaaauaagauugaaauauugagaguaauguuauuuuuuccccucccucucucuuuuucaguuugaacagaaaagugaugcaguuuuugaugaaauuguagaaaacuguaaguacuauuugagaaaaaaaguugucuucagauagguuaagucuggauuuagcacuuacuaaucauuaggguguuuaguuaguauugaauugugugauggucugguuugauuuagcuuuagugucauuaaguugagguguuuagauucuuuuuuuuuuaaguaaauauucuuucaguuuuuauuauauuacaguauagcaguauuuuguauuaguaugaaugcuauagauuguacuuaacaucuuuuacagguuuuuuuuuguuuuuuuuuuuuaguuuuccaucuuuuuagaugcuguaugauagauuauaaaaguaauacauucaauuauaguacagagugaauuaaguagaaaguaaauauuuuuauuauaauuuucaaaagauuuaaugagcuuuaagagcuuaauauaucuuuccagacuuuuucuauaaauguauacauacauauaguauaugagauuuauguucaggaaccacaugaauauuauuccuguucuuuuuaagucaccuauguagacaucuuuuugcaucaguaaaaaaagaucuaguguaugucuuuuuuuuauugcuauuggguauuuuauuacagggcuauacuguaaccagcuucccuuuuauaaacauagaaucuuaauuuuucauuauaaacaacagugaauaucuuuugcuaaauacauuguuuacuuguucaaauauuucuauaaaauaaauacuaagaauagaauugaugaauuuuacaggauguuucuauacuuguguaaguaugguaaguuuugucaucuagaaaucuuuuuuuuuuucuuuuuucauuucuuuuuuuccuagacaggguuucucuguguaucccuggcucuccuggaauuugcucuguagcccaggcuggccuugaacucagagagaucugccugccucugccuucugagugaugggauuaaaggcgagugugccacuacugccuggcugucaaucuaaaauguguuucuuugaauuuuacagaucuauaaguaugucucuucucuucuucucuuuguaauaaauuugguaacuuuuuuuuuuuccuucaagacaggguuucucuguauaucccuggcuguccuggaacucacuuuguagaccaggcuggccucgaacucagaaauccgccugccucugccuccggagugcugggauuaaaggcgugugccaccaccaccucauuuuuuugaaugauaacaauauaaagaauucuucuacuuuucaguggauuuagcaauuguauguccuuguuucaagcaguagagucuagcuagaagaaacauacauugauugauugauugauugguuuugguccugugguuuaaguucagggcuuuguauauaaacuaagcaaguguucugucccugaacaaaugacuccauccucagaagaaacauuuuagauguacaacaaaguauuucacaguaauggugaugaaguaaagaacaaaauuucagagucuucagcaaaagauuacaggucuuuugacuuuguaguacuuccagaaagcaguuuuguuuggacuuucagaugggugggcccucacuauguaguccaagcuugucuggaacucaguauagguagauaaggcuggccuugaacucagagagacuuguuuuuaccuucugaguguuggaaauaaagauauuuaccacuaugccuaccuugguugaccuuuaaaaaaaccuuuuuuaaaauuuugugucugugugugacuuugucuaugcauguaaguacaagucuuggaggagguuauaagcguuagagccucacaaugcugguguuuacaaaugggcuaacauaagugcuggaagugaacucacgcucucggcaagaacaguauaugcucuuaacugcuaagcuaucuaaacuauugauugacuucauuucuuuugauuuuauuuuauguauauggguauuuggcccgcauguaugucuguguacuacauccaugucugguauguguuggauccccuagaguuaaagaugguuguaaggugucguguguguguaaucaagacagguccaaagagcagcagugcuuuaaccacugagcauucuguccuccagaaguuugucuuuuuuuuuuuuuuuuuuuuucugagacaggguuucucugugcaguccugacuguccuggaacucacucuguagaccaggcuggccucgaauucagaaaucccccugccucugccuccugaguguugggauuaaaggcgugugccaccaugccuggcgaaguuuguccuucuuauauaauuguauuuaaaaguuucugucuugguuuuauuugacaguaugauaaaaaucauauauugaaaaagaagcuuacgucaaaacauugaacaguccuuucaauuugaauaguucagucagcaaacagaaauaaccauuuuguaaacuaauuugauacuauugucaguuucaauaaaagaauauuuaugcauacuagaguagauauuucuguuuucuuuuuacuuucuuauauguguguauucauuuaaaauugcaaguuaauauagaaagaugauugggggccaacuugauuucucugcuugucuuugaacucaucauugguggucgggaaagcagucagauauuacaauauagcaacuagaauuuaacucucccucuucucugaugguuugugucaaguuagucagcauagccuccuaguguagggauuacaagugugugccaccacacccaauuuaaucagucuggaagugcacccugaauacuuauuuaucuuauuugccaaaguagcuucaaagaaaccuggaaaucauagcuccguugcugagucuugagucuguuuuugcuuuauaaugaaagugaagauucuuuaguaaggaucagaaggaaauuauuauuagguguguuauuuccuauaauggucagcuggcugaagauaauauacucugauuauauuuuuacuuacgagaaaaaaauaaacuaaggcuugauaguaugguuuauuuauuuuuuauuuuuaaauuuuauuaguuuauguguaugagugauuugucugcauguauguauguguaccauaucaguagcuggugccuguggaggucagaagagggcgucugauucccugggacuagaguugcauaugauuaugagcuaccauguagguccuuggaauagaauacucuggaagaacagucaaugcucuuaaucaaugaaccaucucucuguugccuacaguuuagcuuuaaagugauagucugaaugcauguuuaucuaaaucuucaaucccuauuaaacccuucaucauuuauuuccugaauuuuauucuuccuugagauaggguuuuaauacauauuaaaauguugggucauuaugacauugggcuucugaucucucucgugcuagaauuucaggcauauucuaccuuuugugcuuggcucuuuugagacauggucacuuguagcccagaccaacuuccagauucucuauguagcugaggcuauuccugaaacauuguucacccugucuuuaccucccauguuuaguagcaugaacuaccacaccuugcuuaguuuuagcauuuuaugaaugaaauucuuccaauuacagcauuggaagaauacaaagaauacacagcaauggaccuuaaacaaaguuauauauauuuacuuaaaaacaagcaaacaagccaauucaauuaauaagcuauuuuuuucauuuagaaaauuauaaaaugauuuuacuuauuuguauuggggugagggaaaacaggaggagcugcccacaaaagaaagcaggugcacacaugcuacacugcacauaugugaggucugagucuguucuccuuccauuguugguuccagggauuggaauuagguuguuaggcauauucuucaaguauuuuuuaccuguugugagacaucagugucuucaccucauuaaaaaaauuaaauuuauucauuuuuuauagugaggaugaucaaauucaagccuucaugcauuaagccacauacucagccuuaaaaaauguuuuuaaauuguauuuguucuuaaaauugagcuaugcuagcugggcaugguggugcacuccuuuaauccuaguacuuaggaggcagagguaggcagaucuuugugaguuugaggccaagcuggucuacaaaugauuccaggacaagcacccugucuuguuuuuguuuguuuguuuguuuuuguuuuuugguuuuucgagacaggguuucucuguauagcccuggauguccuggaacuuacuuuguauaccaggcuagccuugaacucagaaacucagaacugcuugccucugccucccaagugcugggauuaaaggugugugccaccacgcucggcuacccugucuuguaaaacagaaaaacauaagaaagagagagagagagagagagagagagagagagagagagagagagagagagagagagaaagaaagaaagaaaauaaauugaggugaucuauuaaauauugacacugugucaacaacuacagaaacugauaaugguuaauacuuauguaccacuagugaauaaaugucuauucaccccagauagagaacuggugauagucugcaaauggauaccaccagucuuaacuuagagcaugaauuuuccuuucugucugucuguccauccauccauccauccauccaucaccuaacaaaugaauugucuucuucccucccucccucccucccucccucccucucucccucccucccucccuuuucagcagaaaugguauucucaacauccuaccccagcgugggugacacucaaggucaccuggagcucacuucagugcuuguaagcaagccccucaguagguagaaaguuuguuuuguuuuguuuccaggcagccuggcuaguuucuguuuuuucuuuuuugguuuuucgagacagggcuucucuguguagcccuggcuguccugcagcucacucuguagaccaggcuggccucgaacucagaaaucugccugccucugccuccugagugcugggauuaaaggcaugcgccaccacugcccagcaagaguaguucuuaugcuuaccgugagguagagaguaggggucuaguauaucugauguguuuuagggauuugaugaagcuccugaauuguuaacuuccccaguacagagacuccauuuagaacaucuugagucuucacuucucuguagagaccagagagauguucucuaauuaaaauauccugugccucucaucuccauggguaacuaaauuccagugcacccuccccacccaccucuguaauucaaacagugagacugaauguuuuaggacauuguuauacaauaacacucuuuaaaauauuucauaguaagcugagcagugguggugcacacuuuuaauccuagcaggucaccaugagugcaagcaaggucagcagccugguuuacagagugaauucuaguauagccaagguuauacagagaaacucugucucaaaaaaacaaaaggcacugggcggugguggggcacgccuuuaaucccagcacuugggaggcagaggcaggcagauuucugaguucgaggccagccuggucuacagagugaguuccaggacaaccaggacugcacagagaaaaccugucucgaaaaaccaaacaacaacaacaacaaacaaaaggcaaacaaacaaaacaaaaaaaaacuucuuaguaacuuaauuuuauuucuguucaguaacuuauucaagucaguuucuuuaaaaguguauuuuuuauuuuacuacuacuacuacuacuacuacuacuacuacuacuaguacugcuauugcuacugcuacuacuacuacuacuacuacuacuacuacuacuacuacuacuacuacuuuugagauuaauuauuucuacauaguccugggugucuggaagucacuguauauacugggcuggccucaaacucauagagauccaucugucucuacauacuguauguguaugggacauaugcaucccauacuguauguguuugggauguaugcauugugaauauaggugaccagagaggucagauacuuagauccucuguaguuacagacugugugagccaccugacuuagguacuaggaacuaaacccuggaccugugcaaaugcacuuaaccacugagacauugcuuaguuccuuuaaccacugagacaugcuuaguuccuuuuaguucuuugguuuugcaaguugaauucuuugcaauucagaaauagguguaaaugcuaggucaguguuugggaugcugaagcaggaggacuauaaguuauaaaggucugccuguacuacauagugugcugcaguccgacuagaacuguaguaugaguaaacuaucucaaaaaaaaaaaaaaaaccaaacaaacuuggggcuuaagagauggcucagcucuugaaaguccuugauauuucccagaggaguuggguuugguuuccagcacccucuccggcaucuaugaauaugcacagcacacauauguacacauaggcaaacaaccuguaaacauauaauugaggagauaaaugcuuuugauuuuucaagauauguuuuuuccauguagcacugucugacuuggaacuuucucuguagaccaggcuagccucaaacucacagaucggccugccucugucucccaagugcugggauuauaggcaugagccagcacuaccuggcuagaaacuuuuuuuuuuuuuuuuuuuuuuuuuuuggugacaggguuucucuguauagcccuggcuguccuggaacucacucuguagaccaggcaggccucgaacucagaaaucugccugccucugcuucccgagugcugggauuaaagccgugcgccaccaugcccggccauaauuucuuuuuuuuuuuuuuuagauuuauuuauuauuauacauaaguucacuguagcugacuucagacacagcagaagaagaugccagaucucauuauuggugguugugagccaccaugugguuucuggcauuugaacucaggaccuuuggaagagcagucaaugcccuuauccacugagccaucucaccagaccugaaauguuuuuaaaagccacacaaaaaaaaaaaccauaguagugugugagaguguguguguguguguguguguguguauguauguguaaggaaaugguaaaacuaaaacuaaagcuuuaaauuuauuuagggacauaauauugguagaaaacugagauguuauuauuugaaagacaaaacauuucucaauguuguccaagcauggaauaagaacuuaacuuaauucccagugcaaauguucaauaaauuacacucccagucaucaguauguaauauaaaccacucugcacauggucccaucuuaggaugaaguagaaaggucaucucaucuuugauuucuuucuuuguaggagcagggaagucacuccuuuggggacugugaugucuuagacacugcagaaaaagugggagcgcagugcacaugucagcaguugugagcuacauguccuuaauauauuaaacaguuaaacuauauuacaauucaagaggacuugguagauaucuguagaauauuucauccaauagaagcagaauauguauuauauguauucuuucuuuaaauaugcauuuucagauacaaaauaaguguuugcuuauaugaaagaaucuaacuuuuuccuuucagguaaaaguacaauaaagcuagaagauaaaugcuagaaacugcaucaauacauuaguaaaguagcguacauuaaaagaaaaauaagagauagagagauggcucagcaguuaaaaguacacauuguucuuccagagcacuguuuuuuucauauuuaccugaguucaauuccuaacaucuacaugcacaguucacagucacuguaacuucagcuucaggggaguccagugcccuuuucugacccccccccaggacaauuguauuuauguauauauacccuauacagacauagaaaaauacauaauuaaaaauaaauuuuuagucgggcagugguggcacacgccuuuaaucccagcacuagggaggcagaggcaggcagauuucugaguucgaggccagccuggucuacagagugaguuccaggacagccagaguuacacagugaaacccugucucgaaaacaaacaaacaaacaaacaaaaauacauuuuuagggggcuggagagaugguucagugguuaagagcaccgacuguucuuccagagguccugaguuccauuccuggcaaccacaugguggcucacaaccaucuguaaugggaccuaauguccucuucuggugugucuauagacagcaacaauguacucacuuacauaaaauaaauaaaucuuaaaaaaaaauuuuuuuuuuuuaauuuaaaggucaggcauguuaaucccagcauugggcguuggaguggagacaucucugugaguuuaaggucugcuugaucuauauaacguguuguaggccagccagggcuacauaaugagaaucuuuaaaaaacaaaaaguauggaguagagagauggcucaggggcuuaagagcacugacuguucuuccagagguccugaguucaauuccuaccaaccaagugguagcucacaacuaucuguaaugggaucugaugcccucuucuggugugucugaagacagcuacaguguacucauuuaaauaaaauaaaaaaaucuuaaaagcuaaaauccagaaauaccucaaauaaccuaaugauacacuucaagguuugagagaaauucaaaccuuaaaguaguaaacacuaaauaauaaagaucaaagcaaaaacauaaugauacagaaauuaaaagaauguuacauauaagcagaauugauucucugagagaaaaagauggguauugagaaauccccagccgugcuaauguaaaaagagagagaaguaccaaauuaauaaaauaagaugaaaaaagggggggggguuauuacagauucuagugaaaaagagauucacuagaaagugcuuuucaaaucuauguuucaaaggaaaaaaaaaacuggaaaauguuggagaggaaauggaugaauuccuagacauauaugacuuaucaaaugaaaaggcacagauccagaacaaucaacaaaauugaaaugcuaauaaacugucuccgaguaaagcucaggccagcucagacuggacacacucacuucuggagucuaccaaaucuuuuuuuguuuuguuuuucgagacaggguuucuguguagcccuggcuguccuggaacuuaccaaaucuuaagugaacacuuuacaccagugguucucuguuauaauagaauauaauagaaauagauggaaaaccaacaaacucauucuguucaggacacacacacacacacuccucaccccauaauauauuaauuauucuagugagagucaacauucucaacccuuuugcaaaguggauucaggaacacauuaagaaguucauaugucaugaacaaucuuacuuuauuaaaguuauacuacugggucucaaacccuguaaaaaugaauagcugaggugccuauuuaacauaucauaguggacauggccuccagguucucucagcaucucucaguccuuaacuguuacgcgguguggcuggcauacucacccccauauguauaguuguccagcccugaggaugggcugccuuccccagcggccccucccuauauaguucagugguucgcucacuuggcccuuuuguccauguuuuacuucuggcucucccuccguuccuccucacaccugccucagggucagguucauuuuggagucuucccggaugccccugccucugguagugcucucccuuuaucuacaauacauuuucuugagacuccaccauaccuagcugcaguccuuguccuccuuuuuuaucucuuuuuuuuucauuuuucaggugcugaaacuugcuucuugcugacaggaaguauaauucagcauaaaaauagacuaaaggacagaaaaaguucagcaucccuuuaugguaaaaaguccugaaguaacuaggacgugaaguagcaguuuccauguaauaaaaacuacauacagcaaauggacacugaacauuuuggggaaaucugagaugacuuccuccaugucuggaaugauacaaagaugccacucucagucaguguagagccuaagauaaagcaaauacaagaaauacaaauaggaaagaaagcaaucaaauuaauuucuauuuucaggugguaugaucacgugcuuaaaagauccuaaggaucccagcauaaaacucuaauacuugagaaauguuuuugacaguguuguagaacacaaacuuuacuuacaaaaaucaguaacuuuuuaauauaugagcaauaaaugugccaagaaagaaaaaggaaaaaaaucucuuccauaauaauuucaaaacaaaaccagaaacagaccaacucuaggaauaaacauaagcaagaagugaaagaccuuuauaauaaagucugugggguuggagagauggcucagcaguuaggaacacugacugcucuuccagagguccugaguucaauucccagcaaccacaugguggcucucaaccaucuguaauggaauccgaugcucucuucuggugugucugaagagagugacagugcacuccuauacauaaauccaaagucaaacaaacaacaaaaacaaaaaccucugaacacugaaaaaaggcagagaagacacuagauuuggaaaggauucacaugaucaugaauuggcaagaguacuauaaaaacgucuauauuagcaaaguguucugcaaauucaguguacucuccaucaaaauccuagugguguucuucacaaaauuagaaaaagguuaauauugaaacauaaagaccauaaauagcuaagacaauuuuaugcagaaagaacagugcuggagguauuauaguaucuuuucucaaaucauauuccagagucuagugagaaaaccagaaugguauuggcacaaagacaaacauguagaccaaugcaguauacuuaaggacccugaaaacaaacccauugugcuguaaccaccugcuuucccuucgaaaaggcuguagaaaaguguauugggaaagagccuacuaacuuagugcugggaaaacuggauuuccacacacagaagaauaaagcaauauccaugucuuccauguuacacaacauuaagaauugauuaaagaguuuaaggaucuuugaaauugccagagaaaagcauaggaaaaacauuuaaagauaaagggacaggcugggcuguggugacauacaucuuugaucucagcacugagaagagauacaugcaagcucaagguuagucuggucuacagugccugguuccaggucagccuggcuacaauaccaagguuugacaaggauuaccaugaaauugaaagugaggggaauggauauuugcuaacucuccauaaggcagagguuaguauuuaggaaacauagaaaacuguaaaaaucaaacaccaaaaauaaaacaaauaaaaagcacaaaccacaucaucucuucaguaaacuggaugaugaaugugacacuucucaaagauguauucuuuacgugguauucuugcagaauauggcaacuuuauuuuccacuuuuuuuuuuuuuuuuuuuuuugguuuuugguuuuucgagacaggguuucucuguguagcccuggcuguccuggaacucacuuuguagaccaggcuggccucgaacucagaaauccgccugucucugccucccgagugcugggacuaaaggcgugcaccaccacgccuggcuugagguacauuuucuaugccaguuaaagaauuaaaaggucagaaaacuugcuagcaucucagguagcagcagggaaauaucuuccaaugggucguccuucccuaaggcuugguggcugauggccucacaacuuguuagguaaacauguccuaaucugccuugauugacugucaagucuuugaagaaaucucaaucuuuaaguccuuucuccggguuauagucagauuaucuagggucuuuugguuuaauaaaaauucuuuauauauucugaauauuauuccuuuucauauacaugauuagcagaaaucucugauuccguugucugucuucucacugggauuguuucuauugcuauguagagguuuucuuucuuuuuuuuuuuuuucccuuggauuuuuugaggcaggguuucucuguguagcccuggcuguccuggaacucacuuuguagaccaggcuggccuugaacucagaaaucugccugccucugccucccaagugcugggauuaaaggcgugcgccacuacucccaggugcugagggagaaagcugaagugacugguuaaaaguguaguuuugagccccaaauuggagaugauuauucagagcuaguuuuguuuauucccagacuucuuuauuuuaguaguuuuuaaucacuguuuuuauaauuuugacuaugcauuuauauuuaauaguaugcauuaguaacaucuuaaauguuuaguucuuggacuagaaagauaguucaguguaggagcacuggcugcuuuuccagaggacuuggguuucaauucccaaaaccccgaagacagaugacaaccaucuauaacuccacuuuuaaagaucuggugcccucuucuggcacccauacauaccagccaagcacauuggugcauagacauaaaucauauauauauucauucuauuaguucuguucuucuagaggacccuaauuaauacaaacugccacaaccaggaaacccaagugguuuuagauucugggcuccuacacuguucuucauaccugugcaacaagugcuuucaccgaugaguuauauucccaaauuuaauaaaaaauuuaagcaaugaaagcauugucagacuguaagauuauaaacaaaguuucaacaauuaguauucacguaaaauuagaaaccauuaaacaugaaguauaaauaccuuaaucauuuacuuaaauugcaaaucaugugaugaccagacaaaauaauggcuucugucuaaauccaucuucccagcucugggcugagucaagacgagaugaaaggguaaaaugagacuuagacaugugguuuuuacucacuugccuagucuauauacucccaguaauucagaaguaacucgguuuucuuuuuauuuuuuuaauuuuauaugcaugaauguauauguauauaauuguagauguacucaaguugacaaccaagaauagacaucacaagguccaaaucccugagcaagguaacuuagguauuauagcaaaaaugauggucuguauuuagcuagauuuaauguguaacauggagagugauugaggaagagaguuuuguugucagccuuaggccucucuacaugcaugcacacacaugugagcaugacauacauauaaagucuguuuauuaaguacaguaucuggucaucuuagaaauauuucccugauaaaguguuucauauaaaaauuuaaauuuuuauaugaaauauacuguaguuccagggaaauauuagcaaucuccagaaaccagacaggagccgauucgaugcagucagaguaggaccuuuguauuugagcuaggucaggcccgucagugcaccgcugucaugcaggaugguuugguggagagggagccccaaauaucuaucagggcuaggcuuuauagaaggcugcaagcaggugugugugugugugugugugugugugugugcaagcaucugauuggaaaguuaccauggccuuuaauauaaacuuaauuccuguuuccauugguuauuguuaggcagaggguaggcuuguaaccugggaguauagguuuguugggggaauaaccuggagaugcuggucuuguugggguguaaccuggagacuggagcuagguuuggguuuuguugggggguaacuuggaagcuaauguuauguacuaccucuuaguuugucugaguucaaacuuaggucagguuuucuaaaauagagucugaacuuaaaagauuuggccucucaauacgaagauuacuucauuuuuauacugauuguuuuucgaauuuuuaagaguauguguuuuugaugggcacagugaugcaugcuuuuaaucccaguaguaggaggcagaggcaggcaaauaucuugaguuugaggccagucugcugguccacagagcuauuuccaggacagccagguuuucuauuuaguaaaacugucuuaaaacacaaaaacaaacaaagaaaagaguauguguuuugugcuuauuucuauuucauuucauguguguguguuugagaauuuauguuuguaccugccauauuuccuguggagauucuagaucaacuuuugggguuaguuuuucucuucuaccacgucuucugcauagcucuuggagaguaagucaucucaggucauugggauuggugucaguguccuuaccuacugaggcccaagucugcuuucuuuauaaagcagagaauaguaguaaccucaggacauugugaacucccucccucccucccucccuuccuuccuuccucccuuccuuccuuccugucuuucaagacaggaguucuuuguguagccuuggcuauucuggaacucacucuauagaccagacuguucuugaacucagaaagaucugccucugccucugccucugccucugccucugccucugccucugccucugccucugccuccucccuguuccucugccucaugcugguauuagaugugcacagguuaacuuaauuaaucauaacuucuucuuuuuuuuuuuaaagauuuauuuuauuuauuuauuuauuuauuuauuuauuuauuuauuuauuuauuguaaguacacuguagcuguccucagacacuccagaagagggagucagaucucguuacggaugguugugagccaccaugugguugcugggauuugaacugaccuucggaagagcagucgggugcucuuacccacugagccaucucaccagcccuaaucauaacuucuaaagcuaaaguuacgauugcuaguacuuuuuuucugaaaauuacacuuuguuuuaaagauuuugauuuuuauguucuauguaugaauguuuuccagauaucauguggguguacuggguaugugccucaugccugcagggggggccauagacauccccaaauccucuggaacuaaaauugcagaugguuguaagccaucauguacauggugggaagugaauccugguccucugaaagaacaguaaguucuuuuaacugcagagccaccuuuuaagcucauaagaauuuuuuugauuaagcagauuacagcucuguaguauucuuaugggaaugauccacuaaaguggaaauaacuaauaaagucaggaagaaaaucuuuauccaauaaaggauuuuaaggaaugugauaauaauaguuuauaaugaagucagaugagagucaucuuuuacuucucuuuuugcuuguacuuaguccuuuaguguuauacuacccaagaaacauuucaaagagccacuaccaacuagggaauuuauuaccauaugauugaacaccaccaagggcuguuacuuucaugucucacaugauugaauucauccugcauauuuauaaauuuuuuuaacaauuuacauauuuauuuacuuagauuuuauaugcguugguguuuugccuagauguuaguguguaugaggguaucagguuuccuugaacuugacaauuguaagcugucauguggguucuaggaauugaaccuggauccucugaaagagcagccagugcucuuaaccacugagccaauucuccaucccucauccugcacauuuuuuuguuuguuuguuuguuuuugguuuuuguuguuguuuuuuuguuguuguuuuuuguuuugagacaggguuucucuguguagcccuggcuguccuggaacucacucuguagaccaggcuggccucgaacucagaaauucgccugccucugccucccaagugcugggauuaaaggcgugcgccaccaagcccagcuauccugcacauuuuuacuguuaauugguguguacuuuuucagggauuugaaggaaggcucauagccgucuaacucuagugccaggcguucugaaugaugcccacuuuugaccucuuuggcauuaagcaccuacauuguggcuuacagccauccauaacucuuaauuucagaggaucaauugaugccuucugacuucuggguaccaggcacuuacaugguguguaugugugugugugcagguaaaacacucauauagaaaauacagauaagccuaaaaucuuaacaauuuucaugaaaauaaucagugucucuuuuauguguugaaucuagagccuggcuuucuuaauuuagagaacaguuccauugaagaguuaucuguagaguucucagggucuuucuuuuagucuguuuggggaucacuagcuacagcacucauuuuugcaguaauaacauauuuuguuaaggcaguuacuuuuaguuuugccaauugucuuaguuugggcuuuauugugugaagagacaccaugaccaaggcaacucuuauaaagguaaauauagcuggguggugguggcgcacaacuuugaucccagcacuugggaggcagaggcaggcagauuucugaguuugaggccaaccugaucuacaaagugaguuccaggacagccagggccacacagagaguuucugucucgaaaaaaaaaaaaaaaaagguaaacauuucauuggaguuggcuuaaagauucagggguucuguucauuaucauggcaggaagcauccgggcagaugugaugcuguagaaagagcugagaguucuacaucuugauccagugacagccaagagaagagacugacuuccagacagcuaggagaaggcucucaaagcucacucccacaaugacacacuuccuccaauaaggccacaccaacuccaacaaggccauaccuccuaauagugguacucccugggccaagcauauucaaaccaccauacuaauaucguuaaccaguuuucagucuucauuugauuaguuauauugguauuuguuaugucauuuuucuccuuuucuuauuggauauucuaucuuccccacuuccacacuaggaauugagcauagccagccuguaacuguuucaucuuggugcccuuucugauuucuuucugucaauuguaaauguugaaguaacccaggaucucuccuuuuuaaucaguaauaaauaaacuuacuggauaauuuuaccuaguauccugaauuguaaaguaucaucucuucaaaauuuuuuggaguuaguuguaguuaguuccaaauuucuuauuauuuggcaaguauuucaucuuuaguuauagacuaauguauucaccuaccuucuugauaucuccaauugaagauauagaaaaaagacauaaaaaugaaacauuauuuaucccguuuugauuccgcccccaucuuaagaaaugacaaagaaaaaaaagggggggggggcuggauagaugguucagugguuaagagcauuggcugcucuuccaaagguccugaguuuaccucuuaauuguucucaagcauguaaugucuuuuuucugggccuuucugcuuuguucucuuuuucccugccaugguaucagguggcuagccugacccaggacauuuuuuggaggaauaucuuaaauaugcauuugguggguaggccaaauccuaucuucacagucagcuuuuuuuagaguagaauaacgcaugacagucucccuaauacuauccauacccaaaaggcauuugaguuucuguaagacugaguccaguggucagaaggagggacuagagagauuggagagcuuagagauaaagagauuguuuugaaagcggagaguauagaaagguuagcgguuaggaauuuuucagaucauuugcuugugugguugcagaaauugucacauucugagacuuuggaaaucaagugugccauuuucuggccauugggacuaaucauuuaguuugaacugaggccaagccuuauugaaguuaacaguaauccuucuauuuaggccuuuuuuuuuuucuuuuuuuuuucuaccaaugccauuuucaggggcugcuuuugcuuuguaccugacaguguguaugugaguauagauguucaugguccucuuugugcauguggagcucagagggcaaauuuugggaguguguuuucaccuuguguuguagauuaaacuuaggcuuguagggcaagugcucuacccauuacacaauuuuacugauugugcauucaaacuuuuuuuuccuuugucaguaggacuugggaauuuaaaaaauauguugggaauuuauuuuuuauuaaaaaauaaaaaagguuuauucagcuggaugguggaggcacacucuucuaaaugccaguacuuggaaugcaaaagcagucggaucucucuguucaaggcuaaccuggucuacaaagugaguucuaggauagccuaggcuacauaaagaaacccuaucuugcaaaaccaaaaugagggaaaaaaagagagagagagaaagaagaagaaaagguucacuucauauccuuggcuggccuaaacccaaacacauccaccuacuaagggcuuagagauccaccuuauuuuuaacguagcuaguaauagucuauuuuugguauaaguacuguaauuugcuucacuggugaaaagagacacugucuacaguaugucuauccacccacccauuuauugacagagaauuaaguaccucacucuguccucaaacuaacuuucaguuugcauccauucuuaucacaguauuuaacuauaaugguuggaaaauauucuuucugagaauuaaacauuacauauuuugggcuuuccaaagccauauaugaucucugccacaaaccucuauauuucauggcuuuggguuauaguuugcuaucuuuguccugagcauucuuguuuuacugccaaucuguauguagcucauuguaucacuuauuaauauuuucuuuauugacuauuggucucucccugucuguggaauguuuguuaaguucuugcuuuuguauguacgugguuguuucuuuguugcccuuugugauacagugcagugaagacauuuuuuuuuuuuuuuuuagauuuauuuauuuauuauauguaaguacacuguagcuguccucagacacuccagaagagggcgucagaucuuguuacagaugguugugagccaccaugugguugcugggauuugaacuccggaccuucggaagagcagucgggugcucuuacccacugagccaucucaccagcccccagugaagacauuuuaaccagcugauccuuugucuuuuguuuggguuuucuuuauuaguguguguaguuagauuuuuuuuuuuuuuuguauuuuuauacugaauuuuuugucauuaaaaauacuuguuuuuaucuuuugauuuaauaacuguaacauggguucucuuacuuuucuuuuaauguuugaucuuagauauuauaaccugaaguuauuuccaugugaguuguaugucagguuuuucugaguggcugcuucuuuccaccauaauccuugacuguuaauguaaauagauaacaaaaguugcuugcaauauuacuuguuaguauugcuuucuuaucuacuauagaacuuaaguuggugacaucauaauguacauuucacacaugcaacaguuagaaaguagccaguacaugguuuguuaauaaugauuaaaugcugaacagaggagaugcuuaggcuuauaagcuguuuaugggcugguagaaugcuauguuguguaccuuguguacaaaucucuuaauaugaauuuuaaguaauuggaaaugucuguaguguugcuugucuugugcggucuuucagucccuuccugucuuuacuauauaccgugagaaaguaggcaugugcacuccuuaagcaugcauuuccucuaagauuccagcauccgauucaggugcuugccuuugaccuuggcauuugggaggcagagacgaggcagaucuuuugaguucaacguuacccaggcagaucuuuugaguucaacguuacccuggucuacagaacuaguucugggauaaccagguccacacaggaaaaaaacucuaucuucaaaaagcaaaacaaaacaaagcaaccaccccccacaaaagccagaagagaaacaaaacaaaacaaaaagauuuuuuagcauguuuuaccuugcauugugucauaucauuuuuaacuuuuuuuauuauuuaaaaaaacaaagcaggguuucucucuauauaguccugacuauucuggaacacuguauguguaccaggcugaccucaaacuuccagauccuuccugccucugccucuugaguuccuggcacuaagauuuaguuauaaaauuuuauguguauggguucuucuauugcaugcauaugauugccuagugccuacagaggcuagaaugaaguaucagauccuggaaguggagugugagucaccacauauguccugguagcugacauacgcucucugccagagcauugaguguucuuaacuggaaagcauacaaggaggauuuuccaguuuucuauuuuucacauuaaucagcaagcauuauaaugauguaaaaauauaaguucuuuuucuccuuccugguuuugacuucauuauuagcuccaauauuauuuuuuuauucuuacuguuuguagguuguuucccuaccacuaccaccaccaccauuuuuguagcucuguaagucacagcagccauuuucagaguuuucaccauuuugugauuauaaacuagugggcaauacuuauuuaucacagauugugcugugaguggaagcaucucuccuuuagagacugggaacuguggaaggucucacaggauauggaauaacuuacaauuuagaaugaugucuuuggagaggggaacuugaaggaaacuuuuauuuggacucuacauaguuaagucuugauaauaaauaaauauuagauuauagauccagguuaaacagccagucacaaacuuuuuugagcugauuaaacaaauauguuauuacuauuuucugucuuuccuguacuuuguuuuuaauaaguauuggccuacucuugaaccaauuaaaugugguguaggcauaggauuugauagaauauaguuacuuuguaguuacguagauuuugugcacugaaauguacagguagagauuuggacacuuagaauuaggugcugaauagaagaaauggauuuuagagaaaugaaauauuacaguugauagaacuuauucaugggagaguugaaauaauucuuuuuaauaauugcuaguuugugaaucauuuaaucaagugauggaaacauaggaacugcagugaggaaaugaauuugagcuuagagacacuauagugggguuucuuagggaaggagagauauugaaaguggguaccuaacucuaccuugggauuuauuuuuauuuuauauguauggguuuuguuuugguuuugccugcauauauaucugugcauucagaagagaaugucagauccccuuggaacuagaguuauagaggguuguuaaccaccguguggguggcagaaaagucaguagucuuagccugagccgacucucuagccccacuaaaucuuaucaugggagaaaagaguaaguuaagguuugggcauaacuaaaaaagaacaaaguagguaaggcuuuuaaaaaacaaguuugugaaggaaaagugaaucuuuguuuuauaauaggacagauuugaguauguaguuaugaaggcuagcaggauagcuaaagucauuuugauguuuacauauuuagccuagaaaaccuuaacuuuauuaaaucuguguuaguguuagugcagagaaacugggauucugggacuaaagaccuauuacauuauagugaguguuuuggucuuaacccugcagaacacacacacuacgaagauuauaauuagcauuuuuauaaaucuuugcguuuauuaauuugugagugucucuuuacacauaacugucacuaagccucaccacaaauuaauuucuaaggugaguauuagauuguuuuuuauauagagcaagaauuuugugcuuuguaauuuuaacacaaauaggucugauucugaaguugguggugcucuuuucucuauaucaucuugucuccuuucuaaccugaagucuuuuaaauuuaggcuccuguucccuuaagugucagauagggauaaucucaucagaaguguuaaaugaauaauaauauuguaauauugccuauauuuuguuugacaaaggaaauacauaugauuaaauggaagacagaccuuauaacugcggucauccucagcccuguuauuugucuaaacaguuucuuacuuuuuaagguggugucauggauacagaaaugucugaagauacagaccacaacuuaacucccacccuugccagcaugucuuauggaaugccgaaucaaacaggaucugaaaauucauugcuggaugaagaugauuauuuuuugaacucuggggaucuugcaggaauuccagucguuaguagugacaaugaggaugaacaggauuguaguucaaaggacaaccuuguuucuucaguucacacugaugguaguuuggaaguagagagaagagcugcucaucaggaaucagacaaugaaaaugaaauacaaauucaaaaucaguuaaaaaaagacuuuccuaaacaguuugaucagguuucugucuuuaaaucaauacgaaaagauuuuuguuuagugagagaaaacagcaaagagacauuuucuggaaaggagaaaaauagagaccuaacuuaucaugaacgugaaaaacgguuggauaaaccccauaaagguuuggauucaagguugaaaagcaguuuuuuugauaaagcagguaauaauuguuggaauagaauuauaaaacauaauaacaaaguaccaguaauagcgcuuuuauugaucuuaaguuaaguacaaauaguuuuaagcuccuuguaagcucuguuuuacuuucucuuauucugcaaagugauugaauuuuuccucauaacauuucauuguuauauaaaugguugaaaaauaucucuaagucauaauuuuuccccuucuuggcuugcaauauuuugaugagaaggcaagauacuugcaucaccuguuccauuucuuugguugaacaucagacucugaaguuggaauuagcaucuuugugcuggaaacacugguuuaaauugcuaucccaccuguuaguuuaaaccagggaguugcaaugaauuacccccacuguuuuaggaguucauuaaguuccuuuugauucucuuuacacgaugcacccuguacucuagcuccaguucuguucuugaauauaucacacauuucuugugugcuuuccuuucuugcuguuucauugguaugccaauuuuuuucucugugcauauauacacuuguaaaauuauuucuuauucaaugaagcauaauucauaaaucuuuccuacuuuauaguuauuccuaaggauauucucuuugcuuauauuuucacagaacucuauuuuaugccuuauuauuuauaguauuuguugccuuguuuuguuccuauuuuugacagcuggauuguaucuuacucuucuuuguauucuugggaccuaggcuuuuacaacaagauuguaauccucucccaaauguuaaauugauguuuagaaaagcagaugcacugugucaauccauguauuucucuucagaaaauccuaggaaaaauguauuuuagaaagagggaaccaguauagugaagaagagcaacgguugaguauguguuauauacaaggcugugcaagggcauaguuuauuucuaacauguuauuauagauauaauuuauauacauauauauaugugugugugcguauacacacacauacauauauauacacauacauauauauauaaauaaauaaauuaauaaauuaauuaauuaauaucucuuaauggauauugacacuuuuggagucuuuccaaaggagcauaauaucuaguaguagaagggacaagacaagguagagaguagaggugcuaaugaagaguugacuagcccaagauugaauguguaagauaagauaguguaagaagaguuugucauggggcacuguaauauuuaaguaacugaaguguuaaagugauugcuuuuuucacauuugagagagacaagcuggccuggaguucucugcacuucugccuugucucuucaguguuuuaacuaacagguaugagccaccauaccuagccuaacucugccaugccccucacccuccagagugcuugguauuagacuuuggaucuuugugcaugcuagacaaguccccuaccacugagccacauuccuaacucacaggacauucuugggagagacuuagugaauaaggaauguuuuucuauagagcuggguuuugaacugagcagagucuguaaacuauaaauauugggauagacagcaaagaccuggugaacuuaguaaaacuucaaaugagaacaguuuucagagcauaguagaucaagucagcacucuuuaugagcgaggaaagguguguaguaaggcugaaugguaagggagaccaaguugugaggaacuuugagugaaacuuuuuuggguucuuuggaaccuaguuagaacaucuuuguuagaauagagagaugauuucaaauuagccuuuuaggucauucuuuaugagacuuguuauucauauacauguguuuguuuguuuguuuucuuucaauagcuaaucaaguugaagaaacauuacauacucauuuaccacaaaacccagaaacaaacuuuaggguaaguuuucaguguguauguagauugcuguuaacuguggcaagugucaaaaguugucuuuaugucacuuuucaaaauucugcuuguguuagacagagcacugauuuuuuuuuuaaacuauuauuugcauaaugacaucuugggagauauucuaaaaagccucggaucuuagguucuuuguuugcauuauuuagaccaugagcuuuuaggcauagggacacuaacauauguccauucagaguucauuuccaaugagcuuuacuuugguuauuaacccugaagaggaauaauuuuuaaauuugaauauuuauuaauccuuuauauuguguuuuaggacuccagcuacccauuugccaguaaagaauccauugguucggaacuggggaauucguuugcaucaaauauuagaauuaaagaagaaccuuuggaugaugaguaugacagagcaguggcgccucagcagggacuacuagacagaguuaaagacgaaccugacaaugcucaaguaaacaccucaccccuccugccuccuucuguuucacaacgagcuuacucaguugagacaggacgugcuuaaagugaaauaguuuauugacaggaugaaaagaaucugugauugaagcaacuugaauuguuuugcaaggcuguagcagaaauuacaugaaaauguuucugaaggggaguagaggcuuauaauccuugucuuuucacaguguggcuuuugugggcauuuuagagcagguuugagagguugcugagucucugagguuucagcagugcaguugaagagcuaggaggguggcaccugggcuuguagagugacuuaauucauagaugcagcuaagccuuugcaguuacuucuaaugaaguacagguuagguacgcaguuaacuccuucaggagggcuaauggacagaacuaucuuugaaaggguuaauugauugaauuaguuuguuagaauuggucaguuuauuagaaaggaggccuuggugagugauucuugauuccguguuugagauauuuggguaguaagaucaaggguauggcugugcuguuucagggcugcucuggaagucaguuaggaauccugcaacagaaauccuacacucaguuaaguuaccagacaguugauggcauuggaguaucuggauuggaagaaagaagcugcgcugcgggcuguaguuacugugaaauguaggaagggauuuaaacaaugaauauauaauaguaauuuuuuuaaagguagucuguauuuuguucauauuuagagagugaaaaauaaaaauaacacaaauuagcuguuucuaggaaauaguaucuaauuuuaggaagccuaucuuuucuuuuuuuuuuuuuuuaauucuagggaauuugugaaugaggcauguauggaagagaaauuuuauuuagccaucuucaagcaggguuucucaacaucaguaccacugauauuuagagcaagaccauucuuuguuaugaggccguguucugcuagucauaggcucucuagcauccuugguucuauacuauacuugguucugauugcagcucucucuuucucuaguuguaacagucagaaauauuuucagacacugccagguauuccugggagcaaaaucauuuacuguagaaaaccacugguuuagaugaaagagagaagaguaggugacuauagaguguaagagagaaaagcagguggcuugugaaaugagcugacacauaauuaccuuucagaaaugguguuuauugggagagagcauuguaaccacaggagccauguaagguuggaaaacauucaaaaguaaaaacacaguauaucagaaacagcauaauagggccuuaaaggaaaagaaagacuucccuuuaaaaucuggagaggagcuucauuaaggaaggauagcuuaaaaguaggaguaagagaaauagcuuccaugaugugauaaagggggaaacuuagauaaaagaaccuucagagaaauaucccaacaaaagaaaaucugugguuuuuauaucuuuuaauggggcagcaggaaguuuuauacuauaugauuuaguucagcauagcauauauguguguggggugucaacaaagacaguagaaggaauaugaaacuaugucaggggugguaaauuaaguauaguuuguagaaagaagagaaguggaaaucuuggguaucugaguucaguuuaauggccugauugccagggaaaauucauguggccauguguuucugugaugauuaugugugucuuuguucaggggagaucucuaucucuccauacuuccccuaugaacauugaacuuuccuaagaaaucauuaugcugguagaguacucuuucuuuccuauaugaugcauugaauuuuucucaugauaaagccuaaagcugauaaguaagugggguuuagaaagcauugggaaaguuauuacuauuguuuuguuuuuuuuuuuuuuucuaagcagaacuuucaguguuuagagaagaucgauaggauggaauggauagcaaugccuguauuuuauacacuuacugaaaguuauaaaauauguuacaaaauucuaaauaucaaguuuauaauacuuaccggaaagaauuuccucaggcguacuacuuauuuguuuggucuccugaguagacaguacuauggguagauccugguauaaauacaggaucacagaguagucuucauccugucuacacaagagagcaaccccagcacaugaguggcuagagguagauuucuguugucagucauauugauccuguuaucugcaauaucaaacauuugguaguucuagaaguccuccaagggaggagacuguuuuuuucccuuucacucucuucuuucccuuccuuccuacauuguacucccuacuugcuccaugcuucuuuguaccucucccugaucacuggaaaucuagauuucuugcuuuuucaguacuauguaacaguuuauuaauuuuacucuuucuccauagaccaauaguaagaguuacaaaguauuauuuauuugauguaacaaauuguacucauaaaauacugacagcucaugacucugaucaucaguuaauagugauuucucccagugcuuaacuuugagguauugcuuucagugugcuuuuuacaguuuaagauggucuucauccaaaacacuaggaugcugaaaugccuacauuugugucucacugcuaauccauugcuuuuagucacuugucauucaccuugcuucuguuagcuggcaaaccauucucugguuuuucaguuucauucauucuaauuccauugcauuuuucuauaguguuuucuguaguuuaaaaacuaguugaugcuguuuuuaauguacuguauuguuucauccucguaacaguuguguguguguguuuguguguguggucuaaaguaauauaacuuucauagauuaauuuaguuauucaaggcuguauggccaggaaagaaucagucuauuuuauaaucuaguuuuauuuucauuagauuaucuuucuguaacuaauuuuuuuuuaaauguuuagguaaggcuuucaaauugaaauucuuuaggagagacaaaguccucuuuuucuaucuuuuccauagaaucugaaaguuagaugucacuaauguugaaaucuucuucuuuuuucuucuuuucugcucauaguaauaaaaaaaaaaaagaacuaauuuguagucuucuauuggaauaaaugaaaaugggaaagcaaauugccuaauuagucuaguaaugauucauagacucuuugaaaguaauguagccauguaaauguuggauuuaccuuuaguuauauuguuuauuuggccauagaggauguuuguuuucaaugucguugcccugugguauuuauaaggccuuccuuuguguucagcaaggaaaagaucugaaguuauucugaccucugguuuuuaguuaguuuuauuuuguuuuguuuuugaaaacuuugggguugucagguauuuauuuuucauaagucaugauuuaagagucauuguaggagacagacaaaccaagcauuucugccuugaagauguuguaagcaucuuauacagaauacuuaagacuucucuccucucccugcuaccaugaauaauacauaccaaugacuuaaauaagucucuuacguuugggaauugcuaucacagaauaagaaaagcagacuagagauaugccaggugugguagugcaugcuuuuaaucccaacauuuagauaaagucaggcagaucucugugaguuagagggcagccugauuuacuuauuaaguuccaucccauccagggcuaugcaaugagauucugccuuuaaaauaagaguauguaucaccaacacugcuacuuuuacuaucagauuccacaugauaugucacauaguugaugauacauuucuuuuuuuuuuuuuaaagauuuauuuauuuauuauauguaaguacacuguagcugucuucagacacaccagaagagggcguuagaucucauuacggaugguugugagccaccauguuguugcugggauuugaacucaggaccuuuggaagagcagucagugcucuuaccugcugagccaucucaccagcccaauauauuucuuacauauacucuguucauugugucaaagaaauagcugugcuagaccaaauucugaauuuaaaaacaaaauucugggaaccuuguguaguuacaaacauaauacagauaauuacauuauuauuaauacagcaucaguacuuaacuguuguuggauuuuuggccaaaaacaugcaaauuuauuuuauaggaaauaaagaagauaagguaauacaguuggggaauaaauuaauuacuuuuuuagagaauuaauaaagcuugugauaauugaguggaaauguagguaaaauaauaauuauagaaaugacaguacuaguucuaugucaguuucccauuugagagccacuauucccaguagcaacuaaaaaguaaucguaaacuaaaagauaacuugaaugaacugaugagcucucucucucucucucucucucucuuuuuuaaugugagaagugaaaauaacgucaacuauuccuaaaguaaaauacagguuugaugaacauaaugguaauucaguucugauauuuugaggaguagguaaacacauacacacauacuguauguacauacuuuuaaacguauauagaaaaguucaguggaaaacaguuugguuaaacauuguauagcuucaucagaauagugugguacaagauuaaucaggaugaucauaauauaaaauauauaacccaugauagacauuuucccacaauuugguguauuccugggaagaagaaaaaaauuucucccuagaaaauuucucccuaggggacuuuugggauagcauuugaaauguaaaugaaaaaauaucuuaauaaaagaauuaaaaaaaaaucuauuuagugaaagaaaauuucccagucccaaauggaucuaacccagcacuagcaaauuaucaguggcuggucaaaucucauccaccuuauguuuaagccuguuguucaaccauuacucuuacaaauaaaguuuuauuagaacuuggucauguucauuuauuuacauguugucugugagugcuuuugcucuaccagggcagaguugggcaguugugagagagaucagaccauauggcuuccaaagucaaaaauauuuacuaucuggcccuuugcagauaaaguuugcugaucccuggauuaaaggacuguauuauaaacagugaaaccacuuccuuauuauuuuuuuuauggaaguaaaacuuuguaagagauagaagaaaucacaaagguaaagauugucagaauuuuggcauaaguggaaaccuuaguacauaaaaauucuaacucuaaagaaauguuaauaaaugcuacugagguuaauauugucaucauauugcacuuguaugugaacauuaaaaauaugugcauguuaaagcaacuaggaaaacacuuuuaauugagaauaguuuuguuugagaacugggcaugguaccauacaucauuauugccagcacucggggggaaaaggcagguggauuucugaguuugaggccagccuggucuacagagugaguuccaggacagccagggcuacacacagaaaccaugucucgaaaaaccaaaagaaaccaaaacauaaauuacagcuuuauuucgacaaaaccaauuucaucaugucucaaaaaccuuuauaauggaucucguaaccuagugauccuacuuuaagaauuaaagauauucaugguggcauuucacugagaaaacugaauaugugcaaauaacuguuacagcagugccacacaugaauguguuagugacugaggcaaaagguagaaaaaaaaaaucaauaaugccuaucuugcuuuuauuugaagcuguguuguguuagccaucgaguuuuacauacauuuucuuuuuaaaguacucaaauuagucauuuuaguaguacucaccugugaucccaguacuuuggaggcagcaggauucuggaguuugggcuuugucuggucucuuugucaaguacuaggccauuuaugguuguacauugaaacucugucucaaaaacaaaaaaaaaaaaaaaaacaccaaagaaagaaaauuacuguguuaaaauacuauuauaauugcagaagguuuaggcaguuuuccuuuuguaccuaagucuagguacauauuucaugucagcuucagcugcuuaauuugauaugccacuauguauauauaauaaauaucaauauugcucaagguuguauaguauauuaauauuuccaccaccaaaagggaguaaguaugucugagacacccaguauucuaagaauaauuggucucuaguauuuuacaagcuuuguugugauaaauaucucaaaaaaaaacuuacugaauucauaguugagcaauauaauuguaagauaaagaacagcccugaaaacucugauguguguuggcugugucugacuuaaaauguuuacuugcauuuaaaacucauuuaaggcuggagaguuggcucagugguuaagagcauacuugagaggaccugugguuguuucucagcaccuacauauaguggugcuuguaauccuuacugaauucauaguugaauuuccagggauucaggguccucuuuugaucuccaugggcaccagccaugcaugugcuacacacacacauuuaguaggcaaaaacucauauauguaaauaaauaaauuuaaauuuuuguccuuguaagucauuuaauacaguuuuucaaguguuuguucggaauucucagacuacccagacaucugguucuugcacucaagucuuauaaaugcuggaauuuagccacuagauauuauuuggaguaauaugaaggaauacaaaaaauugaaaugagaagaacaugaauucauaagaaaaauuuauuuauaguaauuaacuguaaagaaacuaacuuuucuuugacuagagaaaggaaaagacuggaaagaaauauacuggagucccagaggcccauuugaggugauagagggggugguagauuuuuguuuauuucuccuuauuuaaauguucuauugugauuauguauuacuuuuauaauaaacagaaauuuaaaauauuguaauaguaaagaagaguuucaaaaauaacuuagaaauaccugguagcacgccaggcuguuuuggaagcuaacacucauuuauucuucuuuccuccuagcauauacuaguuuauuuugcccuuauuguuaagucuaguuuguuuacuguuucauauuucauuauuucuuauuaauguuaauacugugaacauuuucuaccucuauauagcaauaauaaaaugucuugguuucuugaaggauuuguuaauuucucuguauuuauuuuuucuuuuuuaaaggaguauagucauggccaacagcaaaaaacucaagagggggaacugaaaauuagugcuguguuuucagucaguggcaguccucuugguaagaaucagaccugaaugaaugaauuguauuuauucuggccaacaucaaugagaggccauuucuacuuggguaaauaaaauaggguguccucuguucauuuagaauccuuuauguuguauauuccauaauuaauacuggguuccaaaguagcuauagaagagaaaguacagaugcauaaaauauaaaauuaaaaaguaaaauuuuuugcuuugaauguucuuuucuuucuuucuuuuuuuuuuuuuuaaagcuccacaguugacuacuggcuuucagccuucucuggcaucaccuggcaugaauaaaaugcuuccuucaguuccagccacagcuguucgaguuucuugcucugguuguaaaaaaauccuccagaaggggcagacugcuuaucagaggaaagggucuacucagcuuuucugcucuacccugugccucacgggauacacaguuccaccugcccgcccaccgccuccccucaccaagaagacuuguucaaguugcucaaaguauagcagaguucuaaauuaucuuuuguuucuuuauuucuuuuaaugcuuguuucuuaaccuguguauuauuacuugcauuucaacuuugcuguagguuuuucuuguaaaacaaaacaacaguuaaaaaaaaaaaaaaacauuuagugccccauguugcugcuuuccauuuuucugggaaguacucaaucucuuuuagcucaacaagugauuuuuaaaccaauuccuucauauuuuuuaguuaagauuucuuacauucuacuagucuagcacugaagcacuuuuccaauaauuuuucuguguagcacacuggcuguucuggaauucacugaguuacaccagccuggccuugagcucaucuagaugagccugggucugccucccgcgugcuggguuuaaaggugugcgccacggccauccugcucugcauuguguauguaccaugugugagcuuggugccuucaggggccaggagugguaaugcauacuguuaauuccaacacuugagaagcagaggcagguggaucuuuugaguaggaggucuacagagugaguuccaggacugccagggcuacacagagaaaccuucuugaggaaaacaaaaagaacuaaaccaaaggaaccccccacccaccgucccaauucugaguuuauguaaaguauuguuauagcgaaagugacaacugagcaacuuuagccauuucaccaugaagauauacuuuaaagcauuauauaaguaaauauacaguauuaccugucaguguuaaacaaaaauaauguagcaguauauacuuuguuggguuuacaacuauuagucuaauggauaccuaauauuauuuauugaauuauuuaaugaccuuaaauuuagagaaaagcuauuaguauuauagcuacuaguauuaugacuuagguaaggugacuauuaaauugauuuucccguacuuuuuuggcuaaauuaauguaccuaaagcagaguucuuuauuucuacuguuuugugauuuuaaaaaugaauacuuagcuguauugucuaagcuuuuauauuuuagugcaugcacuauuagguuacuuuaugauuugaguuagauugaaaacuaugauuauuuuagcuuucuagcuugcuguuuuauugugaaaaaguuuggaugguugauguaauagcuuuacuuguucaucuuuaaccaucuuaagaaucagggauuucugagacaccacugauacuuuuuuccccaugagaaccauagauacaucuauaaagauuuuucauuuuuaucaauauaagcucacauaauuguacagaaauguaucaccuuucauguauauauucauaauaguaugcugauaggggaggucaugugcguacucuguaugcacauguauauagguauauguacauacaugcacaugaauaugaaagacagaggauaaccuuauccucaggaauaucaggaaugcuauaugccuucuuuaagacuagacaucacgggggcuggugagauggcucaguugguaagaguacccgacugcucuuccaaaaguccagaguucaaaucccagcgaccacaugguggcucacaaccaucuguaacgagaucugacuuccucuucuggagugucugaagacagcuacaguguacuuacauauaauaaaugaauaaaucuuaaaaaaaaagacuagacaucacuaauucauugacuuggaguuuagcacuuacucuagacugacugggauuugccuuagggauccuucuggcucucuuagguauccuccaguuucaaggauucuccugucuggucuuuucuagcauugguauuacaagugcuuaucaccauaccugguugucuuuauuuggguucuaggaauugaacauagguccuuaugcugucaagguuauacuuuacuggcugaacuguaucccagcuacaccuuuuggauggauggauauauauauauauguguguguguauauauauauauauauauacauacacauauauauguguguguauauguauauauaugcauauaugugcacauauaugcacacauauauacauacacacauguauguauguguauucguauauauuacauuuuugcauauguauuaauuuuauauacacuucuuauauuuuuuuuguccuuuggugguuauugcugaguuaucugaagacacauuauuuuucuauacaugucagaaauaaguguuuaaggggcuggaauggugacucagcaguuaagaguacuucuugcucuuucagaggccuuuaguuccgaggacccacaucaugcaucauaaccauuuguaacuucaguuccagagaauccaaugccuucuagucuccucaguaccaggcaugcauauagagcauauauguacccagaagcagauguucuuauaaauaaaucuuuaaaaggauaccuaaaauucaauguuuguguuuuucccucauccaucaggauuuccaguuucaccuguucucacuauuuuauccccucauucauuuauucuuguguccauuuuuucucuuuacuuuuccguuuccucuuucuguuacuugguagcacuguuuauuuacuugcuugucucccccuccuccuucuuuuuuggcucuuucgagacaggguuucucuguguagcccuggcuguccuggaacucacucugaagaugaagcuggccucgaacucagaaauccgccugccucugccucccaagugcugggauuaaaggcgugagccaccacugcccgguugggauucauucuucuuugucuucauuacugaugcuuacauauuaaauuuuuuagauguggacaucuagauuuuuuuauagcgaugcuuaaauauguaucacacaggacuagguaaauagcuuauuuauaaaaaugauugccuuuugagcacguaaguuuagaugcucaguacugggaaggcaaagaguaguagaucccuguaggucaguggggcaccuacuguuuacucuuugaauuccagguucagggagacccugucuuggagguuuguaagaugauucagugaguaaagacuuaguaccugaauucauuccuggaagccacaaguugucgucugacaugcagacauacagacauacaagauaaauaaacaugaaagagaaaaaaagacagaaagaacaacacacccccccccacugcaauacacaccacaaauguauacguguacacucacaaauuuaaacagcuguacacauguacaccaacaaauuuaaguugcaaucucuccugggggcuggagagauuuagugguugagagcauugauuagucuuucagaggacccuugugguagcuuauagccaucuaacuccacuuccaggugauucaacuccuucuucuguuccuugacugcaccagaaacccaaguggugcacgggcauucauguaugcaaaguacucauacacauaaaauuacaaauguuuuuuuuuuuuuaaagauuuauuuauuuauuuauuauauguaaguacacuguagcuguccucagacacuccagaagagggagucagaucucguuacggaugguugugagccaccaugugguugcugggauuugaacuuuggaccuucggaagagcagucgggugcucuuacccacugagccaucucaccagcccccaaaauuacaaauguuuuaauuuuaaaaaguugcaaugcccuuuauuaucagccuaguuuuauuugguuccuuuaauauaccaagagggugguaaauguaauauccugugacuaauuucaucucuguuaucauuuuagagacauuuuaaauccaaaggaugugaucagugcccaguuugaaaauaguaccaccaguaaggauuuuugcagucaaucaugcuugucaacauaugaacugaaaaaaaagcccauuguuaccauaaacacaaauagcauuucaaccaaaugcagcaugugccagaagaacgcugucguaagucaccucuuuacuguacacgaaugaguaaguuucaugcuuaugcuuaaagaacaaugcuuaguucuuuguuuaauguuuugauuguauuuuguaauucuuagauucgacaugaaguuaauuaccagaacgugguucauaagcucugcagugaugccuguuuuucgaaguuucgcucugcuaacaaccucacuaugaacuguugugagaacuguggggguuacuguuauaguggcucuggacagugccaugugcugcaaauugaggggcagucuaagaaguuuuguaguucaaugugugucaccucauacaagcagguauuugaucuuuuaaaucuugauuuaucuucauuucaggggaguugaaaccuuggguaggauuauuuuugaagcaguuuaaaauaaugagauaaguauuugguuaaguuuuuguaugcauuaggcauuugucaaauguucugaaauagaguucuauaugucccaguuucuguacaugcauuacggaaugcaucuuuuagccgaauagugguagugcacacuguuaucccagcacacaggagacaaagggaggcagaucucugcaaguuuguuugaggcagccauaguuacacagggaaacccugucccccaaaacuaguaagaaaugcaucuuuuaggcuggguggugguggcgcacgccuuuaaucccagcacuugggaggcagagacaggcggauuucugaguucauuucugaggucgaggccagccuggucuacaaagugaaacccugucucgaaaaaccaaaaaaaaagaaugcaucuuuuuaggauuuggcuuuguuuuguugagacagggucucacuauggagucaugucuuccuggaauuugucauaugacccaggcuaaucuugaacugcccuuuugccuuugcuuaccacgggcaggaaucaucugcauuuaaugucauuccuggcuagggcguggcuuuuauuucagaugugauuuguguuuuugaauaguaauuuuuaagugacccaaacauacagcagaauuauauuuccuaggaauauccauucuuuuuaauguguagccuucugaucuuucaaauauaguuugguuuuuauauuuguucuucagcaaaaagguucagauucauguaugucugugcguguguguguguguguauauacacacacacacauauacacacauacauacauauacauacauacacaugcucacacauauauuuucuugcaaauggaaccacauaauuauaguuguagaaaauaaaaaucuuaguagagugaagagaauuuucuuccuuaaccagaagaaaugagggcuauucauuacuuuguaaauuagaaauuugcagagaauaaacuggagaaacucuaugauaagaaucuucuaugcuauuugguuuuuuugguccacaucucaccaguaaauuuugguuauauauuaguuucauaauugguuacccuaaacagugguucucagccuaaggagcaugacccauugguagguggaauaacucuguuacagagguaguuuaauaccauuggaaaacagauuuuacauuaugauccuuagcaguagugaaauuacaguucugaauaggaaugaaagcaauguugucaggugugguggcgcacgccuuuaaucccagcacucaggaggcagaggcagguguauuucugaguucgaggccagccuggucuacagagugaguuccaggacagccagggcuauacagagaaacccugucucgaaaaaccaaaaaacaaacaaacaaacaaagcaauguuaugguugggagucaucacaacaugagcaacuguauuaaaggguugcagcauuaggaagguuaagaaccacuguccuaggggaugguaaauacuuuuuauauuuuacaguggcuuccuauuuuauuucauuugcugaucugacuguuuucuuuuaauacauagugaauuuuguauauaggccacuaaaaccagugaauagugccaguuagguuuuacuguuauugcauucaauuauuuugcuguuggggaagggguauuuuugcuuuguuuugagaguuaggcucucaccauguagcacuggauggccugggacucacuguagaaauucagcauuuuuaaaauuauuggugauuucuaauuuuugaaaggguuuagccuuaacgcauaauauauacuuguuuuuucucacaaaugaaaaauaauuuaauauuuuuuaaaggcuauucuuuuccugauauuuuaucagauacuaaaaguugaggcuucauaaaaagagaaauagaauaaaacauaauuuuaaauuggguuuuuaauuuuaauuuugaaaguuuacuuuucauguauuaaaauaugcuguguuaaggacauguuucucaggucccuacucucagucuuccagaaguacaaggaccuggcauggugaugcacaucuuuauuucuaagaauuugggaauuagaggaaagcaggucccugagcuggaggccaguuugguucaguuuacauagcuugugucaagccauuuagaacuacauagugagacucugucuucaaagcaaaaacccaaacaauccuucucccaagcaaaaaaagaccaaacuauagauuuuuaauguagugaauguuaagaccaaccuaauauguucacguacaguuuuacaugggggaaaacacuacauauauucuagguuuuuguuuuuguuuuuguuuuuuuuuaccuauuaaugguugugacaacucggcuguguaaacuaagagcaaaagcacuaauacacagccuggcacauuguggaugguauugcuucugcuuuccuuucuuuaauuuuaauuuauucaaacaaacauugaauccaauuucuguuuugugggaagacauacuucugauauauaaauaaaugaaaagaugguaugauagaaguauuaugagguucuauguaucacaaacaaagcauagcccguaggacuagauagaugugucagcaaaagguuacaaagauaaguuucgacucaagucuuuuaaauuaaguuuggguuuacaguucugaacuaggaguuagaagauguuccaggucagaacauccuaauauacacaaauuuuagugucacacuuacaacuuaucacagaaagggaagauuguaaaaucuuuuacuucuagcuugagcaguguuuucuuaagugugugacaggguaagaguccuugcccuuauuuucuguugaguuccuaguugagugacaggugcucuguuagaaucacuguuuucugcucucgcuugaugcuuacaacacgccuuguuaaggagaggauuaauaccgaguuucuaaauuuacugauuuccuucaauuagaacuuugcugcuuuaaauaguaucucucauaggaagcucuuuacacuuuuggcuaauauauaaaagagagacaguuguguuauguauaaaacaaguuuuuaaaaacaacguuuaucaguuauuagaucuuaaauuaacacuagguuauagcuaacacuguuuucuaaugagacacaguagaaauacggaaguauaacauacgguuccauggugaaaggcuuuucacuuuuguaugcauacauaugcaauaugcauacucagaauuucagaauaacauacaaguuuccuuugugaaggaucuuucugaggacuguacugaugaucauuugaaaacuacuguuuuaaaauacuucaugaguaaggggaagaaaauguaccaugcagggcccugggauugacuccugcuaccacacauaaaaaguaguaauauuucaacagaguuaaguuaaacauuucaaagaauuaugcuuuaugaauuugguaaaaaugaauguuguuuuauucuguuaauagaaaucagccaaaauaacaccaugugcgcuuugcaaaucauugagauccucagcagaaaugauugagaauaccaauagcuuggggaagacagaacuuuucuguucuguuaauugcuuaucugcuuacagaguuaaaaugguuacuuccgcagguaauacugcuuucauaaacuauaaaauguaaucguuggaaaauuaguuacuacuuuuuugcuggcccaauuuuuugucuaaauuuaauugauuuuuaguacaaaccuauuucacacuuuuguuguaaacuauuaccuguuaccguauuuccuguuugccuauuuaugcauccccuuacugaauggauuacaaauaaucuuccuuaauguauuuucuuuauccacauccaguauauuucaagauccauuuauuuuauaauuucaggguagauuaugccuauuuaaaaauuuaaagcuuuuuaaauguucaguuaguuuaugauagauguggcaugauugagguuuagcuucaguuccuauagcuuaaccuaaaaauugaauuuuugucugauacuuaauuccuccuagguuuaugugugacucauuagcuuuuacuuucauuugcuaagguguacaaguucaguguaacaguuguaaaaccucagcaaucccucaguaucaucuagccaugucagauggaaguauacgcaacuucugcagcuacaguugugugguagcuuuccagguaggaccuugggaaucuuccucuuccucagucagugaaucaccuacuguagucauacaaacuugcuguuuccuugugccaggauuauuguuucuauuacagcuucucagcuuagcuuguuaguuuagccuguacaggcacuuaacugucauccaugagauuuaauaacacuauugagagaauacuaguuuugaagauuauuagaugguuuuccuacaugagugagacuugccucauucaguuuuaaggcucaaagacaaggcgccuagcuugcugcauugcuagaaucugucuuggcauacagaggggcguaauuccuagucuuugaacaggugauuaaauagaccuauucuuauuguuuuacuuuuuucagaauuuguuuaacaaaccaacuggaaugaauucuucaguagugcccuugucucagggccagguaaucgugagcauccccacagguucaucagcaucugcagguggagggaguacacccgcugugucccccaccucgaucaacagcuccgcugcugcugggcuccagagguuggcugcccagucccagcauguuggguuugcccgaaguguggugaagcuuaggugucaacauuguaaccgucuuuuugccacaaagccagagcuucuugacuacaagguaagugugggcuccuagcugcugugcaagugcaugcacacaggauugugaguuucagauuaauguggcuacuuagucagaacuucuuuuuauaaaauacagaagaaauaaaacagcaaaguauagguccaugauaagaguuugaauauaaacucaaauacacucuguaaauguauuuuuugacuuucugucucaaaauugcaccauuuggguuuuucauuuuugagauaggggcuuacuguguaaaucuggcuggccuggaacuuagucuauagacagguugguuuugaacuuaaagaggucuugucucuugucugcuuucugagcgcuaagauuaggacaugccaugugcucaacugcuuaccauguauuuuugaauuaagagggaugaaaauuucuauaauauaacccaaauaucuaauuacuaaauguuucuuuacaggguaaaauguuucaguucuguggcaagaauuguugugaugaauauaagaaaaucaauaauguaauggcaaugugugaauacuguaaaauugagaaaauuauaaaggagacugugagguucucaggugcugacaagucauuuuguagugaagguaauugacaaauaguaaucuuacugagcguggcggugguuucuaauguaguuguugacuaaagggauuacuaugccagucuauuuuauccuuuguacagacccucaacaucuuuuuuauuuauugacagauaauuugcuauuuugucuaguucuuuaauuuuauguagauauuaaaaugaagucaaagaucuucuaaaguacaguacauaauauggcacacaggauacauuuaaccccauuagcuugauggacagcucaaagaccuuuagguccuguccucauuucuagauggaagguuuuaaguucuaguagcacccugaguuuguguuucugaauaaguauaucaaagugaagcuaauuuucucuuuuuuagauaauauacauguuuaggaacguuuuacuugacucuaacaugguacuguuauccuucuugaccagugucuuucaauuauuuaacuauuauacaaauuaauuacauuucacauuacauccuacuauaaaccuaggauauguucacacuuuaaaugaaacaaaaacuuuaugcaaugaaacuuacaauauauaacauauaguucagucugcacacacacagcugucuaguuuugauauauaacugacuucuugaccugucaguugguuaagucccaugugugaaaacauuauuauuauucaguccauauuaauuuuuaucuuuucugauuucuuagguugcaaauugcuuuauaaacaugacuugggaaaacgcuggggaagucauuguaaaaugugcaguuauuguuuacagacaucucccaaacugauacagaauaauuuggguggaaagguggaagacuucuguugugaagaaugcaugucuaaguauacaguuuuguuuuaucagguaaaaaaaaaucauucauauuauguacaaagaauaauaauuugaugauuaaauuuccuuuaauguuaaauguuuuguuucuuagcaauuagugcaacauuugggggauuuaaauuuacuccuuuuguuuuuaacuucuugcagaagauauaguugacuuaugguauuaaaauauuuuaauuauuauucacuuauuuaaauacaugaaucugucuucugaauucugaaaaaaauuguuuacauuuuuaaaaacaucuuuguuuuuauuuuuguuaaauuuauuuauuuuauguguacaguagcacauacaugucgguguaggugcaugcaugccguggcucuugugugggaaagaguucagaugagaacuuguguggguauugauucucuuuccacugugugggucagaaaaucgaccucagguuaucaggcuuggccguucuuacaggcccagaacuuuguuuuucaauugcuacuuuuuuuuuuuuaaagauuuauguaugugaguacacuguaucuguacagacgguuauaagccuucaugugguuguugggaauugaauuuuugaaccucugcucgcucugaucaaccccacucgcucugaucaucccugcucgcuccagucaacucugcuugcucaguuccugcuugcuccggcccaaagauuuauuuguuguuauacauaaguacacuguagcugacuucagauguaccuaccagaagagaucguuggagcucauuacaggugguugugagccaccauaugguugcugggauuugaacucaggaccuuuggaagagcagucggugcucuuacccgcugagccaucucgccagccccaauugcuacuuauuaggguauucuacauauaugaauugguuuuuaaaaaaagauuuuuuuuuaaugaugucauugguaggauuggugugaugccuaaguggauugagugauugcuugcaugugugaggacuggauuuuguaucuucagcacugacauaaaguuccacauguaauuccagugcuuggaugcuccagagaguaagcuggacagcuagagugcaguugaugagcuugaguucaacugacagacacuccuuuaaugaguaagauagagcgugacugaggaaagaacccccugcuugugccaaugucggccgccccuuguuuguuuagauguucaagcacaguacuagacacaaagggacacaaacuuuuuuaaacauuaguguaugaauguuuaccauuuuaggacagucaccuuugacuugaugauuuacguucuguaaauaaaagcagauaugccaucuugucaauuuacaaaugcauauauaaacaaauauauuaauuucaaauuuaaaacauuuguaaguuaaguucuaaaguucauuucuuguuauccugauuuuauuccaucagacuagagauauuuuguuuguuuuuuaaccauuuauuuuuauuauggguguaugggcuuuucugccugcauguaugucugugcaucauguuugugccuggugccuucagaguccagaaaagaggguaucagauccccuggaacuggagacuguuacgagccaccauguaggagcugggaauugaaccuaggucaucuggaagagcagccaggugcuccugacaggugagcccucucuguagccccugauaauuuguuucuucuuugcucucuucaauuuguuucagauggccaaaugugaugguugcaagagacaggguaaacucagugaaucauugaaauggcgaggugacauaaaacacuuuuguaaccugcuuugcaucuugauguucugucaucagcaaacuguaugugacccaccuuuacaaaacaaugcagguaaaaugcagugaagaguaagugaacucuuggguuuguuuuuguuuuuuguuuuccgagacaggguuucuuuguguagcccuggcuauccuagaacucacucuguagaccaggcuggccucgaacucagaaauccgccugccucugccuccccagugcugggauuaaaggcgugugcuuacuuguacuaggagcugacuccuuuacuuguacagauuagaauauauaaauggucaguaauuuuaugaaauacaaaucuuacuauguucaaauaauauuaacaagcugggcauguuagcgcaugccuuuaauccuagcacuugggaagcagaagcaggcagaucucugugaguucaaggacagcuaggauugcauagagagacccugucucaaaacagcagcagccacaacaacaacaaaacuaaacaaauaccauuaagauuuaaauaauuuauugaauaccugaaagcaaauaauuuuaucuauuuuuaucuauuuaucuaucuagacaggauuuaucuguguaagcuguccuggacuagguugaucuuuaauacucauagaaauucauuugccucugccucucuuaaauucugggacuaaaacuugcacugccacaccuggcaggcaaauuuuauuguagcuuucucucagaauacugacugagcccugcucauuuucugaaaaagagugguauuuacaguuuuuaaauucuguauacaccuuggcuuucauaaugaaagauuuuagauugcuuauagcaaaugaagaccgaaucaaaugaaccuuuaaauauaacacacacacacacacacacacacacacacacacacacaucuauauauguguguuauauagauauagauauauauuauauacauauauauguaauauauauauuacauacauacauacauacacacaaucuaucuaagggaggugaucaagacuucaaggagagcaugagccauacagugaguuugaggccagccuagguuacacagugagaccugugucagucaacaaccaacuguauucauauuuagggcauaaaaaucugagaaggggggcuggagagauggcucagugguuaagagcgccgacugcucuucuaaaggucccgaguucaaaucccagcaaccacaugguggcucacaaccacccguaaugggaucugccacccucuucuggugugucugaagacagcuacaguguacuuacauauaauaauaauaauaauaauaauaauaauaauaauaaaauaaucuuuaaaaaagucuuagaagguuuaugauuuggagcacaaauuagugcugcucugagacccagcagagucuaagcauagugcccuugugaggagaagcaagggcaugcucuauaagcuucuuaacagaguccuucacauacgaagguaagauuucagaaacaucuuugucuuauguucucauuaaauuuacuuugugauugucauugguuggaauugugccuuuggacauuuuuguugguuuuaagugagauugguacauuuccauacaaagauaaaguacaagagacuuugagguuucauuaaucaaaaacuagcaaacaaugcaguaauuuaaguggcaaagacaaaacauuacacuugaucuuauccaaaaggccaagaagugguaaagcaagcccguuauuucugaaguuucucugcuccguagcaacuuauucaguuuuggaaacuuuggucuccuuugagcuguggauuucuauguaaaacaaauaaauuauacuaacuuucuucuuucuuccucuuuuaaguagcaaguauuuccaugguucaagcugcuucugcagggccuccgucccucagaaaagauucaacuccagucauugcuaaugugguaucuuuagcaagugcuccugcugcccagcccacagcaaacaccaacagcgucuuacaagguauagcuugauuuggaccgccuuucuuacuacuugaauuaaauauuguauaugguagguuauuucugcacugguaaaaugagccaauucaaagcagauuagaauauaugaauggcaggucaguugggaagcugcucucaggugacuucacugacucccaaggaccaaggcuaaggaagucaccaugggggugaggguugggaagaaagaaagggcacacguguaguggggaggagauccaaaauguuuggauuauauaggggagagccucuagaggaaagaaagcccauccccugggcuggaaagcucaggguugggacaggguauaugccagguagggaaggaugcugagagaaccuggaggccaguucugcuuugagauguaaaauacacacuuuaaucccuugucucaggguccuaaaccaaacuguauguagcuccuggcagcuugcagcaccacuaauacgcaccguggugucuucacaaagucccccaucuuuuuuucuuuuuuuaacuuucagguuuacugcuugcuuuuacugaacuaaguggaaagauacauaucaucugacuaguguuuaugagcugauguuuaaauuuaaagauccuaaauuuauguuucaauuucuauuaaggugcaguuccaacaguuacagcgaaaaucauuggggauguaaguuaauuuggucuuauuauauuuucauuuauauguauuacauauaggucugagcuaauacauucuauuaagguauagaauuguuuaugaauacaguuccuauuaucuaaucaggucuuuauauaucuuuauuucuuugaaugcuugguagguaccuuuauguaauuaauuacugaagguuuuuuaaaauuaugcauaauuaaaguaaauguacugaggcuggucaugugaucuuagagacuguucuuuuuuguuguuuuguuuuuagagauuauuuauuuauuuuauguaaguacacugaagcugucuucagacaccccaaaagggagcaucagagcucauuacaggugguugugagucaccacgugguugcugggauuugaacucaggaccuucggaagagcagucagugcucuuaaccgcugagccaucucucuaacccuggguauuguaaauacccacacuuaggccuccucacucccauuccaugcuagucauacuguauauaauuuuuuuuuuuuaaaggauuuuuuaagauuuauuuauuuauuuauuauauguaaguacauuguagcugucuucagacacuccagaagagggaaucagaucucguuacggaugguugugagccaccaugugguugcugggauuugaacucuggaccuucggaagagcagucgggugcucuuacccacugagccaucucaccagcccuguauauaauuuuuuuccagucgauaauaucuacauugucucuuaagugaagaauaaagaaagaaaauaaugaacagaacauaugaugaaacagugaucuuucuugaaaauguuccuagccucugggauaauguuuuauguuugaguuacuuuuuaauucuuuugugguggcaaacucuauacccuagaccuguaguuucagcccuucaagauucuuggacugaucacaagugauuccauuaauguugguuacauccuccaagucagucaggaaauaacaguucucauuuaaaacucccccauuguacugaugauuaucaguguuuuacaguaagcuuauugguauuuuuguuuguuuguuuuuucuuuuugguuuuucgagacaggguuucucuguguaucccuggcuguccuggaacucacucuguagaccaggcuggccucgaacucagaaauccgccugccucugccucccaagugcugggauuaaagcgugcgccaccacgccuggcagugguguuuucuugauaagcaaauacaguaaguacauuagucaguugauaguuauuaaauguucuuuguugcugucaauauuucagguaugugauauauauuuauuagcauauuuaucuuuugguucugcuuuguauagguucugcuuuguauagugauaggucuuuuaaaguugaaauucuuauaauuacucaaaacauuuugaaaauccuuugguuucugauuuucuuuuucuuuuuuuuuuuuuuuuuuuugaacuaggcaaguacucaaacagaugcccugaaacuuccaccuucccaaccuccaaggcuuuugaagaacaaagcuuuauugugcaaacccauuacacagacuaaagccacgucauguaaaccacauacucaaaacaaagaaugccagacagguacguuucuugggauguuguuuuauuuagggcaagggaauggagcaucugauuaccuugaguacugucuccugcuuacguggauugcccaguguaguuugcacacuuuuucugugaauaagguauuuaucugucugagacuuauuaagguagcucaaauaaaagucaauucauaguauacuaugaaaacuguuaauuucuucauuaauaacuaauguuguagguuuacuguaagcuuuagaauaauguagacaggauuugaauuuagagaugcauuaguuuuuuaaugugcuauuaaguuuauacaaauuaauauuaucuuauuuucucauuuguguauguguucauuuagugguguguguguguguguguguguguguauauauauauauauauauauauauauauauaaaaucucuuuguacuucuugcauguaacaccuauccccguucccuccuacugucuuaaaaagucaguuguauuggugaaaagucaguugcguuggugguggugguacauacuuuuaauugcagcacucggagcagaggcauguggaucucugagucugaggccuuccuggucuacagagugagugagauucaggacagccugggcuacacagagaaacugucucaaaaaaaaaaaaaaaaaaaaccaaagucaguugcacuaagggugguguuauagaccuucacucuuaguguucaugaaggggcacacagagcuuugaguugaggccagcucuguaaguuaucugagguagagugauuagggucccaguguucuuugccugucuguuuuuggguacaaccuccaucuugugaaugaaagcuguuuggaccauuggagcauaagcugcuucuuggccacacacauuaggaauuuauguuuguuuuuaguauuuuauguguaugaguacccugcuuacauguauacauguguacugugugccuauuccuggugcgcauggaagucagaagggcuuugaauccucucugaaaggaguuagagacauuugugcucuuguauguggguauuaugacuugaaucugagcagcaaguauuuucaacuacuaaaucaauucucccgucccuccuagugagucuuaaaagcuuuagcuggguguugagaguagagagaaguccauucauuuuugacacagccagucagaauugagcaguuuuuuucaaguuguucuaaggugagcuuaagugguaaagcugguagaaauuuuaauacaguuuuugaagaaauauuucuauuuauuuuucacaaucauggcaguugccuaagaauuacucauauagucuucaucuccuuuuuuuguuugcuuguguuuagauagcuucuuuugcugccaaccauaaguuccaaaauuuuuaaacuagaaaagacuccuagaugcaaaguugucauccuguaagcugguaauccugaauaacaugcacacaaauuaacugaggccuacguaggagguuccuuuugguggaaccucguuuuuuugucuuaccuguaugggcauacauguaucauggucagcauauagagaggucagaggacaacuuaguuggcuccugggaauucucaucauaaaguaccuuauuauuuuccacaauggcuaaacuaauucacggugcccaccgggaguguugagagucccccuuucucugugcuuaucaagauuuuuuuuuaccuucuuuuuugauaguaaucauucucaaagauacgagauacuuuauuuuaauuuuuuuuaauuuauuuuuauuuauguauuugugugccuucuuaccuaugugugcaccagggacaugcaagugccaacagaagccagaagaaggcauugaguucucuggaacucaaguugcagguaguuaugagccccugauauaggugcugggaacuaaacccaggucuguuguaggagcagcaaguguacuuaucugcugagcugucuaucuagcccugucauuauaauuuugaccauuucucuggugaucauuauuaacacugaauauuuuuuuauuggcacagucacuguuugucauuauaaugaaaugcccaaggcagguaauuuaagcagaaaugguuuauuuagcaccuaauuuuggaguuaucacacaauguuuggggaugcaauuucuuggcucuuguuacccugugguguggguaacauagaugugaauauuuuggggaacaagcaauugauuccuucuauaccaagaacagaugaacucauacccuauacuacuucuacuuccuuaugagaguauggucucucacccccuugaccuaaaguuuucuuaaagguucuccauccaugagcaacaccauguugaccacuuauaaauuagguuguuuuuuuugcuguuuacuuguuugaaucccuugucaaauguauagauugcaaauauauuuugccauucuguaacuuuucucuuaguucccggauugcuucuguauauaacauuuugaauuugguuuaguuucucuggccaguuauauuuuguuguuuuuguuguuggggucauaccuuuaaaauaaaacccuuuucucagaauaguauacugaauaauuuuuuuuauuaucuacaauacuuuaguuauuuugcuugucuugcauuaaaaucucugauucauuuugaaguuuuuuuuucuuuuuccucccuuuuuuuuuuuuuuuuuuuuuuuugguacaggguuucuuuguguagcccugucaguccugaaaucacuuuguagacuagacuugccucaaaccuggagaucccuuugccucugcuucccacgugcugggauuaaagauguaucaccacugcuuggcacagauucuccucuuuaagauggaauuauucuacaugguuucuaacccacuuuuaucugugugugcuuuuuucauuagacacuccaagugagccccagguuauggugguaccagucccugugccaguguuuguucccauaccucuucaucuuuacacccaguauacuccuguccccuuugggauuccaguuccugugaguaaucauugagagauaagaucuaauuuagcuugcauuuuccucacuuaaaauuuuacagcuguguaauaaaaugucauacuucuugguaaaauauaccugauuuugguuggcugcuguuauauugccuuuguuacuuauuucagagaauguagacauuguccuuuacucucauaccuuaucuucugaaagaguguuauaauguagcauggugucucacaccuguaaucucaguacuugagaggcugaggaaggaggauuucggccaguugaaggucagguugggcuacauagugugcuccaggccagucuuggcugcauugagacucugccucaacauaacaaaaacaagggcuggagagucagaggaccuggcuuugagucacagcacccauauuuguaacacacucaccuauuuguaacuccacuuccaggagaucugugccuuccucugaccucugugguacacagacauacauguagggaaaacauucauauacauaaaguaagucugaaagcaacuaaggaaaaaagaaaaaguuaguuuuggcaucacucaaauggaaaagaaaaaucaaaacuguauauauauaauucugaauucugggccagcaagauggcuagccugauaaucugaauucaaucccuagaaccuacauaaagguagaauaacuccuuacauuguccuuugauuauggcaaauauaucuauuacauauuaacauauaauaaccacuacuaauaauaguaauacuacuucuacuaauaauaauggcaaaacaaaaauuaagaguccugaacuguagcaaagguaaaagaagauuccugucauuauaucuuacuuucuuuaaauauauugagaguuuugaaaugaaacugauuuuuaugucguaggauuauucuuuuuaaggcuuuuagaagcacuuuguuaagugucuagaaaaguccuuaguaguuguuguuuuguauuuuuuguuuuguuuauaauuauuuuagguuuucagacaguguuacuagguagcucuggcugguugcagauguaacauguacucuauagaccagacuggcuucaaacucccagagguccaucugccucuuccuuccaucugcugauuuuaaggcgugugcuaccauguauaacuugcuuacuagauuguuugcuugcuugcuuguuuguuuguuuuuugagacuggguuucuuuguguaucccuggcuguccuagaacucuucucuguagaccagguuggccuugaacucagagagguccaccugucucugcuuuucaugugcugguauuaaagauguguaccaccaccaccugacuuagauuuuuauuuuagucauucuagucuaauaaaaaugaacuaccaagacucauaauucuuaucaaugagaauaucuucuuccucccccauuauuuuagugcuuacaucauuacacagauuuugacaagaaaucuauuguauaagaaaccuucaggccggggagagugcauacccagcauaguacuugcugugcaaacauccaacugaguucaguguccagcauugauguaaaagccaggcauagccccuaugcacacaccuacacucacgguguuugaaagucagagacaggaagauuccuggaacuugcugaccagccagucuagccagugugcuguaucuguguucaguggcagaccuugucucauaaaaauaagauagugaauaacugaagaagauaccugcuguggaccucuggccacauacacacacacacacacacacacacacgaaaccuaagaaaccuucggucuuuguuuuuucagaugccuguucccauguuuauuccauccucuauggauaaugaugagaaagcaacugagggcauugaagacauuaaagagaaacuugccacacauccguuugaagcagaucuccuugagauggcagaaaugauugcagaagaugaagagaaggagaaaacuuuaucccagggagguucgugcaaucuuuaaaauaauuuauuuugagcucacuuacaauucuauaucuguaucagaaguaacauuaaguuucauauuauuuuuguauuuuaucauuacguucaaaccuauguuccaugcacaagaauccuuaauauauaaucaauugcguacugauguuggcuaaauagaagcaugggucagaagaccuguugucucaguuaccuauagagaagucugauucuguuaguuuggaauaaggauguugauaauggaugguguuuauucauguguauuucucacagucuagacaaaguccuaguuaguauauuguguguuuuccugcauuuagucuucauaaccagccugugaagggaguauugguuaccuuauauuucucauguugaaauuaaauguuaguuuuguacugguuauauagcuaggaaaugauaaaagcaaaauuuggcccccaaacacauaauuaaacagaacuuuacugaucuauauuccaggacgcuuucuaaccuugauuguaccuucuuaauuugugauuacaggaagaaguagaagaaauauaguuguugaaaugugaagcacaaaauugcuuucuuauaucaugaaugaacuaagaauguucuuuguguuuuuugagcccaauaccaauuuuuucagucaguaguagauuuuuaacaauuagugagguuucaaggguuuuauuuguuuuuagaaguaguaucucauguggcccacacuggccuugaacugcugauccuucuaauucccgcucccccaaucauugcuaugauuaucaucauggaccagcauguccagcuagcuggugggguuugauuuugcauaauaaguaauagaaaaaaauguucaccauuauugcauaucaagaaacauugugaacuuugcuguuccguugccaucauguaugggucuuuuaagauuuguguugguuuuaauuaagugcaaguguguauuuuugugccuuauguguuaguuugugcagcacuuaaguccaaugccuggggaggucaggagcauccccuggaaguggaguuacagguauuugcgagcuaccuaguuuggaugcuaggaucaauuccuagccucacaucaucugcaagaacauaaugugcucuuaacugaccaacagguuuguaguuuguacauagugucaucuuauuaucaguauuucuuauguacuuucucuuuaauguauuaucuuauaguucuaacucauuugcuaaugaaugucuuagaauaugaguguuaucucuaugcuugaccauuuuuaacuucuaauaguauauuuaauuuaaacguugagauaauucaugauuuaaaaaaaacaaaaaacaccuuauuuuaaauuggccuuuuguagcuaggugugguaguaaauacccauuauuuuaacacuugagugggugagauuuauguagucagucugagcuguaauguuuugguaauauaaugccaaaaacuaguuaguauccaacaggggauagggugacuuuucugucacauuacuauuuaacauucauuggguucuucacuuacagauggagaacuuugccuuuguacaucauugagucagaaaagcuuuagaaaauaagcuagcuucaagacaaacacuugcaauuacuauaaguaauuuaccuacuaaaaugaaaugguuaagacauaugggaaggagaaaaaggacuugggacuaauuuuucuuugauuucaugaaaaaacaaaagcuaagaacaaaagcuuuucuuaaauaagcugagaaaacauccuuuucuauguugaguuucugaauuucauuucaaauaucucauuuaucauugaauuuuguuuucaucaacuucaugaagcucugugggcuucaugcucauguaucgauuacaucuguucuaagucuguuggccuucgggggcaaguagaaaaggcguauuugaguggaacaguuugucauuuuugcauggauguguaacaauaugaaaggauuuccgaugaaaaaccaacacagcaugaaaaguaaagcccuucuuccuguggcuucuuaugauguccagaagugugagcucugcuggcgaugugaaugagccagcugcuuuuauuacaguguuucaauauauugaugaagcaggccuuguguagagaagucugcuuaccuaguccccucuauugaguagagaagucauuucaugugagauuuguuuuguuugcuuuuuuucuuuagaaucucaaacuucugaacaagaacuguuucuagacaccaagauauuugaaaaagguuuguaguuauuaauauauuuuaguuuuuagaaauacuauucucugcuaacaauaggaacucagaagacuauccuugggcuuaguaguuuauaauuuuaccuaguuugugagggacaugaauugacugucaugccaauuuguaaugcaaauaauaaauaucucaaauauuuuaauauuugagauaaugcauuguaguguuuacuaagaauaugaaucuaauucugugaagccguuaaagaaguuacuugauucuuuguuucgcgcgugugugugugugugugugugugugugugugugugugcaaugugugugugcuugcgugugugugcgugugugugugcgugcguguguguguuacuuccucacagaagcaucugggucagaaaacugcacagguaaauguaguuuauacauguaugugaucaauauauauuaagguuagaaggcaucuuuggguaucuuuccucaggcaccaucugcuugaaaaaaacaaaaagacuuuuuuuuuucacuggccuggaauuagccaaguagccaaguaggcuagucuggcuguccagcaagcuucaggaacucaccuguuuuaggugcugggauuacauccugacaucaugccucucuguuuuucuuuuuagaaguagguuguggggcucagucucagguccucuugcuuacauaggaaauacucuacugaugaaguucucucuccaaccauaguuacuuuacuaguuguguccuaauaauuaucuuuuaaccauauuuugguuuuuaggauguaggaguucaggagaguuucuaaauaugucaggagagcauguuugguuucuucacuuucagaccaaggaaguacauauaguggugaucuugagucagaagcaguaucaacuccacacagcugggaagaagagcugaaucauuacgcauuaaagucgaaugcugugcaagaugcugauucagaacugaaaccguuuucaaaaggggaaacagagcaggaucuggaggcagacuucccaucagguuuguaccucauagacggcugaaggucgucauagacggcugaagucagaagauugggagagcuccaaguuugcaggguuaaacggugugaaguguucgggagucuucugccuuuauaaaugugaauaucuguugcaagguucuuguaagugguuaauuuuauuguuugcaauuuuuaaugaccuuuucaacaguaacuauuuacggaugguuuccuugcuaacugccguuucauucauguguuaaaauccguugugcaucuuaacuauauaagcggaggucuuuaucacggagacuggacugaugauuacugauacuagucuuaugagcucucuuaagucuguguguuacauaccucacacugggcuuucugcugcuuuuuucagaaucuuuugacccacuuaauaaaggacaggggauccaggcacguucucgaacaagacgaagacacagagauggauucccccagcccagacggcgaguaagcggaagcuuaaguuuacaguuuguguucuuuuguuuagcaguauuuauuaguuuucugauuaaaagcuuuguaggagcccaaauuaaguauuuucauucuuuuuuuuuuuuuuuguuuuuucgggacaggguuuucucuguauagcccuggcuguccuggaacucacucuguagaccaggcuggccucgaacucagaaauccuccugccucugccucccaagugcugggauuaaaggcgugcgccaccacgcccggcucauucauuauuuuuuaaguguuuuaguuuuuaagguuuuuugcuuuuguuucuuagugugcaaaaaagaaaaccaacaauaccauuuauuacauauuuauuucuaaucaggacguuuccuuugguauuuaaacuuacagacuuugacuuacuacuuuaacaaucuuuuuauagcccugagagagaucaggguuaaagaguacuuguugcucuuacagaaaaccaagguuugauaaccagcaccuacaugacagacagacagcucacaacugccugcugcuccaguucccagagcuucugggugucaucuucugcucucuacaggcauugcauaaacauacaugcaggcagaauacccauaaacauuaaaaaaaaauugcgggggcacuuuuuauaaucuuuaaugggcccaugagaugguuuuagagggugaaggugcuuguucccaagcuucacagccugaggacucauaguaaaagaagagacacguuuagacccuaguauauacaggccgguaguuguccaccugcauaugugugcaugcacauacacauaauaaaaaguaaauaaauucaagguaaauuaauaauccagagacuacagaaaugacucaacagauaagagcuccuuuuguucuugcagagaaccuacuaccccaggagauucaacacacuuuucuggauucuagggacaccaucacaaaccugaacuuagccacacauacauauuauuaaaaguaauccaaaguuuuuagucccaacacuugggaggcagaggcaagaggaucucugaguuuaaggcuaaccugguuugcaaauccaguuucaagacagccaagguuacacagagaaacccugucucaaaauaaaauagacaaaaucuaaauuuucuguuuaaagucuagauuuggcuaauuuggaaguucuaauaaaaaguuaacuuuuaugugauaagauuacuaauuauauucauauaugcaguuuuucauguuaaaaagguuuuccaaaaaauaaaggagggaagagccagugaggugacucagugaguuaaggcacuugcugcccaacccaaguacaguccgucuuccucuccaguuaccaauaacccugaacacacacagagaaaauagacuaguucauccuuuuuauugagccccauuuuuuuaaaaagauuuauuuauuuauuuuuauauguaaguacgcuguagcugucuucagacaccccagaagagggcaucagaucucauuauggauggucgugagccaccaugugguugaugggauuugaacucgggacuuucggaagagccagucagugcucuuaaccaccgagccaucucuccagccccgagccccauuuucacaugguauaguuuccccuucuagaauccuccccaacucccaacaauacaacagaaugcacauucacaaacaaaacaacagaaggaaaauuaaaauaaacaagcaaaagaccaaaaauaaacacagcaaaaauuuuaaaaugucuacaaaaacacuauugagucuguuuuaugcuggccaaaugccugagcauacagccuguccugaagugugguugacaccgagggagacuccaauggagaaaacugauuuuuuucuuugccaauggguuucaauugcagaauaccuucuuaauuagugaugggacgcuggguauacuucuccaucucagggcugggacccccaucugccuugaaccuauacagguauuguggaggguguuauagucugugagcucaugcuaguccuccugugucugcaagaccgugcuuccuuaucauccaucacuugugccucuuaaguguaaaaaaauaaccuuuuaaagauagccuuaaaccgggcggugguggcgcacgccuuuaaucccagcacucgggaggcagaggcaggcggauuucugaguucgaggccagccuagucuacaaagugaguuccaggacagccagggcuacacagagaaacccugucucgaacaaaacaaaacaaaacaaaacaaaauagccuuaaauuuuuagaauugaguuuuaguuguauuuaagcucauaagugcucaccaugagccauugacuugcaugagcauuucuuagucuuuuguaaucagccuuaucuccagauguugacagcagccagucuguuauaucaguugauggaaaaugguacuguuuuuccuuuacugaaauugcagguaaguaguaucauacaguauugucuuccuaguuuagcuuuucugacagcagaggccuuugagguucauccauccucuugguuucugagcagcaugcaguguaaaaacagacaaaauuucgucacugccuaagaaguaaugcaaauuuuggacuaucuagacagucguuaggauugcucuaguguaaauuuucacaugaacauaugcuuucauuuuucuugaggaauaauauuuagaaauaaaauuacuagguuuuaugcuaaguauauauuuaacauuauaaaagcuaccacacuguuugcauguucuguuuuacauucccacaagcaguguaauguaguccauaagcaccaugauuuuugcuaacacuagccugucuaguagauugugcgauuguuuguuuugcuccuggugauaaaagguuagugaacauguuuuuauaggcaucuuugagagccauguuuggcaggauaucuuagucuuugagcacauccuuuauggaaugcauggugacuggggggugguuguuagugacugguacucuuuuguuuuuuuguauuuguugguuuuguuuguguguuguuuaaaaaugggauauuauuuuauugugucuuuuguugggagguugcccuggaaaucaacaguauuucugcuucugcuuucuaaaaguugacauuacuuguguaaucucaaugauaaaccaguauauuuuuuaauaugggaauaauuucuuuauucauucaggaauuuucucaugugacucauuccuucauuccuucauugauuuuagugcagaguuugaaguugaacccaaggcucauacauuuaaaaaaaaaaauuuacuuauuuauaugaguacacuaucacugucuucagacucaccagaagagggcgugagcucucauuacagauaucugugagccaccaugugguugcugggaauugaaugcaggaucucuggaagagcaggcagugcuccuaacugcuaagccaucucuccagccccaaaauaccucauuuuaauuuugagaaauucugcuuuucuaguuuugauucuuugauaauucaugcuuuaaaauauucuuuccaaaagucauuaccucacaaguggugucuaaaguaaucucuuauguuuuauuuuacaaauauuauggcuuuaucuuugauuuuucuggucuauuuugacuuaaauuuucugcaugaguucaagugaaugucaaggcugaauucuucccacauggccauccaguugcuguggaaucacauauagauaacauugguuuuaccucaucaaacuccagcgucacuucucuuuaaaagaaugcuaaucauauaaguccaguuuugaagucuccauucuguuauauugagucuuuuuaaaaaauauuuuuauaccauuagcauguuucuuuuuuuaaaaagauuuuuauuuuuuaaaauuauuuuugucuaugucuaugcauuugugugcaauuuucugaggaagcuagaaauauuagaucucucuggagcuggcguuacaugugacugugagcucggugguauaggucuuugcagagcacuacuugcucuuaaccacugagcuaucucucuagccucuaauaccaguuuuaaaaauuguagcuuuacaguugagucucagaguuauccuagauccauauaaaucauagaauugacaucuuuaguaauugugcuauuuagucuauuaagguacuaucuccccaguuuauuuacuuacuuugugugccaguauguaauauauaccugggugaccugcaacgugauauuuauugucccuuguaggcuuucuucugauuuuucuucaaauuuugacccugguuagauaauggacuuuauugggugaacuuucguaucuagugauaaaguaucugguuuuuguuguugguuuguuuuauagucuauauaaacuggugaaauacauugauuuuucuuuaaaugacuuacuuuuuccuaauguauauuuuuuuauauaaugcuggauuaaguuugacaaaugguuuguuaggguuuuaaauucuuuauugucucugccuccucaaauguugggacaugugccaccacaccuugccuugugagaagguuuuaaauuauaaaccugauggugucuuuggauauagguuaucugaucuuuucuuuuuucuuuucuuuucuuuuuguuuuguuuuguuuuucgagacaggguuucucuguauagcccuagcuguccuggaacucacuuuguagaccaggcuggccucgaacucagaggcagaccaugccugccucugccucccaagugcugggauuaaaggcaugcuucugaucuuuucuaugauaagauuuuuaacuuuguaucuuuuaacaauguauauauacaugcaucccuugacguugaacucagggaugcacacgaagcaagugcuuuaucacuugagcuauacaccuagcccuuuuaauugucuuuguuuugagaaagauugucaauuaguugcccaggccgccauuaaauucucgcugucgaauaaccaaacuuuuauuugagauucuucugagucauguacuagucauguacaucacuguauugagacuuuuuucuauaacuuaccaaauuauugauauaaguguucuauauaaauuuguuuuuaauuuauguuauuuuauuauauguguugauauuuguacugcaugugugcuugguacucagaaauuccagaaaagggcauuggguucuuugaaacugauguuacaggugguugugauuugcgguguagguacuggcaauugcagcuguguccuuuggaagagcagccagugcuuuuaacugcugagccauuaauccaguuaccaggauucuauuuagauuuuaagcaucaauucacaaauuagaaucagcaaugaugucauaaaugauguuccuuuuuaucucuacagugacaguguucuugguauuuuaaauucuuaauuuuuuucuuaguuauuuuagcugaagaauuaucauuauuaaaauuacauauuuuaaaagggccaacuucuauuuuaucuguguuuuuuuuuuaccacauuguuuuaucccauuuuuauuuccuuguuuaauguuuuuguuaguauaaauuaauuauauauaacgguggauuucaucacaauauuuucauauaagcacgugguguauuuagaugacauucacgcaugcacaugcacgcgcacacacacacacacacacacacacacacacacagacaacauccaguaaccuuucugguccucaucccaauaguucucuuccucuuuucagcuaacuucucucuuuucauaucuuuucuguuuguuuucuuagugaccugaugaguuucauuagaauugccuacaggagcagccuuuccucacucacagauuguuaacaacacuuagacuuaugauguggugugggccuaccucagcuccuuucucuucaucuuacuccuuugcuuuuggccuuuuggagacagaguaacacuguguagccauggcugacuucaccuggcuaaguagaucaggauggcuucaaaauugcaggaauuuaccugccucuuccuuuccagugcugagguuacaggcaugcgccauggccagucucuagcauuuuaagauguuuagauuguggaucucacuuuggcuuuuaauuuuaguucccguccucucauccucucccucccuccuccccucccucccuccuuuucuacuuuacuggagcuaguacccugaguugcacucaugcuaggcacauguucugccugaguugcacgacagagcucuuucacuuuuucaaaaguuugucaguacuuugaacgucugcaucuguguuauauccucacaggguuuuaugauuuucacuuaaaauuauaacaucuaauuauagcuguaauuucuuccuugaucuauacauuauuuauagguaugcuauuuaugauuugggaagauuuuucuugacagucuuccaguauuggcuuuaagucuguuucuugugugaaugauuuauggaggccuguuuuauagcuuggaauauaaccuauucaagugaacugauaacagaacacaugacaaugauuauaucucaguuucuuaaauguugguaggaacuguagcaauuucuuuucauauaaauuagauuaaaugcuuucuuggaguucugagaaaggguccucuaucaucuggacuuuguguggaacuaagaaugaccuuguacuuccucaccguccuaccuccacuucccaaacacugggacaggugugcagcgcuacaccuaaaaaaccauuucagcccugaauucugaaucuuuaugauaugaaaguaaauuuuauuuuuacucaauaggauuauuuucuuuucaucucugagaacuuagacuuuuaaaauugcaaaguaaguuuaauagguugaauuuuuuggaauucucacaggggaggaagaagucugugguaccuguggaacccagaagucuuauucaaggagccuugcaagggugcucagugucuggaaugacacugaaguauauguaugggguaaaugccuggaagaacuggguucaguggaaaaaugccaaggaugaacaaggagaucugaagugcggggguaaguagacauuguauuuugauguguggaucuaagaauuagaaauaaagucauaaauauauucaaagaugauuagagcuugguuuuauacagucccacuugauuacuguuauuuaccugucucguuaggaggugaacuugccucugcuaguccguguucugacuccuuaggaagugcucaagaccaugcccucucucaagaauccucagagcaaggcuguaaagguaaaaguugcuaauaucucucugcuguaaguuacguauaguauuggaguuuaaauuuuuaaugugugugaauauuuugccuauauguguauauguggaauaugugcaugccuggugcaugcagaagccagaagagggcauuggauccccuagaaauggagcuacaggcaguuauaaaccgucaugugggugcugagacgaaaaccuggguccucuggcagagcaaucagugcucuuaaccacugagccaucucuccagccccuaguaauauuguugauuuaaguuuguaaacugaccagauguggcuagguuugcuagucuuggcacugcaaagaaaagagaauuaagaguucagggugauuuuuagcugcacaaugaggucaaggcucccagaaagaggaagggugcugaauugaguuuuaaaauguaagauuuagagucuuaagaguaauuaauuucauauccucaguuguaaagauguuacuguguuuacaacugauaccgaguuuauacagcauguauaauuaauuuucuuuuuaagcacauaaauaauucaaaauaaucuaauguguauguauaauaaacuauauuaaacuguaaggcuuuuaugauauuuuggauuuuaaaaaaaaaucaagaaaagacuugcugcuccuguauaaauauuccccgccauugagaucccuauggcuuuacaaaaauuuuaagacauauuuuauguguauuuguguuuugccugcauuuacauauauguauaacacagaugccugguggcugaagaggucagaagagaaggucagauuccccuggaacuagaguuacagaugcugugaguuaccauguaggugcuggaaaagcaaacccaggcccucugcaagagcaaccguucauugcucuuaucuuccuuuuuuuuuuuuaagauuuuauuauauauauauaugaugagcauacuguagcugucuucagacgcaccagaagagggcaucagaucccauuacagguugcugugagccaccaugugguugcuaggauuugaacucaggaccucuggaagaacagucagugcucuuaaccucugagccaucucuccaguccccgcucuuaucuucugaaucauuucucuagccucaagauccauaaugccuuuuaauguuuguuucauuuuaguaucuagccagagucaaauaauucaaauauagcacucauguacuaugacaccuuuuuuuagacuuccauaaguuuccacuuuuuguugauuugauuuacugaucuagacuguuuuuguguuuuguuuuuauuacuuuguguuuuauaccaguagagucagaauggaugaagugagguugguuuguuuguuuuuuaauaaaagagaguuuaauuuggcgcuugccauuuuagaggguuagaguccaugagcaucccagcagacaauauggaggcaggcaggcaugaguauuuagaaagccuguccccaguuacauaccuuguccaacaaggcugcacccucuaaugcuucccaacuaguaccaccaaauagggaccaagcauucaaauacauaacuuguaaggaccauucucauucaaacuaccauauuccacuuccugaccucuauaggcuuguagccauaucauaaugcaaaaugcauucaguccaacuugaaaagucuucauggucuuucagucucaacauuguuugaaagucucuugugagacucaagacaauauaucaguuguaaccuguaaaaucaaagcaaauauguacuucuaauguacauugauacagaauauuuauuaauguuugaaaggaaggaauaggggcauacugaggaaauacuggaccaaagcaagaccaaaacccagcacagcaaacuuuaaauccuauaguucuaugucugaugucaaaugguuuagauggcuccacccuuccaguuuuguugacuacgacacacuucucucuccugggcugacuucauuuccuaucuguagcucucuaauggcuccggcaucuugaacaucuggggaccuguccagugcaaucuugacuuuccuuucauagcuuuacaaaauggccucucugguccuccaguaagggacucccccugccucacaccugaccuaagugucucuccuuagcagcagaggaagauugaugucacaaccuucacuacuguauucuuuaugacuccaaagccagggccacaugaacaacacugccaaguccugcuguuugcuugggauucggcuugacccccuugaaucaaauuugcauaagcuuucauuuguugcuguuuguuuauauuuuuugguuugggcuugagauuuccaacuauauauuuucucuuacaagugggugauuaucagguuuugacuuuuauugcuaguagucuguuugcuggccuuggaguucaccaguucugaucagagcaggcgguugguacucuguucugugaugacucacagucucuaaaucaaguguuaaccuuuguucuccacagggucuguaaaugcuuuccuauugggaagucgugccuguaaccauuucccuguuguguagcuuucuucauugagagaacaaagagagccaggugcaauauaucuguaauuccuguauuuucagcuguuuagaggcaaaggaauuaagauuauuugaguuuauaaguucaguacuagccuugacaacuuagacucaaacuuaaaaacaaaauguggguggaaaaugguaggagugaaaguggagugguggcugggcagugggggcgcacaccuuuaaucacagcacuugggaagcagagagaggcaggcggaucucugaguuuaacaacagccuggucuacagaaaguuguagagcagccagggauacauagagaaaccccuaucucaaaaaaaaaaaaaaaaaaaaagagacauagagggggcgggugaaugaacacacacacagacuaguaauauuguuuuagauuaccaagucuucagauugguaggcacaggagcuagcuguucagucauuucuacuugucauuuuuccacaaaaucuguagaaugugcuauucaccagauauccagauacgccgaguacagggacggucccaggauccucccuuaccuugugcagagccaacauagaagaaucgcaggcauaucuuugggaaguguaagccuguuggcaugcaugaaagcagugauggggguucauacugcauagcacagaugaguguguuccagugggagcuguacacacgggguaacucuccugcuggaaauagagauuuucauuucuucccagucuuaguguaacacaugaaacucgugcuuggccugaauuuguccauauuuucuucccuucccccaauuucuuugaaccaguucauuuaaugaccuagcaacagcaguacugcauucuaacauuucuaagagcaugaugguauucuguguuauuugaaauaaucuuauacuaaguucugagaaagagaaaguuaugcagcacuuccucaguggaucuucccagugccuuuaauacagcaauagguccaggaguucuggucuuaguacaaaccccgucccaguuuucuccaauucccauauagaacuggauuuccuauauaugaagcuggccucaaggggggggggugaggagagacagagagagagacagagacaggcaggcagaggcagaggagagagagaaaucuaauagggaaggguucaguuaaaagagucugaaggaagcaacacagggcuauaccacaaagaaugaagauuuaaaaggcaggcagguaaagaauaccaauuugaagaugcaaaagaucuccagagaacauucaauaacaauuuucauggccuaggacugugcugcagcagggagaacauuugcucaguaugucagucucugucugacucuuucucucugggucucugucugucucugccucucuucacucucucucucucuucacuauguagcccuggcuguccagaauuugcuguguacacaagucuggacucuaacucaaaagagaucugccugcuucuuccucucaugcuggaauuaaaagcacacaccauugcacccaacuucuuuuguuuacuuucauagaguccuaguuaaacaagacuugugccauacauaguaccuguuauaccauaugcaguaaaccaucuuuauuugucuacugguaaaacaggaucuguucuuugauugguuuuuuuaauucggcacaagguuuuucuuuguagcccaggcuagccuagaccucagaauccuccugcuucagcaucuugagaacacagguuacaggugugcuuuccuauuuacagugucuuugugacccaauacaguguugggcacacuagugcuuguguugauucaguaaauaguaguuauacacuguuuuuuaaaguuaauguuucagauguguuuucucccuuuccacagcccgcucugugaaacugaaggaagauauucuguccugcacuuuuucugaguugaguuugggcuuaugccaguuuauccaagaggugcggagaccaaauggugaaaaguaugacccagacaguaucuuauaccugugccuuggaauucagcagguaccaauuucaauaacuuacacauuugauugguuucaucaucugagauaauuaaugaauuaaauugaaaaugaauguauauugucauuuaguuuuguuauaaacuuuuuuuauuuugggugaacugcuccaauuuaaagucugaacauauagcccuuccuaaaugaaacugagaauguugguagaauaagagacaugggggucauguauuuuacagguaaacaaacaaaaaaacgugucaauagccgggcagugguggcacacgccuuuaaucccagcacuugggaggcagaggcagguggauucugaguucaagaccagccuggucuacaaagugagcuccaggacacccagggcuacacagagaaaccuugucucgaaaaaccaaaccaaccaaccaaacaaacaaaaaacguguaaauagucuaccuagauacgacugaccgucugcaugaauaaaugcuuuauuugcaauuuugaaguacaaaauaaaauaauagauaugugaauacuuaacauuugcaacaaucaauuguucauaagagugcuacaagaguuucagcagcuagaggcaaugcaugcuuucuacagcaauuugagcauaggauuuaggaguguuuucuccucuuuuuccuaauuuuuauuuagaaauuuuuuauucaguaucucuucaacauuuguuuauggcuaggaaagguuugguucaugcuccuauaauucuuuuauuagagaugcugagucaguaggauuacaaguuugggagcaauuacauugucauaaaucaaaaaucacccauuacagcuaaguucugacacguuuguaaguuaccggauauuguuagugcucaccaagugugagaguuaaguaaauagaggguaaucauaaaauugagcuuaucauuuaacccauaaguuuauuuacaaauuagaauguggauaugguagcauaugccuggagucucaccuucguaagaggaugaugcugaaugacugcagguugaaggacagccuaggcuacauggugaggccuccauuuaaaaaaaguaaugucuagugacacauucaguaaacaaaaguauaaauuauauguauuacuauauaaugacauugguaugaauuuauaacaugaaauuaaaauguaugcaaugguaauugucucugggugguuuuaaucugacuguucuuacacaagguagguguuuucauuuguuuuguuuuuaauugcaaaaguaagugccaaguuggguagcacacagcuauuauuccagcucucaagaagcagaggcaagaggaucucugugaauucaagaccaaccuugucuauguagcuagcccuaggacagucaguucuacacagaccugucucgaaaaacaaacaaacaaacgacaaaaauaaguagcuagcagacuggagagauggcuuagcaguuaagaguccugauugcucuuccauagguccucaguuucuuccuaggcacauguugcuugccuuuuucccauagggaucagaagaagaggucugauaaauccccuggaacuggaauuauagacagucgugagcugccauuaggugcugggaacugaauccaggucuauugcaagaauaucaauuguguuuaacugcugaaccaucucuucagcuccucguuaauuauuuuugcuuugcuauguguguaccuaugccucugucuuucuaucugaaagagaaugggagggauauguguguguacacguguguacaugugugagggugcacauacauggccuggaugucagguaucucccuguauuacucuguuuuauucccuugagaaaggggaucucacacaaucugaaaagugacuuaucaucaaauuccaggggucugcaggucuccacacuccaguacuaggguuucaggccaugccugucuuggacugaugugcugggaauucaaauugggguccuuaugcuuguucagcaaguguuuuaucaccaaacuauuuccacccugucccuacccccaacccccaccagcccugcuucacuuaauuucuuauuuagaacaauagggucuguacaacuuguuucuuucagugaaggauaucaucucucucuuucuccuuauccccccucucccccucccuuucucgucucuuucuuuuuuuccuuuccuuuccuuuccuuuucccuuuuucccuuuuuccuuuuuccuuuuccuuuuccuuuuccuuuuccuuuuccuuuuccuuuuccuuuuccuuuccuuuucuagagagcagaaaggagaaugggaaauuugaggccagccugguauacauaauuuagcuucaagccugcugggcugcuagggaccaaaccucaggaauugcuugcauagcagaugcuuuacaaagcaucucaguccucuaaauuuauuuuuaaaacagggaaacauaaaaaauauauauuaaugcaguaucagucuauucccauucucucuuggauagacagacagaggcauagacacaccaaaaacacaccaaaccaaagugcuuaacaaggaacuggagagaugguucagcaguuaagagcaguugauguucuugcaguagaccuggauucaguucacagcaccuaauagcaguaccuacaaacucacauugcagaucauguuuaacuaucucauugagccguuauaauuuuuuuaugguacaaauguuaaaauucuuucuuuucccacuuuuuuuuguuuuguuuugguuugguuuugguuuuucuagacaggguuucucuguguagcccuggcuguccuggaacucacuuuguagaccaggcuggccuugaacucagaaauccucuugccucugccucccaagugcugggauuaaaggcgugcgccaccacgcccagccuuuucccacguuuuaaaagaacauuuauucauuuguuuuggggcaggcgugccauggugcauuuuguagagaccagagaacaauuuguggggaucuguucucuccuacuguacuaguccugguagaugaacucaggucaucaguuugacaacuagugccuuuaccuccugagccaucuuccugguuugccuguuucuucaucuuuugaaauguacagcauauuacuaucaccugaaaucccccuucucugucacaacacuccagauagucuugcuucuaacuaacugacuagccacaguuugaaagacacaaaaaugaacccauuuuguguuugucuuucuguacugagcauauuucaguuagcauaguauuuuccaagccuguccauguucuuuacuuaaaaugacugcauauucuuuuaaaggcagauaguauugcauuauauauggguaccaccuuuuguuucaucuguuuauacgcauuauauuaguuaacuuuucuuaucacuaugacaacauagcugacagcaguaacuuugcaggaagguuuauauuggcauucagagucugcagucacuguaauagauaaggugugguagugggagcuuagggcuucuuuucaccaugaccacuauacagcucuggccagaagcugagcuaggcugcuaacaucaaaggucugcuugguaggccgcgucccagaguguucuacaaccucccaaagcagaacccaucagcugcugaccauguuuccaaacacaagugggacguuucacauucagauuuaacacacacugguugacuucauauucaguuguuguggguaauguuggagugaacuuagaauacuaacaguaggcuggagaggugacucagucacgaaagugccugcgguaugagcaugagaaccugaacuuagauucucagaacaaaauaaaagaugaggaaaaccgcccaacauugacaucugaucuggauguucaggaugaucagggcauccuaagacggaguuugaggugguugugaauggccauguggguacugggaauugaccuuggauccucugcaagagcagugagggcugagcccucucuucagucuuacagugauauuugagaucgccuauuagaucuagagggguuuguugccuugccagcaguguauaggauuagauccauuuguacuacuauaguuaaguuacauuaaguacgcuuuaaauauauauuuuaaaaauaacauauauaaaauaauauagagcuggugguggcgcccgccuuuaaucccagcacucgggaggcagagacagguggauuucugaguucgaggccagccuggucuacagagugaguuccaggacagccagggcuacacagagaaacccugucucaaaaaaaccaaaaaaaaaaaaauauauauauauauauacacacacauauauacauacauauauauauaucuugugguauauuaggcaaguagcgaauuaggcaaguaagaucauaaguugcuucugaaaaggccucauucaaauaauauauaaaaauaauauuuaccuuguggcaugcacacacacagacacaagguagaggggcaaaaccaaacucaguccuuuuguagagcaguauaugcucuuaacugcugggccgggcucucgcccaaguacuuuaaucuuuaugauguuuuuauaaauggacauuuguuuguuuguuuuuuaacuuccuccuuggguuguaacaggauuuguugucuagcucccacagccugcugagcucccacguuggcucugaccguuuauaugucauaagggcaugugugugagccuguucuaugaaaggagagggagggaaugcucaacucgguuuccucugggagggguuuauaguuuucucuggccagcauaguugugguuagggcuuucaacacaguggugaauaggaguggcaaggacugacguucagcucucauuccucacaaggauggagaccuuuagaaccaugcauuucauauguaaccguguacuuuaaaauguguauuugguaagacuaaauuuucuacauuucacugguaauuaauuggcuuuguuagcugaguuuuaaagucugccuucugcuuuuuaaacuugugaaaaugacuuuuuguuaaaaggacaaaaacagaggcuagggguugaguccaguagucagugcuuauuuggaucuugcauguacacagccugaguuuaaucccuaauacugcaaaaagaaaaagaaaaaaaaaccuacuaucuaauaacaaagcgaauuaggcaaguaagaucauaaguugcuucugaaagggccucauucaaauggauauuguagugauggauaguuguuauuaacuaggauaaauauaaaugaaaauaauuuucuccagcuuauacauagccagagaugaaagauacuguaauagaugugagauaauaacuuuacaguacugaaggcucaagcuauagacucagcaaaugcuuucugcucuuucagagggccugaguucaguucuuagcacuuauucaccuaugacucuagcucuauaugaagcaaugccuuuugacuuccauagacaucuguacucacaugugcacacaaguacagacacaugaaaucuuuaaaaacaaaacuaaaugcuaccucguauucuguaacuauuauauuuguuaauugauuuauaucuuauaaaugauaaacucccucaauacagcuuaacuguguauuauccaaacauuuuuuuguuuguuuuguuuuuuguugugguggugguuuuggauuuuugguuaguugguugguugguuuuuugagacaugguuuuacuauauagcccuggcuguccuggaacucacucuguggaccaggcuggccucgaacucacauguauucacuugcaucuuccaccugagugcuuggauuaaaugugaacuccaccagcaccaccuggcuaucucuuauucuguggucuugcuaauaguugacccuuucagguugggauuacugguacacaucauuaacccuaggacugaaaggcaaauggaacucugugaguucucaauauauucuacauauugaguucuaggauagccagggcuauauagagggaccuugucucucccaaaccccaucuucacccccaaaaaaggaucauucaaaauguuguuccaaguguugaaagcugugauuggaagguccuaaguaagguuucuuuuuccuucuuaauaucuauuuacuuuuauuuuaugcauaugaguuuuguuuguuuguuuuuaagauuuauuuauuuuauguaugugaguacccugucugcauguacaucuucaugucaaaggagcacaaucagaucccauuauagguuguugugagccaccaugugguugcugggaauuggacucaggaccucuggaaggguagccagcacucuuaaccucugagccaucaucucuccagucccacauacggguuuuuuguuugcauguguaacuguggaccaugggcauguagugccugugagggccaaacaggacugucagauuccuggaauuggaguuauagcuacuagccacugugugggugacagguucucugcaaggccaacucucuagcuuccuacccccuaauaugcuuucauuuuauuuuauuauuuuaauuuuauauguccagauguuuugccuacguagaugccuguaccccauguacauguguggcgcccagggaagauaaaauguguuggguuucuuggaucuugaguuaucaacaguugugaaucaccaugugggagcuagaaaucaaacacaggucuucugggagagcagucaaugccuuaaccacuuaagccaagucucuagagccucuuccaaccccagugcucccaagcccuuaaauuugaguuugcauuguuucaggagaacguuaguguaaguagugugguagacagaagcucugugagcacauugcaaacacauaguacauaucaggagaggagaguucugaaguaugcauugaagcaaaggaguaaagaauucuuuuuuaggaaguucguuugucuauuuguuguauguguguucuguauuuguucaugagccauugaggaggagguuuggacccucugggacuagcguacagaugguugugggcucuguggguagagucugggucaucccaagagcaguaaaugcucuuaucugcauccaguucuugguuuuaguauuuauucuguaccacccauauucuuuuuuuuuaaaaaaaagaacuuuauuuugcaaauuccgagccaaauauccaugcaaaagccuuggacuugaacccuuguguuuuaaccuacaguacagugcuuagaagcugugcagggcagacaggaguagaaaaggcagauguaagggacaaaaccauuucuuagauguguucuaaacuugaacuuucuuuacaccaguauguguucuuucuuuuauuuuuuaguaccuauuugaaaaugguagaauagauaacauuuuuacggagcccuauuccagauuuaugauugaacuuaccaaacucuugaaaauaugggaaccuacaauacuuccuaaugguaaggguauuauuuuuaauuauuuuaugauauacuuguauaaauugauuuuuuuaaaaguauuucauauauugcaauauaaucuguuuugauguaauacaguucagcuuuuaaggagaaaaucuuagauuuauuguugagcauuuuaguaaaaugcaacugucaacaguguaugagacuaauauacaacucaaaacauacucaauuauuguuguauuuguaggaauguuuuaucugguaguaucauggaaccuacauacuggucacuacggaucaacucagaugcguuccaugcacagaugaucuuuucagaaugcuggugaucugugcuuguuuuaucguugaauuuuuaaccaauguuguuagaaaagucugugguucaccccagcucucaggcugcgacuggagaagugagggcgauagccaugacugugcccuucucuugagcucuggagaaccuuuggagcauucugagccacacacuguuugagagaaggcuggcaacauauauuuggaaguaauaaagucauguuuagggaugaucuccaagaauagaauacagaagcagcaacagagaagauaaaaagagagcauuggguuagaccugaaugagggacaugaagaauccucuccaaggagcagggcaguuuguuaagaccuugaccuuuucaauacagauccuaguuagucccgaggugcauaggacuguuaguucaaguuaggaaugagagggagggcgggagaguccaucuugcuaaaagguaagcgugauggucugggcaguagcugcuucauuucccauggaccaaagcugacuucguccugguucuguagucugagcuuuaaaaaaaaaaaagguuuuuaauuauuuauuuauuuacauccuaaucccaucucccuccucuccucccuuucacuuccccaucuucguauuuuuaaaugguuagaaacuugaaagaaaaauauuuugugauaugaaaauugcaugaauucaaauaucuauaaauaagccuuauuguugagagaaaguggccuucuugggaaagauaaaagaguacaggguagagcugggccgucccguuggagugcuguucuuccuggugcugcuucuguuugcugcauagagaagaggugggagagcagucagcgccuuacugugcuccgcuuguacaaguggagauuacauggcucucuuuguucuucuccgcccugucuagguuacauguucucccgcauugaagaagagcaucugugggagugcaaacagcugggcgcuuacucgcccauuguccuguuaaacacccuccuuuuuuucaauaccaaauacuuccaacuaaggaauguuacugagcacuugaagcuguccuuugcccacgugaugcgccggaccaggacucugaaguacagcaccaagaugacguaccugagguucuucccgccuuuacagaagccggagucagagccaggugugcuguugguagaugagguuucuguuugaagugcaaagaugguuaucacugaaggucauggagggcacacugaaacuucuuuaacguuuuaauauuuuucuguuucugaguauguuacaagcucucaaaauaggagacuuuuugguucauuuuaauuuuauuaacuuaaguuagaaaugcugacuuaauuguauagugccgggauggcgagaugguucagagguucagagcacugucugcucuuccagagguccugaguucaaaucccaacaaccacaugguagcucacaaccaucuguaaugagaucugguacccucuuaugguguguaggcauacgugcagacagaacauuguauauauaauaaauaaauaaaaauuuuuaaaaauauuguguaguguuucccccuccccaccccccgauuuaguuggguagauucccaaauaaucuacauuuaaaacuuaccagaguauuuaaaucuguaaccauggugauaagcucacuauuuccagcuaucagucaacaauuaacaguuaaaagaaacaugcuuagcuuuaaucuauuggacuuuuuguuuuuuacaggagcaucuugauuugguuagcaucuuuuagucaguucuaaaauucugaaauaacucagaagccgaccuaaaguaggccguuauuaguacuguagaccugggucaguaguagcagcuucaguaaguggauuauggucauguauuucagaaagagacuaaaugacuccaugucuucaguaucugaaaaauccugcuauucuagaacuaaaaauuaaacuuuugguuuauguuugguuuuguuuguuuguuuguuuguuuuguuuuuuuccagacaggguuucucuguguagcccuggcuguccuggaacucuguagaccaggcuggccuugaacucagaaauccgccugcuucccaagugcugggauuaaaggcgugcgccaccaccacccagcgguuuugguuuuuuuaaaaccuuacuauauaguagcucaggcuauccuugaccucaguccucuuaagucagccuuucugagaguugcagucacagcucuaugccaucaugcucauauggcauauauacacacaaagacgcucuuaauuuacaucaauauuaaguucucccaaucguuauuacuuuuaagaauaaauuacauaguggaaaugugaggacuuaaauuuucuaaaucuaaacucugaauaguugguaugugugcaccauacauauuagcuuguuuucacuugcuccuuuagcuuuagaaauacuaccaucaucuugcccuuuccccuggugucugucucuggccauagcgugguacuuaugugauccacuucauaguuuuguuuugguucuugcuuuuugagacagcucacucuguaucccaggcugcccuagaauucaguuguauuucccaaacuagccucagucaugaagccacacauccuccuuggcuuucugagggccgggguugcagaccugguucucccccugaagguuugcuuuauccucuuagauaauauuagcaaaggagugagaggcagucaguuauuuccacauuugauugaguacuugacaauguugauaaaaaguucaacuuguuuuuaaguaacuuguaaggcauuucuauauaggaaacuggaguuauuuuaaagcaauaauacuaauagcuggagaaaaagaguccuaaaccauuuguuuaagagugacuuuaacaaugggcuuuggagguaccuggcaggcucaguguuuuagaggaccucuauucccagcacccauaugcagcuuaacagcugcuuggaacucugcuuccagugggaucugaugccuucuucuggccucucuggcacugcaugaaguggugcacagacauacaucaaggaaaacacccacaggcauaaaauaaaaacaaagacuucauuuuaaaaaauggaaugaggcuauggcucaguggaugacagugcuuaaaaugcuugcagccuagaucaagauccccagcuccaucuggcagugguggggcacaccuuuaaucccagcacucgggaggcagaggcaggcggauuucugaguuugaggccagccuggucuacagagugaguuccaggacuacaccugucucaaaaaaacaaaaaacaaacaaacaaacaaaaaaagcggggggugggggugggaagaaaagaucccuagcucccuuguagcagugauaauguauaucuccuaccucaguacugaggggcugagacggguggaucccugaagcuugcaggccaaccagugcuaggguaugacuaaacuucaggucagugagagaaccugucucaagaauaaaauggcucagcagguaacagugauuguuucuuaacccuguaaccuaaauuugaucucuggaacccguguaaaacucggaaggaaaggguuggugcuacagaguuguuuccugacacggcguugugaaugaaugagugugcaugugugcgcacacacacacacacacacacacacacacacacacacacgcaugcacaaacacaaguggcuugggcucuuaugucuacauacagaguucuguuuaguuugcugaaugggcagaugagacacagcagccuccuuccugugccugcaccaugcacugucuaacagcccagccccauagaguccuguccuaucaaaugauaacucagaugcuguuccuuagaauacguaaguacagggaacuugagcaagaacucagucuguauuaguaccccagaggagagacgcauccguauaaaugcuucgauucaugagcccuauaccuaauccauucuacugagaaagccaacuccagaugaggacauaucagugacaaauggucacuuuugucacacgacuccucguugcuuaacaggaacauacauguuacaggacaagccuaguguuuagcguauaaacaaaacuccuggcacauaguugcuuaacaaauauuguugaauauuugaaagagcaggaguuagagucuggcugggaagcagagcucauuagguagguugacacuuauacaaaucuuugauuuuuuuuuuccuaccucaagauaagguaacuauuggcaagaggaaacgaaaugaagacgacgaggccccagugggaguggagauggcagagaacacugacaacccgcugaggugcccgguucggcuuuaugaguuuuaccugucaaaaugguaaggggcuuuucugugcucugcacacagagcgcucauacccagcauagcuggcacuucauucaagugacuggaaacuagaagcacagcugacugugauccagggucugccucuguucauguuuucuccauccuucuaucugccuggauuuggaacuaagaagccagccauguuaucuuaguguuuuucuccuaaaauuucuccaaggggggggggggaucacauuuuauuugaccuucugacacacuguuguucauccuguauguagagucuuuuuuuuuuuuuuuuguuuuuuuguuuuuuuucgagacaggguuucuuuuuguagcccuggcuguccuggaacucagaaaucugccugccucugccucccaagugcugggauuaaaagcgugugcuauauagauggagucuuaucuauagugauuuauuuuuuguguagaaaacaaauucugaggcugguuuuuggcuaaagccuucaaggaggagaaagcauuuaagaaauuugaguuuuguauguuaacgagccaacauccaaacaggcccauccccaagcugggaguauauacucuccccuuagccaccaacagucugaguccagaguuuaaaguuuugaauuaaagaaauucugauuauaauguaugacucacacuaaaaguacaccuuuuuggucaaagaaauaauagcaucgagugaccuaugcaaauuggcccauuugaagugaaguacaggauuuaugcuucucucucucucucucucuucucucucccucccucccucccucccuaucucccucccuccuucccucccuuccuuucuuccuuucuuucgaggcaggguuucauguuucccaggcugggucucaaacuugacuuguagccaagaaugaccuugaacuccccagcccucauccccaccuuccaaggauuagaacuacaggugucugccccacacccggcugggcuuucuuuaucuaucacggucuaccacuuucagcucgguucugggccgcccugggaggaacaugcauguuaugccugugguucugguguuacugacaacgugagacgggaugggaagaaguucagaacuguuaccuaagaaaggaugcuguguauuucccguguucccaucucaacuuuguuuucucucuuuugcuuguuuccuccuguggauaguucugaaagugugaagcagaggagugauguguucuaccuucagccggagcgcuccuguguuccuaacagucccaugugguacuccacauuccccauagacccuggaacccuggacaccauguugacgcgcauucucauggugagggagguacaugaagaacuugccaaagccaaaucugaagacucugaugcugaauuaucagauuaacaugaaggaaagcucccguuuucaugcacacugguaugcaccaagcugugaugcacucagcuguuggaaagauguugaaaugcaaguccucuugacuugcuuguuuggugggaaaaacgguggcucugagccguaguggacugcaaauguaaccugaggggagaagggugaguggauugggagggagaggaguggucauagacaucuucgaaagacuaaccaguuucugaguggugcauaaucuuauuuucuuugggaauaagaaauuguggaauauuuuuaaggaaaacuguuguauaaaauucuaccauaguaaccuuaguuagaagggguagcuuugcagugagacccuggcugcaguaggcuacuugagcaagcuguccaugaaagucaggagaggucacugcacagcugagaguggcaucagaugaggacagggagacucagccuggaagauccaauaaaaauacucaaguuuuuauaaaaaagauaguggucuggauugauuuucacugccaaccuacuuaugugaaggauagaagccuuuagucuuuuaacugaaggccccucacaucagaggacacgcccuucauuacuguuagugagccccuuuucauuuagggucuugccuucucagcugugggugauuuaagguaaaaaggaugauauuucagaaaauaacuauguacacagaaaaucuguggagcucauuagacccuggugucuugaaguauuuauagaaagcccacuaaaaugcccgcuucucugggugcugcugucuccuggccucagcuggcugcacagaaguggggccucccuuuguguccaguuuuccccauggcauccuuucuucccugucuuacuuuccugucccaaaugaugcugcuuguucuuugucccagcuucuagaggcccuugucauuucaaaaagaauaaucugucuccacaauucugacaaaugugugggcgaucccacaaagacacaguauuauguagcuguccgaguuacgguagggaagauugcaguagguuccuguguaaaagcauuuggaaguugaccuuauugccccagggaacuugcaaguuaggaauuguggggcuggagucugaggugacugaccucacacauccaugcgaccuuucugcugcuguauuccagacucuagcucgcacaggucuaugggaagcgcaaggcacaggugugugugacauuaccaggugucucccucaucuccauucucaguuucuuuccuacaaauuuugaaucaagcuuuuaauaauguuggauaauuacugagcuucuuuaauugacguuaacuugagcuuacagcagaccugagagaagucauaagcuucuccagacugucaccuaagacuucagugugucccauguuauaggugggaguagcaaguugguuguuuuguuuuaaacaaauaaaggucacuuaaauacaucagaacuuuaaaaugggccuuugacguuguguacuuagugguucugucccucugcuuguaacaaauauccuuuuuguuacuaagaauuaugugaaagaaguaauucugccccagucuguaugauuaacuccaucugugcugucauuucugacggggaaacuucuuccuuccagaccuugauugaucggagggaaagcaguuggccugucugauaagucaccaauaaaccauccaaaacaccaggugucauccugcuguaucaguucugauuugugugaacacuaacauuucccaucuagaguuguaugaaaaacaaauacuguuagcuuaguauauaaauugauauaaaauaccaaaaagaaaaaaauguaucuuuuaagagaacaaccacuauccagauaaacgacuguaucgggcuucagcugcauguuagugcaggggcuucagacccuaaacuaauguuaaaaacugguugaucaucaaucauuccuccugaguguagcuguuugcugugucaaaucauuuguuuuuuuuauuuuguuaaaauuguguaaaaccauacuuacuccuuccucccucuagggggagugaggaacaaacccaacaacuagcaccugagcucggccugucccguccuuggucucugucucuggauuuucucuuugcaggcaccacagaacuauucccuuagaauaaaauaguauauuuguauuugaugggugaguucuuuuucuuuguugcuuuaaaaaacuuuaaauauauuuuuuuauuugaucuuauugguaugauccaagagauguaaaauugcaaaaaaaaagaaagcagcuuucagaaaaguuc

SEQ ID NO: 2124 - RNA, 29385 nt, Mus musculus
aaacaaguauuauuuuaccauuuguccuaagaacucagccagugaguccagcagugguguugguaauagugcggaccagccaggccuccucccaccuugcucggugcucugugaggacacagcugcucccggugagggaguagagaacaacagugagaaauccauggaaggaaaugauaggcugugucucucaaaguccacauuaacagaacagaacauuaagacagagccuccgggagagcccuggagcccagcucuccagcaucugcaucccagcccugcagacaauaucgcauucugcuauucuugcuacuuguucuuccagaaaaaauuuagcugucggagagaagcuuuugcaacccaaggaacugcugacugggagaaaaugcugggaaauuucagaaagcaugaagaaagugacgugcacuuaaagucacugcaauuuuggaggcaauaccaguuucucgaugcuauuccgugugacaauucaucuguuuauucaaaacagauugaaggaaauaaaaaguaccuaaggcucaucauugagaacauuuuauuucuuggaaaacagugcuugcuguuaaaaggaaaugaccagucuguuucacccaugaauaaaggcaguuuuuuggaauugcuagaacuuagagcaagagauagaggagagguauuucagcucaugaguucccacguggacuucuauagcagcacgcuuguccaggaggagauuauugaaaugauaaaggaugaaauguugcaagacaucgugagugagaucaacgccuccucagccuuuucaauaaucugcgaggagauagcugguagugccgcugagagacagcuuuccgugugugugagguacccacaaaagacgccaagugcugucuugguuaaggaaagguuccugggguuugugacugccgaggaggugacugggguccacgugcaugggcggaucaaagcuuaccugcagcagguuggaguugauuuuaauaaaauauguggccaagccuaugauagugccacaaauuuuacgguaaaauugaaugaaguuguagcagaauucaagaaggaagagccaagagcucucuaugugcauugucacgcccauuuuuuggaguuagcggugauuagcuucuguaaggaggugaaggagcuccgcgaggcacuacacacucucugcucuuuguucaacacaguucaugugucugaagaaauguuggcaaguuugcaaaccauguguaagcuaagucuaaauaaaacuuguaagaaacacacgucacagucguguuggccagcccacgaccauuugcugcuggccgugacggacugccuuccggaggucguugaggugcuggcgucagugucacgccggugcgcaggcacagcuguggcugccgagcuggaggaccuguuggccaugguuaccaaguuugaauuuauauuuuguuugaaauuucuuuaucgaguacucaguaucacagggauucuuucuagagaguuucaaagugaaacuguugacaucuuuucuuuguuuucaaaaauagaagcaauuuuggaauguuuaucuucugaaaggaaugauacauacuuuaaaaauaucugggauggagcagaugaaauauguaaaaagauaaccaguaaggguuuugauguugagaaacccucuuuucaaaaaagaagaaaaguucaaagaacaguagauccuggcaacucagagcauauguuuuuuccuacuucagcagaugaacaauauaaauuuaauauuuacuaccaaggucuggacacgguauuaaaacauuuaaaguuauauuuuucagaguuugacuauuguaaaaugaaacaaauuucagagcuguuacuuaaguggaaugagccauuaaaugaagcaacagccaagcacauccaggaauucuauaagcuugaugcagacaucauucccgagcuccgauuuuaccggcaguaugcagguuucaacuucaucgcagaggauggguccuuaagcuucauugaccuaggcucuuuguuuauucagcaugcucuccacaauaauauuccuuguaucacgaagcuguugcauauugcuuuaucuuggccaauuacuucagcaaauaaugagaagucauuuuccacgcugucucaucuuaaaacauacuuacuucguaccaugggacaagagaaacuuaguagccuggcucugauagcuguugagcaggaacugguaaauaaacugauggaaccugaaagacuggggggaauugucgaaaaguucauuagucaaaugaaagauacgugagacaaacuugcaacuuugagcuuaauuaaaagaauucugugguuuuauuagaauccuaaugaaguuuuguuuguuggagguucuuugagacagauagggaucuugcucuguagccuaggcuagucuugaauuuguaagcucuugagacugauugacccucuuaccugacucuucuccuuuaaaguauuccaguugacguauugugucguaggcacaucuacauuuaauacauuuacugagcaacuacuauaugccagauaguaugauaugugcuggagguauagcagagaauuaggagccuagagucaauugaacauaguuuuuucuaauauagaaaucuaguaagccuggcacagcggcacacuuuccuccaggacugugacucauugguaacauacuuaacgucccuagaaugcauaaggcccagauucaauucccagugccaaggaaguccuguaauaccaucauagcugcuagugaccgugugcauuguuaaauaaaauuuuaacuaaaaaccauugcugggaagagaauaguucuacagaagcaaaaaauuagaggccuaacuaacucugcuaccagcagagagaugcagaguggcugugagguuaagguuugaaauacagaguagguggaccagguagugguuuuucucuuaacaacugcaucagcucauuccgagaggaaaaagauaaaggaaguagggaguuuagcaaggcugauugagcuuugguucucagcuaccugccuuguugaaagaauaaagacagggguuaagcagguggcaccugaccauucagaagcaaggaagucauuucagguucucagcccccaacuaaggcggcucagagcgucagcugaauucugggcucccaguagucacuuaguugugcuguccuuauucuccagaagaagccaaaagccagagcagagggaguccagcccucaugccuuuauagaggggaccuggugcagguggcauucccucugggcugcacacagaguagcgccuccaagacuagaaucaauuccacgggagccacaagccccuagacuugcuccauggucugucuccauuucccuuagaucucaucugcugaacugcacuugugccagcaaguccuucuccagccucuguguccucaggguggacaugauguggacaaaacguauugguucuucaguugucugguuagucccaucuucauugacugggccuuuauuacaccacagccuaguuugugccaaacuucacuuggauucccuauggccucugccagaagugucuugcucuguugcuaaccacccaacccucacucucgggcauaaugcacccuagguucacagaccugcauggauuuggaaaagguaaaaguccuagcuauccuuagcugugcagugaaacugaguccagcaggaguggugagcagucagggacaaggcugucuucagguguggggauccugggacuccaacaugcaggaaggggcucuaccacuugggacucuaggaucgguaccugccaugguggggaaguuagggauaggcuagcagagcuaggccauuguguacauuucuuacacuagaggaaacaguccucagcaugcgucuagauagaauuauaccuuuagucccaguacuugggaagcaagggcagauggaucucuguaauucugagaccagccugauguacagagcuaguuccaggacggccaaggcuacacaaaucaugucuccaccaaaacagaaaacagaagucuuuucuaggauaacauguagggcuugaggucuugugccucuucuacuucagguagccuccaggcauaguuuuacacucccgccagcaugucugccuuuguucuacauugucccacaguuguuacugucacucccucuagucugaacucuagcugcuuguuggaaauaguugaccuuguuuauuccuuuuuuuuuuuuaacuguuugauuuuuguuaaguucuuuaagccaugaccuuuucucugaaaucagcuuccucuuccacaguguuaggguuuuauuuccucugaugagacacugugacccaaggaacucuuagaaaggcaaacacuggggcuggcuuacaguuucggaaguuuggucuguuaucaucaugguggaaagcauagcagcaugcaggcagacuugguccuggaggagccaagaguuguauauucuugaucugaaagcagccaagaagugacugucuucaguaggcagguaggagacucugaugucaucuugggcagagccugggcaugcugggauuaaaggugugcaccaccacacccagcauaguuuuuaguuuugauuaauuuccaucuuguccgacaaucaagauugauggauuuugccccuaagcccccaaauuugguagaugucucacaccccuucuggaaauuagaacagcuaucuuugucaaguaccuauuauguaacuuaguacuuugcaaguuacauuagugcucucaauagccuaagaaguagguuauugggugcucaagagauuguguagucguuaaguaguuaaggcuacucuuccagagaacccuugguucaaguccuagcaccuacauggcagcucacaauggccuacaacuccaguuccugaggauccaguacccuuacauucacacacaugaaggcaaaacaccaaauaaaaauaaaucauuaaauuuacuccuuuaaaugguuacaaagcacccaacuaguaaagaucaaaguaagauauaaaacaggugguccacggaugguaugauaagcccagcacuuggaggcagagcaagguggaucucugugaguaggaggcugugcugaucuacaggguucgugcccagauagccagaaccacauagacccugucuguaaauacaucaauauauucuucuugugccauguguaagucagaagggucuugucuucaccaucauguugaaugaaagcauccuuucuauuuugcugcuucugauuugugagggacuuacaagcuuaucuuuuuugauguuggugguuugguuuuucaagacggggcuucucuguguagcccuggcuggccuugaacucaaagaucugcuugggagaucuugggagguggagaaacauaaaacaggcucccagucagucacaaggaucagacugaaugucccugcacucaccuuggugccuguguugcuacgcugugcuguuucucaacucggcguuuucugguggauugguuuauugggauguaaguuguuccuaaacugagggacaucuauccaaacucaggaaagugugaguguguguguauuaaccacaugcucaaucaaagaaacuacuuuuuaggcccuuuugggcaggaaggggucuauguagacuuuugcuggccuuaaacucacagagauccaccugucucugccucuggggugcugggauuaaagaugugucccaccaguccuagccuuuuaaaugauuuguauguuggaggguggcgguaauguaguucucuuacagaaucaaacucaggucguugugaauaguagcaaaguuaaaauaguagcauauacaccuuuauaucucacagucucuuuuuaagauuuguuuauuuuguguauaugauuaugcuuagcuuaucuucagacacacuagaagaggccaucggauccuauuacagaugguugugagccaccaugugauugcugggaauugaacucaggaccucuggaagagcagccacuaaucuuaaccacugagccaucucuccagcucaguaguaaaauucuuuaucaacugagccaucuuuaaggugccugcauuucuauuuuuuuaaauuagauauuuucuuuauuuccauucaaauguuaucgcccuuccugauuuccccugcgaaaacccccuauaccaucaucaccccucccccagcucaccaaccuacucacuuccgcuucuugaauuucuacuuuuuauucauaaaauuaaaauagugcaaaaacguagcugggggcagagcucacuugcuuagcaugcacacagcucuggaucaggccucagaacugcaaaauuaaagacagggaaaaagaaaagaaaaaagggacuggagagauggcucagugguuaagagcacugacuguucuuccagaggucuccugaguucaauucccagcaaccacaugguggcucacaaccaucugcaaugcaaucugaugcccucuuuuggggugugugugugugugugugugugugugugugugugugugugugugugugaaaacagcuacaguguacucauaaauaaaaaaaaaaaggaaagcauuuacugaguguauaacuuuuauauuuauugagcacauucuaagaucuacuuuuauuacaaccuacauguugcccucucccuucacuagguauuaaaguauuaaguuaaaguauuagcaaaauaagucuugagaugaaagucaguuuuuugguuaaaagaauacagcuguacucaaagcuggcaaaccgucagguagaugucagugucucacccuugggauucugaguaggucacuuuggggcaaagaucaugaaaccaguuccuaaaguuccacugcugauuuuggcacagucagcuuugggaaucaacuguguuacugaaugauuuucaaagcauuuauauccucuuaacaagagauaaaacauauucugugaagacauauugaguacugcacucugcacaguaaagacuaaauagauuucaugggugugaucgucuccuucuggaaacauggauuagauuagagguuuugguaugagggauuggugccacaaucaguaaauaugcuauugcauagcuguuugagagucaguccacagaggcuaccuaccgcucccugcaaggccuuaauuuacccucgacugacucuuuccuuaucaacccauagaaaccaagaacaccuacaccaggcagugguggcacacgccuguaaucccagcucaaggaagcagaggcagacagaucuuugaguuugaggccagccuggucuacagagugagcuccaggacagccagggcuacacagagaaacccuuuauuuuguauauauggguauuuuaucucuauguaugucuggugcuggaggagguauuuauuuauuuuuguuuuucgagacgggguuucucuguauagcccuggcuguccuggaacucuagaauauauaagcacccugguuguuuuuaauacauuuaauaaauauauuuauuugaccuggaaagaugguucugcuacuaaaggcuaggcucacccuuuuacuuauuuuuaucuuaugugugugucaugaaugucucugcaaaauguuuauucagugcccacaguggccagaauugggaaucagaucccugggaccugaguuaaggauuguuaacugccauggaggcacugaaacucuaaacuagguccugaggaagaacagcuaauacuuuuacccacugagucuucucuucagacucccuugguuguuuuuuuaaagaguuauuguauuuauguaucuguguggcuguguaaagaaagaucugggcaagguagcucacacauuuuauuccagacuuggaaagcagaggcaggcagaucuauugaguuggaggccaaccuggcuuuaauaguuucagguaagccagugagacccuaaacaagcaaacaaacaaguaaauaaaaaauuccaucuuuuaaacaauaaaaauaccaaaauguucuuugacccuccuuaaaucugguugggacaagauuuguaaaucuuauuuguaguaauagcuguugacugcaaagaucacuggaaacuucuacaaauuugaggacaccuugguuacauagugagaucuagggcuacaaagagaaaccggucuuaaaaaaacaaaaauuaagaaaggacacuacccuaaguucaauucagguucuccacaauaaaaauuuucacauuuaaaguauuuuuaauuacuuuguguacacuaauguucugucugcauuugugucugcuauagugaaucacaugcccuggaacuggaauuacagacauugugagcugccaugugguucuguaaauugaaccugguucaucuggaagaacagucauugcucguaacugcugagccaucucuccaucccgacaaaauaccuuuaaaucuucuaaaacaaaacaaaaagcagcaacugggaaguggugacacgggccuuaaguuucaguacagucaggguuauucagagaaacccugacuuagaaaacauaaaacaugggcuggagagauggcucagagguuaagagugaaaagucccaaguucaauucccagcaaccacauggugacucacaaccaucuguaauggguucugacacccucuucuaguguaucuaaagacagcuacaguguacucacauauauaaaucuuaaaaaaaaaaaaaaaaaccagaaaaaaaccaaauccacaagucaagaagauagaguaaucauguaacguauuaaaguggugagggugggacuguggcuuugcaguuaaggugauugcaagacucaaccucaaagaauaggucguguauucccucuguguauuaugaaugcaaugaaucuuauaauuaagagaaaaaaaauaggggggcuggcgagauggcucagugguuaagagcgccgacugcucuuccaaaggucccgaguucaaaucccagcaaccacaugguggcucaaccauccguuaacgagaucugaugcccucuucuggacuaucugaggacagcuacaguguacuuacauauaauaaauaaauaaaucuuuaaaaaaaaaauagggcuggaagauucaaugguuuuuuucauccuuuucaaaaguaguuuagggcuggagaaaaggcucaguagguaagaagucuagcuguucuuccagagguucaauucagaguacccucaugguugcucgcaauuguaauccacucccugaaaaacggugacuacuucugcccuccugaaacuauguagucuaggcugacuuugaacucucagagauccaccugucucugcuacccaagugcugggauuaaaggcaugcaucaccacacccuaaauauuauagguuuuuaaaagagagcauauuuuaauaaauaaaaacgguagcuacucuggggagugauggguuaagagcaccuacugaacccccuacauaugugugguagaugugcggcuugagugggggugggacgaggggcaagcugucucugacucuuguugccugccuuuggauggaucacuuucuucuagcugggcugccaugucuggccucaauuggagaggaugagcuuagccugacuuaguccuuagacuugaugugccauggauugguaccaugggugguaguggggguggugacagggcucccuccucugaaaagggugggggagauuggagaaggugggugggcacgggucuggaaggaaaggaggaaggggagaugagaucaggauguaagguaaauaauauuuuaaaaauauaagaauucaaauugucaaaauaucuguaugaaaaaaaagcauuuguugcucuuugauuucuagcacccacauguggcagaugacauaacuacaguacacagacacacaaacaaaaugaaaaauuuaaaugagaaagaccuaaguucucccucaccauuaucagagcuucaaaauagaacauacuucagucuuccugucuuaccagccucaaaggaaacaagacacaucuguuucaaaggaugagaacaugugcaaggccagccuucagccuuggcuaguuggguaaaugaaucucaaaaccauugccaguucuucuugauuauaggaacuaaaacacaguuaacaauuuugugaagacagaacuuggaggcaggcagauuucagccuggucuacggaguuccaggacagccagggcuacagagaaacccugucucaaaaaaaaauaaaauaaaauaaaauaaaauaaaaaugauaaugaacaaagaaaaugcugccaaccagauugccugucaagcaauccgaagugcguucugacugauguucaagggcgccacucacuuugggaggugccaucccuggcugaugguccuggguacuauaaaacuggcugaguaugccagaaacaagccccccauggccuccacaucagcuacugcuuccugguuucuucaguuuugauuccuaccggguucuuuauaugauggauugugcugcaaaacugcaaccuagaaauaaacuuuccuccccaagcugcuuuuagcuguuuuauuccaauagaaaccacagcuggagagaugguucagcagcuaggaacacuguccugagguucugaguucaagucccagcaaccacauaguggcucacaaccaucuguaaagucaagugugucugaauacaccuacaauguacuuauauacaugaaauaaguggugcugcugugccuccaaggcuuaccaccuucaguugacuuguaaauguggcuuccuguugagugcaagagaaaguauaacuggagugccaaggauaagauggucagaugaggcaccuaaagauuggaauugaagaguccaaguuaggugguaacagcuuggaaggcuggggcagaguucuucagaaggcaguauacgcuuugaaucagcgcuccauauaugguacaguuucacccauagccaggauucauggguccaggaaucaagggguggacuaucacuaucacuccuagugacccucuaagaagaguccaacugggacacaauuuuaccuuuucugugugcuuuucgaggucuugcuaagcagucuagcuucagguauggguacuuuuauucacaguacagaaccaaguucaaaaauaaagggucauugcacuaaucuucuaaaucucuaauccuaucauagaaguagauccaccauccucugccucccagaugcuggaauuaaaggcacacaccuuuauacaagucugcauugcuuucuguuguguucacuagucaucuauuccccucagugcucauuuguccauccuggucaaauuucauguacauacacaugaccuguguugagaauuuaugccaagacaggacugucaauugaauacucauauuuaggcuuguggucauuagggcucguaucuaggauaaggcagauuugguucuagugugccagcauuucacuacaauugugauuuuguaaauuccagcaauguuuuaaguggccacacaacuguuaaaccagcaguauaucaaguucauuuuuaauagacuuccugucaugguuuuguauauuaggaguggcccuguuaaagugugucacugagggugugugugagcuuaagacacgugcugccuggaagccagucuucauguagcagauggaagauguagaacucucagcuccaucuguaccacaccugccaggucacugccauauuccugccuugauaauggacugaaccuauaaaccagccccaauuaaauguccuuggaugagccgagcagugguggagcaugccuuuaaucccagcacucgggaggcagaggcaggaggauuucugaguucgaggccagccuggucuacagaguuccaggacaggcagggcuacacagagaaacccugucucgaaaaaaccaaaaccaaaaacaguugccuuggucauggugucuguuuacggcaguaaaacucugagacacuugccaacacuuuaauggaucuucguguuauugggagucuacuccuacagagauaggaacuucagguaauaaccuauuuuaacuuccgagagguacaggaggcuguguacuucaucugggugcacuacagaaacaaaauucuuacugagucauuucuucauguaccaaacacugacuuaggagcucaguuuccaaaaaaacaaacacgcacacaacaaaacuccaccuggaaagcuuuacuagcugcugcuuugaagcaguuuauuucuucuaguuucaguucagcuggugacugauauuucuaaauaaacuuaauaggucuaaaaguguauucuuccaucuuguggguuuuuaaaagaacaaguuuauauaccugcuuugaaauaaggacucaacguagacuagcaugaagcuaauguucccauuugccucuugaaccuuuuuccaaguuacguuaguaugugcacacacacugcaauguaugcuuaaagacaagacaauuugcuggacucaguucuacccuuccaucacauggaugccaaggauucaccucaggucaucaacccuggugcagugcaccuuuaaccuuuuccaaguuggaauucuuucucugaagcuuacuuauuaaucucuacuuaagucuuguucuuuccuguuuggucacauauagcagcaugauggaagauguagaacucucgugguuuuuucccuuuuuaggcgggucucacuagcuguuugugcuggugcuucacagaucagacaagacuugccuggaacucagaucugccugccucacugaaaguuuguuuccuuucaagacuucacuggguguuuuguagccccacccccaguuauaguuuagggcaccaaauuuaaaaccauuaaauuugggcacacaaucagacaaauccuagaaaggaguccuacuugaacaaagacaauuuuuaaaaauaaauuacuuuauuaaugucaaauucauuccucuuucgucuugacucauuuucugauacagcucacuugauccuguuaauuaaaaaauaugauuaauccaacuuaucaaaacuuccaaguguagcuuacuaagcucuaauaccaccauguuaaaucaaggacugguaauuagugacagcuuuauagcaugagcuucaaguuagagugcuggaucaggaauaucucagcuaucuuggcuuguguaugccugacaucuuucaugacgcccuucgucaauucuuaaauugacauacacaccaaguuuggugacacccgauugugucaccaaauuaauuugaauaucauuucacuuaccuagagucuuugucagucuaaguaauuuguggcuuuccuuuuuagcugacccauguugugugcugucuugagaacaucuaauuccgccuauaauuaaacauauauuuuuuaguucauuaagaaaaaauacuacuuugggcacaggcucugaacaacuauuauaacuauaacaauauauuacacacaaaacagaaauugauauguguggcaaagaccaaggugacuagaagauccacccucugacauggauaaaauuuuaaaaccugcaaauacaagucugaaauuacagcauauuucaucucccaguccucugaaagagcagccagugcucuuaaucaaguccauucucuagacauaacauguauuuuuuuaauuuuuuacuugacaauuccuuguuuuagucuuaucuuuuccccuugguacugaaaaucacaauaccaagacagcaauaugcaagggaagugcucuuuaacuauuuuuaaaaaacuagauuuaguaucuuuguaaauuuucaaggaccccagauuuuucuuuuuuuuaaaaaaaagauuuauuuauuauuauacauaauuacacuguagcugucuucagacacaccagaagagggugucaaauaucauuacggaugguugugagccaccaugugguugcugggauuugaacucaggaccucuggaagagcagucagugcucuuaccugcugagccaucucgccagccccagguuuuucaucucacuguuauuuuagccauuaaagauaaaucagguccuaauccuauuucuaaggacacuuaccucaaguaaauaagacuccaaaaucagccaacaucaaucauucuuaccuaaagaauaauaaauaaacguuaguauaaaagacaaggguauauaauaaaggcuugaaaaaugcuaguuaacuuccaaauucuaaagagcaaaaaauuccagagauuacagacuggaauaaguuguagcauuaaaaaacaaaaaaaaaaaaaaaaaaaaaaaaggaagaaacuuuaugcagggggaucuaaaauuauccuuuaaguagguaauaaguagaugagagaauuagaaagaaaacuaucuucuuuaaaaugcaaaagccuaguaccuucuuuaaaaugcaaaagcccaauuccuauuuucaccagucugagcacaaugaaguuugacugcaacccauaauauacuaucccuuaugugaagguaugugacaacguuuaccugacuaaagcagcuaucagcuuacaaguucccugcuuccccagucaauuuggugacuuucauucuuagugcuucgacccuuuuccuacagcaagcacacaacacugcaguucuuuacccugcaauccuauguauuugcuucaauuuuuguucuccacauccucaacuaugcauuauugggacagcaaaaaaaaaaagaaaaagauucuuucuucuaagggagaaguaagucauuagccuucacuauagacaccuggcacagugcacaagaaacgcagagcucauccuuaaauucaaguuccagguuguucuccacccgaccccaaccccggguaccauuacugccacagguauacaauaguucucuguugcacauugaccauccauaagggauacuauauuguuuugcauucuuucccccuucuccaauuaucccuauuuuauguccaggcccuuuucaucuucauuuuuuucuccagcacugguguucaaaaacauuauuucuaugguugguuguuuaccaaucacuguugagauuuccauauuugagucuaaaaaauugccaaucauuaucuagcagcaaugacagauaaaaggagcaguuaaauccuccagauucucucccuaguagggagccauuaagaacuacacuagcuagacagcacugacauuaucagcuaaagccaaaaccaagaaacagcccaaaacaaacaccccauagcucuaaaaccuguccaagaucauuaacacaaaaggcagcgggaaaugcaggacuguggaucaugucacugcagcugacaaugauuaacaauaggagacaugcacccccaauaagguuaaagaccaaaacuaaucacacgcaucucuucauuagggagagucagaguaugcauugcugggaggcugcaggcagccuugucugagugcccauuucaucuuucaggaagcaccgggaacugcuccaagggccuaacaguacgauaguagauaauacauucuggcaucacaccucugaacuuaguuuucauuaaaaaaauaauuuugguugcaacaagauuuaugaaauacaaugcaagcaccuuagcauauaguauuacuggaacccauuuauuucccagccuuuuuuuuugaauguuuuaaaaacccaauauacuauuaaaauucacaacuuacacuuucauucaaauuaacuagcaguacucuaccuuaagucaauaguuucuagaucucauguacaaaggccuaauaaucuuaaagcagaccaaggaggggggggggggaaucaccccaucccaagucuauguucaaauauaaucucuccaaucuguuucuguucagaagcaagucugagcuuucguuuacauucaaaaucgcugagccacgguaacaggcaccugcuaccgauuuauacagacuaugacacuucaauucccccaggaggguuucaggcagguuagugauucucaugucacacuguuugaucuguauuguauaaaaaguuaagucaccauacugauuucaucuaucagcaaucacaaguugcuugcuuggaguaacuaccccaccaucugacuugccugacaaagagcaagucauuuuuucuugaugcacagaaaggaaauucucacaguccugaagcuuucagcggcacguaugcaaaaugaaccaaacuuuccaguuauagagcagaaagcauuacaaguguagcuguuuucucaugcaugcuaguuaaacaccaaggguaaccugaauugaggucuggaacaacaguugauagaaaguucaaguccuaagcaacaaggaaggugcuuugaagacuuagguauucuaaaacaguuuagacuauaaucaaucacaucccuaaagcuagggaaguucaaagagcuacacugaacaaauguacucacucuacagaauacgacgaagucuuaugguggggaaugauucccaacauguuuucaaauauaagucacuuucacacuaguuucccccaaguuuggaguauaaacauucagacaagccacauaacuugaacuuuuuguaagauccccaucuaaacccaaguuaguaacaacucuuuccaugaagcccaaaccuagaaaauguugaucacauuacaaaaagaaacaaaacccaggaaaaaaacccaccacucuaugucauuuagucuuaauuuauucaacuugcagugcuaucaagauugcauaaugaauuagacauugcugaccaaugagaggucaaguuugcuacuaaggagaguaucacauacuacauucuuaaccaaggugcucugugcaccccaggucaaguaugguuugguucccucacccaccaaccagcuguguucccuuuuaucuucaguuacaauguaacuaaagaaaaccacaaaacugagucaagacacaaggauucacguuuuuuugagaacuacaacacugaauucuuccuaacaaauuacagcucuaacccaagacccagauuuugaacuaaccuagcuuaucauacaaguauuaggugcugcacuguaauuucacugucagaagugugaugucagaaugcccacugaauaaaagcacauagcaagucaccaaguuagauuauauugcuuguuaccuaccuguaugcagucggcaaugagaaucuuggagcaagcaggaauacuacauccggguccuaauguccauugccauuugcgguacuacguuccucacaguuacgcacugcagaaaugcuggcuaaaugcaguuauguagcaggccacuacuuuaauagugcacaauugcaguccaagaacaccacaaaacauuccgccacaacuuuguggcuuguccaagccaaguaccuaaauuuuuaucugccauaugauaugccacuuguaagaauuacacagguguaagauuacaauuucccaaauuauguugauauuagugguacaacacaaauauagagugguggguuuuaagauaauuaucaccacauaaagauaucaaugggauggguucagcuuauggcaugccuauuauacuacuggucuuacagaaucuaacuuuaaaaggagaaauguucuaaguguccucuguaaacaaaauuuugauaaagugaaguaagaaaugggggcaagugauuucuucaaagggaaaaaaaugccuaaacuacacccuaacauccuccccuuccacccuaaguuucucuguuagcuuuugguucaacugcucaagaugauuuaaaaucacuagcaggcuaaaaccaucacauguaagacuuguugaaagucucaguagcuuacaacccuugguacaauuucacuggucauguuggcugacacuauguaaccuuuaucugcuaaacacuguuuagcagcucuacagcccacaauaaaggcuaucaaaagccacaaucugcggacauuauccuuuaagcauccuuucaccacucuucaaggguauacuacuaccaaaagcuuauuuuaggggucugugccagcaucccuuauaaaggcauguaaucugaaaaauaaacugaaacauuaauuuuauaggcagauuuucccauuuccccuccagcccccacccauauacauucaaauucacccuccaugggugucccaugaacaccccucaauuuucucauuauuauggucccuacuauuacaauuucaaccaaaagagcuccuucaaauccagaccuuuguuuccauacagaaaaccuucauguaucaccaauuaacuucaguuggaccaauaacuuucugauugcuguuaauuauaauagaacuaccuauuuccaaguguacuggugauaaaaaaaugaaugcacuuucuaaggauuuuccccuuaauacacuguaaaccugucagucauacaaccauuugaugacaugcuuuuuauaauccaguaguguuuuacuuuaaauaguacaacuuuccuauguaugcaugaaguacguuuccacaauaggucuccuuuuguacucaagcacaauauucaaccucagcaagugauuuagaauuucuuuugccaauuagcaccaaggauagaggugaaaaggaugaagacauucuaagugaaaguucuagaauguauagacuugaauggaaauguaacuaagaacagagccaagcuauucaauuacuuucuguacuguuaauuuuccucuuaacaucuuuacacugggaagaaaucaagcucccaacaguaaccaaucuacuuuauuaucaucaagucagaaagucucuugcucuaacgaaaggaaauucaaugaaguuaacaaugaacugacaucaucaaaacauccccaagcuuauggugggaggaaagcauauuuuuacuauguagccuaagcaacuaucuccagguuuaaugcuacacuguaagacugauauauaaaaacaguucaacuccauagugagacuacuugacaguccuacuugguaacagucaccacuaguucuccaagagaaccaguauuuucagacuacagacuuugcuccauagaaguaacacaggaagguguauguuagaguacauaaggcuaguccuuauaguuggcuaacccuuaacucuucaaguuaaaauucccgacuaagucccaucuuuuaaaucacuugaaguaauacaugaaaaggcuucauguuuaacaaucuuuaauucaaaugcaaaaguucaguacaagccauuuguagggcuugggauucuuuuaaaaaacaacagggagaaacgcaacaagaugaucuuuccauuuucaaaagcuuucaaggaaagaaucauagauagggccauaagggauccauuuaaccaaaauaacaaacucuuucucucacuaccaauaguuuucacccauccauaaucuuaauacauguuccugaauuaagacuugcaaguucaacuuuucuaacauaaccauuuaaaaaugcugagcaccagccugcuuccuauaaugccaaacaaauccuaauuacuucaguaugcauuucuuuuuaacaagggggggcaccauuuguagaaagcaguacuuagccuccuguuacauuucccagaaauggcuuaugccacucaaaggccuacacacgcucaugcuuuccaagugaaauaccuagccuaaugugcauagaagcaugaauagcaaaguugaagaucaguauuauaacuauuuuuucuauuuauuugaagcacaguaaaaaaaaaaugguacacuuuggaaauucgguggcacaagguacacugccauuaacuugagaaacauuauacaguuaaaaaaaaaaguaaaugaaaaaauuuuuucuccuguuuugaacacugcguuacauaauuuuaccugcccaaacaggccauuuacaaauaucaggucaauaaacugcuaacauccauaaaaagguagcuugcuuacuaaaaugccaagaauuuaagugguaucuaaacaagaaaagacaaaaccaaacuagaaugaaagccuaaauaucuaaaaucgggguuuuuuauuuggcccuucauacucuucucucccucuaccauauccugcuggaguuccaggccccauuccucuaggacccuguccacccacaggacccgcaccucccugcccaaagcgcucaguacgcuauugaaacaguaauuaacaguucauuaaauguaguugauguccauguguguuaaguaaauauuuuagaagguuccguagucaacguucgucgauacaaucaccaaugagucgauccacagguaccgggaacauagaaaggaaaaaaggguaauuugaaaauuaguuuacgguaauacaugccuugugguauguucccacuugagccauucucauacaccuguuucaaagaauagaucuucccuguagugcuaaaaaaauucaaaaauuagugcagaugugaaaacccauuccaaaaaugaguucuacaaaauucacaucagauuaauccacugacacgauuguccagguaugaacacaaagucaucuccaagccuacaaaguccagucagacaaaagcaacucgcucaaugaaggacaaaggccuacucaccagguaguggcaugugcugcauaagaaaccuugugcuuuucaagaucuuaagacacaucugcaaaguugcagaaaucuuaaaagguuggaaugaaguuaauaaaaugcuaccaagacuacaaaaaagaaaaagcacaaaaaaauaguuuuuuccacuuaaccggcacaguaacuucaucaaaaacuuauuuugccacagucucacagcauuccacacuucagagccaucacuacuaacuagagauacaugcacaguauguuucugcauuguuacaagcacaauauacagcccaccuacuucagaguccagcuuuuuuuuaguuuuggaaagugcacugucacuuuguuaugaauccauguuuuagguuaucucccaaaacagccuaucaucaagcuagggugacugcaguaaagcagugaaugacuucauuauccaucuaguuuuauguauuuugacuuuaaaacacaaaguaaaauaaaacccacauauccuaacagcagaacccuacacacaagcacuccacuuaaaauucuacucaaaauagcccaguuacuaauuacuaaucaaaauaaaaauaaagacugaacaagguuuuaacuguuccuacaauucaucuuuugaaaaacaaaaacacuacaaaacuacuugaacagacuuucaauuguauucuuuugaaagucuuaagguguauaguuucuacaaaaaaagcuaaaaagaaaaauuugaggcuucaguuauauuacacuaaggacccagaaacuguuaaauguauaaaccuaucuaugucuagacauggagccuaaacauaugucaaacuagucgccuaauauauacaucuugugccuucuagaaaauacuuuuaagaccaaaauguuaaguucaauuugaagaaccuaucaguauauccagccauuuauaaugcuaacuuuaauucucaagaagcaguaggcagguuuuaaauguagucucacacuaaaacccuuaauuccuauuuauaaaauaaauccuauugagcuacaacuguagcuccuuugagacaaaagccuaugggugaauuauuuagauucaauuuagcuacauuuuuucccaccaaaaugcaguuaaggaucuguaaaguccuaccccuacagcagccauucacaccaaaauucauuugacuauuuuaaagcaucugacaggcuaucuccauauagauaaagcaugauugcaucaagggguucagaacaaaugcacaccaucaguaugcuucaauuauuguugacuuuugcuacccuguagcaaaguagaaacaucaguuuggcuuuuuuuuuuuuuagaugcaccuacagagaaacccaacaggugggaaacgacgagucaaaacacuaggcaguuccucuuuucaugggcuagaaacagaaaccacaaauaaggucaaaggccuaccugucacucuaacauacuuaagacuacaagccucaagucugacuccuacuuauggaaaacaccacaaaagggcacugugccauuucucacuuggaugcaagaaaaccauauacaacuaucuagcaucuaaaauuuggauuugccaugcacuggagguucaaaagugcacagacaauaaaauggaagcuaccuauguacuuauugccaaagauuaacuccacauacuaacauaacagcauugacuucuugguggcaaccauaucuguuuggguuaccacacauaguucuacauugccaaaguaguccucaguauuauauauauuuacacaaugggggaacugaaaguccagucagcuacuuuaaaaagagagaaagagagaggaaaaauaaaauacucaaguugugaaauuaagaaucuccuuuguacuaugucccacaggauacauuaccaugucgcuucccaucauggaaccacucaugguugcugguggaacuccaggauuagcuucauaaccuaugccaccaccaccaccuagugguggaaauuucuggccuccugaaccauagggaucuaggaaacaaagacagugguuauccuaacagaaugcugcugcugggcggugcuagcuguaacuaaagucucugacuuaccucccauguucauuguuccaccaccacccauucucaugucucuuucucucuggggagggaaaaacacaaaaauaaacucuuaauuacauaugacagcuuaccauguacuccaguaaaaaaacugaacacaaaaaauuuauccagugggauacacuucuaauugcaacauuugggaagcagauguaguguuauguauauagagaauuccaggccagccaaggcuacuuugccucaaaaaccacaaaauaauucaagaacaaugcauguuuuauaugucauuguggcauguaguguccugaaaacugguuagacuaucaaaacaaacacgcuacauggcauuugguccagcaagaucugauaggaguuuauacacacaaaacaaaacagccacgccugagugaguguacacuuacaauggauaaaaacuuacuggauccauguagcccauccugcuguaacuuucuucucguuggcgucucauuuguucuuccaucucacguuggcgaaucaucaucucuuccucucgucuacgccguuccuccucuugccuacaaauauuuuucaggcauauaaaacaaagugucauccaugccuaaaacuuaagaagccaagugugaugauggcccuugccuuuuaaaacaguacuuaagagucauauaggaagccgggcgugguggcgcacgccuuuagucccagcacucgggaggcagaggcaagcaaaauuucugaguuugaagccagccuggucuacagagugaguuccaggacagccagggcuacacagagaaacccugucucaaaagaaaacaagagucauagggauaugguccaguuggaggguccaacuagugucaugcagcaacaccuguuucagaaaaaaacuacuugaaaaagagcuaaaaguuugucuuugaauagaaaauagguuaaacucuuaauguucauaaaagaauaaacucuagaucauaauucuagaauagcaaaacucuggcaaagacaauaagcuuuuccuucaaauacaaacuugcacuuaauacuucuuaucuacacaucagaauacauaaguaaaggcugaauucaacacuauaccucaacugcauuucuuuacguuucugcauuucuugacugugaaguuccuccaugcgccuuaauucuuccuggcgucucaucagaucuaaacauugagaauuuuagauuguuaaugaggcucugcacacuuuaaaauguaaacugaucuuuaccaaugaaaucugaggcuuuuucaccuuggcgcaaaagauuugcuugguguucaugguaagcaucuuccauuucacuuuccaauuugucuuuagcauccuucauguuuuuuucaacuuguucccuuugcuguuuuuccauuucauccaaggacuuccaucguugagaauauucauacucaaaugugccaugcugagcaaaacgaggugguguuucucucucccugacaauacauaauuuauacagaagcaauuuugagaaucaguaucuuuggaauuccuaagaaaacuagaaaccuuacaccuggcaugguuguuuauggcuuuaaucacagcuucaaaguaugaaaaucugaguuccagaacagaaacccugacucaaaaaaacuaaaugaaugaaaaccuuaaguacagccagggugugguggcccaugccuuuaaucccagcacuugggaggcagaggcagggggauuucugaguucgaaccaccccccccccaaaaaaacaagaaaaacuuguaccuguauaccuauugcccacuguuaagacauuuguagaacauguaacauaauaauauaaugcccuagguuugauccccagcaccaagaauugacacagaaaccacagacguaguccuuucccuaccauaucauguuuuuuuuaaggcccccaacuugcaauccuguuccauugaaacagguuaggaaacaccaugaggcuaaucaacaaugauacaaggagcuggagagauggcucagcaguuaagagcacagcuguucuuccaaaggaccaggucugugucccagacccacaaagcaacuuauaauaggaguggaggauauaacacugucuuugccacagugggaaucaggcacacacagguacauacacaugcaggcaagccauacacacauuaaaaacuaaauugacgggggcuggagagauggcacagugguuaagaacagugaccacccuuccagaggucaugaguucaaauuccagcaaucacaugguggcuuacaaccaucuauaauggaaucugaugcccucuucuggugugucugaagacagcuacagugcauucauauaaauaauaaauaacaaauaaaacuuaaaaaacuagcagggcgcaugguggcacacgccuucggauuucugaguuugaggccagccuggucuacagagugaguuccaggacagccagggcuauacagagaaacccugucucaaaacaaaaacaaaaacacacacacacacacaaaaaccacuuaaaaaaauaaauugacauugcuuaaagaaaggucugucaacauuucuuuaccuuucaccccaccccaacccuuugcuuaagccuaauaccaucuucuuuaaaaucccucacccauuuugagauaaggucucaccauguagcccuggaacuagccuccuagacaaauguauuaacucuagaaauaguaaguuaugauauauaaaacaaagcaaaaagccaggaaugcauggugauguauuucuaguccggucuggucuacagagaccaugugucuaaaacuaaaguuagagggaaaagccccccccccccagggcacacagugguggcacaugccuuuaauuccagcacuggggaggcagaggccaccuaccuggucuauaguucuagaauagccagaacuaggcaaagaaacccugugggggguggggguaggauagggauaaaugagcacaaagaaaaugacagaaguaggaaauguaggaaagagacaccaucuuccccccuuuucuauagcaaauucuuuauccaggcucauuuuccccaccaauaacaaguagcucucauuuaacuuuagcauuaucuggaucauaugugaauguacuuuuuauccaacagcuucaaguuaugccagauaugguggcaacauccuuauuauuuccagcauucugggaagcagacaaaggugggaacuuuaaaaagcaaguuccaggacaaccaggggguuacagagaauccuuguucucaaaaaagaaaaaauaaauaagaaaauagaugagacagagauguguauuaagcauauucaagaaacacuguaaaauguauucauaacacuggcaugauggcucacaccuauaauccuggcacuugugugacagaagucaggagacugucaagaguuuuagucagccuagacaacagaaaaauucuagaccaaccagccaaaacccagacuaaaaaguuucuaauguucuaaaaaguucuaagcaaaauuagaaaucacuaacuucucuuuuagagcaccaaaaagcuuagucuuacuuuugauacauuggauucuucugggccagcuuuucaggaagaccaucuucgucaucuaacuguucaagugguuccacaaugacugggcgaggaguccuaguaacagaaauuauuccucaucuuaacuuccaauuuuauuucgacuaucccucaaaauuauuaaaaaaaaaaaaaagaaagcaugaacuaaagacaacuuacguugucaguaggaaaacaccuucacugcaucuuucaaaugcuuuucuugcugcuggcuuggaagcaaacucaacaaugccuuucccuguagaucuuccgcgaucauccacaauuacaacagcccuuucaauaggaccaaacuggcuaaaggccucuuccaaaaguucguuggaaacauaaggagagagauuucgaacagacagggcugcagcguguguggcaaaucgaacccgaagcugucuaccucucaugggaguaucaucaagcucagcuuuggcgauuucagccaaggcucuagauuccugcaaauaucagaaauacuuuuaacaacuuccaaacuggcuagugcucaauuuuuuaauaacccuucccacuucuaccgcuuaagagcuuucuucaagccuccucccaacaccccgagggcuaaaggucugucuuugagguccugccccaaugcacacuauucugauuucuauugaugaaaaaaacuuaaaggcucguuaauucuucccauuuaaaagcaugccuaaaaacuuucacaaaagggaaaaaaauuacacucacaagcuuaaugaacccgaacccuuugccuuuguugauaaaaacuucuccggguucuccguauuuagcaaacagucuuuugaauucauccucugugauaucagcagguagauuccccacaaacaaccgacagcgcuguguguaaguuuuuucuccaggccuccgcaagagagacaaguuggcuuuaaaucccuaauaaagaaaucggacggaauucauacaccaaagcaggaaaagucuaguggucccaaaguaggccaucgugcauucguuaacgaucucccuuuuuucccaugagggcuagcagguugaaccauauuuggggauccaacaggaucacuaacucuaauccauaugaagcagaguauacaaaaugcuuugaaacacaucgccucuuuaucagcaaacgccaaucaauacaccucugacgucaacaaauagcucuaaaugcagacuaggaagacagcaccaaguugcccuguuuucucccaaacagaggccuccgacgugcacuaguugggucccaagggaccggaccgcuagccucuagcggauuaccgccaagacgugaggaugcccucccgcuggaagccaaucccuagcggccuccacagcccgccgcgcguccgccccgccugcgcaagcaugcgcaggagcgcuuccggcaggggacaaaauggaggcccucuaggcugcgggcgggggggaagaggaaaaaaaaacgccgaggguaggcaggcgccgccaucuuagggaaacggacggcuuugcucgagaacccgcucaccuccgagucggagaucuucuccuccgugcgcggucccgguccgccgggagggggccccugguggugcugcuggugguagggcgcaugaugcugccggcccccacggggcucgccgccaccucggugugguggcuucggguggccaccaggagcgcccaugcccgggccaccuccaggcuuaggcccaccgggcaucuugccgccuuuuggaccgccagggccuggccccggcuuaggccccggcccggcgcccccggcgggcgguggcggagggccgccggucuguggagggguggucgagacuccgcugcucggcgucgaugggggaggcgguccgggggcgguggaggggacggcgggcggcggagucgggguuggaccagggcccggaggggcgccgguggucgggggguuggcgggcggagccgagaccgccggcggaggcgcacugcucacccccggcgccgagccggggccuugggggacgacgggcuuggauuccugcggcggaggcgggggcuguugauggggcggcuggugcggcggcggcugcuggugcggcggcggcugcugcggcggaggcugcugcggcggcggcugcugcugcugcuggugaggagguggaggcgggagcggcggcuucgggccgccagggcccgggcccauggggccgcgguucugguugaggcccaugcccggcggcggagagcggaagucgugaaggccgccgcggccgccaccuccuccacgccggugaaagccuccaccgccgccaccgcgacuccggaaccgaucccgagacauagcuguagucaaggggcggucgaggcagaagcggagaagucgcucagggaacgugguugccaccuugcugagcacaaaauggcggacgacacaagcugcgcgccgccuuuguccucuucuuaaauaggacaguucggccuggcccgccuucccuagauugacagcucggacagccaauagcaaguacaguacuugaugaugaaaccuaaguuuuuccaauuggcucccuagugagaggcgggagguagggagggcugggauuuccauuugaccaauaaacggauaagaaagugucuauacgccuuugugauuuguuggaagaaauuugaaugggcaugcccugcaacuuucgcgugaaauuaaauauccagggcccuaucagcuccugauagcgcugaaaggcuauuuucuuuccucuuaugaguaguccgcuauucuuggcuaacaucuucgcuggguucaagguuauaaauugaacuugugcugucucuuauuccuacgccaaugaaguuagagucaauuucacagaguuuaaucucaacgguuuuacuuuuauugaaacccuaucaaaggcuagcagauuggcaaacacgugagcccaaaauuugggaggaggaggcacuaguaaucaggacugcaaguuuaucuuuacauuaucaauuacauugaguucaaaaccagcuugggcuacaugaaacguaauaaaauaaaaauaauaaaauaaaauagaagccccgguuguuuuggcauaugccuuuaauccuagcacucuggaagcagaaaggacuccaaguucaaagccagccugggcugcauaguaaauuccaggacagccaggacugcacaaagaaacccugccuccaa

SEQ ID NO: 2125 - RNA, 14061 nt, Mus musculus
aggggcggagccggcgggguuguuugcacggcaaaaugcgagugggcgcuucccgccgcugaguuggagacagaucagccauccucguggagccgcucaggcccgcuuuuccagagagaggcggcauuucucccguccugaggagggugacgcgacagguaggaagaccacagugucaggagagucgugcccccggccuccaggcuucuuagcguccuggccucugugcggugacugagcuuggugcguuuggucucuugcggcuucuuucuguaacugccuuccguuacaccuguggcucucuuuccauuaagcaguguauuuuucagacauaaacagauuggguguguuggcccuugccuuuaaucccaucacacgaguggcaggggguucucugaguucgaagccaggcuguucuauaaagucuguucuaggccaaucagugcuacuuaaugagaccuggauucaaaaaacaaaaacaucgggcuggagagagauagaagcaaauaguuuuaucuguagaguucugugagugaaauuugcagguuagcgcuggcgguggcugcccauuuuucuaauccuggcagggaggcagaggccauuggaucucuuagucuacagugcuaguuagaggaccuugaacauuguuacuuguuacauuguuacuuccaaauauuuccaaggaacuuuucuuuuuuuaagauuuauuauauguaaguacacuguagcuguccuuagauacuccauaagagggcaucagauuucguuauggaugguugugagccaccaugugguugcugggauuugaacucaggaccuuuggaagagcagucggcgcucuuaaccacugagccaucucgccagccccccaaguaacauauuuggacugugguucauugcugguaacucauaccaauaguaagagauuacuguacauuuguuuguuuguuuguuuguuuguuuguuuuggcucuggggaugguugaaacuggcuaucauguugcucacaguuaccuugaacuccugaucuuucuuccucugacuuccaagcucuccuauuuugggauuuuuuuuuuuuuuuuuuugaaauguaaggagacucugugaagaagaaaagggcaagugagauggcucagaggguaaagauucuugcccccaaauccgauaaccuguuugaucgccaggcccuacaugguaugaggagagaaugaacuaccauagguugucuugauauguguguuucuaccaccccgaaacaaauaaauaaaugcaacuuaaaauuccuauguugagaacccggaaaaauggcuuggugaguaaagguguuugcagucaagccugccagccugagauuaauggccaagacugacuucuccacacaugccaugcaucaugaguacagucccuuacaagcaugcacacuuccagugguaauuaauguaacuguuagaacuuuuacuuaauuauauguguaugcgucuaugugaauuucagcacaccacauguauucaagagcuggaggaggccagaagcugggguuaaaucucuugaaacuggaguuacaggugcugggaacugaacccagguccucuguaagagcaacaaagugcccuuaaccaaugaaucacccuucuaauccuaaauguaagucuuaaaauguuucuuuuuuaauugggaaauccuggguaaacgggaaggaagcacacacagcacaccauagccugguguucgcucacacaacacuccauagcuuggugcucagggcaguuauguggaggguccagcaggcucucccuuaaucugccauuuucuguugaguuggccaguugccuugaguauacuuuguacauuauguucaguucucuauuuuaaaagagcauugucaaauccaacaacccaaaauucaggagaaaagaaacuccacauuuucauacaaugguaauaguaugaaucauaacuuguuuuugaucagucaaauagccaaguuagucuguuuucuaaaauugccuuugaauauuaugcuauugugaguucgguuucauauccagaaguagccucuaaaaugaaagguguauacuuguuuuauguacauggaaauucuguuuucuuccuauuucucaagcuccacaguugacggucuucucuccucucaccugacuugaauaaaaugcuuccugcaguuccaggcacagcuguucgacucuccugugccaaauguaaaagaguuuuucaggagggacagacagcuuuucagaggaaagggucugcugagcuuuucugcucaagacuaugcauugauggguacccgucaccugcugugucuccagcuccucucaaaaggaugugcuuaaauugcucaagguauggaagucuaagcaaggccuuuuauuuugcugcauagaucuuuggucagagucuugguuaucauuuuauaugcuuuggucuccucugaagauggaaaccauagguaaaugaaagaacuugcuccugcuuucaguuccuuuaagaucacucagaaguaguuuugauuguugaaggguuuacacagauuacauggaaggguggagaagcauugagacccucuuuguuagaguuuuguuaaauaaaugugagacuugagagcaucgaauaggaugguuucuaugcucagaacguggauaacguguggguuuugguuugggguugguuuguuugguuuugguuuuuuugagucagggacugacucaagaugguuuucucauguuuacucccaguucccuuggagggauuuuuuguuuugaguuagggucucaaauguauguauguagcgaggaguucacuguggagagcagguuggaguugaacucagagguacuccugucucugccuuccaagugcugagacuacaggaguguucaccacacuggacuaccuacacuuacuaauaggcucgcagaccuuugcuucgauccuuauuuggcuggcacuuccaaugcugucuuuuguuucagguucuauuuucuugaucucuaccuaacuuuaucucuucuuuuguuuucuuuuuugguugguugguugguugguuuuuuguuuuuuguuuuuguuuuuuuuuuuuucgagacaggguuuuucuguguagcccuggcuguccugaacucacuuuguagaccaggcuggccucggacucagaaauccaccuaccucuaccucugccucucggguacuaggauuaaaggcgugcaccaccacgcccugcuucuuuuuuuuuuuuuuuuaaguuucuuuauauuauuuuauguaugaguguuuucucuacuuguauguguguguacuacauacauacgcugugccugcagagggccuuugaucccuugaaacugccauuacagguaguugugagccacugugugcguugcuggaaauuaaacacagguccucugcaagagcaguugugagcacugucccaccuuucuggcccucucucuuguuuucuccaauucuacaguacuauacuauguccagcuuuccuuuuggcuauaaguuauagggcauucucuucagucuacuuucucuuucugcagaguccuaaaccuggaagggacauuagagaucacccagugcagaccuuuucuuuugcuuuugaaaaaacugaggcccugaggaauuaaggcacuguguugcuaugguuagcauauacgcacuacauuucuucagccccagcuuugcuacaugucacaggcguugaaaagacucaugcaagaaagaauuugcuguguaaguuguucucauauggaguaacaaucagguaugaugagcagaaauagacaaccuuggcuuccucuggaauaaauauauauauauauauauauauugguucaaaggugauagucaucuuaaacugggagaggccaccauuuauucagaauaacaacauguuucuauuggcacuuuuuagaucuauuuuauuuugcauguauggguauuuugccugcauguuuauauguguaccacaugccugccuggggaaguuggaauaagacguucuauuuucuggagcuggaguuauggaugguuguaaaccuccauguggaugcuaggaacugggcccagguccucuggaagaguagcagugcuuugaaccucugagccaucucugcagccccuucauugagacuuuuaaaaaguuucacauucacaacaucuuuugguuuucucagacaggguuucucuguguaguucuggcuguccugggcuuugcucuacagaucaggcuggccucaaacucacagagauccuccugccucugccucuugagugcugggauuaaacacaugcaccacugccuggcugaagucccaaaauuuuaaguaauuuuuaaggcuucuuuuuuuagcaaugauuuaauaucuuuuuuuuuuccugguacugguauuuuauuucuuuguguacauuaggccaugaauuuguauggaaugggcuccaacagcucaggcucuuuuccauuaguccucacaaagugugcuucucuggguggcgcaggcuggcgcuucagcugcacccaggugcccuucucuuuggcuuccuuuuucuucuggucguucuccaucacccgcuucaggaagcugucccugcucuuugagugcuugaugugcucaauccgcacauugauccucuuggccagaauuuugcccuaaaccugcuuguugacagugaugcccacggcaugcugggugacauuguagacucuucgguuuugccgugguagcacuuauggggcauuccuauugaugucuacaauaucacccuucuuguagauucgcauguauguggccaaaggaacaaugccauguuuccuaaaaggccuagagaacauaauaccgggugccucuccucuuucccuuuguguucgucauuuuggcgaauuacuggaagauggcugcggcggccgcugauuuaauaucuuuaacuaauacuuacuguuuuuguuuaaugaagcaaaaugaaggauaacuuugaagaugacauuuaaaauauuagaaaggggagacuuuuuauugaaaacuauuaagauauguuuaagaaacauuuccacacuuuaguauuggaauuaaaaagaaauuccgaagacaaaucauuccgguccaaaauaggccgguccaguaauguuuaauuauuuucaggcagccgggagugauggcacaggccuuuaaucccagcacuugggaggcagaggcaggaggauuucugaguucgaggcuagccugauuuacagagugaguuccaggacagccagggcuauacagaaaaacccugucucgaaaaaccaaaaaaaaaaaagagagagagagagagagaauggaagcuguggaacuuuccauugggucuuaacaccuuuacuaauuuuuuuuuuuuuuuugguuuuucaagacaggguuucucuuauacacuuaucuaccacagaaaaauuuaaaaauccaugacagaguuagaacuagaacgcauuuuaaaaaucagccaccagucucaucagaaaagcugucaaguguuaagaauugaucaagcuagagauggcagauacagguuuccuaaaauuucucauuuuucuuuaaugauuuauuuuuauguacauugguguuuugccugcaucuucgucugugcgaaggcgugugagggugucagguuguggcgguugaacccaggcccucuggaagagcagucagugcucucaacagcugagccuucucuccagccccuucucacucuuccuuaaaaguuuagcaguaaauacugugaguuguuucccuugaaauggcagccuuuauuuuccugaaaauagccccuucuaaacaauaguuuagcauauagucucauagaaauauaauucauaaaaaagauggcuaagguauaacucagauuuucuguguagucugucuagagacagugguccaccacugauaaacauuucagugcuuuaugcccuguccccuuuaaucccugugcugguuaguuuuucucagcuugacacgaaagguucaucagaaggaaagaaccuugauugagaaaaugccuccaucauuguccuguagacaaggacguuuucuugauccaugauugaugugggagggcccgccucacugugagugguaccgcccuuggucuguguuaccaaacuauggucagccagccaggaagcagauuccucuguggucucaguuccugcccuuccuucagugguagauuaugaccugggaguugugagagaacauaaacccuuuccuggucacgguuaguggacccgacccacagcaguagaagcaaacuaggacagucacgcaaauauucaaguuuauuuauucuuuuaccugcuuuuagucuguguauuaagggcaugcauugcccuuggaguccagaagagggcacuggauccccuggaacaagaauuacagacaguugugagcugccaugugggugcuagaaauugucaagguucaaauuaaaauaacuugaaaauguuguuuuauugacagcauccuuaauuucuggaacuaaauuguuuuguuuugcaguaaaaacauggcagaaggaucccaagagcucacugcccaaccagcauagcccauacagugauucuugcucccaauucagugagaaacugggucaggacaauacagagagcaagagggaaaaaugcccaacgccuugcucugggccccucauguguacacacagaaacucauaaguuacuuuauauauuuauuguucuauuaacaagcauuuauuguuuguuuuuagagacauuuuaagucuaaaggauaugaagaguguccaguuggaggauaguaguugugacaaaaacuuuuguagccaaucuugucuuacaucauaugaagaaaaaagaaaaccagguguuaccauauauacugauagcaguuugcccaagugcagcaugugucagaagacaucuacuguaaguuuccauuuuuuuuuaacauuuagaagaauucuugucauucugcuuaaaugucauuuguugcuauuguucuagucuuggcagaaauuccuaccuuucacauuuucguucugcugacaaguuuccuugugaacuggugaaagcugugauuuauaaucugucccacauacuucagggggaagaguguccuuacuugaguagugcaaagauuacuaauucauagaagcaggugagcaaaaagagcugcugucccgccagcuggucggugagcgugcuugguguuauuggggaaaucuuuggcugauggcuaaugaacaugaagaaggccuuuggguguccccaagaacagagaagcuagccuugcuuuguggacuaaaugagacaagcacaguuacugguuugaucccuuuuuaugaauuagaacgauuauuuagcuuuaucacuacaugaucuuuaguaauguggugaugcauaaucuuaguauuugagagacacaggcaagcagaucucugagcuugaggccagucuggucugcagaaugaguuccaggacagccagaacuacagagaaaccauaucuuuuuauuauuauuauuauuauuauuagauauuuucuucauuuacauuucaaaugcuaucccgaaaguccccuauacucccccccccaagaaaccauaucuugaaaaaacaauaacauauaacucauacugaauacuucagaauaucaagaaaucaaaaucugcagcaacuccucugguauaaccauggucgagugugcccugauccguuuccugacugccuggugcugucagugucuugagcugccugcagaguaugccugugagagcuggacggagagcucagugggagagcuauugcuuagcauagguguccagcccaagcacaugcaaaagcaaggauccuucugucuggaagggugaauggcaggaugaggagccaggugugauggccaugccucuaauugucaaguagaucuccgugaacucauccuggucuguguaacccaaguuccagacccgccagaauuccuugucucaaaaaaagccauauuaauaaaagacuaaagugaaaauuauccugugcuuucccccugccccugaaauuucaagacaggguuucucuguguagccuuggcuagaccuggcucuguagaccuggcuagccugaaauucaagaaaucugccugccucugccucccuagggcuuggauuaaaaguauguaccgccaugccuucuuuguucuuucuuuauuuuuaaagauuauuuaggagcuagaaagguggcucagcacuuaagauccagaggacccaguuaaauucccuuacccaugugacgcucauaauuaccuauaacccguaguccagggaucuggugcccugaucuagacacugcaggagcuacaugcacauggugcauacauucacucaggcaaaacacucauacucguaagaaaauugacaaccuaaguacaguccucaggagccacaugguggaagggaagggugagcugacucugaaguugucuucugaccuucacuugcauggaaugaaauccacacacacauacaaaugaggaguuauuuguucccauuuaugugcaugggguguguuuacacaucuguuuaggugcccauggauggaaaagaggaugucauauucuugggacaggaaucagggaacuguauguaacucagcacgggugcucuuaacuccugagccaucuucccagcccauuuccuggcuguccuaucaacauucucaucuccacagaaaagaaacgcuguguaguuuuguucguacuguguaccaaaaagcgguucugcuccaccguugcuuucagugauguagaaagauucgaugguaaaacuccucagucuacagccucucuuugucccgugcuuacugaauuugcugccuuccgccuccuguuuguaugcugcuuucucacaauaggauuguuauuguuuucugggugggggguuaauuuuuuaagacaaggucucuguagccuuagcugucuuggagcucacuauguuaggcugacuucugaacucacagaacucuaccugccucugccuccugagcuggaauuaaaggcgugauccaccacacccagcugugcuugagauucuuuaccgggauguuagccuaggacaacaggucucaaccugugagucuccaccccuuuggaggucgccuaucagauauuuacauuaugauugauaacaauagcaaaauuccaguuaugaaguagcaaugaaauaauuuuacgguugggagcuaccauaacaugagaaacuguauugagucacagcauuaggaagguugagaaccucuggccuggagggacagguauggccccaggaucguaugguagauacuaaguacccuuuucuuucucguuagcccuggugcaagggcucauguccaaggaaaaaacuguaauucaauuuguguucuuacucaguaggcuuucguugccugggauaauaaacuucuuugguggccucucuuuuccuugaauauacauuauugcuauuacuguagcuauuaaaugguagaauaguuuucagauaagcuuaucaaauugccucauuugguuuuuguagccuagacucuucuaguuuuuuaaggaaguguaaagaauuguuauuguuuauacuauuucagcuaaaagcaguuacaguagcaugcuuaguguuuuuaguauugugugcguuguaucagaaauacgaguauuacuuuuaaucuuuaaacagaaaccgcccagaauacuuagaucuuccccgugcaaaucacugcagcugucagaugagaugauugcgauuacuaacgacuuggggaacguagagguuuacugcucugcuuguucuucuucauacaacagugcugugauggagucuccuucagguaaugccuaacggccucaggcuuacuguguacugcaagagagcuacacuucaugaaaguaacuuaauuuucccagugagugcuggagagauaucuuagcaauuaagaaugcuugcuguuuaaucaugaggacccaaguucagauccuagcacccauguaaaaaacauucaccucacaaaugaaauaaucuuuauucaaaaagaaaaaaaaauccaaacagacugguaauguugucaguugucagcccagacugucugaggcccugggcucgaugcccaccagguguuauggugggcaagcauucucccacugaguucuauaacccucagcacaaaaccacuuacuauuagacaguguuuucugcuugguuauaacaaacuaauuuuguuuauuuuugucaguuaauguauccauggugcacaguucuucaaaagagaaucucuguccaaagaaauauccaguuauaagcaauauaaugucguuaguaaauaaucauguugaccuggucgugaacacugaucucuuacaagguaaacagacguuugacauaaacaguguuuugucauauuguugaaucugucugucuguuugcugauaugaaauaagcuucaugagcuuauggugcuauuaaaguguaaaaucucaaauaugugcuuucauuugucucgacagguacacuuucuucucuaccgacagaugucaucaugagcguaaguuuuauccugauuuuuaaaauuaauuaauuuauuuauaugcguacaccauagcugacaucagacacccuagaagagggcauuagaucccauuacagaugguugugagccaccaugugguugcugggaauugaacucaggaccucuggaagagcagucagugcucuuaaccacugagccaucucucugauugaccuuuuguggguuuuuguuguuguuguuguuuguuuguuuguuuguuuguuggguuuuuguuuuguuuuguuuuguuuucgagacgggguuucucuguguagcccuggcuguccuggaacucacuuuguagaccaggcuggccuugaacucacagaaauccaccugccucugccucuagagugcuaggacuaaaggugcaugccaccacgcccagcuuccuuuugagugaauaguucuaaucaucugaguaauaaaaauauuucucugcuguuauauaccuagagcuccuuuaaacacugaaugcugaauuuagauggcaaauaauuauguuagugcugcuuauagagaauccuauacuauaacuuguucauuuuacuguguuauugcaauggauauguuuugauauuuuuauuauuugaaaacugcuuaaacaaguauuauuuuaccauuuguccuaagaacucagccagugaguccagcagugguguugguaauagugcggaccagccaggccuccucccaccuugcucggugcucugugaggacacagcugcucccggugagggaguagagaacaacagugagaaauccauggaaggaaaugauaggcugugucucucaaaguccacauuaacagaacagaacauuaagacagagccuccgggagagcccuggagcccagcucuccagcaucugcaucccagcccugcagacaauaucgcauucugcuauucuugcuacuuguucuuccagaaaaaauuuagcugucggagagaagcuuuugcaacccaaggaacugcugacugggagaaaaugcugggaaauuucagaaagcaugaagaaagugacgugcacuuaaagucacugcaauuuuggaggcaauaccaguuucucgaugcuauuccgugugacaauucaucuguuuauucaaaacagauugaaggaaauaaaaaguaccuaaggcucaucauugagaacauuuuauuucuuggaaaacagugcuugcuguuaaaaggaaaugaccagucuguuucacccaugaauaaaggcaguuuuuuggaauugcuagaacuuagagcaagagauagaggagagguauuucagcucaugaguucccacguggacuucuauagcagcacgcuuguccaggaggagauuauugaaaugauaaaggaugaaauguugcaagacaucgugagugagaucaacgccuccucagccuuuucaauaaucugcgaggagauagcugguagugccgcugagagacagcuuuccgugugugugagguacccacaaaagacgccaagugcugucuugguuaaggaaagguuccugggguuugugacugccgaggaggugacugggguccacgugcaugggcggaucaaagcuuaccugcagcagguuggaguugauuuuaauaaaauauguggccaagccuaugauagugccacaaauuuuacgguaaaauugaaugaaguuguagcagaauucaagaaggaagagccaagagcucucuaugugcauugucacgcccauuuuuuggaguuagcggugauuagcuucuguaaggaggugaaggagcuccgcgaggcacuacacacucucugcucuuuguucaacacaguucaugugucugaagaaauguuggcaaguuugcaaaccauguguaagcuaagucuaaauaaaacuuguaagaaacacacgucacagucguguuggccagcccacgaccauuugcugcuggccgugacggacugccuuccggaggucguugaggugcuggcgucagugucacgccggugcgcaggcacagcuguggcugccgagcuggaggaccuguuggccaugguuaccaaguuugaauuuauauuuuguuugaaauuucuuuaucgaguacucaguaucacagggauucuuucuagagaguuucaaagugaaacuguugacaucuuuucuuuguuuucaaaaauagaagcaauuuuggaauguuuaucuucugaaaggaaugauacauacuuuaaaaauaucugggauggagcagaugaaauauguaaaaagauaaccaguaaggguuuugauguugagaaacccucuuuucaaaaaagaagaaaaguucaaagaacaguagauccuggcaacucagagcauauguuuuuuccuacuucagcagaugaacaauauaaauuuaauauuuacuaccaaggucuggacacgguauuaaaacauuuaaaguuauauuuuucagaguuugacuauuguaaaaugaaacaaauuucagagcuguuacuuaaguggaaugagccauuaaaugaagcaacagccaagcacauccaggaauucuauaagcuugaugcagacaucauucccgagcuccgauuuuaccggcaguaugcagguuucaacuucaucgcagaggauggguccuuaagcuucauugaccuaggcucuuuguuuauucagcaugcucuccacaauaauauuccuuguaucacgaagcuguugcauauugcuuuaucuuggccaauuacuucagcaaauaaugagaagucauuuuccacgcugucucaucuuaaaacauacuuacuucguaccaugggacaagagaaacuuaguagccuggcucugauagcuguugagcaggaacugguaaauaaacugauggaaccugaaagacuggggggaauugucgaaaaguucauuagucaaaugaaagauacgugagacaaacuugcaacuuugagcuuaauuaaaagaauucugugguuuuauuagaauccuaaugaaguuuuguuuguuggagguucuuugagacagauagggaucuugcucuguagccuaggcuagucuugaauuuguaagcucuugagacugauugacccucuuaccugacucuucuccuuuaaaguauuccaguugacguauugugucguaggcacaucuacauuuaauacauuuacugagcaacuacuauaugccagauaguaugauaugugcuggagguauagcagagaauuaggagccuagagucaauugaacauaguuuuuucuaauauagaaaucuaguaagccuggcacagcggcacacuuuccuccaggacugugacucauugguaacauacuuaacgucccuagaaugcauaaggcccagauucaauucccagugccaaggaaguccuguaauaccaucauagcugcuagugaccgugugcauuguuaaauaaaauuuuaacuaaaaaccauugcugggaagagaauaguucuacagaagca

SEQ ID NO: 2126 - RNA, 4023 nt, Mus musculus
gaauuacaguuuuuuccuuggacaugagcccuugcaccagggcuaacgagaaagaaaaggguacuuaguaucuaccauacgauccuggggccauaccugucccuccaggccagagguucucaaccuuccuaaugcugugacucaauacaguuucucauguuaugguagcucccaaccguaaaauuauuucauugcuacuucauaacuggaauuuugcuauuguuaucaaucauaauguaaauaucugauaggcgaccuccaaagggguggagacucacagguugagaccuguuguccuaggcuaacaucccgguaaagaaucucaagcacagcugggugugguggaucacgccuuuaauuccagcucaggaggcagaggcagguagaguucugugaguucagaagucagccuaacauagugagcuccaagacagcuaaggcuacagagaccuugucuuaaaaaauuaaccccccacccagaaaacaauaacaauccuauugugagaaagcagcauacaaacaggaggcggaaggcagcaaauucaguaagcacgggacaaagagaggcuguagacugaggaguuuuaccaucgaaucuuucuacaucacugaaagcaacgguggagcagaaccgcuuuuugguacacaguacgaacaaaacuacacagcguuucuuuucuguggagaugagaauguugauaggacagccaggaaaugggcugggaagauggcucaggaguuaagagcacccgugcugaguuacauacaguucccugauuccugucccaagaauaugacauccucuuuuccauccaugggcaccuaaacagauguguaaacacaccccaugcacauaaaugggaacaaauaacuccucauuuguauguguguguggauuucauuccaugcaagugaaggucagaagacaacuucagagucagcucacccuucccuuccaccauguggcuccugaggacuguacuuagguugucaauuuucuuacgaguaugaguguuuugccugagugaauguaugcaccaugugcauguagcuccugcagugucuagaucagggcaccagaucccuggacuacggguuauagguaauuaugagcgucacauggguaagggaauuuaacuggguccucuggaucuuaagugcugagccaccuuucuagcuccuaaauaaucuuuaaaaauaaagaaagaacaaagaaggcauggcgguacauacuuuuaauccaagcccuagggaggcagaggcaggcagauuucuugaauuucaggcuagccaggucuacagagccaggucuagccaaggcuacacagagaaacccugucuugaaauuucaggggcagggggaaagcacaggauaauuuucacuuuagucuuuuauuaauauggcuuuuuuugagacaaggaauucuggcgggucuggaacuuggguuacacagaccaggaugaguucacggagaucuacuugacaauuagaggcauggccaucacaccuggcuccucauccugccauucacccuuccagacagaaggauccuugcuuuugcaugugcuugggcuggacaccuaugcuaagcaauagcucucccacugagcucuccguccagcucucacaggcauacucugcaggcagcucaagacacugacagcaccaggcagucaggaaacggaucagggcacacucgaccaugguuauaccagaggaguugcugcagauuuugauuucuugauauucugaaguauucaguaugaguuauauguuauuguuuuuucaagauaugguuucuugggggggggaguauaggggacuuucgggauagcauuugaaauguaaaugaagaaaauaucuaauaauaauaauaauaauaauaaaaagauaugguuucucuguaguucuggcuguccuggaacucauucugcagaccagacuggccucaagcucagagaucugcuugccugugucucucaaauacuaagauuaugcaucaccacauuacuaaagaucauguagugauaaagcuaaauaaucguucuaauucauaaaaagggaucaaaccaguaacugugcuugucucauuuaguccacaaagcaaggcuagcuucucuguucuuggggacacccaaaggccuucuucauguucauuagccaucagccaaagauuuccccaauaacaccaagcacgcucaccgaccagcuggcgggacagcagcucuuuuugcucaccugcuucuaugaauuaguaaucuuugcacuacucaaguaaggacacucuucccccugaaguaugugggacagauuauaaaucacagcuuucaccaguucacaaggaaacuugucagcagaacgaaaaugugaaagguaggaauuucugccaagacuagaacaauagcaacaaaugacauuuaagcagaaugacaagaauucuucuaaauguuaaaaaaaaauggaaacuuacaguagaugucuucugacacaugcugcacuugggcaaacugcuaucaguauauaugguaacaccugguuuucuuuuuucuucauaugauguaagacaagauuggcuacaaaaguuuuugucacaacuacuauccuccaacuggacacucuucauauccuuuagacuuaaaaugucucuaaaaacaaacaauaaaugcuuguuaauagaacaauaaauauauaaaguaacuuaugaguuucuguguguacacaugaggggcccagagcaaggcguugggcauuuuucccucuugcucucuguauuguccugacccaguuucucacugaauugggagcaagaaucacuguaugggcuaugcugguugggcagugagcucuugggauccuucugccauguuuuuacugcaaaacaaaacaauuuaguuccagaaauuaaggaugcugucaauaaaacaacauuuucaaguuauuuuaauuugaaccuugacaauuucuagcacccacauggcagcucacaacugucuguaauucuuguuccaggggauccagugcccucuucuggacuccaagggcaaugcaugcccuuaauacacagacuaaaagcagguaaaagaauaaauaaacuugaauauuugcgugacuguccuaguuugcuucuacugcugugggucggguccacuaaccgugaccaggaaaggguuuauguucucucacaacucccaggucauaaucuaccacugaaggaagggcaggaacugagaccacagaggaaucugcuuccuggcuggcugaccauaguuugguaacacagaccaagggcgguaccacucacagugaggcgggcccucccacaucaaucauggaucaagaaaacguccuugucuacaggacaaugauggaggcauuuucucaaucaagguucuuuccuucugaugaaccuuucgugucaagcugagaaaaacuaaccagcacagggauuaaaggggacagggcauaaagcacugaaauguuuaucagugguggaccacugucucuagacagacuacacagaaaaucugaguuauaccuuagccaucuuuuuuaugaauuauauuucuaugagacuauaugcuaaacuauuguuuagaaggggcuauuuucaggaaaauaaaggcugccauuucaagggaaacaacucacaguauuuacugcuaaacuuuuaaggaagagugagaaggggcuggagagaaggcucagcuguugagagcacugacugcucuuccagagggccuggguucaaccgccacaaccugacacccucacacgccuucgcacagacgaagaugcaggcaaaacaccaauguacauaaaaauaaaucauuaaagaaaaaugagaaauuuuaggaaaccuguaucugccaucucuagcuugaucaauucuuaacacuugacagcuuuucugaugagacugguggcugauuuuuaaaaugcguucuaguucuaacucugucauggauuuuuaaauuuuucugugguagauaaguguauaagagaaacccugucuugaaaaacca

SEQ ID NO: 2127 - RNA, 332 nt, Mus musculus
uuuugccucuuuuuuuuuuuuuaauauaaaugcuuuauuuaacaguugcagaucauuccaugggcuaaguaguggauauccagaacccagcugcaagaucaacgcaaccuucgagcuucucuuucugacuccaauagggugagcaugucacccucucgaacagguccuuugacauuucggaugauagagcggcuggugucauccauaaauuccacucgcaccugcaugcacugucccugcgaaccgguccugcccagcacuuugguuacccuagccagcuugaugggcugcacgugacucguguccaugauggcggcgaucuggcagagcgu

SEQ ID NO: 2128 - RNA, 332 nt, Mus musculus
acgcucugccagaucgccgccaucauggacacgagucacgugcagcccaucaagcuggcuaggguaaccaaagugcugggcaggaccgguucgcagggacagugcaugcaggugcgaguggaauuuauggaugacaccagccgcucuaucauccgaaaugucaaaggaccuguucgagagggugacaugcucacccuauuggagucagaaagagaagcucgaagguugcguugaucuugcagcuggguucuggauauccacuacuuagcccauggaaugaucugcaacuguuaaauaaagcauuuauauuaaaaaaaaaaaaagaggcaaaa

SEQ ID NO: 2129 - RNA, 68704 nt, Mus musculus
uuccagccagggacugcugcagucagcucucagcgcuucugcagcuuguguccuggcucugcagcuucgcgcugugcuucggacaguccccuuuccccccucuaccccacccccgccauggcacagccccuggcucggggcccagaggugggcgggcacagugggcacggguggggcccccagcuaagacggcagguauagcgggguuaucccugcacacuggggauugccuccgcuggcggacugugggugagggacgccugucaaagacucggaggccaggcacagcgccccgcccuggcagggguggggcagaagggacuagugcggagaagggggacuccuagagcccaggccaagagcuggggucggguuuacagacccgggaaacuaaggacaggagccuaagaggacgugccugcgagggggaggcugugugugacauucagggugugacugccucggugaggcagccgugugucucccccagcugcccgcgcucugggcuugggucccggugcccaggucugcugugcgcggucgugacaccgaaugugcugguuccugggucuucgguacacaccgacccgggggaccacauucgcacccccgagcugggccuccccggcgcugucgcucagagacgcgggcgcuccuccgggaccgcggcggcugcccgccggcugcgaccucgguccucgcggggccgcugcgggggcggggagcgcgggcccccucccugucgcgggcuccuggcucggccgcccugcgcgggggcgggggcgggggcggagcgcgcgggcgggauccccccgccuccccguccugguccccgggaaauccagccuccguggcuuggccgccuccggcucccgcgcccgcggccgcucagcacucgcucggggcuccgcagcuggcgcggccccuccgccgggggcuccgcagugucggguccgggagcccgcacucgcucccgcagccgcagcgcccccggcccgggccgccggcaccauguaaccccggcuggagcccgaccgggccagguaagcaaccgggagggguggggaucgggccgcgcuugccgcgcccucugcagcgccccccaggcucagccccgcugcagccccggcgccgcccacgcccggggcuccagcggccuggacuccggccccgagaugggggggaggggcugggccucugcggccgcccccggccucacccugggccuggaggccggcgugacugaccccggggacggguuggggaccacgcgcuccgcagacgcgcugucccggcuggggccgcgggaggccagccagcgcccgcccagcccuugcccggcuggaauggaagcuugggucugggagggaguagccugcuggcuguggggggaagucgugguguuggggagauccggaaagaaguuuccucugcaggugugugagcgugcaugugaugagggugucaccgugugggucugugggugagugaguguaaugcagugagcguucaggguguuaaccguccaugagucugucgacauaugugugguugagugugugcuggcacuguguggcuguguauguaggugucugaguguguguguaugaauggacgugcgugugcaugugcaugugcgacuaucucugugaaugggucuggguauguguacugugugacugugugggaauacauccaagcaggguucacccacaccuggguuuugccccgcccccauucuuggugggacuuagcacgggaagauccuacuuuucccgaggucagaccgcccccucccuccagagucuccuuauccuggacacagacaagagcacucugcaccuucaucuacuuccuggggcacccucugcgaagucacugguaucuuucccucaugcugagucccugcugguggugagccuaaggcuguauaccuguguguggggauacuuuuuugggggagggugaagaguacuaggagcuuguguuauuucaaugaugcuuggccaaaggcccuuuagaaugaggaggccaggaggaagaucuaccuuguuagucauuggagcagguggcuuuuucccagaguuccaagucccaaaucuccaaguucugggucguugguuuagcucacgguucaggugggucuguacuuaguuccuugaaguaguaauagaagaauguaucuguaucagucuaggacuuuugaaaaauuguuccucucauuucuucuuguuucucuaacugccuuggaagcaagcugagaugcugucagguuaagccauaugaaauugacaguauugagcaguuguuuguuguuguuguuguuguguuuuuuaaccugcaaaaacagccauuccacacagcucaaucuauuaugaugccaauuugcagaagaggauguugaggcuugggaaaugcauugcaucucucacaaucacacauugccagacagugguagagaaacauucucacccaggucuuccauugacccaagaaacccagcuaggccacaauuagagaguaggacuuucuaguguguuuucccugacacuggaucacugcccuccacuucuguccacuauccccugagugcguguguggggucuacuucuguacccagcugucagugccuaaaagagagagaugagggagaagagaggagggaggggagggagagcuucgugaguuggcagugaaucagggucuaaaaagagagcugggagggcuaggguggcagguguuucuaaaaggaacgugaauacaggaugaacagccucaaaugcagcccccgcacuccccccacugccccacugaucuggcaggcagugcccacugcauuuugugccagggggcucacauccaaggaaugagcuugcaggaagcuauagaaugacaggcagaggaagaaccuuuacagucgacuugauccaaccucuuaauuacaaauuggggaaucugaaagagaggagaccuacucaaggucacccgauggaccuguggauuccuagacuaguguccccacagguaauuuccuaaccuucacauuccauccccaaacuccccaacccccucagagccgaaugugcaggcggguaggggaaaugaagacucaauaugucuaaggcugucaaucugucagccugggacucugcucugaauaaaggagguuacagguauuucuggggauggggauaccuggcagacccaccacagaggaaggucauggccuuggcuuaguucuagcuggcuaccagcgcugcucuaggcccaacuucagacuuccuucuuucuugaugccugcuuuuagcagcugccuggcguuuagcaucugcaucucuugcagcugauguuggugcuuuucuccccccucccccacaguuucccaugcauuuuugccucucacugggcuggcaauuuucccccccuuauugggcuucugcuggguagaaaaacuucugagucuugucugauugaaaaggguguguagcugccugaacccuuucuggcccagucuuccaggaguuuagagcaaaugguaaacauaauuggccucauuuuuacuggagaggaaacugcuguugaaugaggggcuuucuguuugguuucaggugacugaaauugaggugugugugugugugugugugugugugucugugugugugucugugugugugugugugugucugugugugugugugugucugugugugugugugugucugugugugucugugugugucuguguguguguguguguugggagagaguauaaucaugaagcuuauugagacaagcuauagagacuuucccagugucuuccuacccccauggucaagaagccuucucagacuuugauuuuacucccacuugggggagucaaagcuucguuucucagugggggguuggaagagcagcuguguacccuccacuccgcaagcaucaugucucaauucccucuuuaucuaccccccuucagucugaaggcugcuggcucagcgggccuccugccgucuggggagucuggguuugagcuggggugaggcgguggcaccaucguuaugguaacaagcugccagcucaucguugcuaauaacuuguugggccccugggcucagugcagcauccuuucccauuagcccuucuucccauguuacagacagaaaaagugaggcuuaggaaggaggggccugggaagaagagagucugagaaggcuggauggccuuuccccuggguuucuuugcuagggagccaugggcaaagagguaagguggcuugggagcugaguuacaaauguggucgcacagguuugauuucuugggugguuaaugugugacuagcuucaugcuuucauaaacuugugcaugcuagcugacauguucaugugcacauauaccgcagcccacaggcaaacacacuccaggcauccgagcacacuuguguaugaauacugccucucccaucugcacauaaggcacccaagaaaucuggguuuguggggguguccagguauguggguggggaucugaucuuuuucugaugcagcuucaaaguaucuuguuaacaaagggacagaaugggcccaggguucuucuuccuuccaguccagagcucaguaugggagugggcuggggguggugauacagggaauccaagcucucagcuuuccaagucuucugccuccgugcccuuugagcucagguagccccugccccccucccccugcucucuguucuuucucauccucuccucuuccuguguguaaauauuaaaaagcugagccugcagggcugauguagacauggggagagaaugaaauuaaaaaggauucccucgcccccaucccaacacccccgcccugcagucccccgcuccuguuucuuccccucucuuuuccccucacucaguaguuccacaugccucuccuccccccaguccagaugggagcuggcuccuucagaaaggggguucaggacaggguguggggagcuaccucuuccuuccuccucccagcacaucugccuacagggcugagagcccccacgugaguauuuauuuuauuuugggguggugguuaagaaggagaaugcuuuuuugaaccagcugugagugguauugagaggcucaagacugaaaggaggugggugggguccucucucuagcuucucccggucuggauuucuucucucuuuugagaccuucagggaagggagggaugugaggugugacaggggacuggagcaaaggugggaguuuuauggucagagcgguuuccuuggguaaagcuucuuucuugcugucugcgcuuuggaacccccccgcccccccugcaggguggcugugggaacuguccccagugcugaaugagccucagcagagaagcgcuccuuuggagcugucccggguacugaaaggguuuugagccguugacggaaaggugccugggcaguaguacugaggguucacuagaaaaauucucccaagugacccacuuuccaagggcagagucccuggauagaauuauaaauucugaggucauucuuaugaauucaggccucacaguuguuaguggcauuugguaaaaggacuuucuuuucccuguuugaguucgccuuccucuugccaaaaccuguuaguguggggcuaggaaggggcaaugcaaucguggccgugagcuuuauucuucugagaucauacuaguacaacaaacuuauggacccugggugagaacauaaguuucccuuugggucccagaaguucagacucaagacauuccgaguuugagucugacaggguagacuauaguggauggugcucaagaaaauugauuggccacuuggugccaaccugcuaaaccauaacuuuagauuugagaagaggaacccuaaaauauucugaaagucugcugugcucugcccauccccagcccuggcucaaugcaucauuugggagagacuuuuguuggggaggaagauuucucagcaaaggauucaaggagugggugggguuguucagugccauggagaagagaaggaggaggcuacuggagacagggcagcagggaaaaggaagaucugggggaguaaaaaaaauccaaauggaaggaggaguucuggauuccgacgcucaguuucucuggauagcuuuuccccuacugaccugcggucagggucaugugaaauaucuggguucuucugcuuugcuuuuguaaccacggagggaauagagcaaggaguuauauuucuccaggucccguuccuugucaucccagggggaugagagccaaaugucaggacaugcagaugagacagugugugggggaaacaacaggcaggagggguugauggcagcucaccucccauccccaagagcacaaucaaauauucaaaugggauccuucugagugggaggggcagggaacgguuuccagaggacucugggcagccauuggguguggcaggaaauucaagaugugagagagauuuccagaggucucaaacugaaccagucuccuucccuccccucauaggacuccggguuaaugaggggcccuucacccaucauguuuuugauguaacacaagaugauucccucuucuugagcugcuugagaggagcugauuuucguaugcuugugggugcugggagguggugggugugggugugggugccuguuuggggaggggagguguuugugcuccacucggcucccuugguuacauaacagcuuugauaaggcucuggagcugcugcuacugccugaagcagucaccccuccacccccucauggaaggcuugguguccacccccuucucccuggccccuuagagaguccugcuauucaugauccaguguucuagcaguugcuucucuuccaggagguguccgcaguuugccucucugucccuguguggcuccuguuuagaaacacuugcuuuuaugauuuucagcccgggucauccccuuuacguuucugagaguccuggucugccuucucccuugucagggcucucagacugauugucuugggaagcuggacaacauggaacuacuccgaagggaagaagaggggugucccaggaggcuucaggauacaaaguaguucauuuacuguucuuucucugccucagucucuguuucagaguuugggaguggagaaaccuacccagaagugucaggagaacuaucuuucccuuucuccuauaacuaagggaugcauguguggugguaggcugccucuuggacaguaugacuuauaccaacuuuauuguuaucuucacccaagaugucugagcagauacuguuuuugccgccaggcaugggacaaggggauuucaaaacauggcccggaguugggugugccuuguaacuaacaggaacagcuuugcaaauggagaggugggagccuugcaaguugcaaauaaauaaauaaauauaggaaauacaaggauggguuucagucuuuguggacaggguagagaagccugggggaugggggaagcuuccuguauuaugagugggucugugagacuuguguguguguuguguagcucugacuguccuggaacuuacucuguagacaggcuggccucgaacucagaaauccaccugccucugucucccaagugcugggauuaaaggcaugaaccaccaugccuggcuauguaugacuuuguauagauccauuuauacguuugacugugaaggcagcagaugggagugugaugugcucacccagcaauauagauguguggucauguguacaugaacaugaaugugagucuauguauguacuuauuuauaaauaaauacauacauauuuacugaaugauuuaggagcacaugaauauauguacauaagcuugauucauagagagagauagauauugaaguugacucaacauuggcucugucugaaaguuauuuuccgacuagcuugaauuugauccacucugaugucuguggcucuucuccagaaagcaggugucucuaauucccauguccuaagaagccagcuagugcccaucaccacucaugugaaggcaguuugcagagggaaaucuugaugacagcugugaaggagauccaguccugauguuguccagaugcugugauguuuagggguguuuguggggaaguguagaggagcaauaucaacacuacucuagagguuucaugaauuaagaacaaguugguagcagaagggggcaggagauauuaaggaggcccaguaugugcaugugugugugugugcccauacacggcauguagcaauguguguauuacuuaucuaugguaguauaugcacauauaacauaaguaugcuuucuaauaugcauaugaaaacaaaauuauauacacagauaugcccauaaauguuaacauacacacauaugugaacaguguauaugaacugucccaguauaugguggcuguggccuaauggcaacuuguagccauaaaucucuguauuucauguacucaauucuuuguguuuugagacagagucuuacucuguacuauaggauggcacagaacucagaauguaucccacaauggccuccgauucauggcaaaacuccugucucagcaucccgaguguugggauuacugguuugagccaucgugccuggcucauccaaggcugaugagggcuuaucugcagucccuguuccaucccacgugccuuaccuagggcacauaguuacccagucaaugucuagcuuaggcugacaacauucuacagauugcacuuggcacucgaugcuccugaacuuggagugacuugaagucuaaggaggaaauguggaggcaugugagccuagagggcaccaugaauccgaggagaaaguugggucagcucuggagugggagggaggaguuugacaaggacccaaagaaaguggaggggguggagccaaggcuuaaaagaagagugagcuuuugacaagugagcaacugagaggccuggcguuauggagcaagaaguguccaacugggcggugagaugguucaguggguaaaggcauuugacaccaaaccugaugaguucagacuccagaaccuacauggcugaaggaaagagcucccuuccucaggugcucugcccuccacacgcacgccgugcaugccacaagcgaguaaacaaauauacacguaaacaaaugaauaaaaacuauaaggaggaaaggucccagccugucucccacccuccacccuugcuccauagacucaggggcuggaauaggauaagacuauaccuccggcccacccccaucccccagcucccuucuucuuccccgucucuuucccagcccuuucugagacagggucucaaaucaagcuggccucagacacaccaacuagcagagaaugaccuuaaauuugagcuucccucugccucuacuucuugagugcuguaauuacaggcaugcaccaccaugauagauuuuagguaguguuggggggaccaaacccagggcuuucugcauccuaggcaagcgugucuccagccaugcucaugcuuucuaucucaccaggagccacauucggagugcauaguggguggggacagaguauuaagugugaaaccauuguccauugccucccuggucccaagaggcuuccuuuccaucccauagagaagcuggaaaguuccaccacgaggcuugaugcuuucccuuccccucagcccggagaugcucuuuuagacauucacgccauucccccucccuuucuucaaaucuuggcucaaaagucucucuucugcagaggccucccuccccagcagccuaacuuaaauagccucuugcugcucuacugccgcaccccaguuuauauauauauuuuaaaauuucacucgccaccaccauuaccucauaucuugguuucccaucucaccagaccauaaacuucccgggaaaugggagguucgucagccucgcucauuacguucuugacugcgcacaggaagcguaucuggcuuggagugaagcacucucaguuuauuuguaacagauuauaaagggaucacacacuagcugcugauaggaugaguggaucaaggugugaggcggggagacugguuugggaugcuguugugauagccuuggugagaagugaggacgaggguggccugauguaggguauuaaccauggaggaagaggagacuguucacaccuauacauguauguauacacacacauacacacacacacauacacgcacacacacacacauucgcacacgcacacacacagaggcacacacacacucgcgcacacacacagcgaaggcuaaggagggaaguagaaguguucgugcgugcgugugugugugugugugugugugugugugugugugucucgauguguguaugucacgaauaauacccccaugagaagcuggacacccuccagcuaacccuggcugccauucccccuuccuuuaggauuuugucacuaccaacccacauccgcccaccucugccagccaggcugcagagggcugcuaagcagggucucugugguuccaucgcaucggugacggugaugcaacgccuuagggaacaggcuagauggcaggcgggauacugaacaacaggaaggaccuuagcaaaacagagccacagacacagccuuggagacagagaaagagaagggcgagcuggagagcuuaggcacagcucagacuuccugaaaucagaugugguauuuucucuuaccaguccaacuccuccuaugguagggugggcaccguagcuagagaugcugggagcucuugguuccugccugggucuuugauaugaagucaggucccauuucuauaggguggucugggacuugguaguaugggaggaauuucucuuuguguuuugacggaugagcuccuccucucucaagagagccaggggcuuugcccuuguacuguagaauggggaacuagggucggaccucaggcaggaccagugggcugcuaguaagaaggaaccaaagcacagucugugaucacugauggugagaacuggagaaagaaaugggggucgggggucacccuucccccacgcccugcccgacgaccucuggggaaagagauuauucaaggcuaaagaucucuuugaauguucacccuccaguccucgacaccuagagcugggcugcuuugcaacagagagguugguccuaaacccauucuagguugugggguggaggggacuccucuguugcucuccuuucucucuggggacuaggggacgggugcugcagccucucccuucccaccugggcugugagcuuggggguugggccgaaaccgccgccagagccgcccaccugcccgcggugucauggcaacgacucugcccacguggacgaagaggaaagggaggagaagagaggagaggugucgcgaugugaagaugggagggggcuucucagaguuccuuaugcuaggguccucacuccucugcuuggaccaggucuaacuccuuucuccccagagaccccaggggaggguguggcuguguuucuguccuggcuacagagugugcuuguccuugacuggccugaguaaagaugaccuuggccucuuacacguggaccuuggcugggguucuggggaacauggaguuuuugcacaugcauacuucuccaugucuccccauacaagucgggggguggugccuggggcugaggggaugagagcccgaccuacuucuccauuuucucacuauuuuucaaaaggaaaaugacccacuuuucaaccaaucggacuggggccuguucccaggcugauucccagagccccccugcccaggccucugccccauuccucagccucuuugccacgugcuggacccacuucucggggaagcaggugccccucuguggagggguucuucauugccaucuguacugggcuuagggaagagccggcuuugaaggggguggggguggaaguggggggcaggaagccagggccaaagcuggucugagagcagucagccuuuuugggcagaugcccuugacugccacagcccuuggcuuuuugagugucccuuuuccuagccccugucagucccaggauacaccucccaucucacagcaaggauucuggggauggaggggaggcugcgcccucacuggguuuguuucaguggccagugguagcccagcuuccuaagccgcucuuuuccaagggaaaagaaaagucugcugugcuugucugccugcugcagcuccuccaggagacccccucagaaggcuucugcuugggccugguuccucagccccuccucuucuaggauauuggucugggccucagagcucccccucccucaacuauauuggccugggcugacuuggggggugauuagggauuuaauuauuuaguuucucuagcucaguagauuaauuccauccaucacaggcaggccgagccuucucucccucuuugggcugccuggccaagcccagaggaagggagcaucauugcucaccugggccuaguauuggauuugggaacaauggauaaaguucuuguugggagaggauuugauguauggcauugagcgggugugggugccugugagauaugaacacauagaacucucauagggagauaaggguguggauggaggguaugucaugcuugugucugugcacccagagauuggugucuuuugggugguaaugcagacgugggaagaacucuugugggaacuguguuucuauaugcuaagugucccggacucucugugcgaguaagugcuguguaagguguguguggauggaugguugcaugggcguggugcuuaacaucuggauggacaugagguaaaaggugagugggcgguuugagguauguguguggccaugugugagggagaaaugguagggguggagcuuuccugaagugaugcugagucagaccuacagggggggucucucggcugaccucauccgagaucuugacucagaaagauguuucugaugcauaccgguucaaucugaaccuggucuccuugagguugagaguaucagccccguguucuaccaucuguaucaccucaagaaauuuucuuuacauguuaagucucaguuuucuuaucuguuagaugggauggagggugguaccuaccaugggcaguugugguaacugugugagaagauuauuuuucuucuguacaguuuaagacagugcuugcacauuuacagaauucaaagagcugaucuuagccggagugguggugcacuccuguaaucccaguacuugggaugcugaggcagagggaucauaaaugauugaguuugggucuagccugggcuauacauugaguuucaggccacccuaaacuguguauaguuagaugucucaaaagccaaaacuaggggcuagagcaauggccgugguuaagagcacuugcugcuccuguagaggacugggacuggauucccggcacccacacuggacgacucauacuugcuuguaacuccaaugcccucuuguguucccugugaacauugcacauacguggugcaugugcagacaagcaguuuuacacacauauacauaaguaagagugagugaaugaaugaaugagacauuuuuaaaguugcugggcauaguggugcauauguguaggcccagcauuggagaggcagaggcagacagauuguuggcauuuugugugugugaucaugaugugggggggggggggucaaacccaaggccuuguagaugcuagauaaacauucuaccacuguacuaucucccagccuaacuugugauuuuguugaggucagccuggucuauguaaguccaggcuagccagggauacauaaugagacucuguguaccucuagauguccuggaacuuguucuauagaccgaacuggucucaaacacugagauccaggcagccuuugccuuccaaguucagggauuaaagcccugacuuuuucuuucucuuucuuucuuucuuucuuucuuucuuucuuucuuucuuucuuucuuucuuucuuucuuucuuucuuucuuucuuucucuuucuuucuuccuuccuuccuuccuuucuuccucccucccucccucccucccucccucccucccucccuccuuccuuccuuccuuccuuccuuccucccucccucccucccucccucccucccucccucccuuccuucccuuccuuccuuucuuuucuuucuuucuuggcaugguagcacacaccuuuaauccuaacacucaagaggcagguagaucccuguggucuauauagacaauuccaggacagccagggauauugcucaguuggaagaguauucaccuggcacacaugacccuguuuuccgucuucaucaccacauagaacacuccugaaaucucaguagucaggagguagaggcaggagaaucagaaguuuuauaguuauccucagccagggcugggcgugguggcacacacuuuuaucccagcacucaggaagcagaggcaggaggaucucugugaguucaagaccagccuggucuacacagugaguucuagacuagccagagcuaugaagugagauucugucccaaaaaccaaccaaacaacaaacaaaugacuauaguuacuacuaauacuaaugucauucuugacuacauagcaaguucaaggccagcuugggcuauaaaccauagccuucuaaguuaacaggcagcugaggcuuuucuguucugugccggacucugcuuguauuccucccugggcagagcacaagcucugucugcucuggaagacuggcccaggugcggugcuguuucucccuccuuccagugcaucagcuguugguugcugcuucuuggugacucagucacugaagcugaacucauugagaaucuacuguaugcuuugcuuggccauguagaaauagauaucugauccuagccucuaaggaguuuaacccuugcaccccacauuuaucuugccgugcagaagaggcguuagcaucugcucugucuugggcuucaugggaagguaacucuuaguuaauacuuuaugcagggcugggauguagcuuggcugacagaaugcuuguccagcuucuacagaaucaugagcaggauccuuaagcacugcauacacugggcaugacguacgccuaggaucucaguucuugcgagguggggacaggauggccaguuauuuauggccauuucagcuacaacguggguuugaggcuagucuggcuacuugugagcccgucucaaaugcaucagaggugucauuggcaggaaggucugcucgguggcuggcuguuacaguguaugcugcuucuugcccugcacaccugacucccgugcuccccugugcuucccagugcaccccaccccucagcuucccauucuguucucagauccucaacauccagagguucagaggagaacugggcuucgguguuccugcagcugagacagggucaguagacuucaggcagacuggaagguuaggagauacaaccaagcaucagccaacaaaaggcccuucgaaggguccagccuugaacuugauucuccuguggcauggacccagaaggagaagaugggccuuugagcuagacaucccugugccagaggguuuggggacgggaugcuaacccuaaguuguagguuccacggcagagacacacgaccaguuggcuaggcuggaaguagaaaaggcuguggacuuggccugccacagaaucacaugucugcuggaccccuguugggacuuggcuccugccucuuguucucugguggcccuggcagucuggcaacacuucggaggccagagcgagucacacacacaugaaagaagaugcuaugauauucauguuagaacagaugugaggauggagaucaauacacuauaucuuggacagaucaguugguuauugguuguccacaacucaaggaggcaaauaacacugucuccauuuuuacagaugagaacauuaaaacccaggcagugaaaacaagcuguuuagaggucaacugagguagcacaggcucagguagauagcaucauuucgguccuccgugugagacuguuaagcucucucuucuccgucucuggaguggggagagaggcugccauuuauggcgaccgaggacucuggaggucugugaaccuaaagacucugauuucuucagguuccuccauuuugggacacuggggcuguucugcugcguucugcgugcuugagaugugggagguguucagagguauucuaggcaagcaaauuccuggaugcaaaaagaaaaaaaagaaagaaagaaagaaagagagagagagagagagagagagagagagagugagugaguuucuacggcacccguuucugaugcaccaggcaugguugcaggucucugcccaaggcugucugagaaauccucuucaagaggccuuaccuuuaauucucaugcauuuaaaugacuuccccuucaucuucagccagaccucagcccugggcuggacaucuuaucugccuuacuuuaacccuguggcaagaaagaaaccauuccugucccuuugugagcauagggggacuuugucagagagggagacaauuccuuagggcccauguuugguggacuauaaaucugaauuguuuagcucaaaacuuagaaaagacgacacucucugucgcuagccaccacuggauagauucuucuaggaguucugguccugagacuucucucagcaggcggacgcucccaaacuugggaucuuagagauccuugaggaguuggaguggggcggggugguggcagacauaacugagaguagagggacuggaaacaguuggcccugagagagaagguuggucaacgaggcuguaucugaggucuuuuggaagcccugguuaaggaggaggaagcucauauuugguaugcagggcuucuuggcucuguggccccagcuagagaaggaucugggauccaacaagucugagugacaagaccuacuuguggcuggcugugggcacugagccuggauccuacagcucagucccucagagcccccucauagucuugucugucucugcagcacucacuguaaggauuguccccucccuucugucuucuccaccauaccuuccccgugccagagagcacaucugauagauacaagcgaucagcgagagcugggcuguguuuagacacaggauuucaaauaccggucuuuccgagcucuccaaagccuuuggagggaaggcuggggagguccuuuccucuggcuucugugcacaggagagugggcgagggcagcggggaagccauucauuccugucugccaguaccaugccuucuagaucacagacgaacacaggccuagucacugcccccuuggagcugaagacauaccauaaaaauguaaugggugaagaaaguaauuucaaagauccauaagugcuuuggggcagcggaccaggguggcguagaaagaacccaggggaagauaagguuagacuuucguuagagugagcgguuagggaaagccugucagaacugagcccagcaagaugagacagaggaagccaugggaauaucuggggcagaguguucuggccgugagaacaucaagugccaagccccccugaggugggauuuucaaagagauuauaggugguauggguuaugcacaggcuugcaugagcacugucugaugggucaggagaugcauuuagacucagcccugcugaaaugucuugaguguuuuggaagaggaagcccauuuucugcagcccucuugcuccgagcucccagcaagaccugauuaaauaaaguaaugaagguaaaggaauauaucuguaaacuucccuccuuccauucugcccccccccccucuugcugugguaaggacaguaggggagacauuuuuccuuggaggcuugaaggcuaggguugggccauggggccgggcugagagaagcuagggacugaggcacccacccagcaacagagaugcuggcagagauaccacagcaaaacuaaggucagauugauuaaggaggcuuagaugaaaauggaugcaggaagaggugagggggugggaggaauccauaggcagagauaaauaauuguggaauuugaguugugggccagagguuuuguguuacgguucagugccccccccccaauccuauucccaguggguaugccgcugcugucaacagggaagcggcacacuccuagcucuguuaguucaguuaacacagggaaaggggauagcuaagcacaaccuaaagcucccaacagcacacaugguucacucacaggcauggaggaagccuggaucccagcaacgaaacaaacccuagaccucacuggcuaggaaaucuguucgauugaaaccaguauggggaugaccucauaggcccugugggaagggauaaggcugacccccugucaaagagccgcaacauccuuucgcagcucucuggaccauccuaucuaguucugccagcagcaucccaaggaaacaacgaaucagcuaauauuuaauuuuugaaaucucccucuuuaccuaagccauccuguggguaaguccucaagacacugguuuuucuugagcacaucuggaucccugguccccagaugugggccuucgagaacaacuugucucuugggcagcagaggaucaccagccuuaggcaguugucucagagagaguaaaugaccuguucaaggucgcacuguaaaccagugaaggaaggaaggaagggaaaaaaugcuagccuuaacucuagccacuugugcagaguauuuacuguguuagccacaguacuaaggaguugaugugcuaaguauuaaccacgucauuaauaccuucaugguagcucuaauggcccccuuguaaggaugagaaaauggugcaagcucagcgaaucacuggccccuguguacccagcuagcaagugaguagcaagggauuugaaccuagauugugagauggcaaugccacuccagugagugcuuugaugagggguggaccugggagucaccucugucucagggaaggcgugucagcugacccugggacaggggaggaggcaaucugauuucuucugcagcuccuuuccuucuuccauuuuccauucuuuuucuggaagguaauugcuuggggcagugacaaccuccuggcgaauuacacagcuggcuucccagugagauuuguaacaacaaccucaccagccuggcggcccccagcaaguuccagaguaagaaacuaauugcugaauuguguaguuggugcuaaauuggguaauuucuuggugacggcaucugcgccacaucuuccauuaccagauaaauuugaggucuaucguggaagaaccugucacacacagcacccuccuggucuccacucacagacagccacagguaauuguagaaguggcugccuuccugguccagagguucgccaucugggcggcucucuugugucaugggauaagaagaaaagugacuugauuugguaaaauggagaaaaaguagggccagggauguagcucaguugggagagguguuugccuggcaaauacauggcccugugguuugguccccagaaccacaugaaccagacuucuggcaugucucuagucccaggacucagagauagaggcaagauuguuacaaauucaagguugauacauagugcuuuagagacuggcuuaggcuacaugagacccugucuugggcugguuuggcugaaacagagagagcaaguaaggguggaguguuugggaagaggauaaugggaaaggagaaagggccaggugcuuggcuuaguuggccagauuaagaugcuaacucaaggauauuggcgaagaaacuucagggaguuuccuuuagucucuuuauuugaccuuggacuuggcaugaaguuauauuccccacacagaagcaaguuaaaugagggcucucauuagcugugcgguauguaugcagucuuuuuauuuguucgguugcuuaauaccuguuacuuucaaaugacauuuuaccagcucagcuuuucaaggcuaauggugcaggcaguagcaaagccaucaggcugcggagucaggcaaugucagcuucgcuaucagcucuccgugugaucuugguggcuucagguccuauuucuuuagaugggaauguauggaggaaugaagucacauccugggaaucagaucaaaugccuuaagucaaaacaggcauacucaacaaauaccuacuacgcgccaagcguugugcccaggggcugggggaaugugcugaagacggucagaauuccugccuggaauucacauccuaucgggagagagacagccacagaaucauacagauuuaaaauggcaacuagauaagagaaggguacagaaugcccugagagcaagcagcagggagaucugaccuagucagggaggccagagaaagcgucccugaagaaaugacaaccgagcugagaucugaaggggaaaccgaagucagcaaggaagagauggagugggggaaaagcucucuggacagggaguaggcuccaugaugugagggaucauggaacugaaaaagggcuggcuuggcugaagcagagagagcgagcaaggggaggggggagaguguggggagaggauggugggaaagcagaaaggaccagguguguggcucgggcugaccagcuuaaaaugcuaacccaaggauaccggggaagaaagcagagaagcgguauggucacaucugcaucgccaagugauaauuugggucaccagaauggggagacaaguuaggagccuccugcauaugccccagcagaaggugauguuuggggugcagcuggauucaguagcaccacuuucugucgcaagugcagaaaaucuggccaacagggguuuaaaauagaguuuguuccucaucauagauaggccuggagaaaggcaaccgcuuguguugguucuguggcucgauggugucaggacuaacaucucugugacuuucuaagccucucucucaagcuggguacccuggaucuggucaucauuguuuuauuccagccagaaagcaugggggaagggaggaugggcacccguaagccccaccccuugucaugaaagcagacuuucccccaggaaccucauauuuucauguauaaaucauuagccacaauggaauggcauggcuucaucacaagggaggcugggaagaagggaaagggguuugggaaucauucuccgauccuccgccagcagugauuggugggcaugggacucagugggcacggcuauuuuuaggaagcaagauccauaggaaggggugauggauugggcgacgagcucucuccuugauugguucucccucccauucacuguauuuagcgaugagaugggggcagagggagaggcaugggaucugaggcauacgaguucauaauuaaaccuuuccuuuaaaaccggguguagugacaaacaaaugcaguccuagcacucuggagguggaggcaggaggaucagaaauucaaggucauuuuuggcuguguaaggaauucagagcuggcuugggcuacaugagagcaauuuuuuuguuuugucuuguuuuucgaauucaggaauagaauaucucccuccuucaguaacuuguauuuaguuauauuguuugcuguuuguauguugaagauccuaggcacccaaauaaaggcuucugguggauuugcuugaacaccuguaaucccaacacucaagcggcgggggggaggaagccuucaguugggcugcauagggagauccuuccucaacuuaaagaaaaaaagaaaaaaguauggacuggagcgaugguucaguggugaagaaccaguagugcucuugcugggcacuucugaguacucaaaccucagaagacucagaggccucuggucucuguggccggcaauacucacauccaaauaccccacauagacacacaaucuguauauaaucgaaaauaacacaucuuuuaaaaauaauaauaaaaugcccccaaauaacggugugauguuagagauuacauuguguaaucuuugggaauuuuaaacauuuuuuuuuugguuugucuuuugagauugaguuucccuguguagcccugacuguccuggaacucacucuguagaccaggcuggcuuugaacucagagaucugucugcuucugccucccaagugcugggauuuaaugggugcaccaccaccacaaccacacggugggauuguaagcuucaaauuuaauuuuauuauuugcuuaagugugaaugcuuuccugggggugugcacgcaugucaugaggcauagggggggggucaaaggucaaccuuugggacucucuucucuccuccuccuuggugggcuuuggggagccaacucagauugucaggcuuggcugcaagcgcuuccccugcccaccacugagccaucuccuuggccucuacuuccuaggguuuuaaaaugguuucauagguauugugucauuucuguucacuaauguccuggaugguauguggacagguauauuaaacuuggaagaucaccccauuugucugacaccauagaccugguuuugggacaguguuuuguucuuagacaguucuuccuguagggaaugggugcuaguggucuaucugacgagcucccgucugagaccaaagcuaagggaacauggauuggugagaacgagagagaaucaaguuuaaucagagcuugaugaugagcuggguggggcgguucacaccuauaaacccaguacuugggaaguggauacagaaaggucaggaguucaaggucacccuggguuauagaaggaguccuaggccagccuagaagucaagaaaccuuucuccaaaagcaaagccaagagggugggagagacagacucaguaccuaagagcacuugcuaggaucugggugucucccagcauccguguuguggcucauaacgauuuccaguuccaagugauuggacaccuuccucugaccucagcaggcaccaggcacacaugugaugcauguacaugcaugaugggaaaacaccgauacauaaaacguacaaacacauacaucuuaagaagaaagaaaaaaaaaaaaacaaagcaaaacaaaacauuccaauggcaacucagcagcuugguggcagccgcuguaggaagccgguggcaggaaacaccuuuagacugggacaucccuguuagguaguucaguaugagguuccaguuugauaugugccccuuuugucugugacugugucacagacaaagcuccggguuaaucaaagccucgucucagaugggggaugcuucugggugguuuuccacaggagcccaagcuucuuggucugaacuucccucucucauccuagcaaaaggacaauaaaggaaaauugccauagagccaggcucuugguaucaguaaugucaccccagugucucucuaggcaagauaacaaauagcuccuuugguccgggcccuggaucugggagcaguuuauaucugaaccuuuccucuauagacucuuauggacuucuaccauccuuuccauugugucacauuccucagggucaggaaguucuuccugaugucugacugugucucuuucacuauuauuaaucaugcccccaaaucgagcucuucccucugacauccccgucucuaauaauggcaucauuagucuuccagucacggcuacugaaaacuugagagucaucuuccucucugacuccccaucuuccaguauuugccaaacccucaccagcuucuggaacauuccaagcccaacccucagaauuugguauuugcauuuuuuuuugucugccuuguacccacuguuuucuccacugggaauuuaucccacacccaaccuuugucuacccauauuguacuucaaaugcccucgucucugggaagccuuccuucuuucuucucuacugacucugcucuagcuguuaauccaagccagacuaauauuuugucaccucuccugcacagccacuuccucacccacagggaacagugacuuaggacuggcucaagucagagaugacuggaaccuaauuuuuuuuucaccuuacuggagacugguaguaggagagauggagaccaaagcaagcaauuucuauccagugugcuugcugcuucuugugggguaccuggagugucauaaaagcccagugagaggcguaauccagaauaaagaguacaagaagucuccacgggaaguugaggcuucuuaagaguaaguguuagccaggaggagagcucgagagaagagaggaccaaggaggaaggaacagcuugcgccagaauauaaggaccugauaauucugucccuugaguuccuccuguuagacuacagacccuucaaggauaggggccacacccaaaugaccucaguacgcuucuccuucaaucugccuugcggugggcacucaacaaaugucuguggagcgcagccauauuuaagggcaaugaaaaaaaacgcuguagcugagcaucauggacagaucacacagacaccugcaguuggagguaguccaaccuaugagcgaauuugcauacauuugcauaaugaagccaacuucauuucccugagggucugaagccucugcaucgugggggauccaaccaguccugguuuggggggcugggaaagagaaucaccagggcagagaucuguccugaggacuccgggaggagugcccuuccuuggcucacccccucuuucuuuccugucaggagccagugguccugcgccugcugaaguuaggauucugccuggugguggggauccugacaucaaggaugggacaccccggauggugaguguuagaagauuugcgagauggggguuauacuuggguucuugaacccaaauacuugaugcacagagacucacccauuuacuggcuuuuccaucucuccauuuugagcuccauuuucucacgguaaguggggauaaugucuacacgacaggauuuucagucagcuuagagacuaagaugugcaccauagccagcacaccgcuaaugugaggaaaauaguaggagaugaguuuccagcaggaucuggaagaggccagagacagaaugggugcggggaagccauguggggaggaaaggagguugagucuuaggagguaccgcugucuggagucuuugagacugucaucuccuagucagcagauggcccaggagcuggucuagggugggggagggcuccgucugccagauccucugucccugucccuccugcugucaccuccuccugccauagcuccuguccuggcagcuccuggaguccugauuggaggcaacucuugcugagagcugaccucucuuguccugucgccucggcaagccugggaugagggccagggacacugguucaacaaugguuucucuacuggcuuccagccuuaccggcccacuguuccugggaggaagaacucucggguuccacguaguccaguggucaaauguugccuggucuagccagccuucucuggaaucuuuucucccuacccucccuccguccccagaugccaucucauggagaguguggcaaaggaaaauaggcaaggggagggggaagggacuccagugguuaguaucuggaagccagccaagguaggagaagccaacucagguuuuccugccuuuggcauuccccgagaggggcgaaggggaggagccugcagucagaagcaaggagguagacauggaaggaagagagguuuuauggaguggcauggagauguagaccugaagucaguguucucauccuggcgccugcggcagggggaugcgggauaggguugaggugggggaauggcuguggaucaauuugcuucugcuuagcuuguuaaaagccaguucaccuaaugacugguuucuuugaauauguggugcgucugcuugggucgccuuuuguuuuugauaaucuaaagauauuuaaaagcccauuuggcugaaagcauuuccucuuguggauaaguauuuaucaaauuugcaacagugaugaaugaugggaugauccugugcccuugugucuuugucuauuaugacuguuguaaggacuuuucaguccauguguggaaagguaguauaauuaaucacaauaaauugguaggcaauaccaacagggaugccacggugccuggugaaagaugauuuuagguagaguggccuguuguucaguccaaaucucuuuucucucuuucucaggagguuccuggggccuggcccccaacaauaugaagagccuuugcugaggccaugagggguuaccauggcgaccgaggcagccauccccgcccagcccgcuuugcugaccaacagcauauggacgugggcccagcugccagggccccguaccugcugggcuccagggaggccuucuccaccgagccccgcuucugugcuccgagagcuggccugggacaccuuucuccagaaggaccccugagccugagugaggguccaucaucaguaggcccugagggaggcccagggggggugggggcugggggaggcagcaguaccuuccccaggauguaccccggccagggccccuucgacaccugugaagacugugugggccacccacagggcaagggugccacccgacugccucccacacuccuggaccaguuugaaaagcaauugccaguccaacaagauggcuuccacacacucccauaccagcgagguccagcagggccugguccuggaccuggaucuggcgcugcccccgaggcucgcagcgagaguccuagccgcauccggcaccugguucacucagugcagaagcucuuugccaagucccacucucuggaggcacccgggaagcgagacuauaacgggcccaaggccgacggaagagguagcucugggggagacagcuacucugguccaggcucuggaggcacccccaccucccaccaccaccaucaccaccaccaucaccaccaccaccagucccggcauggcaaacggagcaagagcaaggaccgcaagggggaugggcgacaccagaccaaggccacaggcugguggagcucugaugacaauuuggacagugacaguggcuuucugggugggagaccuccuggagagccugguggccccuucugccuggaugcuccagauggguccuacagggacuugagcuucaaggggcguucgggcgggucggaaggccgcugccuugccugcacuggcauguccaugucccuggauggacagucagucaagcgaagugccuggcauaccaugauggucagccagggccgggauggauacccaggggccgggccaggcaaggggcuccuggguccagagaccaaggccaaagccaggacuuaucacuauuugcaggugaggcuuggugggauagggagaccuguuuugaguccuccagucuggucagcugggggaacgauggagaugguuggguggugucucaguguuggaggucuuggaggaaggaggcgcugccuugugauacuuugaaccccuuuggggccucccuuuccccauuuguacaaugaagggaucucccuagucugagcagugauguugaugccaggaagacuucuuugccuuucgguuuggaugacaugugcugaccucugucuucugggguggaaggcggugcgggguuaagggaaggcaguggacagggcauaaugguacuaccuagagcauugccuucgagcucggagcuugggaguuggaaagaagucccuccugccagaaacccuccccuagacuuuuuauaugcaaaucccggugguccaguuucuuggaauaugaagaucagguuccagaacguuccucuacuuggguuugucaucugaccuaugguguggugggacaguccagaaaauuauggaggacucuggaggaaaugccucuugggggauuuucccaggcuggugacacgcuggagucugaguccugauguaauucaggcagagcuuccuacggguggaugcagaagugauggccguggcccucucucaucuuacccagguaaccuuguggucuuuuugccccaaggagcucugaguccuuuccugaggcucucguuccagcuucagucaguccgcacugauuucgugaauguuccuggccuuuuagggguagguaaaggccaaugcaaguuuuggagauccgucagacuuaggguuaucuccaauguucgaauuucucuucgguuguuaauccucauucauucauucauucauucauucauucauucauucagugagcacauccuugguacagugauaaagacccuugcugcccagagcucacgguuucuaggcaauagaccaggaaacagaugauaggcugugugauagaagagaguucugggucccgggagaacacagaggaggcuccucacucacuuguggguggugguuagggguggcuccaggaagcuccugugaggaaugucuccugagcugagucucuguggaggaguuggaguuaguugagugccgauugaagguguuccaggaagaucccacagcacguuggaagggauggaaaggugaggcuugcaugagccuuuggggugacauuggccuugccuguacguuguacacauguuaguacucuccugggggaaucccaugaaagcccaggagagcaaauagugcuauagcaaaaaacaggacgagacuucugggauuugagaccgcguagguuagcuucggauuguucccucccuacgaggggagguucucuaggcugagaacugaagagugcaggggaagacaccauuccuccccuguaaccagaccuugcuaccagauuugcugcuccccgcugcuucuccagggcuguccugaccucccugggggcuuccuuuuuaacaugcaccucacaguguccugcagaggaggagagagcgcacugcaguggcuguggagugggagcccugcaguguggcagugugugcccuggucuccugccauuccucucuguagaggauggagguggggauggcucucagggcuugggcuuccagagcauccuaacaugauggggguugaguggaggucugaguccaagggagggugaaccgaaggcugcaggggccuuccaagauagccggaugcucccuggcacauaagcaagggcgguuggcuuuaugugacauggugucuuuauugucuauuccccucucuuuuuucuguuuuguuuugagauagggucucagguaggccauggugaugugaucuccaacuccuguguagcucagaguuaccucugucugcuuccauuccaucucccacaucuggagggaauauaucaccauaccuagcuucuuaucccuuuaacgaagucugguuucuccuacuggacaccagugugccugugagccuuuuccggaacccugcuucccccucagagagcaucagucauuuccucucugauucugucuucagauggagcucuggccuucauugagccugcucccuugugagggucucuuccugaaccuucuagucucacccuucccaugagucccccucccuuagccuggcuccuuggauccucuccuccuugcucuguuuaaccucuuccuuacugcaugugcuuucaaagccuugccagccuucucuccuuccaccucauucuucaccauguaggggaccaucauggacuccaucccauggaguugaucccuucccaaccagggcuucuucaucccucaacugccccuggaguaagagacuaccuugaccggcucucuuaaaaacauagccacagcugcuuuucucuaaaacguuucuccaaaccuucacccucuaccgcuucuugccaucccuuucuacuuaaagucucagaguguaggcuccuuuccucaguuucccucaccucucaccacagucagauuuccacauccugcccuugaacgugcccugggcagugguuaccgguggucucugggcagcaauccccuaacaaugccccgaacgccuguaauaauagcccucauuuacugagcgauuucuguguugcaggcucucugaauugcuuguuuaucuuacccaccaacccuucugaugcagguauaauuacuuuuaccaauuuauagcucgggaaacugauucuuagagcuuaauuagcuuugcccaaguucaccuagcuagcaagugacagggccagaacucugcccugggucuccuaacugaggagcacaaguuacugaccuugaagagcacuguggcauuugacauaaucgacucccuuuucuucuugaaaugucucguuucugugacauggcauccuccugacucccucccaccccucugcccacuccugcucaggugacuucacaggcccccuucuccuuucuuuuuuuccuuuuuaaaaugucagcggggccuuuccucaguucucucccucuucucccugggguguccccuuuacuccugggcaucugguuaccacccuugaucucuuugugucugccuccagcuggucuuuaccaguaaaccccaagacuuugcauaacaaccgccuuccuggguguuccuggcccaacucagggugcuuaacucugaaccugucaccccuccccaaaaucugggguucuguggcucagugcaggacagcccagcccgcucuaccccggguccucagccaccgcccuccucagccaucuuggauuccucccaggcuccucuuccucccccacuaaucaggcucacugaugcucuuuagcgcaucucaucuccaucuccuccucuuucccuuauucucauugucuuaauuuaggccucaucaucccuugccugcagagcagccucagccuccuaauuggcuacccuccugccacuugagcuucugcccgggccugaucuccugaccaucuagcuuuggucuagacuguggagugugcugauaugcucccugccugauacccucugugguuccuugagagcugggagggagucaggggauggcaagugaacgccuguuaaaaggauggaggaggcaggggugaaaggucacugaggucaggcuaugcugcacagaugaggguaugauugacaggccacgcaggccucuggucuucucuucagcugacccucuucugaguagcgaaaggucucugaagggugaugcagccacccccacaagaguggggagacacccugacgcauucccuucaaguccucugugccuacucaagucaguguggcuugcucccccagcaggguagagcgccuccuacugccagugggaggaagaacacccucuccucucagccgaccaguaacgcgucugagggacagaggcccuuguccuugcaggugccgcaagaugacuggggggguuaccccacggguggcaaggauggggagauccccugccgcaggaugcggagcggcagcuacaucaaagccaugggggaugaggagaguggagacucagaugguagccccaagacgucuccaaaagcacuugcccgacgcuuugccucccgccguuccuccagcguggacacagccaggaucaaguaaggaugguguggggaaggguaucagagaugauuccgagaucccgcaggaacuguauguggaggcuuuuggauggggagcccugcuuaggauucaacagacuaucuugcucugcuccaaauggaguggagucauggucuuugcuuuaguguuucuuuugcgugcgggcgcggggaguggggcagggcagggggagggcuguggggugggggcggggaggaaccuuugacuccgagucuccuggguaguucuuaguguguuuggggggggggggggaguggggagguggaggaagagaaccuggucagaggcccugauaccaucagacccucucuccaccuuggcgcacacucccauucugacucugccauuugccuuuuucagcugcugugucccaccccggauccauccccggaguuccaucccuggcuacagccguucccucacaacuggacagguagggcguggcgcuguauaacauaggagggaaggguaggaaagggaagucaguuccgggcucugucuaggcugugaugucagucucuguguggagagagagcaaguuugguucugggaaagcccccaaagcccugaaaccugccugugacuuccagaucugacuugggcugggaaucccgaagaacccacacaaguaugcuccaaguggugagcaugugugaagggcagcaucguuucuguugcguucuccaucccucuccaagccugacugcuccagacucauaaaugaaagggacaggcaaggcagagucagagcugaagucuccugggcugucugggccugaguuccgcagccucgacaucuacucccucagaccaccuucccuuucaacaccccuguuuccuaaucuuggaaaugacaggaauaaaccugaaaugauggcucuguaaucuuggcacuugggagguggaggugggcaagaucacaaguucaaggccaaucuugguguaaagacuccgcucucaaagaaacaaaaccaaaaaagcaauguuaguguuggaauaucucucaggggauuuguaggaguucagugggaaacaucauucaaacagaaggcacugguccaaaacuguuuuauaaagcgaguuccaacgcuggagauguaguucagcuagcaaagugccugccuagcauucacaaagccguggguucaauucccagugaagccuacgaauggguaugguggcacgugccuaucucaggagacaggucaaaaguucaaggucacccucaguuauuuagcaaaagcuggaggccagccuggggcccaagaaaccccaucucaaagaaaauacagugaccucuauaccuaagugcaggccucccuuuucauuaagcggaggcaauggcaguuuauauuugaaugugggaacaggguugaauaaaggcugaacuacuuaccagcugagugaccuggggcaaguuacaagacuuuugcgccccuuccuucccuauuuaaaaacaggcaucauaauagcauucuuggcacguagccagugcucaagaaagguuagcuauuuuuacuguuugcugggggugggguggggugagagcaaugcaaagagccaugcagaagaccguccacuggcuccuauugugagccucggcagucucucagucucucccuucguuccauuuccugaaucaaggauucugacuuggcacagcugucucucugccuugagccagucucuguuccuggucccaccgguuaaugcccagucuuugugucccuugaccaucggugacaucuaacauagcugaggacccuucuuccuggaacauguuucucugguagcuuuuagacacccccuccccaucuccucccaugacuguggugacaucugugucucgggaugucaccacuggaguuuuccagggcucugucccuucucugcuuuuuacgcccacuccgugggugaucucauccaggcuuguagcuuugaauauuacugagaaccugaugacucccagaugcauaacuccagcccaaagccucccugagaggccagacaugcacaugaaacuguauuggagcucacuuggcuagcugcugcagacacuuccccuguggugguuguuguugucguccucaucgucgucaugguccuccuccuccuccucuuccucuuccucccccuccuccccuuccucccccuccucccccuucuccccauccccucucucccccuccucccccuucuucuccuccucagaccgaugcuccacccaucaucuccuuugcagauaauggcaguuuuauuuuucuaggacuuauggucuaaaagcccaaagucagucuuauuuugguuuuucccucccucccccccucccucccucccucccucccucccucccucccucccucccucccucccuuccucccuuccccauuucugugcugugauuaaaacuuacucauguugagcauacacuccaucacagaacuauacccccaauccaugaagucagagugcucucucugcuagacaacacccuaucuuucaguccuucagcgcaaaucgucuucacaauauucccagacucuauccuucaccaaccgcacugcaagccccaugggcuuggucagggccuuucugcugccuucuuguugaucuucuguguuuguccugacuccaacucauucucugucaguauagccagaacuguuauuuaaaaauauaacuaccaaaaaaaaauauguaacuacuucuguuugccuuucugcucagagcccuggccuugcucagaguagccagacagggcuuugcugggguuuacaaagccccaugugaaccggccagugggaugcuguguucaucuccuaguuccguuuguucccuucccuuccuccacagcacuacacugccugcucccagccuuggacauuagacuccgaccuuauaacuugagcauuuguuacuaccugggcaccuccuccaagacucugccagggaccacuccuucacuuucuuuucuuucuucccuucccuucccuucccuucccuucccuucccuucccuucccuucccuucccuucccuucccuucccuucccuccccuccccuccccuccccuccccuccccuccccuccccuccccuccccuccccuccccuccccuccccuccccuccccucccucccucccucccucccucccucccucccucccucucucucucucucucucucucucucucucuuucuuucuuucuuucuuucuuucuuucuuucuuucuuucucuuuccagaucuuuuccaaguguucugaaauuuuaaucuaaaccuuccaaacauuuccuauuccucgccuuccuccuccucucucuccuccucccaccucacauuaucuaacaguguauauacuuggcauauuucuccuggaggugugacuuagagucuuugcuuuacagaagaggagagguuuaaagcagcaaagacacugcccuguugucucuuaggaugcuucuccuccugaguggaucucucucuuuaguguuugccuuggacaucuuuuuccaucuuuggcuuuagaguguuuugucccauauguuucagguaugucuuuuuaaauaguuuaugaccaagaucuuacauccauuuggcaauugucugagaguuuuguacguuuauauuuauugugguaugcuuggcuuuauuucugccaucuuacuucgugccuucuauuuauccugcugggguucgggagugcaugcugggguguauguguggaggucagaugacaacauggaggaggaauugcuucucuucuuuuaccacguggauccuacagauugaauuauguugccaggcuggguggcaauccccuccaccugcugagccaucuugccuggcccuauccugguucuuagaugauacuuuauguuugucugucugcacuucuuucauuuuuguugugauaguguuucgcuguauagcccaggcugcucuaucacuugcuaugaagcccaggcuggccuauaacuugugcccauccucuugccucagccucaugagggcugaugacaaguuuaugucagcacacccaguggaguuugugcuuuucugccccuuuuggauugaugguguuugcucucucccucucucugccaaaucccaugcugguuugacaguuacacacuccauuuuauucuuuaugguuacuccuguaauuuuaaugugcauccuugacuucaucugaaggagacaaggcuuccuacucuugcucugaauaaugcacaguccuuaggguacuuuaauuuugaugaccucuuuguucccuuuuuaagccauagaaacuuauuugggggugggggagggagguucuagcucagugacagaauacuuuccuggcgugagcaaggcccagguuuuccccccaguguccacacaaaacccacuguuuccagaaacucuagguacuggaaaugaaguauuagcauaccagcuauggugcuguccucugcugagggacuuguguucucauaguguuugaaaaaaaaagacauuuuacuguuguuauuaguauuacaguuauuuauuuauuacucauuuauuuaugcacuuuugccuguguuauugugugcuuuggcacacacguggaagacaacuuggaaaacucagaucugaggacaucaguccuggcgguggcaaucaccuuuacguucuuugucaucucacagugacaaugcucacugucuguccuucagugccagggccuugcacaucugugguaauacuguacuacugcguuauagccccagaauucuuuugucuguguguccuacaguguacauguagagaucagaagacaacuugugggggggucuuguucuuucucucauguggguuucagagaucaaacucaagacaccaggcaccacgacaagcuccuccacucgcugagccaucaccugcccuuagaauccuuuuaacuuuuuuauuuaaagaaaaugauuuuuguuguugccacuguugugcuuuugagacgggguuuauccauguagcccuggcuguccuggaauucacucuguagaccaggcuggacuuagacucagagauccaccugcaucugccucccaagugcugaggcuaagaaugugugucaccaccuuccggucucuuuuucaagcuagucuugaaauuacuaucuuccugucucaaccucuugagaggcuggauaacaacccuguaccgucaggcccaauaaaucacaugaaauuuaauggaggucucuuaggguuuuacugcugugaacagacaccaugaccaaagcaacucuuauaaggacaacauuuauuuggggcuggcuuacagguucauagguucaguccauuuucaucaaggugcaggcauggcaguguccagggcaggcauggugccggaggagcugagaagucuacugagagcugaucuagcugagaguugauuagaaggcagaugggagaagacuuacuuccaggcagcuaggaggagggucucaaagcccacaaccacagugacacacuuccucaaggccaggccuacuccaacaaggccauacuuccuaauagugcuacucccugggccaagcauauucaaaugaccacagguuagauauauuucauaaauuuuucucuuucuuuccccccagaaaaaaauuuaauuaauuaauuaauuaauuaauuaauuaauuaauuuuauguauaugggcacacuguagcugaacagaugguugugagccuucaugugguuguugggaauugaauuuuuaggaccucugcuggcucuagucaacccugcucacucuggucugcccugcuugcucaggccuaaagauuuauuuauuauuauuauauauaaacacacuguagcugacuucagauacaccagaagagggcaucagaucucauuacgggugguugugagccacgaugugguugcuugagauucgaacucaggaccaucggaagagcagucagugcucuuacccacugagccaucuugccagccugaaauuuuguuuuaauauaaaaugaaaucuccacuuuaacccaagaugagaacaaaauuaaugucucuugcauuuuaauuuaggcauguggucuauuuugaggguguuuugggugagggcaugugacaugugacacuugauuuuuguuuuugagauagggucucauguagcucaaacugguuucaaauucauuggguagcugaggcuggucuugaacuucugauccuccugcuucuaccucucaagugccaggaugacagucaugugccacuaugcuugguuuuaggccuuccuauggauggagccccaggcuucaugcaugucaggaaggcacucuacugugagcagacucccaacccuuuacaauauuacuccuaaguugcacauccucucucucucucucucucucucucucucucucucucucucucucucucucucucaugugugugugugugugugugugugugugugugucuuuuccaggucauuauagcuuugucuacgaguuccuuccaucuaaaauguguucuucaguuucucaguggugauugguagcacacucugacagauugaugccauuaagcuugcuaggggaccuaggggacaagucagugucgguuccucucauugucugauauuacgaagucugcaccgugacugucuuuguguacaauucccauuugucuuugguugcuguuaagagcuugcuuagacuuuggugucugcaucuuuacuaugguguguguuuucauguacacucccuaaaucugaggauuugugccuuucaugaauuuaggaaaacccacccagucuccguuguacuuuuuggccugguaugcccccgcucccuagcuuuuacccucaagugacaauugaacccauaggcuugcacacauugaggaaauacucuacuacggagcuacacccccaggcccuuccucuuuguccaguagagugauaucuaccuuugaaucccagcaucggggagagaggccagcuuuuggugaguuugagaccagccuauucuacauagugaguucaaggccaacuagagcuaccuaguugagaacuugucugaacaaaaauucuuuuugagacaggguguuucgaauuugaccuugaacucagucugcagcccagaugggcucugaauuuaugguccuucugccucagcuucccuguuggggucauaaggcuguggucccaugccugcuugguuuaugugguggaguagguuaacccagguggucuugggugauaaaaauucuacaaaugaacuacauugaagccuuuguccaugacuuuucugccuucuucucuccuccuucucccucccuccauugucuuucugggucucccaucacagguaugucuguuugauugcuguugucccguguuuguauuuuugauaguuuuuuuccucuucacucauuaaauuggacaaucguauugcuuugucuucagguuugaugaucaugucuuauauuaaaccucucaauggaguuuuugauuucaguuauugaacuuuucaguucuugaauggauauuuguuucuuagguuuuuuuuuuuuuuuuuacaaauucucucucugucucugucucucucuccccugcacuccccccccccccguguguguguguguguguguguguguguguguuggugcacacacaugccacaaugcacagcugcaggucagagggaaacuuuauggagucaguuuucuccuuucuccugguuguggguuccaggguuggaaugaagagagcgaggcuugcuuguggagcgccuucacccgcugagccaccucacuggcuccacauuuuuuucuuuaaacaaauuaauaauuauaaggacccugugagauggcucagcacuuaaaagagcauauugcuuuuacagaggacccagguuugggucuuagaaaccacaucgugcuguaacuacaaugcucuaggagaggggcgggaggggagagccaaggcucuucucuuggccucugagggcaccugaaugcacauagacucaaaaugaauuuuuaagaaaaaaaaaaaaaaaaaaggccugcaguuuugaaaagccacugcagaaugcuguagagcuuagugucagccgggcugcauggugagugaagcccgggcacugccaggagacauggucuaagccccucccccuccuucccauuagaugaaagugacucuauccuuaaaaucacuguuggcaugccugccuuucagucccuuuagcucuuugaaugugauuauaauagccacucuguaguuugugugugagaaacccaacauucugagaccauuuauacuuuuuucuuuauuugcaugacaaaauauuuuguugagaacugagcauuuuagguaauauagugugacaauucugggcucuuauuuuuaccuccuaaagacugcuguugcuuuguuuauuugucuuaauuccuggagcgaaccuguccaaucugcuuuuccuacaacacggagcccgagucuucacuguucuucuucuucuucuucuucuucuucuucuucuucuucuucuucuucuucuucuucuucuucuucuucuucuucuucuucuucuucuucuucuuccuccuccuccuccuccuccucuuccuccuccuucuuccucuucucccucuucucccuccucuuccucuuccucuuccucuuccucuuccucuuccucuccuccuccuccuccucuuccucuuccucuuccucuuccucuuccucuuccucuccuccuccuccuccuccuccuccuccuccuccuccuccuccuccuccuccuccauuugcuacugcuuuucaagccuuguuuccuagagaccucucaagugucugccuggcuuuguuuuggccaaagaugggguagaaguuguccuccaaacccuugagccagugagguuuccucucucgguuuguggugggguucaagccucccaggcuuucagucaucaccagggucucucggguuuccugugcacguguguacagguuuuccugcugagggccguugggugauggugcacagguuuucagacccuucucugucucauucccaggauucucuguaaaguaucaggccaggacuggugagauggcucugguaacaaagaugcucauauguaaaccuggcgaccagaguaucauccccggagcccacauaaagauggggaaaaaaaccaaaaaccggccucaacaagguuguucucugauuucuacacaugugccauggcauaagugugcauacacacaguauacacacaacaucaacaacaacagaagucuuaaaaaaaaagucuagucagccagucuguugcuugcugcacagucuagcauugugauuggccuuccugcuauugacaauauaccugacaugcuccaacuucaggggggccucugacugaggcaauaaagcagcucuguggauagccugcagcauugccuggcgagcugccuccauuggaacuggggccucggggauugggaacaggaucagagucccgccuucucacccaaagcauagucauuuccugugugccuuugaucagucuucagagugacaaaaugguuguuucugacgcuuguguccaucuugcgaguugucuggggacuaagauuggcuguucucauuuugucugaaguccugagcaagucuggggaauucccggccugugccauuucuacacugcuuuccccacugugcuccuggagucucugccuggagcucugacuaguugugccggggccuucccuccuuguauuaaccuuucuucaggcuccccaucucuuugucucccuccauugccucuugguguugacacuuuauuaauauuucuuuuauuauuucuuggguacuauuaacuuauaagaugagcuugaaauuucacugaggguuuuuuuuuuuaauuuuuagaaauuucuuggcguuccuuuucaagucuuuauauccaccccaagccagcuuuuuguuuuugcugauauuuuuuuaacuuugugggguugguuuuguuugguuugguuugucguuguuuucugggcagggucucauguaacucaggcuugcauagaacucagcuguaguggaagaugucccugaaguguugauccuccugccuccaccucugaggugcugggacugcaauaauucaccuagucuuaucauuuaaauuauaaacucuuaaacauagauuaauacugggugcaauauagccuuaguacuuaagagaaugaggcagaaagaugguuugagccuagcauuuaugggcuauccugggcaaaauagagagacaacauuauuuagucaggcauuguggugcacacacauuggagguagaugcaggagcaucaggaauucaaggccaguguuggcuccacugugaauucaaagccaggcggguacguacaggagacccuguuuaauaacaacaaacaaggaacucaaaaccaaaaccacaacaaaauucaaaacaaagccaaacaaacaaacaacaacaacaacaaaacaacaaaagcccucauaaucaccaagcacaaugugguuuaaaggagauuuucuuagagcuaagguaacauuagcugcuauaacuggaugacuuaguccaguaaugacuucguucuuuuuuuaugccaugguuugaauuaguuacccauggcuacaugauggauugcccaaacaaagagccuuaaaugaucugcugcuuucugugggccaguucucuuggguacaccuuagccugugcaucuggguuuggugucccacaaggcugccugcagucgaggugaugagcaggcugcaguuauagcacagccuuaaagacuugcuuguaugcauacccacgaggcuguugagaaaccucagcccuccguggcuuauugggcagcgauaagaguuguaccuccuuuguagcaaugguagagagagguugcugggguuggggugggaguagggggcgcagagagacagaaacuaaggugggagccacuuugucugcuacauuuuauucuuuagaaguggaccaccagaucuagcccaccuuccagaggaaguaugugucauuaaggguguuauuaacagguagacaaggcuaccuugucuuggauauagacgagguuaccuccucuucaaugugguuuccucaaggagaggccagagcagcuucagugaggcgucaucuccugggauacauucugugguuguuucuguuggaacauuccugauccgagacugcuccauguuaauuuuuaaucugggccaugcaagcccuugcacacccaguccugagacugcuggaaggcugguuugcgugugcagauucacggaggauuugucucccuuccucucagccacagacugacuuccuugucaugggcuuguggugaugacugaucuuucuucuucuucuucuucuuuuuuuagucuccauuaucauuaagguuuaugaagguucucauuucugcaucucauuugggcuucgcacaggcccaaagccucacuccugcaccagagugggugguaaaacguaaaccuuuggcugccgagaccaguagccccugccuccaccaggcuguuugcagcaucggcacacacaguucauauucugauuucccaggcuccucucugcauugguccccuggggacugaucucucgcuuuucuugugagcucagcuaugcauauaaaacaacauugguuauguuuaagccaaugucguggucugaaaucagagacauuuccaaagguuagguaaaacgaauaccguccuuuggguguccagaauuacugcucggccuccagcuggacccaccaacucuagcauggacaauuuccaauuagauucagacaaaggauuuuccucuccgugcgaaaacagcuuguggcucugacucagguugaaggcagacugaggaucuuauuucccaagaggacucuaacucuccugcaaguggguauggggagaaauagaguggaguccaccuggggaagaacgggaauauccacaggaaaaaugcuaucauuugauauucauaaguaguacggaucagcucauggagucuuuaugugccugugguuucccuggguccugucucaugauugggaccgagucacuucuuggccaguucuuuuggaagaugguagcugcuuucucucccucucucuauccccucugucugcuucggauggaguucuuucugcgaauaccugcggguggaauuuuaagggcuugguaccaccuggcaaagagaggccucucuuuccgaggggucuugucaacaugauuccaagacacucucgcuucuuauaggcuucgccaauguuuacugagcaccuacugugugccucacgcuuuacacacagaagagggcuggaguuuguuugcauggcuuugggauuuaagagauucguguuauuuuggaggccccaacaacuccagccaagaacacccuugaccaggguuagaucagcuccucugugcuccgggcagaacucuuugggcuggauaguugcagcagggagccccgcaaggcugggaaggacaguuaguugaguuccugccuuuuaggaguuacccuggcacccugcuguccuuggugcucuggagagaaggacugagccaggcacugggauaccgggagagccgaugccgagaacuuccaugcuacagacucuaggaucugcacaguauucagacuucugcaccccggcaaccaaguuguuuugggaaaaaccacaggaaguccaaaagauagaaccacaguccugugucauuccuugggucuacccaagagcuaccagguagacuuacuaggacuguggucuggggauguaaaaaucuggggccuucauuuuucucagaauacuucagcgauuuugguucuaaguagcaaaagcagagagcaacaacggcaccucaagggcagguuaucucaagggcagguuccgagagcuccucagagacucugaggaccagccagcuucacaggggauccaagacauaagcuguggcaauucaguuuuccugcccaccagaugggcauccuuggacaguuucuuugcuucccugagcugauagaugaggcuggagaugccugcuguaauugagcagagucuagugagaucccauacggcugaggagauggaguuagggaaacacugagcuguguucugcuuagggacucuuucagguuugucacuacaggucauuguagugacaugaaucuuuccagggaaagcucacaaaugcccuugcuguuguagugccccuggaauguuuuggagaacuucauccaggacuuuguccaguggccucugcauaaccaucagccaggggcuugcucuugggcucaguggugacagugguaguccuuaugagccaccugaccuguguccaccagguaggcccugggacauccauaugccacggaggguuuacgcugggccagccucugcuccaaaugccuugugugucuauuuuaauucucucggcagcccuaagcuagcgcccuuagcacucccacuaggcaggugagcaagcugaagcccccagauuuuuacacccccagaccacacuccucgaaagugguggaugcugaguccagguugagucuacacuguaucucaugcaggaagcuccaugcuuuggccgaguggaagcccaaggucaaguucacacccaugaugcuuuggcuuuguaccugugcugugcuauuggcauauucaugaugcugggaacagggcaguggccagccauuaugagagccauagugaguaggcguguauagcagggaguggcuugggacacuuguaggacacuuugcuccauuaccuguccuuaucuaccugcccuuugccaaagaucuuucuacuauugcuuucaaucaguucauagccaaggaugggggugagaaccugugaucccaucgacuggggaggcugaggcaggagugcccugaguucugcugcccaccuggcuggcaaugagcucggucuuagaaaaaacaacauacaaaaccaaaacgaagucauaacaaaaagcguucacuccugcagucugcucuacaccggaagccggccgggaggauggauguuaguuccuguuucccuccaccaggguccagugagagaagagugaggcccggaacuagguggaggucuccagucuagcuagcguacagcaucccugaagggagggguagguuggaguuuguguguccaggggaugaauggcccagagaagcccuaaggcaggcucggagaaccuccugucuccaaguggagaaggguugcacagagucgcagcuaccguagaccuaggugcucuccaaagcaaagcuccuaguugacccuauccuaucucagcaucucaauaaagguccuccugguccccuccucagcuaagcgaagaguuuaaccagcagcuggaggccgugugcggguccguguuuggggagcuugagucccaggccguggacgcccuggaccugcccggcuguuuccgcaugcggagccacagcuaccuccgggccauccaggccggcugcucucaagacgacgacugccuaccccuccuugcugccccugccucugucucagggaggcccggcuccugugaguauguccucuguuugccucugaccgccaguugcacccaucgcuucucucucuggguaggauuagucgggaggaaugguccuuggccaaaggguccuguguaccacguggguguggcuguguggggaugaugggcgacucucugcaucccgguccgcagccuucaacuucagaaaggccccgccccccaucccgccgggaagccaggccccaccccgcaucuccaucaccgcccagagcagcaccgacucugcccacgagagcuucaccgcagcagagggcccggcccggcgcugcagcuccgcggacgggcuggacggccccaccaugggcgcacgcacccucgaguuggcaccggugccaccccgagccagucccaagccccccacacucaucaucaagaccaucccuggccgggaggagcugcggagcuuggcacgacagcggaaguggcggccguccauuggggugcagguauaguuggcaguaauaggcucuggcucuaugucguugggaauggauggagggaaaucaaaagggacuaaugcauacacagaccuuaacaaacaaauuucccugggcuguaaguggacccaucuuccucauugauagacgagguuugucucuaaauagcccaucguccuucccuggguaucauuuguuugggauuugccagcuagcuugguaccuagccacuucuggccauucuaguucuauguggaccauuuguuucuuuggcuagccacagccacugacgccuccacccugccaccagguggagacaaucucagacucggacaccgagaacaggagucgaagagaauuccacuccauuggcguucagguggaagaggacaagagguaggucagagugugucucucgggugucguugggguuugagggugaagggaagccagggcuguguaaagugcaacgucuuugcuggccugcuguuuuugcucgggcuauuuaucuagaagugagaguguguguguguguguguguguguguguguguguguguguguguauguguguguguguguguguguguguguguguguguguguauuuguguagguaccaaugcuggagauuuucaggaguugcucucaccuuccgcaaugauuucgcagcaagagcuucuauacucugugccaucucacuagccuaccucguuuucuugagacacgguuccuccaugacuugauauucaccaaucaggcuagacuggcuggccacugagucccaggaguccuccugccucacucagccuucccagugcugggauuacaaguccaugccaccauacuuggcuucuuuauguguguguguguggggggggggggggaagaaaaccuagguccuggcgcuugugugagaaacuuuuccacggagcucucuccccacacuuuccuacuggggaggagucaggggagauaugugucauacacugauguugccacgguagccaucaagucuauguugagugcuugaacuccugccaacccagaggaucagaggcugcaggagagauaugguggucaggggaacgaagagggcuggagggggcggggggggggaggaugggggcgggggggggggaggaugggcguggguggguuauagguuggugcugagcaggccuccggcaauuguccuuuagccggagauaacaggauucugccagucccuuguuacauccugugguguacaggaguaugagcucaaaagaaacaaacaaacaggaagauugccucuccugggucccuggcaguuacaacacuccuccucacuuggcucgcacaagcauuuaaccagcaggggguaccuauuaugugccugaauugguggugaaucagagauacuagaauugccagcagccacuauucuggcauuagguggccuccgaaacaucaccuccuuaauuuccaggugaagaauuaacauugugagcuccggagggaguccuggaaagaguccucucugcuuugggagggagcccguagggagauauuuucucuaaugaccagguggcagugccacuguggcccuacauguccucugggcugcaaugacaccaggcuggcaggcuggaguauuguggcugggaaccuucuuggcacuggcucugcaggcuucaugguaaugggagauaucaaggccauacccauggcaggaaggaaccuggagccuggguagcaguucuucauaguuguucgcaggcaccauuauagggcuuucuaacccucccaggguuauuacagcuucugagaccccuugaaguggcuuuguuugagcgccuggucaagucuuaggguucuuuggggagucuccguuucuguccucucuuacuauuguagcuccacgaagcacagcgugcuccugagaugcuggaguggcaaaagccacccaguugccugaccuauuccugcagccacuguucuccaaacccuuaacaugccauuaaaaaaaaaauggaacaguggcucugcauggcaaagcccaucaaaccaugguuugaauccuugagaggaguaagagucauggauggagacaguuccgugcuccacacucucuccugaauugccagcagccacuguggguuccuuaaaagcaacccacacaucuucacugguucucuggaaggccauuggauuccucauccgagaccugccacggugcagcgggccuuugaugagcgcccggccauucacugaugacgucacucggccgaugauuacugggccuuggcaucugacagcuccugggcugggaacugucaaaggcagggauuuuguccauagaacuuacaggcuagagggaagucaagacaguaaauaaaccaugauuaaaaccgggauucuaugcaaugggguaaagcguaagaggagcuacaaaagaaaaagaggggauaaagugaacuuagagcagcaggagaggggcgcauuggguugcugcugagggugagcauacagggagaugggauagcauacgaggaggugggauagcauaugggaaggugggauagcauacagggagaugggauagcauacggggagauggaauaacauacguggagguggaaacacucaggcacguguugggaucugugggaaaggucaugugaccaguguggaggggcugggcagugcugagagagaguugguuaaugccugggccagguuuuacagggcacaggcuaaaagaacugaacucuaauuauaaguaaugaguagcuguuaaaagguuaaaggaauggcccgacacccuuuaauuuauguuuacaaaagagcauuaacuacugaguggaggguuuuuuuuucuuucuuccuuucucucuuuuuuaaaagauaaggucucauauauaccuagcuggccuagaucucauguagcugaggcuaacccugagccucugauaccccugccuucaauuuccaaauacuggaauuauaggugugucucaccacaucaggaccagcauuaaauggagaaugagucugaggaagaaauagaagaaaugaaguuaaccagggugacucucaugaugcagggggcugcuggugggugguguuugaacucugguggcuuuuacagcaggccuuucuccuguaguguuuauaacuggccagugauaguguuugugagcuauuaaguuuuggauauuuauuuuguauucagcaaucuugcugguccuuuaucaaaucucagguuaucugguaauugcgauggauuuuucuauacaguuauuuauuuucaagugaggauauuuauuucaaaucugaauccuaaauuuuauuuuucuuugcuggacaugauaaugcauuuucuuuaaucccagcacaugggaagcagagacaagcagauucuaccuuuguuaguucaaggcuagccucaccuacguuguacauuccagaucaggcagugguacagaguaagacauuucuuaaauuuuuucucauaauaaugugccauauaggacuucagcucccuguugagugguggugggcucaucccauuccugauuuauuuguguguuuauguguggcagucauaggauaaccugcaagguuugguucucuccugccauguuguggguuccaaagaucaagugucagacucagcaaaaagagccuuuaccuacugagccaucucacugggcccaagauauacuuuauuuuuguuuaauauguaaggguguuuugccuacuuauauauccauauaccgugugcaugcaggaucccuagaggccagaagaaggugucagaucccagaacuguaguuacaaaugguuguaagcugccaucuagaugcugagaaucaaaccugggucuuuuggagaacaaccaguguucuuaaccauugacccaucucuccagcccccaagauagacuucuaaagauaacauuuguuauaaacuuugauugguaucauuuuuguuuuauuuaggaauucucuccuauuccuacucuauuaaggguuucuaaaaaugaaaacacuuuacccccuccccccacagcauuguuuuuuuuuuuuucuggugcugggacucaagucuaaggcuuugcacaaguuagacaagagcucuaccauugagcuacaucuucaucuucauuuuuaaaauauaagauccggguagaauuuaauugaauguugagagucuacugagauuaucuuagacuuucuuuuccuauauggaaugugauguaacagaugaauacauuuuccauguuggucuaaucuuucaaacuugggauaaucucugcuuaauccaaucaugugcuuagauuaaauuuggcuuuacaggguuucaguagugucauaagcaaguguauuucuugcuuugaaaaagcuagucuugacauaggcaaugcagugucaggaccccuaggcuccuucucauuuccugcucuuccaccuucuuguaugaguuaagagccaaaaaaaaaaggaguguaguucaaaaauuauauuuacugcaucuguagucuuagcaguugaaaggaggguagaaagagaaggaugcugucuucuuuuauaaaaagacuuccuggaaauuacagcaccuucacuuaaaucauauuuacuauaagcacaucacaugggggaaccuagcugcaagagaggcugugaaguauagucuaacccaugaggcacacagcuaacaaucaggcggggggggggggguguuuggccaaagacaaaaccaaaaauggauauauggaguccuagcaguuuuaaaagucaguuuugcuguauuuuauguguguguguguguguguguauguguguguguguguguguguguguguguguguguauaauagucaaagacuauuuauuccuugaagauuuuuauauacauucuuuuuagauauuaucucauguagugcagguuguccuugaacucugauccugcuucuauuucucaggugcuaggguuacaggagugugccaccaugcugugccauaauuuuguuuuauuuguuauucaguuuagauaucaagcucaugcuaggcuucuaacaugaguuugauagauuucucuguguuguucuuagaaacaguuuuauaaagcagggugaucuuuuucuuaaggguuagcaaaagucgcccauuaaaaacuuucuauucuaguaucuuuuggggauugaagaaaauuuuaaacuaucuuuaguuuguuuagugguuauuaaucaagucugguuucauuuuuuuucuucuucuugagucaguauuuuuaaaccauuguauaaaaauggagaguuuacaaauuuuugggcauaaaauaauccuuucucgcccuguuauaaugcuauaaauauacacucuuucucuagguuguuuuuauuuauuuauuuuuugcauucauaauaccauguugucuuaguuacuguucuauugcagugaagagacaccaugaucaagacaacuuauaaaggaagacauuuaauuaugggcuugcuuacagauucagaggguuaguccuugagcaucauggcagggagcauggcaaacgcagguaggcuagccugcauggugcuagagcagugcaguaguugagagcuuuacaucuugaucugaaggcagcaggaagagagacagucagaccgccuggugugaacuuuggaaccucaaagcccaccccuggugacacaccuccucuaauaaggccacaccuccuaauccuucuaaaacaguuccacuaacuggggaccaaguacucagacauaugacccuaugagggucacucucauccaaaccacuacaugucuuuaugcgugaccucucuuucuuggucagcuuuguauuuuuuuuuucaguucaacauguuuuuaaguauucuuauuaguuuuugaaccuugucuuuuacuuugggugagaaguauuuccuacuucuuaauuugugaugagagagagggacagagggagggagggagaggaagggagggagacagauugacuaauguaaucccagcuaccuggguguggagccaaggaugauguugaucccucugacuccacucccaaggguugaauugcaggcacaugccaccaugccugccuuuuaaugagugauuucauugcucuaaaaucccaucuaacucuacuguuauuguuggaucuucuaaguguuccaauuuaguaucuuuuauugcucaguuuuaaauaguuuauaacuuucauaauuauuuucuccuuucuuuucuuuuucuuucuuuccuuuccuuuccuuccuuccucucuucuuucuuucuuucuuucuuucuuucuuucuuucuuucuuucuuucuuucuuuccuuccuuccuucuuuccuucccuucuuccuccuccuccuccuccuccucuuauuuguuguuguuuauuuuaauuuuuuuugagacaggguuucucuguauagcccuggcuguucuggaacucacucuguagaccaggcugaauucagaauucacagagaaucuaccugccucugccucccaaaugcugggauuaaagguaugcaccaccaccaggcacauaauuucuauuuuuaccaguguauuauuuagaaguuuacuaucuuuauuuucugaauguauuuuuuagagggaggaagcauauauucucauuauuaauuucugaauuuccuagauguggccauuguauguguucuuucacucuuuagauuauuuccuuuuuaaaaaacauauauuaauaaaccaggcagugguggcgcacgccuuuaaucccagcgcuugggaggcagaggcagguggcuuucugaguucgaggccacccuggccucagagugaguuccagaccagccagagcuacacagagaaacccugccucgaaaacaaacaaacaaacaaacaaacaaacaaacauaaauuuauuuauuauauguaaguacacuguagcugucuucagacaucccagaagagggcaucagaucucagaucucauuacucaugguugugagccaccaugugguugcugggauuugaacucaggacauucggaagaacauucagugcucuuaccugcugagccaucucuccaguccagauuguuuccuuuuaaauauuuauuuuuuuaaaguuuaucacuuuauuuuauguauauggguguuuugccugcauguauaucugugcaccacauacaugcagugccuuuggaggccagaagaggccguuugaacccaugggacuggaguuacauaggugcugggaauugaaccuggguccucuggaggagcagcccgugcuccucagugcagagccaucucuccagcccaguuucuuagauuauugagaucuucuccuucaugcauacacacauauaauagauguauauuuuguauguguuagauaucucauauaugauuagacuuauaaaucauaacuuccagaugguuaucucccauuuucuugauauguuuaauucacaaguucaggcagagaaguguguagacaugucucucacaggcugagcaugauggaguccaagccagacaguucucugugaguuggaggccagcuugguuugcauagccagaucuagaccauccagagcuauauaaugugacccuguuucaaaaagaaaggaagaaaaacagauucacagaaguauuccaggaauuugaagcuagcccagaaaagauagugagauccauauuuaaaaaaaaaaaaaaaaaaaggcagaagcagguggauuucugugaguuuggggccagccuaguuuucauagcaaguaccaggccauccaggguaacauagggagacacugucucaaaauacaaucuauaaauccgguucauaauacuuacuugcaauuuucucuagcaccacacuuagucagugguccccuguagauguaaacgagagcuuuggaaugcuuuauuuaguggagauuuucuuggggggugggggucuguucagagaaagggcuaaucucaaacgcaugcuccuccugggucagccuccgguccgcugggguuauaggcacgccuaccacccaucuuagcucccucuugcuagccugcgugcaugcuuauguagcauuuugaucacaccucuucaaagggcuguguuaaucagccguucugugcuuuguggucuaauaguguagauuuacagacgcgucugagcgucugacucuugugcucagucgguuacugcccacuccuuccucagguuccauccccuccucgcuggggaacuacuugagcgcuagaucccuuugaaaaugaacaucucagcuugaaguuucuguguguuccccgguagaacacacuggaaccccacaucccauacaaaacagcuuucauguucugcucccccugcaucccgcuuccaggcugccuucccgagaaacaucagcaucagguuuuccuucgucugcguuuauaaacaaagcugaccucuuuggcuguuggcuuuacgcaggaaaucuccuuccaguuccccguggaucauagguuuggggucucuccucucucccucccuuccagccuucagcauaugucuggcuugauccuccugcgguucacuuggcuucgaaauccacucacugcccagguuucaagucugcuuuguauuucuggagcccgaagcugucucccauuuuccagccuggcaugggagcagaaacgccauuucugauuuuauuuuauccaggucuucuagguguuuggcuguggaugggugcuuccucuauucccuauccuguauugaucagucauuuccaugaggcugauagcagccaagccagggagaaguuggaccaaguggagcaguugaaaggcaaggggaagcugggcugacagggaaugugguaaggucuugguggugaguguaggggaggggagaugcugaaaaacugagccucggguacaggugaccacacugggaauuuagagggagugacagguggggacagggcaaaccuggcccaucucccuggucagccuucuuugcuugucugcagaaggcauccuuucuuauacaccggcacagcucuugccaucccuucugcccugguacuuuacauucugacucaccacacaccacgccccaacugcuaccuagaggugagccguggaguccagugaacccacuguccauuguacuaauuuuuaaaucucaauuagggguuucuacccugccuuugaucauucaguucucagauuaaaaaaaaacacacacacacacaaaacuuuuauauuuauaauaagccuuuaaucagcacuagagcugggcagauaucuacccucugugcgauucugucuacuucccugccaauaaucccaggaucugacuugccauagucugucugggccucucuuauucacacugguaagcccucaugacugauucucaugaucauuuaccucuuggugucuuuucuucuuuccaccuuccucucucuccauucuugguccuccucagacccccagcccuggauccgaaaccccgccuaccucucuagagcccagcuauaagcugauggcaucuuuauucaaccaauaguuuuaaauuaaggagcaaggucaccuagcgucacuuggugugaggauucucuucucucugugggcaaccagaccuugggggucagucuuuaccaugacaauagaaacagaccaaaccucaacaacugccgcccauuuuucugcucgcuagccuguacuuugguuuuaaaaaaacggcagggcaucgccagcgagagggcugccugcuaucaaaucucacagcccgagccuagucccuggaacccaugauggaaggggaggaccaacuccugcaagcucucucacgaucuccauauuugcgcugcggcacacacccaugcacagagcgaacaaacucauaaauguaaagccggugccugucagcgugcucugaguuagcugcuuggguggaguucggguguacugccccuucuuucugaggcucgucuguggaugcuuucagaugcccaucaucagugagacugaacuuuccagucccaucgccucuaccccucaucccugcuuaccugcuuacgggguccuuguuacacuuacuugucaaguacuguguagguaccaggcuacugagaugaacagcgcgagacugacccccacccccgccccgacccuuugaggcuuagccucggagucaucugagacucucacagaaaacagaauuagcuuuuccuacugccccuguuuucccagccccagccuccuggacuacaaaaaaaaaaaaaaaaaaaaaaaacguacagcguaugcagaaaagccuuccucagacccacgggaccaaagaaaaggugaucuuguuguuguuuuagauguuuagaaauauggugucaugaagcaaaggcagguggaucucuucuaauuuaagacugguauagcauuuuaccuugccuguauuagccaccccaccccaccccccguuacacucguuuguccuucauccuggucccuuuucuuuuucuaaacugucuccauucugauuuugugucauauguauccauguguguauguauauauuuaaaucauguuccauauaugagagaaugugggauuucaccuuuuucuuuuucucugguucauugagacaggguuuuucuguguagcccuagcuguccuggaacucacuuuguagaauaggcuggccucgaacucacagaguucugccuacaucuaccuguacuugggacuaaaggugugugccaccauagcugcccagcuugggauauuugccuuuuauuucuacuauucuuucuuauuuccuuguuuuucuuucuuuaaaucccuccccugccucuccccuacauaguuucccuucuacccccuugucuccaucucucugucucugucucucucugcuucugucucucugugucugucugucugucugucugucugucucccucucucugugucacacacacacacacacacacacacacacacacacacacaccccuagauucugcaucugaaaaaaacagagcuauuuugugagucugacuuauuuugcgagucugauuuauuuggcuuaacaugaugaugucccucuccuguaaaugucacaauuucacucuucuucaugacuguccagagagguucuuaacugacccugugaugucuaagucugucuugcugcauccuggcuugaagucuuggcugcucucucagagacgagcuacuucuccagagacuggugcgcugacauguccccauucccccuccccugcccacuccucucccacccccgacuuccugcugccaaacacuccuggcaaaacccuugccaguuuguggguacugaauguucccugaauacuaugucucuugggguaauccaauuucuguccagagagccacagaagggacaacucccugaaguagccaugauaacgauuuccaggcuucaguuccacaugaguggaaaaugacagcagaagccaguuccuaccuggugcuuacagcugcugaagaccacagccaugacuaucaaaguccaaacccaaauggggauguaaguucugcauuucaagaccuugaaaauucauacuauuucuaggauuagguuugggcaugaauuauagaaaauccaugaaagacagcgacuuccauaaggcagaaguugcuugcuugcuuacuugcuuagguauccacagggucagagcccaggcuguuucuggcauauuccuuucuccacaugguagcucauguucuaaaauagucccuugaggucuagucauugagucuacauuauagucauuaaggagaaggaaggcaacaacaacaaaaagguuauaauaaccucccccuccccgcacacuguguguguguguguguguguguguguguguguguguguguguagguuagaggauggcuugugaguugguucucuccuuccacugcaugaggcucagagacggaacuccuacgguugggcauggugcagguuccuuuacccaccgagccauccugcugcccuuuacccuacuuuuaaccacacuuuccuuauuauggccuugugcacguuaggcaaaguucucucccacugaacuacaugcccagcccaacacuuuguuucgaagaacacuuucuagaaguuggacauaauaguucugcucacaucccaugggcuagaacuuugccgcaccauguaagugaugagggagcuugggaaaugaauuguuaucccaagaggccaccuguccagcuuaaaaucaugggauccuguuacugaggaagagagggagaauagacguuggggauaauuaguacuccccacacccuagcagccaaccaacccaucagccgcccagccaacauugauguuugaggaacugcucuauuuagugagagagacggauaugcaaauaacggacucgggugccaugugacagggaggauaaaggagguuuuguuccgagggcugcgggagaacagauggaaaugaucaacagcaaucagaauaauuaaugacuacaaugcccgagcuggggcccacagcacuacgcugggcuauuguguuccgcaggcuccuuuucuccgcagcagcgagagccacaaacuucccugcaucuccacaauggcucgcacaauggcgggccaggugcuggcccuucuucccauccauuaucucgcagcacccuagagcugcuacugcugucaaucucacuuaaacgaugacaggcuccagccguccagcuggcuuuggagccgggcagucuggcucuagagcacccagauuuaaccccuccagcugacacccccagccccaaaagcucacucuccucccucuucugaccccccccccaaaauccccagcagguagcuuccucacacacuucauugugaugaccgcagccaucuuccaggacuuguguccacguccacacuagcgccuaccuugcuuguaccucuucucucuucuuagccaucagcccugccuccauggucaggcaacugauugcugcucucuuccuaaguauaggguagccugggguggggugcagugaccugagguggccucugcauggauugggucacugucccaucucaggaaaucacuuugccuguuaaggguagcuuuucucaucugugaguagggauggugcugacacccugaugcuuggccugauuguaaauucgcucccacugaacuacugauuaauuuagcacauacuaagugcucagaaaauguuaauuguuauccuccccaacuuggacuguuucucuucucugagucauucgauuuaucuuuacccauuguguuuguuccccaucccugccaugauaggugaugauaaaauuauauauauaaugcaauguaauauauaauauaauuuauauuauaucuacaaugccuauaauaucuaucugugccuauaucuagauauccuacauuucuggggcucagaaguuguuccuagauuuaccugggcuaacaucaaaguguuagcaauacaaugucccuucuagaggaucaagaaagaagccauuuugaugcuuuuuacuguuuauucuccucuuuauuuuugugauguuggagacugaaccccgagcuucacacgugugcaugugaggcaagaagucuuccccugagccauauaccagaccuccauuuaucuccuuccugcgguuuucuuucuccaucuccuuccugcccuuccucucuuauuuaaaaugacccaugugauuaaucugcacccaucuggcacaucucucuccucucguugcuguuauaaaguaucuauuaaagcaacuuaaggaaggaagcguucucugugauuaggggacaugguccuuuaaggcagggaaggcagacagcaggggccugaggcgacuggccacacugcauccacagucaggaagccaagagacgaaugcccaaaauaacaagaugccuaaccggcuuucaguuugcuuaggauggcacuguccuuccucagugagacaccuccagaaguggccucacuggcgugcccagggguauucguccugagugagucugaaacccagacaguugacucuuaucaucaaauccggauaaucuaagauacucaucucaucucaggagccugaaccugggcaaguccacaaaacccccuuugccauggaagguagucuaccugccagggacuaagaaagggaccucuuggggcuagagagguggcucagugguuaagagcacugacuguucuuccagguucaauucccagcacccauguggaagcucaaaauugucuguaacuccaggggcuccaauauccccacacagaccuacaugcaggcaaaacacugaugcacaaaccccuucccuccaggaugucuacagagagccccacaaagcaagcucuccuccuucgauggacaucccucuuacugcugccagcuucucagagacaaucuucgaugagcuuguuuuauaauuaguuuccccuaccuccuggcagccgaugcagcccacacuggcucccacaucccacugaaccugcucuggcuguggccagcagagccuuggcuaaccuuuguuuccaaucagcugcuuacccuugcuggaagcuucuggaggccuuccuccccucugucugccuuuacauacuccuccuggcuuagugggguuuuuguuguuuuguuuuuuucugaaauuacauuuaucuauauguauguauacacacacauaugcacgugcaugugaaccuaugcaccauggaaugccagaggaggacuugaaggaguugauucucuucuuacacucugcgggaccuggggguuugaacucagguucuauggcuuggcagcaaacacuuucaccuacugagccaucucaguuucuccugacucugcccccucccuauccucucugggucauucuugcuauguauuguacuguguucaccuaccugugaaguguccagguguccuugggguuuuagaugcaauguucucuuauuaugaucuggucccacacuaaugccuaguucucaaggauggcuggcuccugccuguccugugcacuuuuagcuggggaugauaucugagggccaugcuucaccgagcacaguagcuucucagcucccucagccuaccuugggauauauggguugagaugguuuccugaggaggggggcuuagacccacaaagccuaguguauuugguguuucuguccuagauaguguggaguccgaugaguggaauccuuucaggacuucccagaggucagaugaaggcgucagaccaguggagcccaagagcauaguguguugaauggggaaugaccuuccagaggcaacuucaaggaggaaaacuuuacuuuggguuggaguuucagagagugcaggcugucacugggggcaggcaugaugacaggagucuguggcuuguuccuuuauugcagaucagggagcggagagcccaggccuguaucagaaauagaacagauaguccucaaggcccacggugcaguagcccauuucugccacuuaggucccaggucucaaaacuuccaccaccucccaaacauuguccacaguuggggaccaauuguucguacacaagagccugugggguuguuuaggacucaaaacucuuauagcaggagccagccagugguggcacacaccuuuaaucccagcacuagggaggcagaagcagguggaucuuugaggccagccuggucuacagagugaauuccaggacagccagagcuacacagagaaacuuugucucaaaaaaaaaaaaaaaaaaaaaaaacaaaaacaaacaaacaaaaacccaaaccagggcuggagagauggcucagugguuaagagcacugacugcucuuccagaggccuugaguucaauuuccagcaaccacaugguggcucacaaccaucuguaaugggaucugaugcccucuucuggugugucugaagauagcuacaguguacuuacauauauaaaauaaauaaauaaaucuuaaaaagcaaaaccaaacaaaaccaaacaaccaucaaaacaaccaaaacuuacagcagggaaacacguugagaugguaccucuucagaaauguaguuguugggaaaacauaucgugacccccaguguuggcaaacgcuggugcuuagaaggaacuagagggccaacuggaguucaaaagcacaaguauuccuagggaaccaagagaguauagccagccauaccuggcuguuaucagaaagagagacuaaucaaaauagugggguuguucuaaaugcaggaggacugcugaggggcugcagagcugacgagugaucuugagggcagucaggggcuugagcagagaaugucaggaagccagaaugaaaaaggccaucucaggcaggggaacucagagaagucgguggucaggauguaaucuauuuuaggggggucaaaggagaaagcagagaggaggcugaagauguggugcauccagagucaggucagggcuaacaccaaguuugagcuuuccccugcugguaguggggaggcauggggaaggguuuugagcaaggggaugacccaaaagagcuuacccuuaggaauacuggucugggcagggauugcucagcuccagauuuuuaacauacacaagauauuuagacaggaaauacauuggcaaggauuguccuauuccuacgggacauuaaaccacauuccuaugguuuuauauguguguauaugguauuugucauguauauguauuuauauauaguacauuuaaaaucggacuauuuguucuuuguccuggcuguccuggaacucacagauaccugccugcaucugccuccugaguugcugggguuaaagguguacaccaccacugggggcuacuugacuguauuuuacaugcaacuucauacauauuagauggccugcauggaaaacuucccuaaggcacagugacaaagccagcauuagaacucaggugugcucccuggucccggguaccuccuucccuuuugcuguccugaaugaaagcagagguaucugauaggagguagcccugggccaguagugaacaugaacggugcccagggcagauaccaaggugaagggcauaugggaagcaacggaaauauggguuuuuuuccucucucuggguggggguggggacauagggcucguuggagacugcacacgagcgagcgcaucucucuuuccugaguccugcagcauccuucugggucugguuucuauggcaacaggcucccagcaggcagccugccagcuggaaggaagcaggcaggcaggcuuggagagaaggccugggccacaggaggaagguugaaguuguagggguuggggggaggcugggagagucuccugggaaacuggacaggccccuggagaugucccauaggacccuggucuguuuugaccaugaggagguggagguagacaaagacccauggaccuuuucuuugagguucucuaauucccagacuauuucaacuucuguuccccuuugcccucccuacccgccaccuaacucccacuccuuaaagucuugucugccccccaccuucuguuucacaggggcucauugacuuccuugcagaaaaagagccccuacucugaacucagaguggguaaaaaugaacaaggccaauugacuuucuguuuugcauaggauuugcauauaauuaacuuaaagacaagaaacguucaggccccggugccaucccugccaacaacuuaauucagcuccacugccucuggcagacugucuggccaggcucugggcugagccauugggguccccaggggugaagucuccuccagcgcuguacgcccccaccauuccaagcugcucccaggcggcuucuuggagcuggugcagcccugggccacauccuggcucugccacucugaagcugggugaccugggacccucuuugagcuccauguacucauuauucugcagguccaggaaauaccguacagccagggcaaaccagccuagacaguguuucuagaauacucuauuguaagcuggguguggugagucaacacuuauaauaccaguacucgggaaguugaggcgggaggaucacugugugggauccauugugaguuccaggucaaccugggggaacacagggagaccuugucucaaaccagcaaaauuccaaacaaaagaaauaacaaaauguuucugaaugccuuggucaaaagcuaccaacaccagggccccaaagcuggggucuguaggucagugucugcgcugcuuggaguauuccagcaucucuucuggucauagguacaggcaguuaaauauuuugacugcuacuggcuguuuagugucagugcaaaaaguagguauaguggguaccuaccagcuccaaggauuuaauugguuuccuguguauggauugguggccacugauuuguagguuccucaucacaacagccuuccuuccauuuuugggggagggcuuggaguuuggauugaggguggugaccuggggugacuggagcaggagcagaaaugauaggcaucucccuccacaggcgggcgagguucaagcgcuccaacagcgugacagccggugugcaggcagaccuggagcuggagggccuggccggccuggccacuguggccacagaagacaaggcccugcaguucggacgcuccuuccagaggcacgccucugagccccagcccggcccucgggcccccaccuacucagucuuccgcacgguccacacacagggccagugggccuaccgcgagggcuacccacugccguaugagccgccggccaccgaugggucgccuggcccuaccccugucccagcccccggucccggguccggccgccgugauuccuggauggagcgggguucacguagccuccccgacucaggccgcacgucccccugcccacgggauggcgagugguucaucaagaugcugcgggcagagguggagaaacuggaacacuggugccagcagauggagcgugaggcggaggacuaugagcugcccgaggagagugaguccgcugccauccacacaggggagaggggcgcuggcauccugugcuggauagcgugggcaggcgcaggguaucaugaugguagcccuggcugcaaugcaccagcaggucccucccauucaugcuugguccuucagugcuagaacuugaaguucuuacugggaacaggacaucuuuagaggccaaggcuaggacuuaggaggaucaugaccaggccaaaagcuagauuuucuaguaggcagcuaccagucuaagucacuaacuccauggggaacaaucuguucaaaucugagcaaguguagcaauccagucuaagcuugacagugaggcugggaccacacgacagacauucugauuugagcuguuaagaugggacucucccaggggaugcugggauuccucagcgagugaggaauucagaggaggcaguucaagcaagaacgagucugaggaagaaaugggaggguuggcauggaagauagcccugucacaaacaguauaccccuucccuaugaguccacucugaagggagccauaggcuucccacagaaucccuaaccagagaugaaucaaaauuuuuaacaaaccaaggaggcauguacugauuagugacagaauacggccagugacugaccauugagcugauguucuggccagggcuggagggcuagacagggaacacaggugggaggccuuccuccuacagaaggaucggcacuugguaaaugcaggcuguguaauggaaggagcuucacugaggaugaaaguucucgagguggcuggauaggagcuguuguaggcaaguuugaguauaggaugggaagggggcuggaggagaugagccaguacacuagucaggaagugagcaucucaacuuccuggggaguuaggaaagagagaucucacccccgcccccagccccuugagccuccuucuguucuuuagucuuagagaagauucgcagugccgugggcaguacgcaacuucuccugucucagaagguccagcaguucuucaggcugugucagcaaagcuuggugagugucugugaggagagagugagguguguggaucugacaggugacccagcgugacugagagauaggaccaggucuguggacuuggaaggguggcuuauguguggcccaaagaacccaaaaaaagucagaugugacuuguuggaguacagagccucaagguugggcccguugugcccaggcuggagagacccuggcuuuuccuugucccuguugcccauuccucaacccauuucccuagacugagcauagcguucccugagccugccuggggucagaccucccugacuggcugccccccccccugugugucccaccacggcaggaccccacugcguucccugugcccaccuuccaggaccuggccgguuucugggaccuccugcagcucuccauugaggaugugacccucaaguuccuggaacuacaacaacucaaggccaacagcuggaaacuccuggagccgaaggugugcuugugggacccgucagaccaggaagccacacucuguaauguccuucucagaaagggguguguggguguggagaagucacagggaaacagacgcacgggcagcaggaacagcuuuagauaaaacagccaugcucccuggccauugcccugugcuugauccagcuguucacacugcugcacacuggccaccucugaccagcugcaauguggggaguagagcuagauuuucuaggcgauguucagccuucuacuggcuagacuuaugucugagaugagugucgcaggugagacuaggccagccccuggagcccuugacaaugcuccccacaaccccucagccggcauguaggugcuagcugaaaacggcuucaccagggggcgcucgagcccguuauucuuuggagaccgguacagggguuuugaccagcuuugaccucgugcgccugcaagccuccagucccagcgauguggccaauucuagacgcugucccauugggagacucacgaaauccaucccauggggaacuugcacgggggggagggcgggggacggggcgcaaguagggaugcugcggugcuccccgcggcucggcucagcucugcgcucucccgacaggaggagaagaaggucccuccgccgauaccaaagaagcccucgcgggggcggggcgugccggugaaggagcgcucccuggacucgguggaccggcagcggcaggaagcgcgcaagcggcuccuggcggccaagcgcgccgccucguuccgccacaguucggcuaccgagagcgcggacagcaucgagaucuacauccccgaggcccagaccaggcugugacccgcccgggccgcccaguccgacccgggcccgcgguuuucuacccguacuguacacccagcgucgaggucacugugaacgcgggcagcuccgugcgcccgcccugccggcaccgcacgccccggcuucugcccgccgcgcuuucguggguuuuuuaccuuccugaucccacgcaaaggcgcccgggcuaggcugggggucgugccucuccgcccugcgccccucacuuggaacucccaucuuccugguccgacgcuuugacccccucaccuuuuuccccccaugggcaccaucucugccauuauuuuaccccuccacgggccaggccgggccgggucccccaucugggcucugcgucccccccacaccccgcggggcugggcuucguggggaucaagcuucguggcuuuuuaugaagaaucccgaaccccgccuaggagcccgccccaccuucccagggcuccacccucagcccucugcccacagggcccagggaccacaguggcuggaccaauccaggaccagggcgccugggccucuccccuuucccacaucuggggaggggagacaggggcuuucccucaccacaccuguggcuguucccacaucccuuugaguaucccaggaaaaauaaaaccgcagaacugcaccggagcca

SEQ ID NO: 2130 - RNA, 8469 nt, Mus musculus
ggaagaucuaccuuguuagucauuggagcagguggcuuuuucccagaguuccaagucccaaaucuccaaguucugggucguugguuuagcucacgguucaggugggucuguacuuaguuccuugaaguaguaauagaagaauguaucuguaucagucuaggacuuuugaaaaauuguuccucucauuucuucuuguuucucuaacugccuuggaagcaagcugagaugcugucagguuaagccauaugaaauugacaguauugagcaguuguuuguuguuguuguuguuguguuuuuuaaccugcaaaaacagccauuccacacagcucaaucuauuaugaugccaauuugcagaagaggauguugaggcuugggaaaugcauugcaucucucacaaucacacauugccagacagugguagagaaacauucucacccaggucuuccauugacccaagaaacccagcuaggccacaauuagagaguaggacuuucuaguguguuuucccugacacuggaucacugcccuccacuucuguccacuauccccugagugcguguguggggucuacuucuguacccagcugucagugccuaaaagagagagaugagggagaagagaggagggaggggagggagagcuucgugaguuggcagugaaucagggucuaaaaagagagcugggagggcuaggguggcagguguuucuaaaaggaacgugaauacaggaugaacagccucaaaugcagcccccgcacuccccccacugccccacugaucuggcaggcagugcccacugcauuuugugccagggggcucacauccaaggaaugagcuugcaggaagcuauagaaugacaggcagaggaagaaccuuuacagucgacuugauccaaccucuuaauuacaaauuggggaaucugaaagagaggagaccuacucaaggucacccgauggaccuguggauuccuagacuaguguccccacagguaauuuccuaaccuucacauuccauccccaaacuccccaacccccucagagccgaaugugcaggcggguaggggaaaugaagacucaauaugucuaaggcugucaaucugucagccugggacucugcucugaauaaaggagguuacagguauuucuggggauggggauaccuggcagacccaccacagaggaaggucauggccuuggcuuaguucuagcuggcuaccagcgcugcucuaggcccaacuucagacuuccuucuuucuugaugccugcuuuuagcagcugccuggcguuuagcaucugcaucucuugcagcugauguuggugcuuuucuccccccucccccacaguuucccaugcauuuuugccucucacugggcuggcaauuuucccccccuuauugggcuucugcuggguagaaaaacuucugagucuugucugauugaaaaggguguguagcugccugaacccuuucuggcccagucuuccaggaguuuagagcaaaugguaaacauaauuggccucauuuuuacuggagaggaaacugcuguugaaugaggggcuuucuguuugguuucaggugacugaaauugaggugugugugugugugugugugugugugucugugugugugucugugugugugugugugugucugugugugugugugugucugugugugugugugugucugugugugucugugugugucuguguguguguguguguugggagagaguauaaucaugaagcuuauugagacaagcuauagagacuuucccagugucuuccuacccccauggucaagaagccuucucagacuuugauuuuacucccacuugggggagucaaagcuucguuucucagugggggguuggaagagcagcuguguacccuccacuccgcaagcaucaugucucaauucccucuuuaucuaccccccuucagucugaaggcugcuggcucagcgggccuccugccgucuggggagucuggguuugagcuggggugaggcgguggcaccaucguuaugguaacaagcugccagcucaucguugcuaauaacuuguugggccccugggcucagugcagcauccuuucccauuagcccuucuucccauguuacagacagaaaaagugaggcuuaggaaggaggggccugggaagaagagagucugagaaggcuggauggccuuuccccuggguuucuuugcuagggagccaugggcaaagagguaagguggcuugggagcugaguuacaaauguggucgcacagguuugauuucuugggugguuaaugugugacuagcuucaugcuuucauaaacuugugcaugcuagcugacauguucaugugcacauauaccgcagcccacaggcaaacacacuccaggcauccgagcacacuuguguaugaauacugccucucccaucugcacauaaggcacccaagaaaucuggguuuguggggguguccagguauguggguggggaucugaucuuuuucugaugcagcuucaaaguaucuuguuaacaaagggacagaaugggcccaggguucuucuuccuuccaguccagagcucaguaugggagugggcuggggguggugauacagggaauccaagcucucagcuuuccaagucuucugccuccgugcccuuugagcucagguagccccugccccccucccccugcucucuguucuuucucauccucuccucuuccuguguguaaauauuaaaaagcugagccugcagggcugauguagacauggggagagaaugaaauuaaaaaggauucccucgcccccaucccaacacccccgcccugcagucccccgcuccuguuucuuccccucucuuuuccccucacucaguaguuccacaugccucuccuccccccaguccagaugggagcuggcuccuucagaaaggggguucaggacaggguguggggagcuaccucuuccuuccuccucccagcacaucugccuacagggcugagagcccccacgugaguauuuauuuuauuuugggguggugguuaagaaggagaaugcuuuuuugaaccagcugugagugguauugagaggcucaagacugaaaggaggugggugggguccucucucuagcuucucccggucuggauuucuucucucuuuugagaccuucagggaagggagggaugugaggugugacaggggacuggagcaaaggugggaguuuuauggucagagcgguuuccuuggguaaagcuucuuucuugcugucugcgcuuuggaacccccccgcccccccugcaggguggcugugggaacuguccccagugcugaaugagccucagcagagaagcgcuccuuuggagcugucccggguacugaaaggguuuugagccguugacggaaaggugccugggcaguaguacugaggguucacuagaaaaauucucccaagugacccacuuuccaagggcagagucccuggauagaauuauaaauucugaggucauucuuaugaauucaggccucacaguuguuaguggcauuugguaaaaggacuuucuuuucccuguuugaguucgccuuccucuugccaaaaccuguuaguguggggcuaggaaggggcaaugcaaucguggccgugagcuuuauucuucugagaucauacuaguacaacaaacuuauggacccugggugagaacauaaguuucccuuugggucccagaaguucagacucaagacauuccgaguuugagucugacaggguagacuauaguggauggugcucaagaaaauugauuggccacuuggugccaaccugcuaaaccauaacuuuagauuugagaagaggaacccuaaaauauucugaaagucugcugugcucugcccauccccagcccuggcucaaugcaucauuugggagagacuuuuguuggggaggaagauuucucagcaaaggauucaaggagugggugggguuguucagugccauggagaagagaaggaggaggcuacuggagacagggcagcagggaaaaggaagaucugggggaguaaaaaaaauccaaauggaaggaggaguucuggauuccgacgcucaguuucucuggauagcuuuuccccuacugaccugcggucagggucaugugaaauaucuggguucuucugcuuugcuuuuguaaccacggagggaauagagcaaggaguuauauuucuccaggucccguuccuugucaucccagggggaugagagccaaaugucaggacaugcagaugagacagugugugggggaaacaacaggcaggagggguugauggcagcucaccucccauccccaagagcacaaucaaauauucaaaugggauccuucugagugggaggggcagggaacgguuuccagaggacucugggcagccauuggguguggcaggaaauucaagaugugagagagauuuccagaggucucaaacugaaccagucuccuucccuccccucauaggacuccggguuaaugaggggcccuucacccaucauguuuuugauguaacacaagaugauucccucuucuugagcugcuugagaggagcugauuuucguaugcuugugggugcugggagguggugggugugggugugggugccuguuuggggaggggagguguuugugcuccacucggcucccuugguuacauaacagcuuugauaaggcucuggagcugcugcuacugccugaagcagucaccccuccacccccucauggaaggcuugguguccacccccuucucccuggccccuuagagaguccugcuauucaugauccaguguucuagcaguugcuucucuuccaggagguguccgcaguuugccucucugucccuguguggcuccuguuuagaaacacuugcuuuuaugauuuucagcccgggucauccccuuuacguuucugagaguccuggucugccuucucccuugucagggcucucagacugauugucuugggaagcuggacaacauggaacuacuccgaagggaagaagaggggugucccaggaggcuucaggauacaaaguaguucauuuacuguucuuucucugccucagucucuguuucagaguuugggaguggagaaaccuacccagaagugucaggagaacuaucuuucccuuucuccuauaacuaagggaugcauguguggugguaggcugccucuuggacaguaugacuuauaccaacuuuauuguuaucuucacccaagaugucugagcagauacuguuuuugccgccaggcaugggacaaggggauuucaaaacauggcccggaguugggugugccuuguaacuaacaggaacagcuuugcaaauggagaggugggagccuugcaaguugcaaauaaauaaauaaauauaggaaauacaaggauggguuucagucuuuguggacaggguagagaagccugggggaugggggaagcuuccuguauuaugagugggucugugagacuuguguguguguuguguagcucugacuguccuggaacuuacucuguagacaggcuggccucgaacucagaaauccaccugccucugucucccaagugcugggauuaaaggcaugaaccaccaugccuggcuauguaugacuuuguauagauccauuuauacguuugacugugaaggcagcagaugggagugugaugugcucacccagcaauauagauguguggucauguguacaugaacaugaaugugagucuauguauguacuuauuuauaaauaaauacauacauauuuacugaaugauuuaggagcacaugaauauauguacauaagcuugauucauagagagagauagauauugaaguugacucaacauuggcucugucugaaaguuauuuuccgacuagcuugaauuugauccacucugaugucuguggcucuucuccagaaagcaggugucucuaauucccauguccuaagaagccagcuagugcccaucaccacucaugugaaggcaguuugcagagggaaaucuugaugacagcugugaaggagauccaguccugauguuguccagaugcugugauguuuagggguguuuguggggaaguguagaggagcaauaucaacacuacucuagagguuucaugaauuaagaacaaguugguagcagaagggggcaggagauauuaaggaggcccaguaugugcaugugugugugugugcccauacacggcauguagcaauguguguauuacuuaucuaugguaguauaugcacauauaacauaaguaugcuuucuaauaugcauaugaaaacaaaauuauauacacagauaugcccauaaauguuaacauacacacauaugugaacaguguauaugaacugucccaguauaugguggcuguggccuaauggcaacuuguagccauaaaucucuguauuucauguacucaauucuuuguguuuugagacagagucuuacucuguacuauaggauggcacagaacucagaauguaucccacaauggccuccgauucauggcaaaacuccugucucagcaucccgaguguugggauuacugguuugagccaucgugccuggcucauccaaggcugaugagggcuuaucugcagucccuguuccaucccacgugccuuaccuagggcacauaguuacccagucaaugucuagcuuaggcugacaacauucuacagauugcacuuggcacucgaugcuccugaacuuggagugacuugaagucuaaggaggaaauguggaggcaugugagccuagagggcaccaugaauccgaggagaaaguugggucagcucuggagugggagggaggaguuugacaaggacccaaagaaaguggaggggguggagccaaggcuuaaaagaagagugagcuuuugacaagugagcaacugagaggccuggcguuauggagcaagaaguguccaacugggcggugagaugguucaguggguaaaggcauuugacaccaaaccugaugaguucagacuccagaaccuacauggcugaaggaaagagcucccuuccucaggugcucugcccuccacacgcacgccgugcaugccacaagcgaguaaacaaauauacacguaaacaaaugaauaaaaacuauaaggaggaaaggucccagccugucucccacccuccacccuugcuccauagacucaggggcuggaauaggauaagacuauaccuccggcccacccccaucccccagcucccuucuucuuccccgucucuuucccagcccuuucugagacagggucucaaaucaagcuggccucagacacaccaacuagcagagaaugaccuuaaauuugagcuucccucugccucuacuucuugagugcuguaauuacaggcaugcaccaccaugauagauuuuagguaguguuggggggaccaaacccagggcuuucugcauccuaggcaagcgugucuccagccaugcucaugcuuucuaucucaccaggagccacauucggagugcauaguggguggggacagaguauuaagugugaaaccauuguccauugccucccuggucccaagaggcuuccuuuccaucccauagagaagcuggaaaguuccaccacgaggcuugaugcuuucccuuccccucagcccggagaugcucuuuuagacauucacgccauucccccucccuuucuucaaaucuuggcucaaaagucucucuucugcagaggccucccuccccagcagccuaacuuaaauagccucuugcugcucuacugccgcaccccaguuuauauauauauuuuaaaauuucacucgccaccaccauuaccucauaucuugguuucccaucucaccagaccauaaacuucccgggaaaugggagguucgucagccucgcucauuacguucuugacugcgcacaggaagcguaucuggcuuggagugaagcacucucaguuuauuuguaacagauuauaaagggaucacacacuagcugcugauaggaugaguggaucaaggugugaggcggggagacugguuugggaugcuguugugauagccuuggugagaagugaggacgaggguggccugauguaggguauuaaccauggaggaagaggagacuguucacaccuauacauguauguauacacacacauacacacacacacauacacgcacacacacacacauucgcacacgcacacacacagaggcacacacacacucgcgcacacacacagcgaaggcuaaggagggaaguagaaguguucgugcgugcgugugugugugugugugugugugugugugugugugucucgauguguguaugucacgaauaauacccccaugagaagcuggacacccuccagcuaacccuggcugccauucccccuuccuuuaggauuuugucacuaccaacccacauccgcccaccucugccagccaggcugcagagggcu

SEQ ID NO: 2131 - RNA, 4082 nt, Mus musculus
ccagugggcggggccucgggcgcgccccgcgggccacugggaaccucggcgucccuguugcucccggcuagcgggcgcagcgcgggaccuguccggggugugcgggcuggaccgcaggugaguucccagggcugagggcacuucgcuucccaggaucgcuggcccccagucccacgggaacggcuccuccuaguugagggagcgaugguuuccgugacccgcucggccucggccagcuuuugguggccgaguguggacuguggucagaucucguccgccucaggccccugcaggccgaagggugacgaagccacgcguguggcgugacuggacagggaacaggagcugaugacccgaaccucacuggcgcucccaucccaacuuggcuggcugucaaggcugaugguuucaccuucucggaccuccuacgacugcucucauuuggagagcuuccggugggcucaggcacugggacagguuuccuggcggcccgguugaccuguaccuggagccuuuggcuggcgccccugcgugucgggcuggaaauaggcguugcaguauuugggaaacacuugugcuacuuacauuuugauaccuucgggaugacuucaugaagucuagcugcuuaugaucauaucccuauaccccuuugugagugcggguggaaggcugcuguagucuuccauaaacaaagcaacauguuuaugcugccugucauucauucgaccaacaaacuuuuuuagcucuuugcuagggaggauagcaagggugggaagaggcacagagcauaggacgauccggacauccuuaguucuuaaccuuguggagcuccaggguguuuugagagcuguagacagguaggguaggcccacauagcuuaccgaagagaagguuguguuguauacauggaugacuggaauucggacaagagcacauagaacuugggcuuucuauguacaagaguaauacucauagacuggugcuugauaugcccgcccuaagacaaauuggaaaauugagagucucuacccaggaauuguauaaaggacuugcacuugguguggaccugugaucacaagcacuuggcacuggaaacaggagcgucggcagaucaaaguuauccuuagcuacuuugaggguuugaggccaggcugggugccaugagaaccugucuuaaaaauaaaaacaagcccaacggugguggcacaugucuuuaaucuuggcacuaaggaggcagaggcaggccaguccagucucugaguuugaggccagccuggucuacagaaggaaucugaauggcagggcuacacagggaaacccuaucucaaaaaaccaaaaccagcugaccaaacaaaccccaaaacuuaaaacagaaaauagaacgaaguacugaguuaaaaauagaauggaggauugaguuugggguucuuuggagcuuccccucuuuguuaauguguacauuguaagguuucucggaucucaugauauaacuucagagcucagaaggaaggaagacuuucaguguaaugaaaagccaagcuaauggggagcuguaggaggcccuccacacaucuagggugugaacggacaccaugcauacaucugcagaguguucuuucugcuagaaaaaaagcccaggcuuggccucagaccagcgggccugccacuuguaugauuuuggcaagcugacacagugucuuugagccacuauggccuuggacaagaaucugggcuccucguuccuacaucauagagaugugagggucaggcgaugaccaggggagauaugguagagcauagggcauggugucaggucaaaggagcaggaagagaaacuugaaucuugcugcaguucuuugccuuugaagguccauguguagugucaggcccacaagacacccaaguucccccaaagagaauaaaagggggaaaugaggagccuucaaaucuuccaugaggucuggaugucucaccguagagccgagagagagagagagagagagagagagagagagagagagagagagagagagagagguguuggagaaacaguuauggaagcauaaacacgggcaagugacuccaugcugaugacuaaggcgagcaugugaacauuggagaacacugugugugugaagugcuuagcccagggcccagcuuggaauaagcacucaguagauggugguagcuugcauuauuacauucauugccagcagccuuuuaugauuguaacgguaauuaaauaaugguauaaauaguaauuuaauagugguaaucauuugugacuaaguggccauuugaguguguagguuugcauauuacuuugguguuucauugcaggaggcccuaggggcagcucuacaguuuuuguuuuuguuuuuguuuuuguuuuuuuuuuacagcauuuuccacggggacuuuuuaaguauuaggguucuggggcaucuggaauacuguauucauuugugauguuuucagggacuugcuguguaagcaugaggaugugaaugguugcaggucguauauuuugaaguuguuuugaucaagauuuguuaacuauagguuauuauuaggaaagccaaggccagaauagaguuacaaaacaaaacaaaacccuauccaucuuaggucagaauaguuagguaauagaucauaguuaaauaaggcccuugugcuuucccccaggagaaggaacuacuuaucaucagggagccagaauucagagugaggcugugugaaguuuuauagagcagagaaaagacuucuuuucucuuccuaagauguugacagauaucuggaagagaggaccugaggucauaccagguuggaagagccauuaauuaggcuuggaguuuccuugugaggggcauaugcacacaguagcacuaguucguagagguuuuuacccccguccccaacagucgaaucuuuugcaacuucuuagaguauuucggggacccaacuguugcacagagcacaguggcugcuugcugcucugcaggguggcugcccaguuauuaguugccaggcugccugguaaguagagcaccuaugugcuguccgcacgugcuagaagaggaggcacccaugucucccuaacgcucucuguauucuucugcagaugucauguggccugugcuuuggaccguggugcgaaccuaugcccccuaugucaccuucccuguggccuuuguggucggggcugugggcuaccaccuggaaugguucaucaggggaaagacuccucagccuguggaggaggagaagagcauccuggagcgccgagaggaccgaaagcuggaugagaugcuaggcaaggaccacacucagguggugagccuuaaggacaagcuagaauuugccccuaaagcaguccugaacagaaaccguccagagaagaacuaauggagggcccaggucccuguggugcacagggauaugccauguccugccgccaugucgacccagcuucagaacacacaucugauuugcuuugcugcucacuccggcccccugagcacccacagccacucguguacuggcugguccuguauggcugcagagcggcagcaguaggggccagcaaugaggaagacugcgucugcucagugggcucucuccgugccuggacaggcuucugaucuuaccugggagcccugcagggaggagcccuggggaaugaaccuuggucucaggcucccggggaggggcuuggccucaacugggaaugguugggguuuaucguugccauuaggaggggcaccuccaugucuaguucucguuuuugcacugaaaagaauucaggaaugucccuggcucccuugaugaggcuuucuuauuuuccugugugcauucuucccuuuacuggcucaggcgugggauucucaggggaaggaaagcaugcuucucuuguggggagcucaggcuguuuaccucggggccagcggggcauaagccuggaaauaaucacugucuuccacccuuccucacuggaguggggacucaauuaaaguggcaccuggcacauacugauggaguccugcucucuggauggggucuggguucuccucggaguuagugca

SEQ ID NO: 2132 - RNA, 5615 nt, Mus musculus
auuguauaaaacacaacuuuauugcuuuuaaggaaacggacuuggauaugucaaggauauacgccggggauaugacaggauacgcaugccuccaagguccuggcuacagggugcagagggcucagcacccuggugggagggagaagguagagguuggcaaagggggauugagagggacccgugggugugucucaagcagcaguagaccugcuagccacacuugcucuuuggccuccagaagguugugccaaaccuucucaugguugaguaguaaagccucccucuggcuggcuguccccaguccaaagccagcaccucuccucugagaucccccaguucuuuuugcuguugcuaugucugauggagagccccaucuccuuucuuucacugugcuuuuucugagagggugcccagccgggcaguccccugcaguagguagaagcccuguguaccaucccagcgcuaguagacccuugcaugcuuguaguaaauuugcuaaucuaaaugucucucggaagcugggucuguuaugcuaccuaaaccagguagccagcacagagcccagcacccacaaauaccugcuucaaacacaauuggcuagcuuagugaauucaaagugggagcacuuggcgcccccaggaccccuucaccugcagcaccucccggcuucaccccuucucuagcaccugguucaaaugggggucaggcugggcgcugaagccugcagcuuuucacuggcugggucugcuuccggaucgccacucuccagcagcuuguggugacagcgacagguggaggcccggcuggaggacuucggggagcugaugcucuuuguggacuugcccuugcuuaugccucgcaugauccuguggaagaugagguagcagaucucacagauggugagaauaaugcagacggcagaagcgccuaccaugaaguagguaaagaccuucuucuccgugggccgagcgauguagcaauccacgguguuggggcaggguacuaugcuggcgcacuguaccagacgcggcauggugaagccaugccagagcguguggagaacguacaggaagaccaauucgaugaugagcuugaagaugaggcuaaacaaguagguccaccacaggccgccaugcuucuugcccggguggcuguacaguuuggcgcauugcuccccgugcuucuggcgaugcuuccguucccgcuccucgcgguaggcuacaugcaggaugaccagcauagacggacacgugacgaagaugagcugcagggcccagagucggauguuggagauggggaagaaguugucauagcacacguugguacagccggguugccugguguuacagucaaagucuuuuugcucgucaccccacacacgcucggcagccaccacauacaccagcacccggaagacgaacacuacugacagccagaugcgcccaaaugccguggaguacugguucacgccacucaauaggucuuggagcuucuuccaguccauggugccugcucaggguucggggggcugugcccaccugagggaacaauggagaaaaccauuaugguagugauucacuugauuuauauauauauauugcuucuggauauaugucauuguucauguaugugcacaugucagaguccagaagaaacaaaguacaagccuuuaaucccugcacuccagaggaagaggcaaguggauuucugugagugcgaagcuggccuaguuuacauggugaguuucagggcagccagagcucuaucaugagaaccugucuuaaaaaaaaaaaaaaaaaaaaagguuaagcugggcagugguggcgcacaccuuuuaucccagcacuugggaggcagaggugggcggauuucugaguucuagccagucuggucuacagagugaguuacaggacagccagggcuauacagagaaacccugucuugaaaccaaaaauaaaauaaaauaaaauaaaauaaaauaaaauaaaaaaauaaaaaagguuaaaggugugcgagugccaccacauccagcccucacugaacccuucauuggguggaucggguuaggcaucacaaggcuccuaagaaccgaggacuuucauucuucccacguguagacagacaggcaggcagacagacagacacuguggcucauggagaacacaugacucacccaaagucaccgagccagagugcaguggcacacaaugacccuuuacugugagucagggacucaauaugcagauucucacuuaacacuucaucaggguauccuuaaguggauccugcuccccucccaauuuauagauggagaaucugauaaucaaacgacagugacgggcaaggcacagagagcucacaauaagugauaaaugcuggugacucauuacugcagggugcaggaagccaggcacucgcugcugaagagauuggacuuagguccauguacuccuccaccucccaucccuucccgaggcccacccagaccacggggaugggggugggguguuuccccaccucuuuucuuuucagacagcaucucagacuagcuuugagcuauguggcccaggagaaccccgaaauucuaacccuccauucuuuucuuccugagugcuaguauuacgagaguguaucaccauguccaguuuuaugccauauugaggcuggaagcccaggcucugggcauucuacccaaguacugaguuacauucugagccacaagccacgguuuuugaaaauuacuuccucauugaugucgcaacagcauccugcaaacuuggggguugugagccccaggagacugagacuagagaagaccuguuaacugguuuuuuguuuguuuguuuuaauuuuaauuuuaugugcaugaguuuugccugcaugcauuucuaugcuccgcaugugugccuggcgucgguggaggcaggaguugggugucagguccccuggaacuacaguuacagaggguuguaagcugccucguggguacugggaucaaaccuaggugcuuuggaagagcagccggugcggugcucuuaaacguuuagucuccccagaucugaaaccugcuaauguuacaaucaguggcaguaaagacagggagguuugcgucaggagagagaugcagagggguuugggucuguuucccgggagagaccaaaguucaugugguuauguagagacagcagggcuugggggauucuagccagcccgagcagugcuguuagccauggcuuuguagggcuaaugggucagagaccucaucuuccuuccguucuaagugacucagaggguguagacagguggaucugcugagagucccugggaauggcaugcagauaggggugugagaguauguagcucuccccgagccuguguggaccuggauguacacgugagugcuuccaagucuguugggaugccugcuggaucaccaaccaccucagcccaagcuauauccuuguccaucuucccgccucgguccuucauaggccuuugagauauucucugcacucuguagcucaugaaaucaugguuacaucccucccuucuuaaaacuuguuacuaggggcuggaaagauggcuuggugguuaagagcgcugacugcucuuccgaagguccugaguucgaauacuagcaaccacgugguggcucacaaccauccguaaggagaucuggagcccucuucuggagugucugaagacagcuacaguguacuuacauauaauaaauaaaucuaaaaaaaaaaaaaaacccaaaaaacuuguuacuaguucuuaccuccaaacccaagucuauagucccggcauuccccagcccccugacacacacauacucuuaccuugccucucucugcucagaccuggccuugauuccucccgccuggaaugcucuuccuuucuacccuacucauuaaggaggcaucucuguuccaauauccccuuagggucuguucucaaauuacuucgagucugaacccgcccuggucagucuguuccuguuucccuugguuuuaguagcccucaaacucaauuugcaauuuaaaccuuggucuuuuguuuguuuguuuuuguucccauuuaucaucugccuguccaauuaacaugccuacuugacuggcuggcugcuucaaguuugguaucacucaguguucauucaguaggcacuggauuugcacacucaauucagagcuugagaguggaguucucagagaggcugugggagggcugggcagaacggcagaggaccaaccgagccaggaauuagauggcaguauugcugcccuccacagggucugucuuuugagaaucucaguucucgacuagauggggguaucugggaagcccuagagcgugaagacccuuauggguuugguccuggcacuuacuuuuaaaccuuccagggagggccaaagauuagcaccuggauucugaccccccaggaaaugccaggacugcguuuacuagcugggagaaauccaagagaauucuguaaugucgcuaacccuguuccuuaucucuuaucuuggauuacugcaagaaucuucgacuguucccuccccagccggcucuuccugggagugcucaaggagagugaaggggaggaggaguuccuuccacccgguacccccuaaggaugccacgucuggggcuccccauuuuggugcaggcuaccuagucccuucuaagacacaccccgagacagacucaccugaaaagaauuucucgccuagcccgugcugaggacuggcagagccgguucuggauccccuguugccccccaacucccguuuccagcuacuagaacgauuauuacuauuuuuuuaauccaguuuuuauccagcugcgggacccaaccgcuccaucucuuucuaccccgcagcacuguggcuggccccaaagguauagcuccccucuugggccccgggccccguuuccuuccuuucuagacaguuugggagcuuugugaaccugugacucgcgcgcgcgcgcgcgcgcgugcggguguguauguccccuucugugaaccuuccaguguccggaaccgccaccugcuccagaaugcugguguauguaugagugugugggguggaagugggagugggggcggggagcagagcuuuggguuagggugcuccuucccugcgcuucugcagcauuaaaucuccaugcugggcgcgugggcaggccccaguccagccccccaggggauccccauagagagggguucucagcugccuuggauugucgccccuucccgguacuuacagucagcggcgccgccaccgugggagccuggcuccacgugcccaagacccacagcagaggaggaacgaggcgggagccaagccgagcucuguggccucggugaggcuccuggccagcacagccagaggcagcguggaggaggggcggccggggaggagcccggagucgccucagggaugcaaguucuaauccaggagcagcugcgcugacuagggaacagcaggcuccuuugcggaggcuccgcgugcucgccuguggaaugggggcauugguggccacuggcagggcuguugcaaggacugcaaugacauuagggugugaaacaccuugcaaacuguuaagugccg

SEQ ID NO: 2133 - RNA, 5615 nt, Mus musculus
cggcacuuaacaguuugcaagguguuucacacccuaaugucauugcaguccuugcaacagcccugccaguggccaccaaugcccccauuccacaggcgagcacgcggagccuccgcaaaggagccugcuguucccuagucagcgcagcugcuccuggauuagaacuugcaucccugaggcgacuccgggcuccuccccggccgccccuccuccacgcugccucuggcugugcuggccaggagccucaccgaggccacagagcucggcuuggcucccgccucguuccuccucugcugugggucuugggcacguggagccaggcucccacgguggcggcgccgcugacuguaaguaccgggaaggggcgacaauccaaggcagcugagaaccccucucuauggggauccccuggggggcuggacuggggccugcccacgcgcccagcauggagauuuaaugcugcagaagcgcagggaaggagcacccuaacccaaagcucugcuccccgcccccacucccacuuccaccccacacacucauacauacaccagcauucuggagcagguggcgguuccggacacuggaagguucacagaaggggacauacacacccgcacgcgcgcgcgcgcgcgcgcgagucacagguucacaaagcucccaaacugucuagaaaggaaggaaacggggcccggggcccaagaggggagcuauaccuuuggggccagccacagugcugcgggguagaaagagauggagcgguugggucccgcagcuggauaaaaacuggauuaaaaaaauaguaauaaucguucuaguagcuggaaacgggaguuggggggcaacaggggauccagaaccggcucugccaguccucagcacgggcuaggcgagaaauucuuuucaggugagucugucucggggugugucuuagaagggacuagguagccugcaccaaaauggggagccccagacguggcauccuuaggggguaccggguggaaggaacuccuccuccccuucacucuccuugagcacucccaggaagagccggcuggggagggaacagucgaagauucuugcaguaauccaagauaagagauaaggaacaggguuagcgacauuacagaauucucuuggauuucucccagcuaguaaacgcaguccuggcauuuccuggggggucagaauccaggugcuaaucuuuggcccucccuggaagguuuaaaaguaagugccaggaccaaacccauaagggucuucacgcucuagggcuucccagauacccccaucuagucgagaacugagauucucaaaagacagacccuguggagggcagcaauacugccaucuaauuccuggcucgguugguccucugccguucugcccagcccucccacagccucucugagaacuccacucucaagcucugaauugagugugcaaauccagugccuacugaaugaacacugagugauaccaaacuugaagcagccagccagucaaguaggcauguuaauuggacaggcagaugauaaaugggaacaaaaacaaacaaacaaaagaccaagguuuaaauugcaaauugaguuugagggcuacuaaaaccaagggaaacaggaacagacugaccagggcggguucagacucgaaguaauuugagaacagacccuaaggggauauuggaacagagaugccuccuuaaugaguaggguagaaaggaagagcauuccaggcgggaggaaucaaggccaggucugagcagagagaggcaagguaagaguaugugugugucagggggcuggggaaugccgggacuauagacuuggguuuggagguaagaacuaguaacaaguuuuuuggguuuuuuuuuuuuuuuagauuuauuuauuauauguaaguacacuguagcugucuucagacacuccagaagagggcuccagaucuccuuacggaugguugugagccaccacgugguugcuaguauucgaacucaggaccuucggaagagcagucagcgcucuuaaccaccaagccaucuuuccagccccuaguaacaaguuuuaagaagggagggauguaaccaugauuucaugagcuacagagugcagagaauaucucaaaggccuaugaaggaccgaggcgggaagauggacaaggauauagcuugggcugaggugguuggugauccagcaggcaucccaacagacuuggaagcacucacguguacauccagguccacacaggcucggggagagcuacauacucucacaccccuaucugcaugccauucccagggacucucagcagauccaccugucuacacccucugagucacuuagaacggaaggaagaugaggucucugacccauuagcccuacaaagccauggcuaacagcacugcucgggcuggcuagaaucccccaagcccugcugucucuacauaaccacaugaacuuuggucucucccgggaaacagacccaaaccccucugcaucucucuccugacgcaaaccucccugucuuuacugccacugauuguaacauuagcagguuucagaucuggggagacuaaacguuuaagagcaccgcaccggcugcucuuccaaagcaccuagguuugaucccaguacccacgaggcagcuuacaacccucuguaacuguaguuccaggggaccugacacccaacuccugccuccaccgacgccaggcacacaugcggagcauagaaaugcaugcaggcaaaacucaugcacauaaaauuaaaauuaaaacaaacaaacaaaaaaccaguuaacaggucuucucuagucucagucuccuggggcucacaacccccaaguuugcaggaugcuguugcgacaucaaugaggaaguaauuuucaaaaaccguggcuuguggcucagaauguaacucaguacuuggguagaaugcccagagccugggcuuccagccucaauauggcauaaaacuggacauggugauacacucucguaauacuagcacucaggaagaaaagaauggaggguuagaauuucgggguucuccugggccacauagcucaaagcuagucugagaugcugucugaaaagaaaagagguggggaaacaccccacccccauccccguggucugggugggccucgggaagggaugggagguggaggaguacauggaccuaaguccaaucucuucagcagcgagugccuggcuuccugcacccugcaguaaugagucaccagcauuuaucacuuauugugagcucucugugccuugcccgucacugucguuugauuaucagauucuccaucuauaaauugggaggggagcaggauccacuuaaggauacccugaugaaguguuaagugagaaucugcauauugagucccugacucacaguaaagggucauugugugccacugcacucuggcucggugacuuugggugagucauguguucuccaugagccacagugucugucugucugccugccugucugucuacacgugggaagaaugaaaguccucgguucuuaggagccuugugaugccuaacccgauccacccaaugaaggguucagugagggcuggaugugguggcacucgcacaccuuuaaccuuuuuuauuuuuuuauuuuauuuuauuuuauuuuauuuuauuuuauuuuugguuucaagacaggguuucucuguauagcccuggcuguccuguaacucacucuguagaccagacuggcuagaacucagaaauccgcccaccucugccucccaagugcugggauaaaaggugugcgccaccacugcccagcuuaaccuuuuuuuuuuuuuuuuuuuuuaagacagguucucaugauagagcucuggcugcccugaaacucaccauguaaacuaggccagcuucgcacucacagaaauccacuugccucuuccucuggagugcagggauuaaaggcuuguacuuuguuucuucuggacucugacaugugcacauacaugaacaaugacauauauccagaagcaauauauauauauaaaucaagugaaucacuaccauaaugguuuucuccauuguucccucaggugggcacagccccccgaacccugagcaggcaccauggacuggaagaagcuccaagaccuauugaguggcgugaaccaguacuccacggcauuugggcgcaucuggcugucaguaguguucgucuuccgggugcugguguaugugguggcugccgagcguguguggggugacgagcaaaaagacuuugacuguaacaccaggcaacccggcuguaccaacgugugcuaugacaacuucuuccccaucuccaacauccgacucugggcccugcagcucaucuucgucacguguccgucuaugcuggucauccugcauguagccuaccgcgaggagcgggaacggaagcaucgccagaagcacggggagcaaugcgccaaacuguacagccacccgggcaagaagcauggcggccugugguggaccuacuuguuuagccucaucuucaagcucaucaucgaauuggucuuccuguacguucuccacacgcucuggcauggcuucaccaugccgcgucugguacagugcgccagcauaguacccugccccaacaccguggauugcuacaucgcucggcccacggagaagaaggucuuuaccuacuucaugguaggcgcuucugccgucugcauuauucucaccaucugugagaucugcuaccucaucuuccacaggaucaugcgaggcauaagcaagggcaaguccacaaagagcaucagcuccccgaaguccuccagccgggccuccaccugucgcugucaccacaagcugcuggagaguggcgauccggaagcagacccagccagugaaaagcugcaggcuucagcgcccagccugacccccauuugaaccaggugcuagagaaggggugaagccgggaggugcugcaggugaagggguccugggggcgccaagugcucccacuuugaauucacuaagcuagccaauuguguuugaagcagguauuugugggugcugggcucugugcuggcuaccugguuuagguagcauaacagacccagcuuccgagagacauuuagauuagcaaauuuacuacaagcaugcaagggucuacuagcgcugggaugguacacagggcuucuaccuacugcaggggacugcccggcugggcacccucucagaaaaagcacagugaaagaaaggagauggggcucuccaucagacauagcaacagcaaaaagaacugggggaucucagaggagaggugcuggcuuuggacuggggacagccagccagagggaggcuuuacuacucaaccaugagaagguuuggcacaaccuucuggaggccaaagagcaaguguggcuagcaggucuacugcugcuugagacacacccacgggucccucucaaucccccuuugccaaccucuaccuucucccucccaccagggugcugagcccucugcacccuguagccaggaccuuggaggcaugcguauccugucauauccccggcguauauccuugacauauccaaguccguuuccuuaaaagcaauaaaguuguguuuuauacaau

SEQ ID NO: 2134 - RNA, 1926 nt, Mus musculus
ccucuucucuaccucugucucacugcucaccucuaaaggaggaggaggaggaggaggaggaagcagaggguguuagaccucccaguucucagugagcagccauuuucccacucaaugcuaacggcucccccccccccccccccccacuuaguuaaagccagagccucaggucagugaggagcagcuccuuucucauuuauuuucuuucuuucuuuuuuucuuaaagauuuauuuauuauauguaagugcacuguaacugucuucagacacucaagagggcaucagauaucauuauggaugguugugagccaccaugugguugcugggauuugaauucaggaccuucagaagagcagucagugcucuugaccgcugagccaucucuccagccccucucguuuauuuucuaaaugcauugaacguggucuggggauucacgugggacaacaucaucgugauucucucucuguguagauucuugucauguuuguugcuuauugcugaagucaugcuuacuuuuuacaucuguguugcaggaaaauacaccauagucaugcuaccuagaggaugagggucacaggaaggggcauuuaaaaaaucaaguucugagaacaguaucaggcacucaccugagcccaaguggcugucacugaaaacuguugucacuuaagucuugagaguuccuggugcucaggaaguccuacuuugguggcagguggugaaucaggagggaagggggugucucuuuccacacagaagcugggauuagccucagggcccugggcaacuaacagaccacaagagaaguuugugcaguccuaagaggcccauaggaccagcagguggugccucagcggcgcccccugguggcaguggucagaagcuuucuacaaacccauggacccagaucaggagagggugccuguguggauggcagcugaccacaucugagaaauccuauaccugaaguuucuaagaaacagaagugagacuggggaggcaggggucgcgcuaaaccuaucugucagggaaaugaaguagguacaaucagcagggauuucucgguaggcuaauuccuuuagaaaaguagacauuugcaauugacuuuuuagauguguuguggucacugaaguuagaauugguugccucuuagccuguaagagacugacugaagaccuuaacuaaaacaaacaggcccuucggggcuauuaggucaccuggcuuuauuuuauuucauuauucuggcuuugcuuucucauuuuuuacuauuuucuuucuuuucuaugcuauguuuuagagugagguggccugcagaguaaauuacaugaugaccaaaaggggcagggggaagaaacuagguauggauucuucuagaacuucuuuguuacucgagaaggguaaaaguggaaggggagcgcauguugggacuugaagaagggcuaaccauggcggaauuugaauuucugccuuuuggcuucuuuauauuucugaaaauggcaucuugcuuauuuugcccuuugauuauagacaguacauuucuuuuuacauuuucacaguuuccuguuucuuuacuaccuggugguuauaaaggugcacccacagaugaguucugugagucagaugugcuuggugugucagccucgcucugccucccaggccgucaaaaaaacaaggaagaaaucguuugcaguugcgugcuucucuguugcugugauaaaacacagaucaacaccaacauguaggaaaggguuuguugggaguuaguucuaaugcuuugucuuaauuuggcucccaaaagccacacuuccaaaugcugagggucucuguccccagcuggcuucgauuaguaauaaagaauugcuuggucuacagagugaguuccagaacagccuagguuacauagagaaacccugucuugaaaaacca

SEQ ID NO: 2135 - RNA, 26573 nt, Mus musculus
aguuguggucucagagaucggguuccagggcuggcggcgcugggacuaugcgucccagcauccccugcaagagcccgggagcacuuccggccuguugagaagugggugucucugugggugagucuggguggcggauggggugcaguugagaaucaggcgcugggcuggaggcuuuggagguggugguacccgcgggggaggggagcugggaaggugagaggggaaagcaagcaucguggcgugugugugugugugugugugugugugugugugugugugugugucggggcgggagugcgggcgggcagaggcugcagcguguggagaugggcagggucaccgaggggucgggaugaagagugaguuggagaggcgggcagugagacgggucuuaccgaggucuguggguaaggugguagagaugcguuuuggcugugaggggaaguuaccuuagggucuagaaaagcacaaucaagggaagagagaacucaagggcccuggcaaagaagugaagaggcccugagcggaaagucugaccuuaaaauagugcuucauucucgacaccugcguucaugucaucugugacgggacuggcuauuguguucaaucccaaaccuguacuucuuuccucauaacugauagaagugaaaggcaucuuuaucuacugacccgcccacccucgacugacccgcccaccccugcugacccgcccacugaccuacuuguuuuaccagcugauuccaccugcgccugcauucuucuucauccacgccguuugcuguacacuguucgaggcuugccauuucuuuaguaucucuuaaaaugaccucugucuuccgggagccucugcagaaguguccacauuuucauuucuccaacucggagaaacauugcagcuagugugaucuguugaaacccucaacuguauaccuuccguuuguucuccagcuuggaauccaucccuggcaugcaacacguguugaauggaaucugaucuaguagauucuucauaaugcucuuugcagcccacuuuucccauacugcacgcuccggggcugccaagguguuucccauucuccaggugggccauuuugcuucucuacuauuucauagccugccucucugcuguaaccucccucccccauucucucugcguuguacucaagaaccaaaucaacaguuccuuaagcaaauugccaccuccaacuucccagcucccaaaucacacuuucuuuaugacauuggauuaauauaauuaucugugacuuuuaaauuuauuaauuaucauuauuauuauuugucucuuccacuagauagcuucaucagggcaggcagugucuggaucaucuccauuuucuuugguccagcccagaacagcagacaucuaauguagauccagcaaaugaguaaagacuuggugaaugugggcuaaagacucucagggggagcuuuguuagaccacguuugaaaauggcuacggacuuccagggcugugagcuucaaucuucuuccugacaucgauaucugcugggagcugagguuguugggggcuuaaggacaguguuggccaacacauagggaugcauacagcggcuuccuuuaccugaggcccggcagccauugcuaauugaucacaacauauauccauauggagcucauuucucagcagacuccucuagguagcuucccccaugauggaggauggucggcuaagugaggccuaucugccacccccaguuccaguccuuagaugcgagucuccccucuuacagccauagauugcauaguuagcccaguaggacugacaaccauugggagcucccagcugcuuagaggaucccaaccaaucugguccucucucuggaccgagggagcaucuucucuccuccucuguugucacaggaguggguggagggggggggggaacuuagcuccgcauucacauccaguacccaguugccaaggccccgcucagcuucccugugguaaaguggaacaacuuaaaaaaaaaaagguuuuuguuuuuuuguuuuuaaauuaaaugugagaauuuuauacagugaauucugguggcccugauuuugauugaguacccuuucaucauuuggggacucugcaccccuccuaagucuuucugggaacuggaagugaaaccuuugugauuuauuuauucagacuucugucuggaauaaugcuguaggaaagacacgcugcuuccauucagugccaagaaaggcucacaaaaagaaaagcaggcggggaguagcggagacaugaggaguagcaccacaagaggagacauaguggcagcccacguggggugaagucccucacgugucugaagcaauucuggccguugccagcaugugaacucuagaggucugguuucucuuggagaagacugaagaaccggggacguccugggcucgccguccucuuagggcuccacgaugggucacagucccugcccguauuuacuuuuuccguuucaggcucgcugccugcuuauucuauucuuguuucacaaguuagccugugauaagagcuggguaggacaggaggcugucugaccugcacggugugacacagcagcuaagaggcagaagucucacucuuccauggauguucuugucugucucccguggcaugauucuagcagguaggaggaugugacgggauuacggaaaauggugggagacuaaccugggccuagguccuagcucagacacuugguggguuuaggacuuuuucuccccccucucucuuuuccccccucucccuaccuucucucuuugagaaguucuguuucucucuauacaucauagcuugggaguccuuuguuaaggacucagugagcacucagucuuggcauaagcucagguuuucuagugugaccacgaggcagaagaauuggagacagcccguuuccauucuggucuuccugggucauggguguuauaggucagugacggucccucuacuuccuugucuggaggauucugugcaaaucuagauggagaauguuuaggacuguacuuaguguggauaaaaggcaccucuuggaggccucgguguaucucuggaggccucagggcuggagaaugcucuugccacgcuccugacugacaguguggaccucccuucccccaccguagucuaggccauauggauagaucgauauaugauucugacaaggguuucuuccauuuguuugaaaugaacuuuugagguuuuucggaucucucucccccagaagauguccucggcucuggcuuggugacugguggcgucauugccuggcgggugucuccuuuaugcaggaguguaggagucuuugcuugccaacuuacugucuguuccuagacuguaacuuugugaaggcugaagggacuuucugucccagccacuguuggaucuguagcucccgguacagugcagggcauaugguggguauucugugaaugccugacagguuacuccuuguguaugacagugacagauuguguguuuggauuaguguguugggaaaauguguguuaaaaaaaguuaugaaacauuaauucuucaauauaaaucauggacauucuagacuuuugauguaacagauuuacauauuuaauacaagacaacaaaaucucuaauggcacugguauuuguugucuaugaggcugggucccauacuggccugguauaccucagugcaguggcacuguccauuguagggguggguggcugcaaaccaugggugagcauuuaucucagagccauguaucagcugcuuugggaggagcagggaugguggccgggcaugauagagcacaccaaggaaugccuggaggaagugacauguagccacauguagcagagggauagccagaaguagcccgguggcccuguguucucuaagcaucuuccuacguacauggaagucuuuuuggccagucucuaucuuuuuguuuuugcuuuuguuuuuugagacaggguuucucuuuguagcccuggcuguccuggaacucacucuguagaccaggcuggccuggaacucagaaauccgccugucucugccucccaagugcugggauuaaagcgugcgucaccacgcccggcuucagucucuaucuuuuguuacccuugccucuacccauccuagucagauggcccagaauaccagaugcugccauccuuugccucugguccugcugugccauuccuacuuggaugcagccaguggccuccuguugggugugucuuaugccauuagacuuucgacgacuagcuuguuuucuaagagaacccaguaugggugucaucagagaggcuguaccuccauaggugccaacgugcacgugucuccacagaguguaauaaaagauagugccacgggaaggugggagucggggagagaggaaucuuuuugaugugggcaggccaccaguuguccuuuggcuagugugcuccgguccucaugagcucacaacaucacugucugcuuuguuuucuccaugcacugaguacugugcuagagccuucagaagcuguggucugggcacugugguuauuacaauagggugaucaugguugcaagggagagcaugagaugccacaaaagcuggugaccaaggacaagucuuguaucagggagcauguaguuuuuguggagcuugccacaaaagauggcaacuaggauuuuauuguuuauuugcuuuauguauguauguauguauguauguauuuauuuuuugcuauuguagcucaagcuggucuuaaacuuagaaucuuccugccucggcccccugauugcuggggaagguacauuugguuuugacccauugaauaugagguaucuagaggacagucaaguggaaauguuggagccaugagcuaugcagacagcuuuggcuggaguuucgagaaacuucaauuuagagauggugaaugauaucugguguguggggugacuggagagugagggggggauuuugccagaugaccaucccuagacgaggaccaaggcucaaguuucagaaggcaggucucauggaaaaggugacccucuugggguccggcuuuggggaagguuggcuuuggaaccugguguagaagggaggaaggccaaacuagggucaaagcccagagguccaggguucuuggauuaaacauuuaggcaugucccaaaagauguagcauggugcugucuucuuguaaagggaacugggugcugacauuggugccugaucacggucucacuuccugcccuuugcaaagcagugucucagagaagccucagagacacuuccacagacuuccacagagguuguggaagguaugagagaggcgaaggaagcaguguuccuggguccucucccucaccgugcccuuugucuuucuaccuucacagucuuggggagcuguccccgccaacccccaggagccccuugaaggacacauugucaaugcaggaagcagccagaugagacagcuccgcugaagugaagcacccgggccagaugauggcuguggccucaccuccgccagagccggaagaccuccugauugugaagcuggaggaggacucguggggaucagacuccagacccgagaaggagagccacagccccgucccuggccccgagguuucccgccgguguuucaggcaguuccgauaccgggaugcagcuggaccccaugaggccuucagccagcucugggcgcucugcugucguuggcugagaccugagcuucgccucaaagaacagauccuggaacuguuggugcuggagcaguuccuguccaucuuacccagggaggugcagaccugggugcaggcacgacaccccgagagcggagaggaggcgguggcccugguggaggauuggcaccgagaggccugggcugccggacagcaggugaggcuaauagucugaucucuaagaagcuggcuaggcaagauagcaggccugagguugaguuaauaauugcccccaaauugccauaauagccaucauugagcaccuaccguuuccugagcccugccguguagcagguaguauuccaaccguuugacuugcuuaauucauuuaauucugccacagauuaauaaggugggucgguacuauuagccuaauuuuacuagugaggaaguggaggcaaagaacggauagauaauuuguucaaaaucaccagcuacuggauuauagaggcaagauuugcacuuggcaaggccugacaauggugugugccuagccaccauugagacugccucccuguaccauucagugugccuccucuguauuauacuggauguucaacccagucaucacccguaccgggaucucuuuggaugcuuacagcagcccauagacagaaauaguuuuaccuucuccauuuugcaguguaagguucuaagacucagaggguucauggaggucacuuggaaauggaaccagagccuaaacgccccaucucuggguuucaaggucaugcaugccuuuucuacuacagaacuagcgccucaucugcaaaugugccguucaaaugccuccaagggugaggcucaggugagcacccacggugcuucaggcccuguucugagccucucacaugugcaccucauucagucagccacugggugcugucuuucaagugagcuaacagcaagguaaguaacuugucugaauuugugagugguagagcggaaaaggggaggggccuuacggaucccaccucuggagcuucagcaguuuccaagcagcucucagagccuaugaugucaugugucauuuuccuauggcccagaauuaggauccugcuugccgcugccuuguagagucagccccuguagccggcuucaggcuaaggggcccuuucggaacuugcaccucaaacccuuuuggcucugcacuuguuacagucaggaauccccauggccucguacucgaccacacuugguugugaggauucuguguuugagaauacguaugcugugaaugacaagguucucuguccauuuaaacuguaaagcucuguacagaugagagagucaggcgagggagggccaagguugauggcucugcuccugggcuccuuuacaaacugacaggaagcugucauuucccaucagagaacagagcuugaacacaugccucuuaguagacauccccacucccucuaccaccuucccagacccaugcucugucuuucaagaagccuuaagugucaaagaaacaauggaagccuugggauuugaccuggaggaugggggacgugagaccccugagaugggggacgugagaccccugagaugggggacgugagaccccugagaugggggacgugagaccccugagaugaggacugacuuaagguguuuucaaugcuccaucugugaaaugagaaggcagacgaggcuaguuuuucaagugauaccccugugagguggccaaagguugaaccccucuaaaauagagagaagacauaaaacaaugguguucucucuggucccccuuguccaugaccuccacuuuuacucuccagcuucucugccugcuccuggguccucacguagugguacacaggggagcgccucccuucuucagugcaugcgccacaccucguagccuugugcugcaauccucucugagucgucguccuccucucuggaggcaaaacccaauucuucaugagaggaugaaauuuaugagccucacccuguggucagugccuucauucagggcuaaaacccucaaagggaucuuugaguaccacugucuuacaaucuuuagcuuauuucgucuggaaccccacucuucaucagguauucugaugaaguguucauuauuugaaccgaguuuuuagguucaaaauugagcagcgaguaugguguucucagauguagucuccaucacggucaucauccccuaucagaguagagcggucauuaccccagugagcccccaccaacaucaucaccccucagcgugugcaugccacacugagccucacugcuggagguaugugucguauggauuuuggcaggcacaugaagacaugugucugcuauuagggugucucacguagucgccuaacucccucaacgguccuguguguucuguguacugauuccuuucccuccuaaugucuaguaaccauucaucuuucuacugucauguagagcggcccuucccugaaugccacagagguggagccacacagucugugaucuuugugcuuaggcuuuuuuucuuuucuuacuaagugaugcaugcuuaguguucuuccauggcuugagaauugcuuuucuuuugagcacugaauucuguucuguugucugggauguaccaguuccuccaguccagacagaaggaugucuugguugugucucuguuggcagauaugauugacagcacuguaagugucacauguauguuuuuuguguacacauaaguuuucaggccauuuggguaaaacugaaggauugcguuguuggaucacauggcaaagggauguuuuugucuuauaagaaacuguuggagcuggugaugguggcgcaugccuuuaaucccagcacuugggagacagaggcagguggauuucugaguuucugaguucgaggccagccuggucuacaaagugaguuccaggacagccagggcuauacagagaaacccugucuggaaaaacuaaaaaaaaaaaaaaaaaaaaaaaaaaaagaaacuguuggacuguuuuggaacguggcccuacuauucuccaucuuccguuuugcuggcagugagcaugaguuucugugguuuuguguuuggaugccaggcauucugguaguugugaaguggucucacauuuuaauuugucauuucuuauauguguugauggguacacaugugggcgaguuuguaugcacauguuagaggccacagguugaugucaggggucuaccucaauaguuucuuauuaguuaguucugagugguuacuuacugagccuguuguuuacugauuggcuagaguugcuggauagugagcuccagggauccuccugcagccuccucccuugggcugggaugacaggugcacacuguuuuuaccugggugcugggaaucugaacuuagguccuuauccugcuguggcaagcacuuuacuuacugagccuucuuccuacuacccaauuucuuaaugauuauaaauaccuugucguaugcuugguuggcaucuauaagucuuuggugaggagucuggguuauuuugguccuuuugccucuccuuauaagcuaagaauggauguuaaacaaagaucuaacaaaaauucucaauaaaauacuuacaaaacaaauucagaacacaucaaaaauaccaucuaccacagucaggccagcuacaucccagagacagagggauggcucaacaguaaauaaauguagucuugcacauaaauugauuuaagagcagaaaacacaggaucaucuaucucauaugcagaagaggccuuuguggaacuccaacaucccuucauaauaagaguucuagagaaugggacaggggacauaucucaacauaauaauggguauaauacaagcccacagccaacaucaaacuaaauggaauauuuucacugaaaucaggaauaagacaagacaaacauaucuccucuuuccuuuccuggucaauauagugguuguauucuuagcuagagcaguaagacaggagagagagaagcaaauaggaaaggaaaaggucaaaaugucuaauucauagcugguaaauacauuaaaaaaacuauuaggauaaaaaaggacaaaaaucagcuuccuauaugcaaacagcaaacacuagaaagaaaucagggaaucauuauucacaauuaccacccccccccaaaaaagaccaacaaccuuggaauaaauuuaaucaagaaacugaaaaacuuguacaaugaaaacuuuaagacaaugaagaaauugaagaacauaccagaagauggaaagaccguccaugcucauugcuugguaggguuaauauugugaaaauggucauuauacugaaagcaaucuacagauucaauaaaguccucaucaaaagcccaacacaguucuucauagaaauaggaaaaaaaaaucuuaaauuuauauggaaacacaaaagacccaggauagcuaaaaccaugcugacuaauaaaacacuggagauuugcacuucugcuuucagauuauacuacagagauauagucauaaaaccagcaugguucuggaauucaagcccacacauuugauaagugggacagaaaugaggaccuggauaaaaagcccacacuucuacagccaccugauuuugacagagaagcaaaaaaguacacacuggggaaaagacagcugucucagucacuguuugauugcugugcaaagauaccacgaccaaggcaacuuguaaagggaagcuacagugucagagggcucuuccaugaccaucauggguaggaagcaaggugguguguaggcauggugcuggagcagcagcuaagagcuuacauccugaucugcaggauggaggcagagagacaaugaagcuguggcaaaggauauuugaucacauugugaaccccaagacugugaacuguaaaaacccuguuucuaauuguggugugguauagcucagccuuugauccuagagcucucugcuuacuguggacaagugcuuguggugcggcucagcccuagcacacaccuguaagccaagagcuacauaaaaucaacccuaggucaaggggcagagcuaguaaccagcccacggggaaugaacauaagcaaacugaaccaagagucuuuugaauugaagggcauuuaaaacaguguggagaaggagagcuuuuuccuucugggaggucagugggguaggaagguuggcuggguucuuucuccgccucucugagcuagccugcguucaccacgguaucuggcucccgaggcuucauuuggcaaaaucgaauggcugggauuuuuuaauuaacaacaagacugggcccacugugggcuuuuaaaaccuuaaagcucaucuccccaugauauaucuucuccaacaaagccauaccuccuacugcuucuugaacaguccaccaacugggaaccagacaugcaaauauaugagccuauggggcuguucucauuugaaacaccacaauagcaucagcagcacauggugacgguugaaccggauagcuugcauguagaagaaagagcuagaucucucacucuacacaaaacucaaguccacauggaucaaggaccucagcauaaggccugauaacuugagucugucagaggggaaagugggggugggucggggggguaugcugucugcaucacaggcauuacgauuaacauuugacaaacgggaccucaugaaacuaaagagcuucuguacagccaaggacaucaucaucugagugaagaaacagccuauaggacggggacaaaaccguaagguuauacaucugagagaggguuaguauguagacuugacagcaaacaaaacgaaacaaaacaaaacaacuccacaaaacccuagacaucaaauagacaaaacccaauuaaaauccggaacauggaacuauacaaagaauucucaaagguuucuacacaagugcucgucuaaaaaguucucucuaaagaguccucucugcucucuccugcucgggcucuuugccucuccugcucugaugugaugaccguagugccgugacucccagugcuaugcccucaccucucaguucuucuugaguucaguucugacucuuuguccucagcacuucaacgucuuucagaguacgcgaucacaugguaaaaguucacaaguuuacacauaaauucaagccaugaaucggauaagacguuuacaacacagaguguuuacaugcauaccuggcuaaacagccaccaucugucaccagcucuacagguucauggagaguuaaccauaauauuugugacugagguauuagugaaguuuuguauagauaaacccagucaguauuuuaucuucuguccuugcaccuuaguucccuuuuuaggaccuucaguuaauuguuuuacaaccuauuggaaugugcucuaagguguagacgccugcuugcuaucucagaagcaauugacucauggcacuugaaggcuggcagaguucucguugcaguuuggacaucagaaaggacuuaauagcaguccuaguauaaaagagcuuggugauuacuaauauaauuuuaggaauucuuauagggucaucauuaagaauuugucuacauagcaucuauauagcaucacuacaagacaguacaucuuuaguguucugcagagaucuguucaaaagggugagcuaauacuuagugauuguuauauauauuuaauaauaacaggaaaaguauauuaauagcaggaaucuuuccuaaaaugaaauucuucucggccuugccuagagaaacaguuccaucauuaacuuucacaguccacggcagaaccaucucagcaagauuaccugcuaguuguuuagcuucuccuugauggcuccgggcaaagugcgaauuagaacgguuuugagauuuuaccuuaccccagucaggauaguuaagaauaaaacagcagcagcagcaacaacaacggcaauggcaacaacagcagcagcaacagcugacaaccuauaguaguguggacaugggggcaggggagcacuccugacucuuagcagaaguguaacugguccagccccugugggaaucacagcggagggaucccacaaagcuagcaacagaucuguccugugauccagcgaugccauuccucagcauacccugcugcagagagcugcuuucucauccacauucauucugcuuuaugcacaauucagauaauggaaacagccuggacgcccuucugcugaugauaauggagaaagaaaaugugcauagauagaguggaauguuauuuaacugauagaaaaaugaauuauggaauucacagauaaugguuggggcuguaauuaauuacucugagugauguaacccagacccagaaagacaaaugcugccuauucccucuuaugugugaauguuagcuuugacaauuuagauguguguucauuuuauuuuauuuuauuuuugugggcugacaguguccgagacaggguuucucuguguagcccuggcuguccuagaacucacucuguagacuacacuggccugaaacucagaaauccaccugccucugccucccaauugcugggagguauguacuaccauugucuggcuuagaugcauauuuaaauuagagugcccacagaaaucaggagaguaguaagggacccugggguauuaguuacuuucugguauuaugacagaauaccaugaccaaaagcaacuuggggagguucaaguucguaguucagcccguaauccaucaucaagggaagucagggcaggaagucaagcaggagcugaagccagaaccacggcagaaugcugcuuccccgcucgcccucucuggcuugcucagccagcuuucuuauacaacccaggccaaccuaccuaguaauggcacugccuagagugggcuagacccuuccacaucgacuagccuagggaaauggccuccccaguugagacuaccucagauaggucugggauaugucaaguugacaggugaaggugacugagagaagggagaaucucguaggaaggguagaauacagaugucaugaagagggaaagaaaauaauggggaaaaggggguuaaagggaugagggagggcaagguggagcagggaguguggggaaggaaaauaauaggaccuuugaauaugccauauggaaaaguaccacugugcgagcuuucuaaaacacacacacacacacacacacacacacacacacacacacacacacacacagaggaauggacugacucuacaaaagaagcaaugcuuuucccaggucccaggcuaucaaauaaaaagccuuuuucuagauauggguuaccucuugagcuggucagugggaguccacaaacauuagaggcuacagccauugccccugguggccccuccagaacuuaaugggaaggcccuguugcugaagacaccacauacuugaacuguagcacagagagaaaucaagcuggcaccagccugggagcuucacccccacuggcuagcuuucaugguggcaugaaguuugacaaguggccugaccagaucucccggcugguacgauguuggugggaauguuaugcggaugagauggccugguuggauuugagaccugcuccauaagaugguacucauguuugcgcuguuaacuaggcuaaaaccccacugacgaggucgcaggccuuagcggagagccaaauacuauuauucugcuaaauggacauaguauuaaacugcccccuaaauucuuaccuuauucccauggauugcugcaucuucugucaugagagaaacuacccuugcaguagacguggauuaaagcagagauucacagcugguuaucaugcagaguaagagacuggaguacucagcucugacugggccgucucucccauacaaccucccuugagggucagggagcaucauaaaacagagacagaaaauguauaagagauacagggaguagaugccugcagugaaagauucuuuggugggcaugacaaggcugcuccacucaugaacucggugguaggagcugaaccuggucuucuggaagagcagcgcgugcucgcagcugccgagccgucucuccaguccuguguucuggauacagcacugguaacucacuuccaagcucugcaacucucccugcaucccgagggcuuuuaucuaauuaucuaucuaucuaucuaucuaucuaucuaucuaucuauuuaucuuaaguuguauuuucauguaauuuaaaguaauuucucuugaaauuucuuccuugacucaaauauuuacuuguauauuguuugagcuccaaguaucauggauuuuccagcuaccuuucuguuucugagucacuuccaugugauccgaggagcccacuugucacgauccugcccuuugacauucgcuuaguguguuuuguggccuggcaugugguugccguggcaaugaaugguccaugagggcagaucuuguacuccuucguuagaaguucuaccuugcagaauucagccaucccucugcuguucugucccgcuagugagucuacaccgcucaucgcucucuucccuucaacugacuuugguuuugucuguuccaagagcugugcugacgucacugacuguacucacccucuucugcuucugucaguuuuggacuguguuauuagaaguauggaggaucaaggugugugcaguccuuaccuggaugagaauuaucaugccuuuguggagugucaaaccccuguaucauaucaugaagccacucuucagcccugggaacuucucuugcucugaagucuccuguucugaaauuaauacagcuucucuuacuccaccccucuucaugugcauguguauggugugcaugcauguuugcauguauguuagggugugcuuauaugugugugcaugugugugugcacacaugugcaugugugugcacaugugugugugcacgagugugcauguguguguguguguguuuggaggcuugagguugaugccaggauucaucuuuaaucacucuucuaccuuacucauugaggcgggcggagucucagucagaccgagagaucacggauguggcuagucuuacuagccagcuugcucuugggauccccagucucugccuucuaaagcuggcacuacagacaggccuccaugauuacccuguauuuacaugggcucuggggucugaaguuugaccugaacugcuugugugucaagaacuuuaaccacugaggcaucuuccggcccacuuccuuuugguuaggguuaaguugguaucucuuacuuccuccuuugccuuuuaucuguaaggugucucuauauuuaaaguggauuucuuaguuacagcauauauuugggucauauuuuauacacucuuggccuuuuacuugguuuguuuauuuaucuuugagauagggucuuauaguauaauccagccugcucccaaacuugcaauccuccugccuuagcuucccaacugcugggauugcagaugagaaucaccaugccagcuaguuaguguguuuagaccguuggcaccuggguuacuauuuuuaaguuuuaugguuugauaaucccagcucucugccaucugacacugguucaugcugauugcucuucaaaauguugcuugccuuccgguaugccuugaaaguuuugguuaaaagguggcauaugaugucuuggguggaaggagcuauguaaguaagucuuuuagaauacaguggcagagcaugucuagugggcagucuacagcucugugcucuggacucugaaauucaucaguauuucucaggcuucccuuuguggguggggcaggcugcuagaaagggcuucaggcaggcacuccugucaccugugcagaauaguagggaaacagaaggggcagcuccuuuauguaaaguaggcuaugcuccggcacucacuguucacagaguacacugguguguuucacagugguuccugucccuacuccaccccacccugcagaaucaugaggggacuuuccugcgcauuccccucauuacgaggauggauagagcucuuggaagugacacucgguaaagcucaccugcccuugucuuggugacuggguuuccuggagccugacucucagguggccugcccugugccucuagcuguagggcuuuccugccagcaccggucccuucagaggucuccccuccagugaagucaccucucuuacuucuccagcuucgagggcaggccuaggugguguggccucgcuucucugauggaucuaagagcuuugagucuuguucggcuuggguuuguccagcucacuucucgcugagguggagcgaugaugucuaagcuccuuccuggauuagaaacuugagacgauccucaugguugucucauuccucgucauugucaguugaaucugccuuucuuccguguuggcaguucuggcccaagggguugaagucuccguuguagcgugguaucagcuggaggagcuggcuagagugaggauugucuuagaguuuauccaugcagcuucuuuguugauuguaacuacuucagaggcaagcaggcuuauaaauaugcuuaucaguuauuuuuaaggucacaacauuuuauguaauuuacuucugugaagcaagagcauuuugaauaguguucaccugcuuuagauacuuguguagccucccagaauuccacaagacagaacucauuucguaguggagauagaccucguucgguagcacagacagaauucauaugguaguauaaaugcugauuuguuuccugaagucagucugauaguuuucuuacuguguuaaaacccucuuuggauccuaagaaucuguuaaccccauggaacacguucacacucaagguaacaguccugucccauugaggggaccacaccgaucugaugguugauuuuguguagggacuggagcuaugcucugaagacuccagguccuucgaagcaguucaggaguuccagagguuccagcugcagccagugacccacggcucugagggccagccccgaaaacaguggguggagaaugcacgucccgaccuuuccaagaugccaccugaguccuugaaagagagugguaaguaccaaggauauggggauagaagagagugaggcuuuucuucccaagggaugggcuugggggugggguggggagaaaggacauacagaauucaagguacacagugggauaaauguuggauggaugcuguuauugagccaaagguugagaagcucugugagaugggagcaagacccgcuggcuggagucauacagaaggcgcuggcguggcagugggcugggugcugcucacaggauggggaaggguaccucacaccugggacauaacugaaaacggcuuaggagucccagcuucuaaaggaagugaaauggcaagugcgugccggguguggggcacccuuggugugauucccagcaugaccuuugggaagcugcgucucagaaggaagugguuuuagagaaccaaagcuuuuaucucacggauugcucucuucuucagcuguccucacaccccaagccccaacuguuccaaagauggcgagcauuggagauugggagguggcaggcaagucccagguaaacuacuguuuucuuuucaugucauccucuuccugugcccugucccuaacucauggccucccuagcaaagggagagagcauaggcuguuagcccuuggccccugggccugcugcuaauucauugacagggaugcuggccccacaucacaaucugugguguuagaagcuguagugagcucucuuaggccuggucagguucccagggggguuuuaaagugucauugauauuuaagguccucuguguaugugucauaggaaaccccgagccccaguagacaagccaagaaggagcccugccaggaccccgcaggaggugaucguggggacagugcgugccuggguaaggaaagcucuggguaacucuguuccgggguccagcuggccuguuucuggcacacucaguuccaagagagggguugccacaugcccagaacccgagcucugcccucucuggacuuucaggggaggaagaagacuggcuccuuguagccacccauguagugagucugcagguugggaugggggcugcaugcuguuaccuggagccagcccugcuggacucaucaccucagucagucaccuuaguccggaacuggcccaggcucucugucucaaaaguucagcacccacugagaacuccccuugcgggcagacuccugcaaacugaggucaugagaaaagcgaguagcaagggcuucuaaaugcucaaagcucaugugaccagcacaccuuucucugaaggccaacgcuaaagggucuguccccagagggagggagggagggagggagggagggagggagggagggagacacacaaaugggguagaauagaaagguuucaacagaguaacuugugaaagguuaagauagauggcugagggcugccuacuggacagugggaccccaauagugcuugcuaauugaacugaucaagaaaugcugaauuagaguaccccaaaaaggcuuuacaucaaaauucguuaucuagaucaccucaaacauguacuaugaugaaaggcuuucugcuuuguuaggaccaggcgcugcugggaaggucuuccuguagaccagcuacauuuuuaggaugaggacguccuagaggaugcgauguuccaggcaugcuaccuguuagcucagcaaugcucuagggcucuacauucauucauucauucucucucucucucucucucuuucugucuuuuugucugucugucucugugucucugucucucucugucucugucagucucuguguuuguuucugucugucucuaugucucugucucucucccucccuucuucucucucucccucccucccugccucccugccucccucccucccucucucucccucgcuugccuucucucuccuucccuccaacagugaguugagucugauggggauuuuugagguccuguguguuuucuuagccacgcuguugugugauguauuucauaacaacagcauggcagaugaagagccggcaggucccuuucauuuuuggugaugguccugugucuucuaagcaccccucucuaggaagaucaucacgggaguuucuaauuggccucuuggaggagaaggauguggguuucaggaacaguuuagauaaacacaguccgacaggguuguuucugcucaggcguuucuguccuuccuuuugugcaggaguuccagcuucaaagccaagugccaccucccagcaagagcaaggaccggagauuuggggucugagccuuauaaauucugggaaugggagugcugcagacgauagccuggacagugcgcaagacaagccagugcaggcaguggcccaggcagacucaagggccuggggagagccgugccaauggggugcggaggacaugaaggugucagguguucacuggggcuaugaggaaaccaagacuuuccuggccaucuuaagugagucuccuuucucugaaaagcuccagaccugucaccagaaccgccagguauaccgggcuaucgcagagcgacugagggcacggggcuucuugcggacucuggagcagugucgcuacagggucaaaaaccuucuccggaacuaccggaaagccaagaacagccauccgccagggaccugccccuucuaugaggagcuggaggcccuugugagggcucggacagccaucagaagaaccucaggugggccaggagaggcaguggcacuccccaggcugggugacagcgacacugagauggaugaccaagacgaagggagcugggagcccgaggagaccguggaagacugcagugguucuggccuggccgccgaggagucucuucaggggcccaggauugcagggggcccagcucugcuccagagccguauugguaagaacauggcauuuaacuagaugaauaucagccaggcugcugccucgugagguuagagcucagccugugagucaguaagacgccaaguaccugggcccuccucagacucacucuucucugcaccacgucucuuaguuauaggagcaaauaacucugaagccuugccagaccgggagagauuccaguugcuuccaaagggugucgcugaggacacuccgaggugguacccgagugaucuugucauuuccguaggcguguuucucauaaugcgggugagaauggccaauuaauucacagauagcaagucuuggguaagaaagugugugaaauacuggcguauagagaagaaagugacaguguagccuugagagucacuauguggcaaacaccugauacugcaaagggaaagucugugacagccaucugaggcuuuggaagccacauuggcaggaacagagccuggucuccugccuggaguucauguagccccucccccacuccaccuccuuggguuaugccgcuuacccgaauggagacuaaacuguggcccugcccguggaccagugaggaaagcuuuuccuuagucauagucugugcccuggucacugaaguccauugaugucucugauccuuguggauucucagguuccaaauauuguugaagagaggauucacaaaggagacaggggaugcguuuagagugacugcagggagaaugucauggaugauaccauuugucagcugaagccacggggugggucacuugaugcaguugcuaaaagcauggccagucggccucuccuucagcaagacugucucuugaaauggugagagaggaugccuuggccggcuucccuagcaugucucuugaguuuguguugccaggugcuuggacagucucugagaucuguguucuggaucuguagaagugcaggugaccccaguccuaaugaccuagguaaagcuccuaagccucacaugucugaacucuucacuucugacagcaggcgugcacuggggcuucgaagagaccaaggucuuucuggcaauucucagugagucccccuucgccgaaaagcuucgcaccugucaccaaaacagccagauauaccgggccaucgcugaacggcugcgugcgcuggguuuccugcggacgcuggaacaaugccgcuaccgauucaagaaccuucuucgaagcuacaggaaagccaagagcagcuguccaccaggaaccugcccguucuaugaggagauggacucacugaugagggcucggacugugaucagagccguggagaugguaggagaagccacaggccucccuggaucugggcagagcaguacugaggcugaugaccaagaggccuggggugagauggaagaugaggacgccguuagacuucugacuccagacucccagccugcagaugcaggugaggcuggagccauuggguguuggcagaaucugcagcccuguacaaagaugggagcugaaaggaccaggaugggcacaggacacaccaagaccaaguucucagcacagaggagauuuauuugccccagagggacagagggcagggaguaagaaacaaagacaggagauagaggaugaaggagaggguaaagaaacaaggugggguaggggcagggcaggguggggcgggcugggggggacaagugguauuuucccaggaggaacaaaggacugccucuggauagagaggagacagauguggcccacaggcaaaugguuuauaaaguacaaggggaaaccccaugucaggauaagguauuuaauuuuaauugggcauguuaauuagaugagccaaagggagcuuuugauugcuggacuucaauacuuugaaccuuugaaccaauacuggaccuuaguggucagccucaggaggagaaaguggccaaauaacagacuagaccuuggaggccagcuuuagggaugucauggaacaguuuagcaaggcagaaggagugagagagggucacggccuccaagccagguuugccaggcucgagucuacuagaaccaggcauaucaucuucgucucugagccaaagaauggaugcgauccaacgggaaaagccugugcacuguguagacgcugucauacguugucaucuguuuaagugucagccugcauucuggguggcuggucuagcuuuuacugggacacaccuggguaacuauggaacugauuguugacacggggucugcuuaaugugcuggaugacgagaagagcuguuuauuauugaauacagacuucagaggaaugccuggggaggaaagccaggcugcguggucacuagggugggguuacugcauucuagacugauggguggaggggagagccaggcuucaugguggcugggguggugggugggguuacuauauccagacuguucaucagcguuucagggcuagaagcacaugcuuacacaaaaacuugacagcuuuugcgcuagucacauuuauaagcugugggcuaucauauauaaaucuguuagccagaucgagagaauacaugguauaggugugguagcgguaaccagcgaaugaaccgagaccuuccguuugucuguccuuucaggauuugaguugaagcgugaggaagaagaccagauuucagagcaggauguuuugggggauuugccuggcgccuuaucaagauauaccaccaaagccguuugccagccuugugacuggggggaggaccaugugaacggaaaugaaggggaguggaggaacacaugggaagagugcuccucugaggaggacuuagaaaaacucauugaccaccaaggccuguaccucacagagaaacccuacggaugugacacacgugccaaaagcuucagucggaaagugcauuucuuugccccgcagcggacccauucaagugagaaacccuacaagugucuuggcucugggaagaguuuuagugaccgugccaaccucaguacccaccagagaauccauauuggagagaagccguacagaugccuggagugugggaagagcuucaaugaccccucuaaccucaucacccaccagagaacccacacaggggaaaagcccuauaaaugugggcuguguuggaaaagcuuuaaccagagcucaaaccugcugaaacaucagcggguccacuugggaggaccucccaaccagcgggaugagcccggggagaacuuuggccaaagucuaucauacagugcucacuggagacgaaauucuacacaggagggaccuaaagaaccucagaauaucagcaugggugccgacucuccuggagccugucaccccaacuccggggagaagcuguacucgugcccugaguguggaaggugcuucucuaagagcucugcccucacgagucaccaaaggauccacaguggcgagaagccguaugagugugccgugugcgggaagaguuucagcaagagcuccagccuggcuaaccaccgacggacucacaccggcgagaagccgcacaagugugcggacugcgggaagugcuucagcgagcguuccaagcucaucacccaccagaggguccacacgggagagaagcccuacgaaugccccgaguguggcaaguucuuccgagaccgcuccaaccucaucacccaccagaggauucacacgggagagaagccguacaagugcagagagugcgggaagugcuucaaccagagcuccagccucaucauucaccagcggauucacacgggcgagaaacccuacaagugcacagaaugcggcaaagacuucaacaacagcucccacuucagcgcccaccgcagaacccacgcgggagggaaagcguuguaggcaacaccuccuccuccuccugacagaagcaauaauguguaucuaugccucucaaguuccuaaaacacucuagaaagaaaccuuccgauguuuaagcuugcuguaaaucuagaggugccaucuuuguaaaauccggguaauuuggaagugaauuucagugacuaagguuugaagguacuuccaaguguaauuugguuugcacacgcccaauacacacauagaauccuuacgaugucuuuacaaaugcugucacuugagaacuuagucugaggcagaugggugauauugggguuagaguugaauccguggcccagcauacugauuccuguuucuuucugugccuucgcuacccuucccacggaaaccaguucuuguucuucuugguaguuugcaguuggagcaaauccucacagggaaaaccuugaaaacucacagugagaggagguguagacugggaacuagugccugggguaccccaucuugaggucagcagcaaguggggccacagcgagaucauugcagaaucauuacuaauagaaauagcuguucauugaacauuugcucuuuggcagccugugugccaagcgccuuauguaacaucucauuuaauccucaaaguagucccagcguagaaaauggaggaggcacaauucaucaagacuuguguguccccagagccugaggggcugggugcucuccugaguccucuuacaugagggcauuaaugaacucucugucuuuuacaaguacagaaguugagaguuccugcaggugagaggauuugggacguucagaaguggugaggugcucugugugaggcugaguuguuaccagagcaaugggucugagucaccaucuuuauagagucauacgggugagagagguagguagauggagacagugugacuugcagcgagaucgugcuuuggcuaagaaguggguugaagaguccuuucucaggucaguccugcuucucuguaccuguggcugggcacaggugaccaugucuucccaaacucaacuucccugugcucagucucgccugccuuuuggucucucuggcucaguuucuucauuuccaaucccgaugccugagguagaaggagcugaaacauuguccuuuacugagagggcuugaaaaggguuccauguucuagguucaugacacccuuuuagcuugaguccucuuguccuaagcugcccuauauggucucuuagaccagccacucccacaacaggcuacggcagggaggcccauacacagugcuuuucuuguuuguagcacuuuggccuccauaguuuuucuuaggguuuaaaaacauugaauaaggacuuugacuuucauagauuuuuaaaggaaggugacuuucuuacgucuaugugugaccuuagagugccacuuguaucccaguuacuucagggcucuggaaguauugaucagagaauagcugugaagaacuuugaagacuggaacguucuauuuguaugugagaaaguagguggaagcucuugauugcuguccccucuaaaggaggucacucccuagccuucuucuaggaaccggaagccccuucccaggaacgaguccacuggaggcuacuuucugucaacucucuucagcuuaccuuuccuggcucaucuuaucucugaggaucaggggucauggggugagcccugguuaaagaucagcaaaugucaguuauugcaguaagaagauacguaggauacccugggucugaaaggaaggguccugagggagagaagaacauucuagagaaaguuaccaagguaugaaagaccuggguucuaggugaagguagaggcccagguuuguauccugggguaagggacugggauggugggaggguggcaucugggauugcacaggugcugggacaaggucauucugggugcagcaaugccuucagcucuuucuuuucagaaguuggaagcucagcugggugggcccuuaauggugcuaaucucuaucgauuccagccucacauucagcacaugccuuaguuguaauuaaauugccuagugcuuuuuuucucuccaaacugaac

SEQ ID NO: 2136 - RNA, 33030 nt, Mus musculus
caccgccgccaccgccgaagccgggagcccccagcccggcccuacucgggccgccgggcucggggcugcggccgcgucccggagcgccgccagcacugccagguccgugcgggcccggggcgcgcgggggagcgggcccgcccgcgggaaaguugcgccgaguugcggggcgggggccgggcgggcgcgagcgcugucagcgcggggcggccgcgcugcgugggcccgggggucgccggugccucgggccgggccccggggcggccguggcugcggcggcugcgcgcgcgggguaggcagcgucucccgcggcgugucugggguucgucuccgagugugugcguguguguuuuccuaagccgggcuauucaaaccugcugcaauucuccgguaaacaaugauucauggggcuuaaugcaaauaaacggauugcaaacggcgcgguucgcgcacuuugcagccggcccgguggagcggccagugccggauuucuccguuuuuuugcagaucugcagaauauggcgucccuguccuguuuuaaaaauaagccaggcugccauuuuuguuuuucuuuugucugaagauuuuaauaaaacugucugagaaugugggagaggcggcuggaagcagagggggcacccgaaggguuggcuuuuuuccuuuucuuuggagagagccgggagccuuucggggaggugagacacaauacaauuacacuuuaaaggaaaaaauaagggggagagaagcugccgggugauuuggggggagggggcugggaauuuaaaguuaacucugaaaguuuucuuuucuuucuugcuuuuuuuuuuuuuuaagauuuuuuuuuucuuccccugagggcccugagaugccgcgaaaggauaugggggcccauuucucuguuucuucccaccuagcuagucgccuuugcaggguuuuugggaaaaguuaacugccgguuuccccagaacugcguggguggggaugucguguguguguguguguguguguguguguguguguguguguguguagggcugaggugagagguuuugggaggagucguuuggacgaggcucuguaucaaagugguauuguaaggaacuauauuguagccccagauuugggggaguuggcuggcucuaggggcauaaagugggcccaggguuuggagcuaagaucccugucaugaggacaugacccuucuugccacccuguccuccagcaguguggauccuuuaggagcuguguguguguuggagauggagggaggcuugccccuucauggguggccagagcccccuugguggacaggaaguuuugguagcccccucuuggggcaagucugguugauugcaguggaagaacccccuucagguauggguggucuucuuagccuccagagauggccucuguugaugaauguccuuagugguggguuuuuagcuggguacaggccugcagcuccugugggucccgauauacauaggaguagcugacugccuggcccuuguguucugggccuguccucugcuuguguuaacuccuuucugccacccggccugccacuuugaagucuccugauuggacaucaguugaguuucugaaguggcugacuggacuggcuggugacuguacaggcagcagagugguaugaggccaggcccauaaaaucugaauguggucuuuuccccuuuugggggagacucuguccuaggaggaugcucugagccuuugugcuuaucuagggcccuccccccauuuccuggagggaaaagucuccuuucagagcgguguccuggcuucaccaggccaaugugagcuccccaagggcagccagugggaacaaggccugagagcguugagcugcagagcuaggcaugccugggucacccgguucugaaccaacaagguuuuagauggagaaacugaggcccaagagucacuacucugcccaguagaggagagcugagacuggaacccacguuuggguucucuguuuuggagcgcucucacccccagcaugguuugcuucagacaaaacugaacaggaauagacaguguggcccccuuccuuucccccuggaccccauuaucaucacauuucaggaaaucaaaugucacaguguguaccauguccuauguggcuacagccaugucaggcgcuccccaaaacugaguugaggucagauguucaggugggggcaguugaacucauuuuaaaauuaagaaacugaggcuuagagaggcugggcagugacggaggagggauggccugcagacuccuugugugggccuuuccuaaguggguggugcugugggcaggaccuuucccaacuucuaguuuuuggucugaaauucuucugcugaccccaguggcuguguaaaaauccagaggcuuacucccaccccaaagaaugucagagaugaaaaggccccggaggucaucuggacucggagaggaaagcacuggcuccaagucuggcccuagcuuguucuggagccccgaucuccugucuccuuuuuucugugaaaugcucagagagagagagugaaacacugggcuggguguaggggagcuagcuggugcaggggcuggcggguaauggcuacacuagauaaguuggcccuaggggcuaagggauagucugcggugaccuugggaaacagaggccagcuuggucuuaggugggaagaaacugcugugugagcaagcuguggccucugucuaaagcaagcuuagcccugcccuucccuaggcagccauuccuugccucuucucuuguugcucuguauucuuacuguuuguauagucucucauuugugacuaggccauucauuuguucuuccacuguccacuucuuagucuaugggucaguucaguaguccugucugucccaucaaccauccguccguccguccguccguccauccauccuuccauccauccaaucaguccagcuccccccagcccagguuggacagauaugagaugcaaauguaacccuggcacuuuugaauaccaacagaggagaaaagccaaggcuucggguacguuccuagggauugagaguaucagaggcucuuuagcauuugugucucagaucucugagcaugcccuguaccucugugagcuuccaccuguacagugggcgcuguccuuaucucaccaugauggggggagauaauaacaguggcucugaggucucccgcccggccaggcauguccugggcaugugcucaggacauggucacugccccauaaggaccgucauuuacuuuucuaguccaggccuugucucugugaaccauggcggggggguuuucagaaugccaagugaucuguggacccugacaauccccuucucccccugcugaaaguuccacugcuuccugaacauuuagaagaaaaauaaguaguagaaauuuaguagaaaaauaaguaauaauucuggccuacggggauggggagggggaggggggcuucuguaguuucagccuugcccaccuuucaaccucugcuuucacgcgccagcccugcccugccuaccccuauaucuuaccaccucuggccacgcuagcuucuuugcgcaccuucccugaccuggaauguuuuuuuuuccccgaucccguggcaccaucgaacaucaccuccucaaaggggccuuugcugaccgucugcuguaaauagcuucccacuguuacaugagccccugcguauuuucuuuuguggcucugggcaucugagaccuucucauuugcuuguuuguuuaagcaaacacaugucugccccgggcacauguuuaaguucuagagcagcuuaagggccacucaggcuuccagugagguguggucgggacuucggcagaggugaggagggacuguggagccaggugugguggcagccucgguguccuggcagugccugggaggugaugucacaucgaggucugucauccuccccugggaaucuugggguuguuguuaggcaguggugggauugauuagaucacaggcccagacucagaacgguagaacccaagcagcuucccccacccagaaccuuugacacuuugaccaugacccugucaugaacugucaccauguguuuagggagcaacagaggguggucacuuugugccagaccauguucucugaggcuuugugcauauggagauauaguugucacuguuauccucuuuugcagcugaggaaguauggguauggaggagucagagagcuuaucucuguggaguugaggggcgucuggugccaggugggagcacugcugggucugguuaggaucccacaguuguggggaagcccagccuuaccugaccccugcccacauccuaacugaagagcuucugcucucucucuccuagaacucccucccucccuagagcccuugucacccaugcagucagguggcugucacugcugggacacuguuucuucuuuacacacuuagaguuccugcaccuuccagugaaugaccgugggaagccaagcuagagugccggcuuccggggguguugacugggucagucugguggucuuggugcacaauauugaacaugugaaagaacgaaucaauggguacacagagacugcuaaguauuaccuaagcaccccacccaccaccccaccccacuccugucucuguagcaccaugcugacacuugcuuggggucccuagagaggcuugauguccucagggaaaugagacccgcguucugcuccuguagugggcaucugaugaugcuuaugcagccaaugucuucuuacucauuggggaaacuacaggguuagggaagaggggugcucugugccuacgacuguaugugucuccugaggcuuucuuuaccucucugaucaucagguuugaacaggcugcccagccuuugccuggggguucaggggaagcaagaagcccuggcgggaguagcugugccccauucaguaccauccgccccccccucguggagcaaugguccugaagcacagaaaauuuccccgacacugaagaagccaaguguuguagauguguguugggaacagcugugguguuaggagagcuuucuggaaccccagagcagaggugggcuucagagacuugacaaguagcgagguggugucacuaguagaucagcugugacagacaggcugagagucuuggcucugaggccuaaggagucuuuagucuguugguucuugccucaccauugugaccagcaaagguauccauuugagcuuuaggcaaaggcuucaggcuugucggagcagccguucucaaccgguagguugugacucuuagugggugugugaacaacccuuucacagggucacagaucaguuauccuguguaucaaaucuuugcauuaccauucacaacaggagcaacauuucagucacaaaguagcaacgaaaauaauuucaugguugggggucacuacaacaugagggacuguauucaagggucacagcauuaggaaggccgagaaccucugccucagaggauagucuaguuagccagauucuggggcucuguugggggacaccuggcugugguggguagacuccccauuccacucagacauacacagucauacacauauagucaucuguucugccgccaucccugagucuucaugcaucccauggcacucccucgggccaguguccaccccuugccuggaucugcuuggagaaguggagucacccaugaacaagagaaggcaguagaacugagaaccuggggggggggggugagcuaccagguaggguuggggauaguucaguccccuucguaguaagucuucccagguccgcccacccacguggccacccaguccuucugcgugggguccauaucauuugcuagccuuuacucaggccugagccuuuccuggccugaucacagacggccuacacgggaggggaaggggcuacuucauggaggaguuaugagcacaugcugggguucuuaguuugggaccuaucuugaaagacagauucguccaugucagcagagcagcccugauguggggaguagucagaagagcugagggaagcucccgcaccucagauacuggcacacgaguguaagguuccucggaccuuaggagcccaucaccggcagguguaguggcugcauaucacagagcuaggcaccauucuggaaucguaugccuauucaccuguacuggccuugcugcaucccuguggccuguacggugacacacucucuacccucaccaguuacagauggcaacuuugaacucggggcuuuguugugauccagaggcccaggccuagcugggcucucuugacuguaaaugccacccuuccaaccuaggcccaucccuucccagcugugauugguugagccccuucacuuccuagagaaggacccagagacccagaaagguuugccagagguuucuguacccucagcccucaccacagagcaccaugcccgacccuaaaucaggaaacacucugagaaccaggagggcaggggcaggguuuauggagcugggcagaucuguaagaaggacaggguaacccccccgccccgccccccccaucccccgcaggaugccuuuugauacauuagcucagguguguucuagacaucuuccugggagugugccacacuucagaaauguccacagcaucuuucuugagagguugggagggaagugagaaagacuuggaaagcaucuaaagguaucugggaggaggaaggguuggggacugucacccugaucaaccuggcauccccgagggagcugccagcagaaagucaauaaggugauggcgucucgggcugcugcggaagguucauugcccuggguugucucgagcuggguguggagcugccgaggauacagggaugggggaguggaaggucaggaggucaccgugugcgcacauggaucaccccucucugccucccaggccuguggggcuacaaacccugcccuaaucagauccaggguccucagucuuguuccucacgggaaguccacagaagccaguuucugaggcggcagcuuggccuggcugcaauuuuagggguagaguggacagggcagcaacaggaggacuucauggaaugggggacauggagggcagaggggcggugggaggcagguguucagaauggauggcugggugggucucacagagccaggcagaaggcagucucaccaaagccucucuccugcaaagccuuugcuuguccuuucuccggcaucccccuggccacucuggacugcucagggcccucccucaguacaugaacugcucaggccaucgccuguaccugcccuacacucaccaugcugccaugggcggcuccugauuccugccugugcaguucugcucuucggggguggggugggggagcaguguucccucucugugcugggaaugcuucugucuguaccccucugcucuucuggcaugaagagaccccgcccccuuugagccccuccaggccuuauguagcaccagugugaacugagcccugcccaucuccaauucggagggugcauggcuuugccgugauccuaacgucgagugucacucuuggcuguuggggugaccaguguauuuagagguacgauaaagggaggauaggaguuuggaacuggguaaacugauuccuguuaagggaaagaucagagaaaauuugccuugaaucuaagauccgucaauugagccaugaggcccugcuggggaccagggaauacaaccaugaacccucaaauaagccauccucacccagcccacggcucguguggggaacuggauagacaaaugaccaggccacucaccccuggcagugugaucucagcugagauuugaugucaggauucuggcucuagaaccuucagaugguuggcacaggcuggcauguaaaagcagcuuguuuagggugggugguauaagugcugauaggggcagaaggguaggugcagugguuggaugacgggaagaaugugggcgacaggaccucuggagaccuuggcugaccagcugcaggguuaggacuuccccaagcaguggaccuauaaaggacuuucugugggagagugagugacagacaggcaggcugggcuaucccucggccugucuuccuggcuggagccccuggaugcaaugagacuuccucacugcccucccacugggggcauggguagugcuagggcuuacaguaggacccuuaucuucucuuuuggaaaaauuuggagaucuucauaguuuggauaggaggcaagggugucuugcuuuccaaacaaagcuugcaaaagcuucaauuuuauuuuaaaaguauucuucgaggcagccacauaggcacacgguagaaaagucauaaaagacagcuaugaaguacaucagccccccggcccugucucugcccuguuccaacccucgcuccucgcccacugucagcauucaagucacuuaguggcaucccauguugagagugauuuuuaucuuuuggccuccugacuacugucccacaaguaucuccuaacugcccauggaggguuauuaacuauacccuuuaauggguguggugguagucugaacuccagaucccccauagucuggaucagagccccacauucccugcuugccuuugggcagcugcccagucccucugugcccccggucccucauaggcucaugugcacauugaacaagucacagcagugucacuguggacagucacagaggagagucauuucagagccaucucuaucgcuugcaaguuuggccguuccagguucucgcucuuaagaacccacgaccauaagcggugucaugcauagaacuucagguuguuuucuagggacagcugaccaagacugggcucgcuaggccauggggucugaauaccuuuugagcuccucacauaucaugggucgauccuuucuggaagugcuuguuccaguucacacucccaccgaucacccacagaagugucacuguccucccugcgcccccaccaguaucggguguucucauuuuucauaguucccuuugcucuguuggcaggggaagcccguuggcuuuucauggcuggugaggcagaaccgcaggccguguucacuagccacucacaucuuuaaggaucagcacacacgccacccccugcucaugccagcaggaaugggguuaggcagauagaggcagcagaucugaguguacugcaaggggcuuucagaggagggagggcauuuacuucuguccagacuguaacauuuuuaauucccaugcaugcacacugucauucauucauucacucauucacucacucauucgaacaccaggugcugccaaaaggucucuaauucuuucugauggagucccgugacuaggguggcuaagaagagacagauaugggaagugcccugaugauaggcaugcagggcccagggcacagaacccacguaggguuagcagacuccauaugcaggaagaagaaacugugcaucaggaaacaugggaagggggaggggggaggauuuggacuuggccagugaguggcccugggguccuugaaggauagaaagcaagaagggaagcagauucuauagggagaggaacugucagccugaguggccauugugcacugggucaagcaguggggacagaagacaaccaaugaccaccaagagcuggucacacaacccaugucauccuuaccaugccugcaguagggagcccugcaaucgucgagguagggcacggugcagugacuguaguagacuuaggguaggguggacauggagagccugcaggggugaggcucuugcaauagcugaggccagagcugaaggacugggccagagaccuacauugcgccccagccugugaaauucuaaucauggucaaagagcagauugcguugccucuuucaggaagcccuccuacauucccccagcuuaguuuuaggguuagguugugagaggccugaugcauggugggucugaagugcccccaucagcugagccgagccucuagcuuagccccuuaggcucccaaucacgcacuuacuuucuuucuuccuucccccucucccucuccucucucucucucucucuuuuucuuuuuuuaaauacuaaauguauuguuuucauuuuaaaagaaacggaaugccuugacugagaauuuggaaaugagggaaacaaagacaaaaccccaagcaacugaggcuagcaccgcccccuccugccgcugaggcuagcaccgcccccugggcuccgugccccugugggcgugguucccugaagccuccuuuuaaucagggguccugcugucuagguccggcuccucccacuuccccgucccugcccacccacccucacccccauuggccuuuucaaaagccuguucccgugugggacugggcagaucucaguuuuaaugucugugguguggcuuugggggugggguggggccuaaauuuguugaacugacaacccucuguuccuccauccuagcagcagugcuccccccuacaacccacuaugggcuguguguccucuguguccccaggaggcagagccuggucccuagugugcccuccccucuggaguuugcuagaguggccuccgagguuuucugggaaaaggugacagagggaccugcuuugaaaucuguacugaggcuuuguagccucagcccgguugccuaacuugucuggaccucaguuucuucaucuguaccaugggucuauuguugcuguaaauauccugccacaguccucagccuauuguagguagccaccuuggguaagacgcuggcccaggugagaugccagauaccaaccugggaagagcuuuuagauucuccuagcggcugcguuaagaaccacaccagagugcaugugucccuuuagggcugggccaggguuggguggcacccucacucccucacucacuugcugugugaccgagcaaguugacuggugucugugagcuguacuucugucaagugcucauuccacaaagucaccgggaagagucaauaacuugauucauaagaugcucagcacauugguguuuaaaucaacaguagcugccauuuuauuguuauuguuauuguuauucccauauacaaggugccguugggaacacagaggaagugacugacuggggguucagggcaagcuccguagaagagggaacccuugagcugggucuugaaggaugaguagaagcucaccaagugggaaaggacccucuagguaaggagccugugacuccaggcugcgggucuguuaaugaggggguuguucuuuggggaucaagacacuguguccauaagagucccgcgugccccucacugcuguccucugaaggggucuaugggggagguaugcuugccuuguuaguguugguggcuuuggcuucccguucccauggguucaugcuuguggccacaggucugucugucccgucuggguuuggugcugucugcauguuguguuaacuguauuugucucugucgauguccagagaucugggccacacugugagggcagcuguauacuucccuggccacauggcucuccagagccuccaggccccucggggcccaggcucaguccuagacucagaccucuaguugggaauuccccugccacccacucuggccucucuagaaucugcugcaacugacaggucuuacccggcacacguuucuccccuuuaccuacugcugcagaccuggacucugggccuaagaacuaggggucagccaggcccuggcggacugcccaggaucaucucuuugccaggcucucugagaggcugcaccucccaggcaccacaccugugcauugcuugcccacagcccuuugcagacacgguucccgcuacccgaaugccugccccagccuucugguugagucccacucacucucugagacaccaggcaggccuccuugguucaccuuuccaggcuaggccagcaucuccgcagcuuauucccuuacuuggaaguugagcaaaagacuugcccaaggucacacauucagugagguggaaucaggauuagaacaagagccugcuguuuccuggugggagggaagugcucaaggccagacugcuggagaggcuagaguggacuggagagugucugaaaauagccucucaacccaucucagcugggacuggucugaggugggaaggucacugugugucugugacuugcucagaggugagucacugggggaggggcuugucccgggagaaagccaagaccaaggcaggcagacugauacagagaagcuucuaagauacagucugggaaagggcaggggcaccagggagcugggccuagacucaagguggagggucagguugguugguacuuauagcuccuggguagaugggccacuguugcugagcugcuacggaaugagggucgugcccaaugcugaggagcccagugugagaggcugggugggaaaucgugagagagauggagagaucaugaggggacgcauagggacccuucaugggcccagguggcucugaagggaauggccuggugguguguagaaggccucauagguagcagcucuuuccugagucccuguucgcugcucccggaggcuggcacaucugacuagccccguagcuggucccuggucuggcccaguuugugaaacaacuccaggagauguuagucauccacgguuaaacuuucucuaccuuuuagagcaagaaagacaaacggcagcuguagguggaccgcaagggucagggucaagguguguggcucccuacccccauucucugcccauugcugaaggccccagcugacugcuacuguguuuccucugcccauccaguguggacacucagcccuggcaggcuuggcuccuacuucuaccccaguauauucccacugcccccccccacacacacacuuggugucccccccacccuugccguugcucccuugguccugcaugcucuuuguugccuucauuccauccccugucucaucuuggcauucaaggcccuaaggcugaccucagugucccaugccaccguaguacugggaaggugcucaucuugcucaucuuccacaucacugcaccuuccuccuccucugucuguccggagugaguacccguccuugccucucuccugaauaacauccucccuuagggcaggucuacccacaugccagauugccugugaauaccaggcaauggccccguccugcccccuguaucuggcacacaguagguggauaccagggcaaaagucauugacagacaccuagcugcagaagggcagagaaagaccaggaagaggauguguaguucccugccagagccucuucuuaugugcuuggcuguguagcuaagguuaucccuggcuccucagugguaaaugauaaaugguaguguauauuuuauucuagcagugggacccugggcaagcccucggcucccuagaggaguggaggaguggagaguaacuucccuagaacagucuggaagcagccuagcgcagugggcagagagcccuggagcagggcagccugucucacccaucuuacugaugcagaaaacagcucagggacuguauuguauccaaggcugcugguaccaguccucgcagccuggaacagguguccuuucuaacgacugguggguuccuccaugaaauggugacagaaaguugucccugcuugucauccucgugggcuucugaaacagagggcacuuugagcagcuagaaagcaggaggacuugccagucagagaauuuggaguccuagucucuguucauuccuuccugaaauucacacugauggacucugguccuggaggccggggcuaucaguaggaacagacagguggaccuauucccaagcuacuguagguuagcucgcuccucagucuccccuccccacaucuccaccucacguccacucguggggguacaaccaugccacccuaggacacaccuacaagccuacagccagaggacucuggccucucccugaacaguucaggggugaaugcacuggauguggggucaggcuaaggguaguggagucucaguaguagacucacuugcugugugaucuugagccagucacucugccucucugaucuuuguuuccucacuucuaaaagugggcauggugagaguuccuguucuagguguccgugugcuugggacaaggugggcacuuguaauucacagccuccucacauaguccugcuuggagauuuguuuucugggagagaaaccccaaaggccugggcagucagggagaggagcagacagaauaagaggccagcauggguuugaugggcagaggggccuccgaugccuguggggccagaaggcugacaggaugggaaauguccugguuaccccuuguccccagaguucugcuccagcccaggggcugccgagguuaggagugagggguaggacuuuuaccuuagagcugcuggccuccuuucuacugaggacuggaauuccuaaagcaaacgaccaggaaccgcagcuggagcaaucucgacuuccacgcuaacguagcacccuagaggugcugggcggccuccuuccucccuucaagccccagccucuucaccuauaagaagagguagagaggggugccuuuuaugcccccuuaucaagcaaagaucacaaaagggauccauauaaaagcucuuucugaaaacacucagauuagacuguccgaguggcggcuguccucagacucugccacgguuccaggagggacuuccaggcucauuggagcaagccagguugcaguuauuucuuuguggucuaaagcugcaauaccagguaggguuugcaaucagaagugauuucugaaugauuacuccaucuaccuggauaggaagcaaugagcgagggaacaccuguguguacccacucucugcacaucaucacuugacugacaggaaccacagaaaacucaacuucuccaccccacccccaacucccaacccccugccccugaggaaggacaaagcuagucuugagagccuggccuuuguauugcccugguuuaaaaggcccuccagcccauaggcugccaaacuugccagcaguggggacugccggguacccuugucacaucaugucgaccccuggucuccccagccuccccccuuaagcacagcauccugacaccccaucuuugcaggucagauguuacacaccugucagucagugccuagacuuuccagaguguaauuguugagacaagagaagcacuuauuuggggcuguguaaauucuucuaccgccucccuucagagaggcugugucuaccccccaucucauguauucugacggggaugucuucccuaagggagaagggcagaagggcaaggaugcaggauagguagucaguugccuccgcucuguggcuauuaacaaagguguucccuggacucuccagguugucuggggugggggaggguccuguguagaagaaugcugcuauguuggcucugaaaccuaggggauggaaacuggccuggcagcauguccccucccccaaccaccccccaccccccacccccgacugggagcacucuggucuggauguaaccuuugccccuugagguccacccagggagacacugaauuccugacuuuucagccugggaauaugggucucuggacuccguggaaggcccauuuggcugaggaauuugggucucacgggguaaagaggucucauagcugauagugacaggugcucucccuuccugcaggauggccgaaccucgauuuaacaacccguacuucuggcccccuccucccaccaugccgagccagguaagacugacaucgccagucccugcugccuuccaugggagcuacuaugcuuugccuggggcuugggcaguagcuugcaagggagagagcccuggggugcggcccacccauuccaauuuggcuccucucccuucugcagcuggacaaccugguccugauuaacaagaucaaagagcagcugauggcugaaaagauccggccaccucaccugccacccaccucagccucaucgcagcagccacugcuagucccucccgcgcccgccgagagcagccaggcggucaugucgcugcccaagcugcagcaggugcccgggcugcacccgcaguccgugccgcagcccgacguggcacugcacgcgaggccggccaccaguacugucacagguaaccugagugggcagggcuggaggugguaggggaaguggguggggccuagggagugggcggggcuggcaaggucuguuaagaauguuggggcggaaucuaguccagguagaacuugacuguuugagaacagggugggcaggacuugggguuguaggggaaacuuggcagaggcuaguggagcuagccauagcccccaggcuucuuccucugaccuugaacuaugagacucuccucugucagauggacgcucacuaggaaaguacuaucuagaggacucagaaccuccaaaaauuugaacagaugcaggagacaagagacugcuuccgcggagaagacaaaggaaagguucaaggcagaggagaaaagcaaggcagaagacagugugcucuaccccacacuggcugugcucccucagugcccagccaagugccuuucucccccuucuuagagaugcccaaaaauugugggcucugugagccuccccaggccccagcuguacuccgcacauuuuccguuauugugauuuuauuaaauuuauuuuuucauuguaaaaguaauauuaaaaaagcaauauacgcauauuaaaggaaauuugggaaaaggaggaacugagaaaaaaauuauucauaaucccgagugucuaacccagaaucuuuuuuuuccccuuaacccagaaucuuagagacucucuuggugcauuuuuuucuuuuccauaucuuuuguuuauucuuuaauaugcgugcguuugcuguguuugugggguguccaugacuuguuuuggguuuuuuguuugcuugcuugcuuuugcuuuuugucuucauccccucugcaaccucccagacaucuuuauugcacauuuauuguaaaaguaacaacguagucauuauugaaaauuuagaaacuucagagaaccuaaaagaggaaaaacaacccaggagccuuggccacuuuuguuagcauucuuauguguuuauaauuuaucuuaucuucugaucacagauguuaagaaagauaagugaauucaccaaguaaaagauucaacuaauuuugaaguagacaaacaaacuacggaaaaucccccauuaccaaaccuuuccccuuccucggugaagagggcuguguuagccggcuggagcguccaggucuaaguccauacuggcuugcucacauccauacaugugguuagagugugcuuucugggguaggugggcccucgugggcuugcagagccuggcguuccucuguguuccuugcguuccagcucaccuaucuuggcggcuguacaggccccguauccauguccacaacccacgcugaagacaagcacuuuauaucuuuguggggaaucgugguuuuguguggaaagccccugcguggagaucuuugugcucaagggugaucauuucuuuguggugauuucuagaagaagaaucaguugccuggcuaaaaguuaugagcauuuaagcuuuuaauaguuaguuauugucaaacuguccucaguggaaucaagaagugugcauuucugcugccggugugagcacaaaccaggcucacacccacgcuggaucgcaucuuauuugcuuaacacacagauucuggcuuuguuaaaaauauagagggauauaaauaaauugagccagaugauaaauacuaggaucauauuuuuaucuacuauaagagcauuuaucuauaaaugcuauuauaaauguuuguaggcccucccucccucccugaugggccucaguguuguagucuaggccggucuagaacugaccuucuuccaucucagugugcacucccaagugugcauuacaggcagcagcuauuccuccacuccugccuuuauuucuaaaagaauuaacuuucagcugagcacagcgacucauguggaaggugaagggaagagguuuaggacucacagagcaggccagccugggcuacacaggaccccaugucaaaaagcaaaacuucgauaagagagguaaauaaauaaaagcagacauuacagaauuagggaggguuuucuuucuucucuuuuacacuucauuguauaaaaccagaaaacaguuaaacuauuuuaaaacgcacacacacguauacaugucaccuaucauuugccccagcaccaccacacguaugcacgccgcccauuaauuuuuccugggcuuacauccacagucuuuugaaacaaagacaaugggaaguuggggagaaaagacugacccguuugcucaacccuuccccaauuugcauaauucaguuuucucugagaucuugcuauuauaaauaacacaguggugagcgucugcgugccugggacuuuuucugugggugguggacuuauuuccaaagugcuucucgguuucgguagugccugguacaaacccgaggccucgugcucgucugcacucuacgagugagcgauaccuucagccccuacgcugacuuuuugauacaacuuagcccaggcugucacuuaucuagggcauuugacaugugugcaagcuguccuuuaauuacccccgaguaaucacuuaggauugggaacagcucagggaggcaagaggaccggucugucacagagcugggugaccuguggcucaguuguccuuaacccaguccccaugugugucuuccuaggucuggggcuuuccucucgaaccccugcugugaguacaucugagucaaccccagggacuggaacaggcaccaguaccccguccacacccaccaccaccagccagagccgccucaucgccucaucccccacccucaucucagggaucaccagccccccacuccuggacuccaucaagacaauccagggccacggucugcuuggcccccccaagucugaacgcggccggaaaaagaucaaggcagagaacccagggggucccccuguccuuguugucccguaccccauccuggccuccggugagaccgcaaaggagggcaagacauacaggugggugucucuucauauggggucuggcugagguugugggagggugugugccuggacccagaaaguguggacccaggaguaagaguggggagcuuagauucaaagagcagaguagacccacaccagggagaagaugggagaggaaaagaauuuagccccaucagagguggcccauggcaggcaggacucuggggugcugagagcgcuguccuccugagccguguuaaaacaccuugugcacuuucacaaaaagcuaccaccagggcuggaccucuccaaggucugagugagcuggguggagguggggagguaggguaccuguacuugucaaaaggucccagaaaauucuaacacacagccaggucacaaugacuuaaucugucagaaccuccuuccccagggccacagguguggccguaggcaagaccuugcauguuucccuguggcuguaucuacgucccccagacagcuguucccagaugucagagcucccuccagacuagaagaaggugccugcgcuggaacuugccccugucucucucaagcaggccuguguccucuggacuccauaaguagaaucugcccccugcagagaaggucucccuggagaccugcccuuugagagaggaggucucccuggagacauccugauguggguggggaucuucccagucuugaagccgccucuugccuuauagguguaaggucugcccgcucaccuuuuucaccaagucugagaugcagauccacuccaagucgcacaccgaggccaagccccacaagugcccacacugcuccaaguccuuugccaacgccuccuaccuggcccagcaccugcgcauccaccugggugucaagcccuaccacugcuccuacugugacaaguccuuccggcagcucucccaccuccagcaacauaccaggugggugccucccucccuuccucugcugugggcccccggagcucagcacuagugcuagaacaacugcagagaggggaagggacucucggaugucugucacucccagggccaagaccagaguccucugaugggccuuuuaggccacacuggaugaaacccuucacugagggcgccaugcuggauggaacccucuagccucucucaccuccaggucuuugcacuuaagugugcuucgcuugacacacccuggccgccucuucugcaccucuuccgcuuggucgcauuuccuccgucauagcuggaguguggcuucugugugcccacagguccugagcauccaaggaccacuuguccccuuugaaucagggguaggcugccuccugcuugccugugcauuuuucuaccucccucaauauuuugggagccguggcaagccaggccuugguguccuguauuucugugucugucccccgugggcggcaacacgcaugaguguuuaggcgucuguuaaguauuuguggaauagauagacccaguuuggacaucaaacgugauucauccauguagcagacauuuacucagucccuaugcugugccagacagacuucuaggaacaaaccagacaaaucucugcccggugguugugcauagccuagcugagugcgugaaaggagguuuagggagauggcagugugcucaagggagagcagagggacgccggaaagacuggcucccuccauacaacgagcagaguuuaaaagagagaaaggcuuagaaggucuaguugguguguuccaugcguucggaggggaaguacagcuugcucaugugacuugcucaugugacuugcucaugugaaaguaggucgaauguuaccagugcuaaugggaaaggacgguuugauugcagagucuauaacuacugacagcuaaaguuuuccccuccuguaauggacuaaagcuauauaugaaaccauguuuuauugugaguguuccuuuaaaauuuguuuggucugugguguuaggaaucaaaccuuuggccucgugugugcuaggcaagaguucuacccccagcccugguaaauuuucauuguggugauuuuuuuuuuuuuuuuuuugguaccauggauuaaaaccuaaaaccuugugcuugcuaagcaaguuggcuaccacagaacuguaccccagacuuuuuuuuguuuuguuuuguuuuguuuuuguuuuuuguuuuucgagacaggguuucucuguauaguccuggcugcccuggaacucacuuuguagaccaggcuggccuugaacucagaaauccaccugccucugccucccgagugcugggauuaaaggcgugugccaccacgcccggcuguaccccagacuuuuaaauuuuucuuuuuuauccuuuugaaacaaggacuuguucuaugcugcuccugacgaaccugccaucgucccucugucuccguaguagcuagcuuaauagagugugcuuggucacagucggccuggucacaguguugcucguuggucaucugucacuguggucuuugcagaguuuauaucagggugcagaugguuugccuuguccguuguucugcuuuguguguagguucagugguaagaaugcaucgacagcacggcccagagaaagccgucagccuaauucccaucucugggccuccccagucacagauuugacugugaauauguuccagcaauuuucugauggugucaugccuugauuuuuuuuuuuuuuagauuggcuggucuaauguacauagguaugugagacaugguaucgaggaauaaacaaagagcugcugauagcaugguuuggagaauuacagcauuugguacaaaauacugucaggagacucugccaagucccugggccagaauuuucaucauuguguauaugugauuuaaaaaaaauauuauuagggaucagugaacaacgaacuaacugauuucaccucugccagauuguaggauagcagggauacccaccccccaaccuuugggagaccaaggcucucgugucaaggcucucaggcuguuucuuguucuguuugguuugucuuuagaaaggggcaauaaggcacaaguagcagagauaggaggaucgggauuucaaggcuagcuucagucacauagcaaguucaaggcuagccugggcuacaugagauccuguuugaagaacagaacaaaaccaaucaacaauuuuuaaaaaaagauuuauuuguuuacuucauguaugugaguacauugucgcugucuucagacacaccagaagagggcaucagauuccauuacagaugguugugagccaccaugugguugcugggaauugaacucaggaccucugaaagagcagucagugcucuuaaccguugagccaucucuccagccccugacaacaauuuuuuuuuaaauaacauaaggcuuugccuccccaggcuguggagcauguccagccauuuaccaugguggccucacucucacaggaggcucuguccuaucagacuugucaugccuaauuaaaugagauuugucuuuaaaugugacauuucuggcauggucacgguuacaaauuugauuuagacaguuguauccuguuaggaaggagagcggacuguuagaaaggaggagacuccuuuggagccugcuaucagagcuaaugaugguaaagugugugugggggggggggucuccccaggcagagagagggucucacugaagugccauucugugugguuuuguagaugaggccagucacgugcaucgaucguuuuuuucagaaagaugugauuuuaaauucuccuugguaguuuacucauaucuaaggaugugaaguuucuguagcagccccccuccuccgugaaucugaaggguuaaaugaaacaggcugucuggagacuguuucaucccaucuuguuaaauauagcuuccuaaaugaagagucggaggcagaccaaguagaccaaguagagggugguucucuuggguucuuuaaacaaugaaauauuaaccacgaugaaacuggcuucguucuccuuggagauaauucccugucuucugaccccaugucugucaguccacugggcuaugcuguccuuaucaagagcaaagacucaggcaggcagcgucaguucucaggcugauagcacauucaaggccccagaacugaggucugguccaggccuuucucaggcuccagucucuugauuuucauugggaagacucuggaaguuucugaccugcugcucagggaagaagccuuaaggcagaugugagggguccagagagcuuuggauaggacugcauggcucugccccaucagcaagaucugaagggagcguggagcccaccguuaaggccucuccugugcuguuccuuguacuaagaacacgaugcacccaguaagguuggcucaccuucagaggccuucaguuuauccuguauagcuaauugagaaagguauuuuauaucuaggaagaauucuugugucugugguucagaggaucaaacccaaggccuugggcaagcaucuaccacuaagccacaugugcgcacaugcgugggugggugggugauguauguaucuguguauacacauacguggauacauccaugagcacgugugcagaggccaggggaagagaucugggucucuccugucauuggcagccuuacuccuugagacaaggucucuggcugagccuggggucacgcuggcauccagccaggcccggccuucuuccugucucugcccucaccuuccacacugggauugugaguaugucacuaugcgccuuuggcuagucaggaacugguucuguagaacaggcugcucccagacuuccagagaugcccuuguuucuguccucuaggugccaggaugaaaggauugugccccugugcccagcuaaguuauguuuuguugacauguucugggacaauaucuguacauuagcaucuuugguccaucuuaaaaaguauaugcugugggcuggcgagauggcucagugaggaagggcacuugcagccaaaccugaugacccguuauauauucuaguuauauagaucuggaauucccaugguggaaggagagaacugacuccugcaguuugucuucugaucucugcacgugcacugugacauuagggugugugagcaugcgugccuguacacauacauccacaaaauaaauacaucaaggcaguaaacuguuuucggaagaacaagccauaugugcuggguuauaacuccagcacuugggagcuggaggcccaagugucaggaguucaaagccacccccagcuacauaguaaaucggaggucuggguuauauaagacucugacuccaaacaacaagcugaaugggaacaaaagauuuauuuacauuagauauguguauauguaugaagugaacccaugggcacuuagcuucuuguuuggggauuugcucuguucugaggcuguggacuucauagggcaguuguagucuuauguccaacuaacuggaaacaggaaggggaccagacagcccccucccuuggugcauccuccuuuccagugguuaguacuauccagugaccuucuagaaacucuaggaguguuuuuauguagaaggagcuggaaagguuuauuauucugaaccaaaggucuggaccugagaacggccauugagcgcaaagucggccuuagauaacaauagacacaguuggggcucggagguuacgagcucacauagcucuucugugagaccucagugugauccucaccacaguccccaggcccacagccgaccguaacuccagcucugggaggaugcgauuccucuggccucugugggcaucugcacucucauguacauauucccacacagacacagauacacacacacacacacacacacacacguacguacguacguauguacguacguacacuugauaaaauaaaucauuuuuuuuuaauuaagagaaaauagacacaguagcaagcaguaaugaugucuaagaauucuguuguuggucauggguagacuuugucuaagcauaugucagaaugguuaugggagauucacaccuguuuucccagcuccuaggcugggcaggaggagcuauucaguccccuugaagggaacuguuuugccaaaauaauauucucagaccugggggauugcuucuguuucugugguuucuguuuguuuguuuguuuauuuguuuguuuucuuuugguuuugucucuuuuuccuuuccucauuugugggauucaacauuguaauaggcaggaagcaaaacaacauaauggagucugucaacauuuagaagauaauuguaagucacagggagggcacuggcuacuaugauuaagcuaccauguccucacccaguagcaaaggggaguuuacgauacucccaagccccaggaccccagcauccucugaaucaaggaaucaaccuguuccauuuuacagagacucuauccugucuuccugcccuuugagaaaccauacacaucuuccccauguuacugucaugaaggguauacaagggugaauccaaagcaggaggugugcuaggcuggcuccgggagcugaaggagcuaucccccaagacuacuguuggggugauccuauuuaguggcucccagaagaacuuguauuugaaaggaacgcacaagugaagagaggugaacccuaaacuguaaccagaaguccagacuuuggguagaucaucuuaccuaauggugcccuccacaagcauguaucagcuccacugcggccugucacaguaggcccacagccugugucugaugcaguugugacuaagagauacacaggugaaaggcaccacacgccuacagguacgagggugugagacucaggggugaagcugccucaggagggauguggugaaguacaggagagcguucagaguuuguggaggccacugccagacauggugacacuaccuguguuuguuugcauaugcggggugcaaaccaugcuugcuuuugcuuuucuuucccuggcugugugaugugguguguguguguguguguaugugugugugugugugugugugugucugugugugucuguguguaaguguaaccuuaauccuacacacagacacacacacauauugauaacuacagcuaggaacugugucauuuugcuuucuuaagucuguugacaauaguuacaauauuaaaaacagcuguucagcaccaaggggccccugggcacccaauacacagugcuuuaacacaggcggagucccugaagucuuuguguguggugaguguauuucuuccuaggaaagggugugaaaggagagagaacccugaauacugaauacucccucuacccucauuuuaauugugaaauacaagauaguuaaaggcacccaguaguagggaaugccggagugugggggcucaugucugaaaucccagcaagaaggaggcugagugaggcaggaagaaugcugugaagugcaggccagccugggcuagagugagacccuccuuaaaaacaaaacaaggguuggagagauggcucagcuguuaagugcacugacugcucuuccagaggccugaguucaauucccagcacccacaugguggcucacaaccaucuguaaugggauguaaugcccuccucuugugugucugaagggagcaacaguguacucacauacauaaaauuaauaaaucuuaaaaaggagguuggugagauggcucggcuaaugaagacacucugccaggcauaauggcauagaguuuugguuugggguuuggguuuuuuguuugucuguuuuguuuuguuuuucgagacaggguuucucugugucacccuggcuguucuggaacucacuguguagaccaggcuagccucgaacucagaaaucugccugccucugccucccaagugcugggauuaaaggugugcaccaccacugccuggcagugauguagguuugaugucugcagcucacaugauggagagucgucuccccuaacccugcgauggugguuuuuaaacagccuuagauggaaucuuuuguacccacgaacuucaucauuaucccuauuuuauacaugaagacuuggaacucagggagacaagaaguaguggaagugugauucacuacauggccugggcuucaggaggaagggggugugugucuggaucugcacugcuagggcuguauggagggcaagcauuagguaagacagcaggucugguuuugagguccccacauggagcugggaucaugggauuucggggguuggggggcaggcagcauaccuguuucugcuggauuuucuuguguuugaagagggacuggcccgaggucaaacugaacauccuaucuuacagaugggggagccaaggcuguaagcucugcuagcaggaagaugcuaggaacaggauccuggugauaggcauggccugacauucagggcuggaaacugagagcuuuguggguagugggaacaggcagcaguccaguccuuuguccaauagcuacccuccuuaaauaucuuucugaggugucccugagcuggcagccucauacagggauaagucaguagaaggggccaggccuuggaccaaggggaucccuuccaugauuccagagccacaaggccaguguguguggacauggcagaggccuuccugaggcucaaggcuauaugugugccagggaagggaauguaauacagaaaucagggacagagaggaggucucagaaacuaaggcagaaugugggccggcccugaaugcuaggauaagggcuggggacccuguuccagacaaacagggacauaguggggguuucugagccaggacacuacaagggcaggccccagggaugauaucauauagcugaagucaggaggcuacugagacugaagaccuacggaggaagcugagcaguuggaacaguugggugcucagaggccagagcggguaguuugcuggugaagagguuugaugcacuccuauggaagagcccaagucccuggaggaccacacgguaggcagccaaccaacagucaagcaacacccucgggcaagagccugaaucuuauaugaaucuuauuucugcugucaguggcuaacuuuagagaugaggagccuucaccgucuguaguucccagcugucuauugcgcuuaugucagacccuggggagauggcagagaauaaaacccagagaggucucccucucacggagggagccgagagaaccgagacuguaggcugucacagggauccgagggagugggaaacuguguucagaccagccgcagaguccagagaagaugcuggcggccuuugcaggcccuagcucuuguuuggggccuacucuugaccaccagagaaagcaaguugaaggcuggagagagaguacuccagcagcagagguguaguugcggccaggcugggggcuggaacugcugugggguguggcagggguaacucccucacugggcaugcucuugcagaauccacacaggcgacagaccauacaagugcccgcauccuggcugcgaaaaggcuuucacucagcucuccaaccuccaggugagugccccaccccacccaccccccacuaccacccgcgcacacccccuuucaggggcccaagaaagggggugggaugugggguagagucagcgccucacagccccuuaccgugcucuuuacagucucaccagcgccagcacaauaaggacaagcccuacaaaugucccaacugcuaccgggccuacucagacuccgccucccuccagauccaccucucugcccaugccaucaagcacgccaaggccuacugcugcagcaugugcgggcgggccuacaccucggugagucuugcugccuggcaccaaguuccaaagccuaggggcaggacugugggccugggauucucuucuuagccuaggagcgucucagcccacgcuuccuacuugggacagcugcaauacccgccaaguccagcagggggcacagucccauagccagagccgacuauccuucagagaaaggggaccagagaugguuccugggugggaaaauccuccaguggagagccuuggauacucaaguaacucaguuaugcgcacgcuucuagcccuuugacuguucugggaacaccaccauagccaagaguguucacgaguaauacugucuccucccgcuaucgagugguuauucucagggcuacuggcuaacaggcauaucagcuagccagugacucauucguuaguguucacugaccacugagccagacacuaaggagacagaaaacgcagaucagauagggacuuuagggacuacugaugguggcagggauuaaauacauuaucacagguaagcuuuuacggacagguagugcuuaauguuucaaagcagagcugucugcucagaucuagccccagggacccugagcaggaggcuccucuggggcgggacacuuccuugugucugguaagaugcuaaagaacuucuguaucuacccacugggugccaguagcaaccucuccucuccaagaugaggucaccagaagcauccagacacugcaugugacccuggaggggcagcccucuuuucuuguugagagcgaguauuuugagagacgguaaagagucugaggagacaaaguuggggacaguccaaauaauaaggucuuuugaggaagggguacauaauagcuuucugucaugguaacagaauaccgcagacgguggauuuagaagaugaacgguuuguuuuggcucugggauauggagguuucaguccauggucaaguccuuguguuuucucgucguacacgucgcugacugucuucagccccugcucucugaagcaaaauccagacacgcuauuauuuuguuuguaaaagcuuuaugucucaaagggccauggcuccuuuuaaaaacauacccauaauaucucuauaacccuuauucagaggcccauuguccaguacccagacagcauagacauauuuauuugucuccuaaaugccauauuuuuauuuauagaauuuauuuuuaaagagcaagacccaaauaauauuccuauauuauccuaugucuuaauuaggguuuuguugcuguuaagagacaccaugaccacagcaacaauuauaaaggaaaacauuuaacuggggcuagcuuacaguugagaaguuuggugcauuauugucauggcggaaaacauggcggcacacaggcaggcauggugcuggagaaggagcugacaguucuacgucuugauccacaggcggcagaaggauacugugugccacacuggguguagcuuaagcauaggagacuucaaagcccacccccauagugacacacuuccuccaacaaggccacguaucccaauagugccacuccccauaggccaagcauuaacacacaugagucugugggggccauuccuguccaaaccacugcagccugugucagugucuuuuagggcccagcuugccucaccucucuccuuaccuuguacucacuggaaacugguuucuguuguggcuguugcugacugcuuccucuggguuguguagcaccuugccacauuccuagacucucucagucucugccuggcgaccucucuugaguggcagccagggacaggguauguuaccuugcucuuggccagagccaauggaagaugugggcaugcagacagacagcccaggucaccucaccgauccagugaugaugccucagggcagggcaaguggggaauaggaugacucggguguggcuuuacccccaagagagggucaccuggagguuuacagggaccuggacuccugcuuccaacuggaauaaaauguuaagacugggaaggaguguccccguagggcucuagagacagcuccuacuuacagaggaggaaaugaaggcuugggagcagguugggggacaugacuugcccugaugcuaagaaauggcagaacucaacuccugccaggccucugccucaaccccacagggaacacacaguuauagguuggaauggcgagcagagcuggagauugcagggcuuggguggaaucuguugagggugagcgaaguugccagucagccuuguccaccccuccagcaagcacuguguaggacugaacuccagcaaagcaaagaucacccuaaaucaauagaacccuuagaacccauuccaagguccaccugagcuccaaggcuguggcuucagugagcugcucucuaguggcugauuuuggaacuacagccucuguugugauggcuucugcauauuccuucugcccacaggagaccuaccugaugaagcacauguccaaacacacagugguggaacaccuggugagccaucacucaccccagaggaccgagucccccggcaucccggugcgaaucucucugaucugagccaccugcggcgacgccccgcccacuuggcagacacagacccaggcagcacccagccuaauucccgcuggggccuccaggaaccaccaagcucucucacaaccuuccaaaccugccagaaagcuugguccacagaagcccucccuggcuggcuccuggcagccaggccaacugcaagauucuggacuguucugguggcauccaaagacgaucucagagcacuuugaaccugucuguuggguuuucuuuuuguucccccucccucacuugcuucacuguuucuuguuuuuaaguuuguuuuggaaauaacaaaaaggauauuuauuggccagaauguuggugcugcuaagaacgggaaauuaaaaggacuggacagacggauacagagaaccagagggcagcgugggaacuucucuggccaaaaccucaggucuugaggggaggccugggguucuggacgucaaaggggacacccucccucaggugggaggagacaggagacagcuggagugagcccuucacccgucacccagucaaacugccugagcuuugcccuagccuucgugagcagagggcacagcagcugccaggccugccuggcuuuagggcacggaaaugagagaggucuggagacccgcgggaccaaagggugcagugacggcuggguggcaagcccagggaauggguugggggcgugccaggugagaccuggcuccuccccugcugcccugaagaccaccccagucuaccucggugcuggccaggaaaccuaucggcuaccucucccaccacuccagacugugggcagggggauggagagggagggggccugggacuaagugcccuuuccagaauuucuuccagaaggguacagugcccagggagggguuguccuucucgacacagaugaggacuccccaacccagaccccaggcccugcggcagggauaggagccuccaaaggaggacccaggagcagacccugcccccagccccccaagacauaucccaauccgaaagccaugcguguccguguauauaggaacuauguacagaacccagagaagcccccuuccacaucacccccagagaagaaaacuagacaaaacucaucuauauauucuguaccuggaguccguuugaauauuaacuguguuauuuuuauacacuuuuuaagccuuaacucgccauugauuuaccaguuuaacguuuccugggguuucuuuuccacugggagggggggucucagccccccacccccaccccuuuguuugacuugcgucgucugauacuccguauuguagcuuuuguccgcauguuacuacccuguaaauaugcuguuccaauacuguuaacagccuuugcuuuuuuucuaugggaccuccaggccaccauauuuagaaauaguuaccuuauuaaaaaagagaaaagagucug

SEQ ID NO: 2137 - RNA, 32225 nt, Mus musculus
cgggcgcaaggcggggcguggggucgguggcugcugggcgcgcggggcgcaggccgcggggccggagccggggggagcgagcgagcggaggcgccgaggauccgauucacucgcuggggagaccuaugggccgaagccguguaaaugcguuuuaaggcgagugcaggagauggcugggggggagccucggggagcgggcguccucggcuuugggcgcugacccuucccccggccccccuugccuccucucagcaggggccucggcuccgcaauugccacuccuccucgggguguugcacaaguuucgaggucaccggcgacccccccuagcagcgcgccuggcucuggcccccgcgaaggaggacggggcuugguaaggaggccugggguuggggugcgggacccccgcccugcacuugagagagccgucccgcggacagaacccacccguggcucauagagcauucuuagugugucaggaccaaccuuuuauaaauggggaaacugacccaaggucaugaagcagagagccgacucgaacucaagcucacggguuuuguuuuuuuuuuuuuuggcccuuuagguagguguagucuggacuggagaaauccuucaauuggaaggagacuuccccaacuagguuucucagaucuguccccacauuuuuuuucuuccaauuucaaauuucagaacuggaaaagaacuccaaaccaaucccauuuaacagauggggguaauugaggcucuagcagacauaacuucaccauucccagcgaaccucggcuucucaggcuugggcaagggcacagaacaugacugggcagggaccguaggccuggggaggugagggaugcagccuguuccccagcgguuuccuccaucucccucuccccacaguguguugcauacuuucuaaggcgguggccaaggcagccagcggugcuccaaggcagcgguuuccuccagccccugggcuccuccugcucagcauggcuggcuaucugagugaaucggacuuugugaugguggaggagggcuucagcacccgggaucugcuggaggagcucacucugggggccucccaggccaccucggugaggggauggaaauggguguggguugguugccuguccucuucucuguaggagaccucccauucucucgguauugguauuuguuuacuugauauuuacuagauuguccccuuuaucuccaauucuugguccuugcccccacaucugcccucccuguguuuccugacuugagaaaagaacaguaucuccaccuucacggucuccccagcacuccaggugggaacuucggaguaccugccuuuugcgcucuccccuucuacacucaggcauacccagcuccaggaacuucacgggagaaccucccuugugguugguccucuucucuccgaagcccccaggaccuucuccuguuucucccaccugcugcaagucuccggaacagaaucccacaacagcuccccacugccccaggacccccagccgcacuuccggcuucaugcucaggcuugcgcucugcucaguuagagcagagucgcuguguaugugaggugcuguuucacugggccuuugcugggcuugucuucaggguucccucccucuacgguugccuuuuuccugauuugcuucuggcuggcucuguauucucugccuccagggccacucacuuauucuguagagucccauauagcauuuauuaaagggacuuguaacuacuuaagggcgguuucucuccagauccaagcccuuucaaggucuuuggccucugccucaauuauuauguuggacaacaccgaauggguauccauuaaaaaaaaaaaaaagaaguugcaggaagaggaaaaugagucccaggaaggguuuaccacagccucaaccaugucugugaggaucaggcauggcuugcaagugggaagagcacuugcaugacauuggcagugggcuguacgccacgguaucugccuuuuguggagcagauagcuguauauauaggucugcugcuuuaaaaggacaugcagaaugcagccagagcauuaaauguuauggguuaaaaccuauuuugcauaacacauauauuuuauauauaacuauguauaaccauacauauauauguguauguauguauauauguauuuauaaguguggggguagcauuuagggugaaugacaggaaauugagaaccugccagaccuggcagggggcauggugggaacacaggaggcuugggaugggaaagaguagacagucuguauaguuggcauuagcuggacugagaggagggacugacuagagcuggucacacacagccuuaagugucagcccuagauugccuuccguccuggaggacaugggagccucagaaagcuacagcagggugcugguguccggucuccggaaggacuguggacagccagcaggcacagggagggagcugggucucacauccguucgccucuugcugugcagggcaagguggcugccuucuucguggccgaccugggugcuguagugaggaagcacuucugcuuucugaagcaccugccucgaguccggccuuuuuaugcugucgggugcaacagcagccugggcgugcugaagguucuagccgaacuggggcugggcuucagcugugccaacaaggugagccccccgucccuaccgcacgcguagccucgaugcuugccaaauguggcccuucugguguuggggacuccagggaacaggagggaccuguacuugaccacgaccuucugggaaggacaccuacucaagagaagaggaggcuccagggaggaagacauggguggaacuugucaacucugaaguuccaaaugggauccugagaagucucugggcauaugggccacccuuugaauggguuuggacuuauccuucuguuuuauuauuauaauuuuuuucuuuaagcuagggauucauugugguccaggcugacuuuaaagucacuauguagcugaugcuggccuugaacuccugguucuccuaacuuccauccucucaagugccgggauguaucaucauaccaggcuauuuuuuuucuucuuuuuaaagaaauacucauauuuuaauuuuucuacuuagaaaagaauuaaacuuaauagcaguuuuaaaaugccuuggcuuagagcaguagguaccaaucuuguaauuacaaaacaaaacaaaacaaaacaaaaccacuccuauguggcugggguuuuuucccuuuguaagcuuaacauguggccguguuuuucagacuaaucugcucagaguuuugcuguugcugccaaaggccgucuuccuaauuugauuucggcuuuuaauucccuccugguggcuuuccguuggcucuguuuauguguagucuguaguccugagcuacgguggggugguggcugacuggguggggcuugcagcguggcacugagcaagaaagagccugcucauucauugaguuucauccauucugcuuuugcuggguuaagagccuucucgcuuaugucugucucauucauucacucagcaaaaugcucucccagcugggaauuuagcuguaaguaagcgauacaaagcccccuuuucauggugcuuucuagaaaacucaacaaugagcaugugugcuguuguaggugggaaguagugaaguugggugaggaaguuuguuuugaagcagcgucggucccugccgacuguaggcuagucuagaacucgcuguuucccacagccuggcuuggcgcucucaguucugucuccuccucucuaaaugcugggauuccaggaggagucacaucaccacacgcggcuggacugcacuuuuagauagccauccgaggaagucuccucugagauuuugaauucacauuugacugagguaggagacugagccagguggaggaugaguggaagaacuuuccaggcagaggucagggccagugcggagcgccgaggaggaaauaagccugcugggcaugccuugugaugucagcaccgucauguucucggugacuacgaauggcuguucugaggagaucagcaucgugaugggcugauguaaacagaguccuugaaagaauucuuggaggagaaaggacagcuaggcuggccaagccuacggggcuagagugaauccacguaugggaggcgagcaggcagguuaaccuugacuugaagguuaacuguuguucacucauugugguuccggagucuccucuuggucuuuuuugcuggccuuguucugcauaugucuaccaugaagcccagugaggcagaagguuuugcuuugccuguggccuuccauggcgcugcaaguuccuuacagaggcaggaagagacgggauccuuugguuccucugaacuagggcugaaaaauaaggcaaaagcguaccaacuagaucccucagcuucuggaaacucaggagugaagugcuggguccucuaguuucagggaguggacgccaaagggcagaguuguggcaaauagagucuuagaaaagcuugcaagacaggagaaaggggguguguugaauguaucugccauugacugagaguuccugcugggucaggcucuuugccaggaguuuucugcaaaugaucucacucucgaaacagcgcugcgagguuauuccuuuacugugaagucauucucuuacccggauucugacaacagucucuagaauauagacacauuuggucuauaaggaagugagucacagagguucagcugccugccccggagucgugcccuggaagaugccagcuugagucuggcuugccuuuuccaagauuuuuggagaggguuggcugucaguguggcuggugagacguucucuuccgcagugguggcucacacagauugcuugauguguuuuacuugagugguguggccucuggcacuuauaacccaagcaccaauacccuguuccaccucacuagccaccccuucuagguguuuuaaggguggaggcugcccucuucuggugagucacaguuggugaccaggcuugauggugucauaccuuucugcacuuagaccaaagguuuggcaugaacaauggcuggauguagacaggcaaucaggccagaggcacaggcugcaacuccuucggugcucugagccuccuccuacuucccaagggacuccugucuuugaucuugccucccagccucuuuccggauuaauguaccccacccccaccccagccuacucccuugcuccccccuguggcugaacccugcagagcugucugguuuggauacgccucagaauuucuucuaacagggaucagagaggaugcagugacuauuauaauuuuuuauuuagguaggaucuuaugcaacugaggcaagcccgaacucuugguccucuuaauucacuuucugagugcugggaugacagucauaaauauaccaccucauccaacugcuuugcuucucuauuuauuuauuuauuuauuuacuuauuuaaauuuuagauagagucuaacuacaaagcccaggcuggccucaaaccuguagcagugcugagauuauaggcaugaacacugcuccuagauucuggucaacgccuuauuuuagauauggccauguaagcccagcaugguggcacauucuugucauucuuaccucaacacaaucaaaaauaauagcaaaucacaacaucuccacaaccugcgaauguccaagugguacauugauuuauccacucacagagaacaugaggugcugguuguuugccuggguugcagaucugcguuccgagcuuggcagauaguguuugggaacacgcaagcaguugacuggaaacacaguaagcaucuugugaucaggagacugccgugguguagccuguucccagucacuguagcgcagcaggcuaaaaagcuuggaagcuuucuguguggaaguguauggaucuagucaggggaacucuuuucuucuucaucuuucaacaguauucaacccagaaaauacuguugcauuaaauaagaugcaacaguaauauaacuucccuggagagagagagagagagagagagagagagagagagagagagagagagagagaacgcacaauugagagauugagauucucugggccugccuucacccuccgagaacacuugaucuauccugugcauauuuuucucgcucuauggucuacacaguuucugggugcuggugccuccgauaccuuggaauggugcagcccucuggacucaagcucucccaccgccuuaaacgcuaucuguucccugccucccuugcuugaauggucaccucacaccuguccacuuguuuggugcacagucucauauccucacccccaccuccacauccaucaugccacccucccuccagagcaccuccucuguccuuucuaguguggcuuuaccauuucucucaggcgauuguaagaggcauggaccagucuccccagaaucccaugaaaccuuuccucggguagccagaauaagugcucagaccuuucacuuaaaaugcaagacugacucauucccucccuccugccuuuccucccucccucccacagggucugcaauaguccaggcuggccuugaacucccaauccugccucauccuccaugugcugguauugcagguauacauagucacaucuggcugugugucuguccguugaacucccgaagcugauguuucaucacacaggauaacguguaaacgcacacacugcuuccuggcuccuagguggcuggcucugcccacaucgucgacccucaucuuucccaugguacagaaccccaaccaggccacuccagcauucucagccucagaaccucugcgcaggcugcccucccugccaaauuguuguccccgaccuguccagggcuccagugggggcucugcgugcccuucugacuccucggucuguucuuuguccuccuuauucucuagcaugcugcacauuuuugcaucaugauaccuugaacccgcuggccacucugccauuauugucugugccucugucccucuagucugaaagcuccguagagucggagauccagucuuuauucacugcuugcuucuuucaacacuugucacagucuggcaaauuaauggaugcucaggagaugccugccaggguaggcugagcucgcccuccaaaccuccaaaucuaccucauaaggugguuuaugaagauuaagugugaauguauaggacuggaacgcaguggcugaaucagagcaagucuuuccgagugacgcuuacuguuuaaauauuuauaaccacacuuauuuaaaucacaggcccucaccuuugccucucugcaccuuguguagggggagagggagcauuuucauauucacucagacuugaucuggugacagaucugcaucugggaugugagcugugacaaccucaaguccagcuccagaguuggaucucuaugaugccgcuuauugacugucacuaucggcagauugacgugugugugugugugugugugugugugugugugugugugugugugugugagagagagagagagagagagagagagagagaacucagccucccucucugugaagcgugccgagugaauccugauauuugaugguucuggaccuuucagggauuaauguguguaaacaacuagugcugaaagcugcuuggucagaauuagacuaacgauggccacaggcagcucuuguuucuccuaucacguucccaaggcugacuccuuuauucauggagaggcaugcuggaugcuggaugcuggaugcuggaugcuggaugcuggcuuugucaucugcugcauagccucuucuccccuccccuccccccuccuccccuccccucccauuccccuccccucccuccccuccccucccauucccuucccauucccuuuccuccccuccccucccauucccuccccucccauucccuccccucccucucccucuucuccucuccccucccucuccccuucucucucuuuuuccugagaugggguuucucugaguagcccugauuguccugaaacucacucuguagaccaggcuggauucaacucacagagaccugccugccucugcccuccgaguucugggauuaaaggccugugccuccacugccagugcauagcuucuuuuuauuuuuuauaacacuuuauuuauuuuaugugcacguguguguguguguguguguguguguguguguguguguguguauguguguguaggggggcucgugugcuaagacauugcuggccuugcacagcuucucauacucccugcaugggcuguaaggacugaacgaaacaguccaucuaaggcaggucagcauagcaugggcagugaaccaaaucaaauccacucccugauuucauaagcguugaccagaucaccaugcuaauucauuuaggaguggucaguggcuggcuuggagcuccgagugacagacaguuggguagcgacagacugaauggcugaagaagcugaagccagagaccacagaacauguuuucuaguccuugauggaaagcaucucagucaggaccuuccuguggcaggugcucauuguacauggcuacuuaccacucccccaucaccauccacaucacugaugcagcaggcacgugagccaucaguaacaucaguaacagugagggagagcuggggggaggggcucagugcugcauaaagcagaacucggcauggcuaaggauguagcacauccuauaaguaagugcuugcccagcaugccuggaagccuggguuugauccucagcgacagaagaaguucuacuucagcccaugugguggauggagaaucugacuccacagaaugguccucugacuuccacauguguucauagcacauacacacaugcacaccccaccccuauacauuccaugcauaugcaauaauaauaaagaaauaaaaaaaauaaaguucauuuucaggccagcuugagcuacaugguaucauccucuuuucuguugguaggauggcucagcugggaaaggccuuugccacaaagcccaacucugugaauuuauggcccacaggguggaaggagagagccaacuccugaaaguugcccucugaccucuacacauuccuccaaauaaacaaauguaauuuaaaaauuaaaaacacccccccccaaaacagcaguuaccaaaaaggagagacccugggguaggggguagggagugaggggagagaacacauucauuggcacaguagaggccuuugacugacugggugaucugugucagaaagacccauggcuuuggagacuuugccuuauacacauguacgcacgcacaccugugcacaugcacgaacacacacaaacacacauacacacacacacacacacacacacacacacacacacacacacacacacacacacacacaguggaauggcuaaaccaaccuaacaaaggcuuuaacucgucuuucuuccucucucucucucucucucucucucucucucucucucucucucucucucucucucuguguguguguguguguguguuaagaacagcuguaauccagcagggcgugguggcacacaccuuuaaucccagcacucgggaggcagaggcaggcagauuucugagucuacaaagugaguucuaggacagccagugcuacacagagaaacucuguguagaaaacaacaacaacaacaaagaacagcugugauucuaucucuugcgaugucuaagcauuguuauucacguggucaucugaggucugguagauugcuggaacuuacuucuuuuaacuggaacagcauccuuugggcaguaucucauugcuucucucgucagcccugggcuuaaccauccuacucuuugcuucuguuggcauuuguagauuccauguaguuaauacaggcucuggggcaauggcucaucugauacaguguuuaccacacaagggugaggacccgaguuuguaaaaugccaggugacuugggcugugguuguggucucagugcuaggaaggcagaagacagggagcuugcuggaacuugcccucuagacagucagccccaucagugagcuuccagugagggacccuggcucagagaguaagguggcaagugaccgagaaaaacacuugaugaagaccuugggucuccacauacaugugcacacacaugcaccugcacacauacacacaaacauguauacaccaugcauguacccugugcuaagcgaguuccugcauuuuucuuuuuugggcccgguucauuccacuugccgcaauguccccuguguucauucaccuuacaaauaauagaauuuccugcuuucaaaggaaggaauuguguucuaagaucuucuuuuuacccacgcauccacaaacauguuuagguugauuuugugccgugucuauugugcuuggcgcuguagugcacaggggagcauggccaucucuuugacuucaaguccucuggauguuaccuggaugguguuucugugucaggucgcaguuucacgaugauguuguguacaccgcuauaaaguauuuuaaucacauugguucccucuguuuucucucauuucaguggguccucguuccucuuucucuucccaaccaguccuuuuucuuucucuuggugguggugggagccucacuauguagcccugucuggccuagaacucacuaugaccgagaugaccucaaacacagagaucugacagccucugccgcccgaaugaugggaccaacggcaugcaucaccucaccuagcuuuauguuauuaucugccucaggcugggguggggcccccuaagcuccuccuccccacuccacaguaagaugcucacguucccggucuuguagguuuuauguagguaauuagagaugccgaguauuuuuuuauacuccucguucuauuuuccaagcaauauucauuaaacaucuguuugucagaagccagugagucuguaccagugugaguuagaaacugugugucccugcacacaccuggugccugcagaggauccucuggaacaggcguucuggaugguuguuagcugucaugugggugcggggagcugaaucuagguccccugagagagcagcaccugugcuuaacugcugagccaucuccucggcccaugugccucccuuuaaaggcauuuaccuuuuggaauaaauacacugauggugguagaaugagauuuucugcuuucugggagaauaaauacgcaaauaugcccugucuuugucaugaauuguacaguacaccacucucacgucuauccauggcagccuuaccaucagagaacaggagaugagugugugacaugauuguuguauaucugcugucuuaaagagcugccacaguggugguauauacuuuuaguccuggcacucaagaggcagagacagggagaucucugaguucgaggccagccuggucuacaaagccagguucaggacagccagggcuacgcagagaaaccuugucuaaaaaaaccaaacaacaaaaacaaaaaacaaaaaacccccaaagccaaccaaccaaccaauuaaaaacgagcuggcccacuuauguugauacgucaguguauaguuaugaauuugcuccucaucuggcuccccuggggccuccucaccacaaccuuuggaacuucacaggcagagauggaguugguccagcacauuggugucccugccaguaagaucaucugugccaaccccuguaagcaaguugcacagaucaaguaugcugccaagcacggggugaggcugcugagcuucgacaaugaaguggagcuggccaagguggucaagagccaccccagugccaaguaagcagagggccacuuacggagggaggcugggcagcagggcgaggguagagggggaaggaguggagagcuggggagagguccucacccuggaugcugcuuggauggcaucacacucccagaggguaaggugguacuccuggguaggagccagacccagggcagaccuguuauagcucuaggcaggaaaggcccaaaggauuccugaagaucaggaaagaugacauuugaagugggccuugaggaaugaguggaauuuggggaugcguaaacagccaagcaaauauguggguguugguaaacagcaugggcuguccaagggaugcgugccagcgucaugcugcuggaacaccgcgugcagugggugaaggaugcuuuaacguuggucauaggggaggagcccagggcaaguagacugggaauggaugucuugcucuggcugugacuguuacuagcccucaggggucugagggaauaguagggcguccaggagccauucugcuucauccaaagcauagcaccccucauguuugaggguuccccuuaggaauuuuuuuuuuuuuggacaugugguucccucuugugugauaucugaagacuuaggaaaccugccugguauggaguugaaugagaagaccugagccgccuggguugaugagguugggacccagcaagugccucagaagucgauugguagugcagggugaucuagaaaggcugugcgcucaguggccucucagcuaaggugguuccuggaguccaaagaggagcagcugggcguggcagcgggcggaguccaaagaaagagcagcugggcguggcagugggcgggggauagggugcucacucagcaggauugccuccguucuccacaggaugguucugugcauugcuacccaggacucccacucucugaaucaccugagccugagguuuggggcgucgcugaaauccugcagacaucugcucgagaacgccaagaagagccacguggagguggugggugugaggugugcaaugggaaccaggcacccugcccaggccagacucacuacccuuucucccaggaauuauuuguggacauccugggccuuccgcugggccugcaguuuugccaccagagaguguccuuucuuuagaaggaagguuuauuggcauuucuuuccagagcuccauaguccccagaaggucucaucucaggagguuuuucccacggacguggcuuugagguaguucugcaugccuauaagccggagaccauagccaugcucuggagaugucucuguccgugcagagauggggccacaucucuaguuuccuuuauucuguacuucagguucaaugcccagugccugaugccuugaacaguaaggacuuuuguccccagccuguagauggcaagacauaaacaaagcaagccuagugacuugcccuggccacaugauaccuugggacuccagcccuuauccccaaaagguuucucuccagagaggcauggagagaugggagaagugccaccuuucuguuccuagcuucccacguggcccucuguagccuauggucccaggccucagugguugcaucuguaacguggggcuaccuggaccuuguauguaagccaaggcucuuccuccuuucccaguuuucacauuggcaguggcuguccugacccucaggccuaugcccaguccaucgcggaugcuaggcugguguuucagaugggcgaggagcugggccacacgaugaacauccuggaccuuggcggcggcuuuccuggcuuagagggagccaaagugagauuugaagagguaauguguggucaagcguggccugaugguuauucugugguaggguauaacaaucccacugugcauaccuuuggcccgacugucaacaccuugggcuugguggauuuuauugauauuuauuaauccugugcuguggcucagcugggcucauggucugugucauuucccaagcccgcagcugagcuggcuguaccccagcucugcuugacucccaugcacuuagcuagcuaguuagaggcccagccaagguaauuuaccuuccaugaacucuacaguggucugaauaugugugucuaauuuacccuccaaugggcugguaagaaaccuggugggaagggcacgugaggaaaaccaaccuuuguuuugcuccccuuguauccaacauaaauguguugucgugauucccauucugaccccuagggggcgcaucucccucguagugcauuacuuauggagucuggacuguaccaaguggccaggagaaggccccagaugucccaggaauuagccucgaaguugacaauuguggccuugcuagacauagcagaagucuaguagacuucccagggcucagacuggcuggguaugaugagaacauucauguggguaggacauucagaauccauugagugcaccaggcuauaaaaauacacaugugcuggggguggcauuacacguuuauaaucccagcaccugggagguggauguaggaggucaggaguucaaggccagccugggcuacaauaacuaaccuaauaagacaaaacaaaacaacgcuaaaaaacuccaagcccacacaacucaauuguauuuauaauuaaaaguaguguuugcauaagaaugaaagucagcgaccagguucacccacccugauggcagaucuagcuuugcacacuugccuuuuuuuuccccuuggaaucugaccuacuguguaacaugcgaguuguuuaugcccaggaaccuggaaucugagcaccgagcauuaugggaaagaauaccccauucuaugugggauuaucuggacgaaugagcuauaugacguccucacuccagcuccgccccagcccagccucccccuuccuggcuagcugucacccagcuaccaggugggaccuuuccacugccgaauucuucccgaaaucucauggucccgcacgcugcucuucucuccagauggccucaguaauuaacucagccuuggaccuguacuucccugagggcugcgguguggacauccuugcugagcugggacgcuacuacgugacgucugccuucacuguggcugucagcaucgucgccaagagggagguucuggaccaggccagcagggaagguggguguggugccagaugggcguggccggcuaagcagggguggggccuucuggagaauggguauuuucucuagggaaaguugcagucaguuccccucaccccaaagacaauuuuaucucguuaucccagugguucucaaccucccuaaugcugagacucuuuaauacaguuucucguguugugguaacccccaaccauaaaauuauuuccauugcuacuucacagauguaauuuuccuauuguuauaacucauaauguaaguaugugauauuuccuauggucuuaggagaccccugugaaaaggucauuugaucccccaagggggucuugagugacagguugagaacggcugugagaaauggaaucaaagagaauguaaaugaagaggcuaaugguuggcuagagcugagcuucccucugaccccaugucugccuccgcucauccuuucucauaaccucaugaggacagauuuguugacacaggacagcgcauagucagggacagguuaagucaucagguccgggcacaggacugauauagaacagugcugaaguucaaguucagcccaggcugacucggagcucacgugcccacaccacuggcaucaggugaugcagaacucacgugcccacaccacgggcaucagugauuucuuugcccuuccaugucagagccccaugaguggccggggucagugaaucugauuuugggccuugcccucugcuccaggccccucacaccggagaaagccucccagugcugugcucauccucagauagagcuuguuggcagcgcgggggcuccgggcagcguggagcucugggcagcaugugcaugugugcauucagacauucucuugaccucuuagagacuuggggcuauccuaccuaguguggcuagccugccugguuuccuacucugucacaccuccucccugucacaugccucugagaaaguggcuuaauguccuggugaccugaguuugggugagcugccuuccugcuuuuccuagggccucgaggggacucugaggcaacagggaauuaugguguccugacucagcugccccgagggaauccucccaacucagaaguggauccaugucaccaaaaagauccaugucaccaaaaagguggcuuuuguugcaggguccaucucauagcugcagaaagagcaaccguuugcugcacagcucucuccuuauugagcccacuguggugcuagccuccgacuccuaggccccucacauucugcuuguguggcccccguucucucccuuccucacagagcaaaccggcgcagccccuaagagcaucguguacuaccuugaugagggcguuuauggggucuucaacucaguccuguuugacaacaccugccccacccccgcccugcagaaggugagcccaccccugugaaugugccgccgcccucccaagcaugugauuuuaucuaacuccuauuuaaucagucucugugaugccggggcucaaaccggaggccucagagaugccgagucgcgcugagcaugacugucaccgagcuguguucccugagugcagcucagagguagagaacuugacuagcacgcaagaggcccuggguguaaugcacacuaaaagugguuuaaaaagccgggcgugguggcacaugccuuuaaucccagcacuuaggaggcagaggcacguggauuucugaguucgaggccagccuggucuacagagugagggcuauacagagaaacccugucucgaaaaaccaaaaaaaaaaaaaaaaaaaaaaaagugguuuuaaaaaaauggacaaaagaucuaggcaugguauguacuuggaaucucagcccucaggaugcugagacagaagaauugugaguuugaggccagcuuagacuucaucuacccugucaauaauaauaauaauaauaauaauaauaauaauaguaguaguaguaguaguaguaguaguuuuuuguuuguuuguuuguuuguuuuuuucgagacaggguuucucuguguaggccuggaacucacucuguagaccaggcuggccucgaacucagaaauccaccugccucugcuuccuaagugcuggaaucaaaggugugcgccaccacugccgggcaagcucauagucuuaccaagcagaaaguuguauuucuuucauucuuuuggaaaauacaaaguacuuguuuugcuucauggucuuccucuuuguucacacgggguguggcuauugcuaugccauugacacagcuuccagucacuguaggccuggcugcuuggcuuccugaauguguugacagauaucugugauccccacucugguguugacugucacagauuuucauaugaacaggggaacuggagcgacaaagccuacagaccuccagcagcuuuaguggaugcagaggagccugucugugucuuuauccucacagaucagcaucucccuaggcgaacucuacuccuuaccccauggcaggcagggagcccaucucugccucauucaggggucuccacacggugcauugaucuugcaaugucucguuccaaaguuaacuaugguuuccagucacagcugcuugucugaggaagccucccugacaugcagaggaauucaguuuuucacauucuguauuuuuguggcaguccacauccuacuauucagauuuagggaccagguuagacugggccaaucuaguagcuuauucuuuccaguucccauuuccuacuuugaaaaaaauacauguuucacuuauucuuugaucauuucauaaaugucaauaacaugucaugauuauucauacucccagucccuuccucugaccccacaucucaacgcacccaugaccacuguccugcccccagccuuuauaaccacugaguauaaguagggcugccugcggggauacugucuugugucguaaugagugcaaaagccaguuucaaaucucuguuggugcuuacaacagagaggcgucuugggccuccgucaagagcagcacuaaucuaugauuauaaacacugguucuuagccuguggaucucaaccucucuggggggggucaaacgacccuuucacaggggucagauauccugcauaucugauauuuacaucacaacucauaacaguagcaagauuacaguuaugaaauagcaacaaaaauuuuuauaguugggggucaucacaaccugaggaacuguauuaaagggucacagcguuaggaagggugagaauuacuggugcagacaaauauuuagaaggcauuuugucagugugugcauuuagaaagacaacggcaauugguuucccccuaaauucucugacuucugagccauggccuucugaccagguuugcaguacugcacagggcaugaggcccucccgaggaucaggcccuccuaagguuucugguuuugcaggaggcuuuuccuaugucucucaggcaccuuagguuaagcuuguucagcuccaaacucuuaauuuccagcccauaguuccuucucucagcggucagcccagcugaagaacuuggcaugguggguucuugucuucccugguuuuccucauggagugcaccugcaguucuugagucccaaauccauuugaguuuaaucuccuuuuugccuguugucaccaucaugugggccauccccugauugagccaccaaagcgaccaucuggcuccuccucuggccccuccuccugcaccucuggccucuccuccugccugcuuaucauccauucacuauaucauucuuuccacuccucccucccuuccuccccccccacuuuucuuaaagacaggaucuugcuguuguagcccaggguggccuccugguuuagcccccugaacaccugggacugccacagcuggagugucacugcuggaacuaaauagacuuuggaaacggguagacaguuagagucagaaaaugggaaaagcccaccacgcuaaugaaccuucgcucaucguccuggcuccucucaagcugugugcacgcggugccucaucgcugcccgcaucacggauguacugggaacaguugauacuaugugcuuauggccguggguucuguguuaagcauuucacaugucauuacucucaauucucauacacgaauccuuuaagguauauguuauugaucucguuuucagaugagaaaacuggccuuaggggguggaguuccuuguucagagucucggacucugaaaggcggaaugcucauucacugcagcuugggggugggggcuugcuuuacucagcguugauuaucugcuccugucagagaagaagcuccugugacgagaccgccuuccuucuacagucgcugcaccaccugccgcucgagcacugcaggggucuuguucuucccaugaaugcacauccaccuguuagaaugguccuaugcgaaugguccagcugacauuguugagauggaaucgcuuuuaagaaugauauucuaaugaugcaucccuaaagucuuaccaggcuuaggagugcuuuuaggccucuugcuuguacauuuccagaugacucucccauugaauuaagcgccgucaccucugucugucuuauacaccgucaccucugucuuacaugcugucacgacugucugucuuauccuacacaucaucaccagugucuuacaugcuaucaccucugucuuccuacaugcugucaccaccuguacccuucccacagcaagcauaguggccuuuuguuggcuaauucaucugaaaugacauacuuuacuauuguuuucauagaaacauucugauuguguuuauuguuuuaucuccuuuggugccgaugccuuuacaaagaucuguuuguuguuauuuuauguguaugaguguuuuccugcgugcaaacacgugcaccacaugcaugcaaugccugcagagaccagaagagggcauuguguucucaagagcuggaguuagacuguuaugagcugccaugugggugguuggaaccaaagcugguuccaauggaaagagcagccagugcucuuaacccugagccaucucuccaguucuguaaugguuuuuaaaaacaaaauguaaucuuaccccaagacucucauauaauccgcuuguagucuacuaucccuccucccaccgaaacuacuaucccuccucccacuccagcuacgauuccuucucccaaccaguuguacuuucuauuuaugaaguacugggauauacacuauuuuaaauaacccaguauuuuaaaucuuuauauauagcaaguacauuuagguacuaugaaaauaauucaguuggcaaagugcuuguuacaaaugcaugagaacccaaguucagucuucaacacccauguaaaaagaaaaaagcaggugugguggugcacacuuguaaucccagcucugaggacacugugaagaguggagcccuggggauuaccagccaguaaaaccuacucuaaucaucaaggucccaggucacagugagagacuguccuaguuucuguucuauugcugugaagagacaccaugaccaagacaacucuuauaaagaaaccauuuaauugggggcaugcuuaucauucgugaucaucaugcaaggagcagacaggcauggcacugcagcaguagcugggggcuuuacauccugauucccaggcagagagagagagagagagagagaggaagaaggaggaagaggaggaagaggaagagggagaagaaggaggaggaggaagaagaagagaaggaggaggagaaggaggagaagggagacugaggcugucauggguuuaugaaaccucaaagcucaccccuaaggccacaccuccuaguccuucccaaacaguucuuacugggaccaagcauucaaacauaugagccuauagaagacauucucguucucacuuaaaccauuauagaaacccugucucaaaauauaagguagaugguuccugagggaugacaccagagguugaccucuggccuccaugugcauggacacacacacacacacacacacacacacuaucaccuaaauacacaagaauaugcauauaacccaaaauaucugggcauggugauacacaacuauagucccagcacauaggaagccaaggaaguaggauugugaguuugaggccagccuggucuauauaguaagacugucucaacaacaacaaauaucuaacauacuaguauuuaaauaaaacuguauguuuauggcagcucagugauaggacuuaguauauuugagacauggguuuaaguuggagcacuacacauucauuuauuuauuuauucauucucucccucucucucucucucucucucucucucucucucucucucucucucacacacacacacacacauacacacacacacacacacacacacacacacucugguccugaagggaaguugcaugaggaaggaacugaggaauggcuucucucugcaaagugaccugaaaccugagcgacagugacaggaagggagcucacccgggacaaagaagcgugaaacagagaguguuugaaacgggaaacguagauagggaaagacuuuaaagcauuaucugucuauguauguauucaagcacgcguccaugcacgcauguauuuuggagcaggcugacacugugugcccgcaucuggccuggacuucacuauguaggucagguuggccugaacuugcagcaguccuccugccucugccucccaagugcugagaucacaagagagcaucgccgugccuaccugagcacugguguuugccuguguuaaaugaagaacuuguaaaacauuugucuggcaauucaugaaagaggaaucaaacuggaaagccagcugcucccugcagccaagggagugcuuuauccagcaacagugagcguuggugagucugugucgggaaacgcuuugacaguaucagauaaagcuagccauguguaccccuugucccggcaaguucccgugugcuaaggaaacgacacgugcuugaggagcuguggcagaacacacagggcaucaguuuacaguauaaaacaccagaagcaaccuuaacgcugucagcagaguaacgaauguguaaaugugcaauccacacagaacccugugcaccagggccacaggugugucgacaggcuggaucucaggaguggaaaugucaacaagaaagcaggucucggagaucccauguuccaugaugucaaguguguaguugccagaagcaugcaaagugaacauucucauuuaacguuaggcacauucauacaaacauuuuuuuuauaaagcaagagaaugcugcacacaauuguagucacccccggaaaaggaaagaagggggugugcuuggguguaccaggggacaucugauggaacuggaauuuuuucuuuugaauuuguuugaauaauuguucuucgguagagucucugugcagccaggcugccggccugugggccucuugccucagcuucuggaguucugggaucacaaggugagccuaccgcuuggcuuuguauuccuuuagcuggcaggcaagcacacagauguucuucucuugucacucuguauuuuacacaggauauaaggguggcuuugcaugaauuaaccaacgucaaugucauuauuuuauugauauucuuugauaagcucauaauuauuuuuauuuuacaugccuucuacugcuaagaaaauuaucugggcaauuuccgugaguaauucauuuagucuguuuuaaauuagggaggaauuuaccuuugcuuuauuaagauuuuccagcuaggagaggguacagcucaucuauuugauuucucuauuagagucuuaagacuuuccuggauuaaauaauaguguggcccagauauauccaauaauuguauauaugacccaaugcuuccauuacuuugaugaaugaaaacucugucuuugaguuuagacgcugacuugugugcuaacccugccugauuucuucuggucauugucccaacuccuuugaguuuuaucauuuuuucacauuuacuuauucacuuuauuauuuauuuauuuccaucugucugucugucugucucuaugugucugucagaggacaacuugugggcauuggcucccaucuuccccauggguucaaucuccaggccgucguguuuggcagcgcacaccuuuccuugcuggccaucuugccaacgccacuuccugcuuuuucuaggaggcuaggcauaucuauaauggaguguuuuauuucuucauuuuucuauauacauccuucccauuguaacauuguaaaugcuguaaugccaguauuucucaugauguguguguguauaauauauaucauauauauuauacacacacaaaaacauauauauauauauauauauauauacacauacacacacacacacacacauauauauauauauauacauacacacacacacacauauauauauauacauauacacacacacauacacacacacauauauauacacauacacacacacauauacacacacacacacacacacacacacauauauauauauauauauauauauauauauauauacauauacauauaaggagagugaguaaugauaacagagagucauagacuuggagucagaaaauacagguucaggaccugguggcuuugccacacggcagcagagaaauuguaggcaggucacugaaugacuacuaaaguccgacacucugguuucucggaaaaccagggugugaccuuugacuccugaagucacuugugguucuaagcgaggcuguucuaacgagucucuacauacuuagaguuaacucauuggcauaaauagacuguccuguggaggggcuuuguuuugccuggagcuuuaaucaagaauacaacugcugaaugccagcuugucgacauugaguuggagucgcugacuugaauuuuccguguuauggcagugaugggcgauguguaucuugccucuccuucccuuacaggggugaauuucuugcuucccuuacaggggugaauuucuugcuucccuuacaggggugaguuucuugguuccugaaggggauuuuugaccauauggauggacuugguuaccugaaauuucuuguccaaucucugccuguauguccacaaauaggguuuugauccuaagguuauguuccggugccuacucuguguuugucgcugccugucaauucucucuuuuucuuccauugaagauacuuuugaguguuuuauauguuuauguggauuauuuagggacccaucaaguccauguacccuaccuuuccaugcaccccagccccuuuuaaagauaaggggucuaucucugagccagaagcucacugacuaagcaagaauagcuggucauggauccucuaucucugccuucccagccagagauuacaggcauguuccgccaugucccgcuuuguacgaguaugaaagaugugaccucagguccucaugugccauguccccaccccuccccaacaucuuacucauuuuuauuuugagacagucuugcggaaacaucaaguucaaggccccugugggcuacagagugaguucaaggccagcuuggaugacugagggagacccugucucaaacauacagaaugaggcgaacuguggauacaggauacaguucaguggcagagugccuguguagcaagugccaggcuguagauucaagccuaguuguaaaaguuacaacuaggguacuuuuauucuccugauguaacuguuaucuccaaggcuuaaugcuuccaucugcugacuuaggccuaguuuuggaagugucuagccucuaucuaaucuauucaagaccuagaauguuuucagccucugaaccuugcugcugaauaaacucucccuuucuuaguucuuuuugaucucuagcuggcuggcucagcucaguugcuccagcucaaaccccucuccaagcugacugauuugaucuggcuucucucagcuucugacuaauggcucugcuuaccucauaaacucuggcaaucuguucuaaccuucuggcuccuucuucuaugacucaucccgucuucaccugcaucuagcuuguucucucugccaucugucucuauaacuguccugguaagcugccucuucuuuucucucuuucugugcucucuucgugagaguugggcauauccuguucuaucaaagcuuucucugauucgccacuuugucugccacucaaggcaacuuucaaacaugaguacuuucuucugcaaacuaacuucaccuucauuguuugggauuaaagguguguacuaagggcuugucuguauuccagccagagggauuaaaggugugugguaagggcugagccacaacacaacuagaaaaaguuauuuuuuuuuuuuuguaaauaacagucuugggguucacagugugauccgauauccugcaacaccucgucccacaaaaaagacaaaugacugaaaaagugaaugaauagaaugaaagucagaacaggcacacagugucgauuucacuauaaaaaucaagccagaaagggcuggcuguguggcucagcagugcuccuggcuagcacaucugaggccccacguuugccccagcaccacacacagcugcuuucuugucuguuuucaagcuugucccucuaacaggcaugaggauaguugguaacuuauaaccuaaugcugucuuuucuuuguuguggagaagcccuuaaaggcgguuugcccaaacagagcacucgucccucauaacagaccaucaacucaauguuuucuagacacuggggcuagguggcacauaccuuuagucccagaacucaggaggcagaggccgguggaucugugaguucaaggccagccuggucugcaaggugaauuccaggauagccagggcuacacagagaaauccuaucuagaaggaaaaagaaaaagaaaaagaaaaaaagaaaaaauaaggauaugaagcuaagcugaggaggauccguggauccgugcuuacuccugcugacuucccuucauauccucuagaucagagccugguauacaauaggucucaguauguaaacgaagggacuggugaguacaggcuagcucucagcgugggccuuuuccuuauugauaggacuggccaaugguuaauuuuugucaucugugugaaccucauuuauacuuauggaaagagucccucucucucaguuuccccucacuccuguggcuggcuaagguacugguggccuuucuucugcuggcccucacugccuccucccaggcccauuggaugguuucuaugcauaucaccgauuuuuucccccuauagacccgacccacucucagcauucauuagguuacaaaucuugaaacuaguaccugcuaguaccuucuaguacuaguaccacuggaguguggaggacaggaagacccuggacacugccccucagcugacagaauucacucuguggggaaguugggcccaagcaugucaguauuccguuaccaaucacaacugucacaaaagguggaacucuggagagugucaagcuuccaggggcuuuggacgccaccucugaaccuaaagaaagcacggcacacuuggugucagacggaagaucuggggugaaauuggguguaggggaggcagguuugcuggagaguagcccaggagcagcuggcaugugaccaguacugcagcaggcagagcaaggggccaggaaagccacacagaagacccacccguguuucuccuucagcugugaccccucuucuaggcccugcccagcaggggcccuaaacuguggcagaacugcacugauacuuugguugcccagagauggaugucagagauuuccuuuccauuuggaaaucauuuaagaagaaaauuugcaguuagccggguauuggugacacauaccuuugaucccagcacuugggaggcaaaagcagguggaaucucugugaguuugaggccagccuggucuacagagcgaguuccaagaccacugaaguuaggaaucagaguguuugacccauggacccucuguagacucugccaggucagacucagugacaguuuguuggucugggaccugacucaggaugacuguuacuccccuugugggcuuccggcuucugucuccuguccaugaauccuagaagaggaagccucagggcuggaagagaggcugggaaugagcuuuauggaacgggcuguggaggugucugaaagugcccggugcggguggacccacagacccagugacagcaacagucagacuagcgugaaccccucugccagccagcuugaaaugaucuauguagccgggcgugguagcgcacgccuuuaaucccagcacucgcgaggcagaggaagucggauuucugaguucaaggccagccuggucuacaaagugaguuccaggacagccagggcuauacagagaaacccugucucaaacaaaacaaaacaaaacggaaagaaaaaagaaaaagaaagaaaaaagaaaaagaacaagaaaaagaaaugaucuaugugccuugacuuaguggccuuucaguguuucaguggccaggcaaaguaggugauauuuauccccauuuuacagacaggcaaucugaggcacaaagagguuuguguucuugcccaaagucacacugcuaguguuggaaccuagaaauggguaguccuuauauacuacccaugugggcgaugggagcuauggcaggugucugagggaggauugcugaggaugugguaugucugucggggcugacaugucccccuucucuccgacagaaaccaucugcggaucaaccacuguacagcagcagccuguggggcccagcaguugaaggcugcgacuguguggcugagggccuguggcugccgcaacuacaaguaggggacuggcuggucuuugacaacaugggugcuuacaccguggacacaaagucccuccuuggggggacccaggcccgcagagucacuuaugccaugucccggcuagccugguaagagguuccugcagugaggugggggugagggagucgggcagagggacaguccuaugccugguacuguguugauaggggcucuaucccggccagagccccacaccugcucccugaggaggggagggucagcaggcaagcagggaaggaauggggugcgucccucaguggagguugcuugugacugcauggggaagcagggcugguccuggggaggcauuggaggcagagagaagaugcagaaagugagggcaagguugaagcguggucuguccuggcagcauuuucugaagaccacucuagcuauagauggaggaggcaggauuugaacagaugcaggcagaggugguggggaggugaccugggcucacucuguugggccagcaagcucagugggcaguaaugggacuccugccugccuccucuggggucagagguaucugagguggagggugccaacaccugagggacccucaugucugucaggccucgaguugggcauuccacacucuuccguuucaccccacaaaccucuaugagggucagugucguuucuggacaugguuggagucagacuaagacagggcuuggagggcagaguaucugggaggggcuuguauggaggccccucagaacugagugggacggauauccugagagcccccaggagcguccaucaccaaaugccaggucugaagggcacagggagagucacauuacagucaucuauucaguguccucauugugucuccccugugggguacaaggcaggccuaugcagucaauuugccauugggguggauuugacaaagcuaaacaaacaaacaaacaaacaaacaaacaaccgcaaagaaaaacaacaugcaggcuuccuugugagucucuaacagucaucagcaccucccgguggaugaggcugcacucaccacauuuguuacgggggcaccaaaugcugacauaucucucuaggcaagugggcacggcaagcagugagggauacagccacauccccugccccacuguuggugccagggaggcagacauugauccaaggagagcuggucugggaguagggcccuguagugucuguagggcuccaaaccuggaugcuggggaggaauuggcgagugugaauaaugcagauagaacagcauagugcugggaauggauugugacaggccuuauggugacaucugggggugccacagggaacauggggugcaccggggucaaucucuugggcugugagucuggcagaaaagugcuggaggugcaagaggagaguuuaccuucugugcugggucugucuggagagacagaagcaggucagagaagaugguggaucccagcgagagacagagauggaugaguggguugcuuaggagcugggcugggcagcgcugggcugaguguggggcaagguugcuggcugcugcuggagcugcugaucugaucagaugggacagcucauccuuacaggaagggaguauaacugccagcuugugagagcggggcguggcaggcaaagcgcuagaccuggguguggggaugagagcugggugguccuagucuccccgcguguuagggaggagucuugagcaguuugcucccucugaaucuguuuccucuucaggaaaauagagaugguuugguuuuccuacagugcuuuugggagaauuaacuuagguaaugggaugcggggagcaaaguaccuggcgcuguaucugaugcacauacacacacaaaaaaucucaauaaauaugaacaccuuuccuuuauuagguggugggaaccacuggggagaaacaguggggacauggaucacaggccuuugucugugcuuagggcucaggugagaguccuguguguaaugagacuggacucuauauagaagcaggggucccaggaagcucugggccucuguccccaugccaggugccaucaccacuugucccuugcucucagggaagcgcuucgagggcagcuguugccugcagaagaagaccaggacgccgagggugugugcaaaccucuguccugcggcugggagaucacagacaccuugugugugggcccugucuucaccccagcaagcaucaugugagcgggccuguuuucccagagaaucccagcggggccaaggagaugccucuggagagguggauaaggcggcaggcugguacccucuggccaggacucuggugcucgcuucgccacccccacgcuccaccuguaguguuugugcccuguaaauaggaccagucuuacacucgcuguaguucaaguaugcaacauaaauccugccccuuccagccgugucugccucugcagcgugaggggccuggccauccaggugugggcugugcuugggguugcucuuagucuccuccccaccucuguaaauacgaaucaaauaaauauuuaguuuuuuuuuuuuuuuuuaaacccuucaguggaaucauucacaaagcagccuagcggggcugagagagacuggcccaccugacauggagaaaccaguuccucuccucagccccgacucugcuccuggaccccagcacugcucacugucaucugcuucccugaaucaucacagucuuccucgcaggccuccgggccuggugucaugagguggggugagcgggggugggaaucagaguugcgaccuuuccuaaacucgugacuggccauggccucugugaccaaccaugcaggcuaaggccuggcccagagaagcuucagaaacagagagcagagaagugggggauggguguuuuguugucucagggcucgaacccagggccuugugcaugccaggccagugcuuugccccugagcuacaauuuuagcuccaucucccugcccccaggauguuucgaguacacuauuguaagcuggcaaggcccuaacgguuacccauguucgguuugcucaugcagcgacugucagaacaaggcuggcccagcacaucgcuguguccgguaccaugggucccgaugucuccucagacugacaguucuuaccaggacacaggcuacuuccuacugccauggucuuaaguuaugcuccugggggucggggagggugugugcgcugagaaaagcuguucaaacuuagauuuccccuugcuccugugggcauccuaaagaguuuucuuccagguuuaagggaaacugagacaaagucaccugccauaaaauuaucuuuacuuuuuugaaaaacuguuauuauuuauuguguguauguguacaggcacacgugugcuauggcgcgugcauucgugguguguguguguguguguguguaggucagaggacagcuuuuaggagauguuucucucauugugugggugcuggggauugaacucagguuaucagcuuggcagaaagcuucuuuaacugcugagcugucucauuggcccgcacucacccuguaaaauggaaaagugaauacuucucaggauaucucagcacugaggccucucccuccauuuucucuuuccccagcuccuggaaauauuaaucuuugcauuguugugccuuuguggagcauuucuuggggugagccuggccacuuggccucagaguuccaguuagucgcuggcuccuacauggcuuugaggucaucugaggagucgaugugcuauguguucacgauaaucaaggacgucuuccucuucaaggcugggccuacucuucauacacugacaagggacagacugaaagcucaggacaucgacucaggaaagccauaaggagcuaaugccuuguuccuccuccagccacccagagccacaccuaacagggacucccaugccacucucagcacuuugggaggccauuucugacuccuuugccgaucucagcucuaugggaggccacuuuugagaugcccaugucagcuguccuaguggaucuguucccacucaugcuucagauugaggggagugggguggcuggacacacaggucauuuucuuucuggaacuggccccuccucccaaaggcggagggcaccuucaagccauggguggcugcgcugcagcucaggacuaagucuuaccucgcuggagggccuuggugacuuccgaagugacuucuugcuugguaugggacuuguuuccuucucuuucacugccaucuucuguguguuuaugucccacuuccuuugcugaggacagaccuugauauggcuuauuugagaauauuaaugcauauucauuucuu

SEQ ID NO: 2138 - RNA, 7898 nt, Mus musculus
cgccuucugcggucaggugguccggcgcagccauauuuugcacaggcuccacccuccguuccuuguccaggagucaggggucuucuuuucaaugaggaugccuucauuucgucuguaaaaagaagacgagcguugaucugguagugauucccgccgauccaccgcccaacauuucuguugaugcuagccauuaagugguaaggaauauagucacucauugaagauccucaaagugagccgcacuucuagauaagacaggcaggcuccccuaucuucaagaaugaguccagaguuuucauucuagcauuugcuguuuucugucaacuagugaacuuacuccuaagcuguaucucucagguacucugguuagucacuguugguagaaagaggcccaacaauuucgcuucuagaaaugguuucuuucagucccccuuccccaguuccucuaacaaaagacccuuaggcuuggugaugagaaaagcaaauaccuucaacagcagcaaagccaggucaggauuagauuuuggcuuagagaaaugagagagggaggcuuaugauagagaauuuucuuuccaugaaaaauauguccgaagaucgacaguucaagcuucugucuuaagcucaccucauucugccauauuccaaacggugggaagaaaaaugucuuauuuuaagaagacugcuuaggaaguucugcccaguuuugcuugaaucucauugguuaaaacaaucaucuugaugcaucuuucuuuaaagauaaaaacagugucuuguuauuaauaaggaauggcagugaaggcuuacagugauucacuugucuagcaugccuuaaggagauggggguggggaucgugcaauguaggaacagauaugugaacauaguaaguuguuugauuuuuuuuuccuggccaauacuuaaaaccagauccgcaacucuuuaaacuuuugagauuacaacaacacagcaaacgaagcccauuggaagaaauguccgguaaugaaaacuaagaacagggucuaguggccuaagaagguaugaugucauagaugaucaagcaggugugaugucauagaugccaagacaauuuguuugcaagaggaaguggucagccgucaauugugacaaaugcugccaagaacccaagaaagagaaggacagaaaaauaugacggcuggaauugacaacaccaggacuuuguguguguguguguguguguguguguguguguguguguguguguguguguagggcagaaggguaguuuuccuuaagaagaaaagagguuuaaugcuagauagcuaaaacacacuuccgugaacacgucaccagcuccagcucuugcugggucuguaugacacucggcuaggcucugucugucguguuaacaaauauucuaaauagcucgauggcuuuaacgcaggacauauuuuccccacccguggaaaccugccuugaugguuacucuuugcuaucaauuugguuggauuuagaaucaccacaaaggcacaucucugcuuguguccguaagaaugguuucccaguagcugaaaugaagaaggugaauaguggcaccgucccaugggcagagguucugggacugagucgacaggaggacgaagcugaacaccagcucucucucucugcuuccugacuauggauacaauguaagcaggaccuccugugaccaagauuccuccuccaugacagccuguccacucaaacugagagccaaaaucaacccucucugcugcuguugcuuuuaucaacuguuugucagagagucaaggccugccuucuccaagcuaaguuacuuacuuaaaaaauucuuuuuuuuuuuugagacaagugucccacuauggcaauuucuggcuguucuggaacucacuguguggaccagucuggcccugaucuaagagagaugcuccugccucugccucccacaagcugggauaaaaguugcgugcugucacacccaguuguuaacuuuucuuuuacacuuagagauucuccagacgcucagcuccacauucaguuugccccaacaagagagagagggcuggaggcuguucaucaacaacuaaacgccucaguuucucacagaacuguuagccagaaguggucacacaggcucaguccaacugccagagaggcuggagcagguaggagaaaggagaaaaauguaggcugugucgcaggcaacaaucuuucugccacgacugacaggagcagcugucagacucuaguuugcugucugguggguaguggugcaugccuguaacccccagcagugggaaguccaaguucaaggccagccuggacuacgugagacuguugaagcaagaaagcgagugagugagggaaagagggaggagggaaagaaagauagaggaaaaaagaugugaaagagaguauaaaaaaugaaugaaaagcaucccagcuuguugggaaguccaaauguuugucuguccugggcacagacucccaaacagagucaggcucaguucaucagggccacucccaggacuugggcagaaaauggaccucuucuaaacaccccugggcuuugcagcagccccauuucccaaagguuuucucuccuggaucaucacccgugaacaaagagacuaaggcaaguuccucccacaccuucucuuucuccuuuagagacuaaguagugacucagguagauggcaugaggggaaauggguuuucacucauuugguuaauagucauucuuuuuccuucacacaacucuuugccaaaagcuggagucauaauagagacggagcacacaguuuucuggggguuacacacaagaaagcaggccauuggaacacuaggugacgaagacacgcgcacaaaggcucugacaggucaguggagugagccuggugccagaauuugcucggggcuuagggacugauuucacacagaagagcucccggggcaagcucucagugaguaagaguggacaaaccugucaggggaggaaaggaaaauuccaaagagaggaagccagaaggaaacacguagugggaaagacagaggcacacucaguccgaggaagcgcgagcagcgggcgugacuggacagaauauuugaaaggaaauaacaggccagaauggaaaguucuguauuacggcuccaucaggugccaggaacagaaaccugguacaaagaguggaagucugaagacagaguuuuggcucaaguaacccugggaaccauugguaccuugacggcuuggccccaggaccagcugcagaaagaccagcugcauccagggacccaugcaacgccugcaauccucacccacccucacuuccuuccaugucaguugaugguuuguuuuguuuuuuggguuuuuuuuguuacuguggcuaaaaauuaagucauaagaccuucauuuuuaccaaucccaagcaucccacucaaugccaccugguuuucgaauuguuggguaaccauuaccagcacgcaucucccuuccuuugcauacacuccacuaccucaucauaaaccugaaagcaguugggccagucauggacagaaaccucugaaucugcgagccaagauaaaacuucauccuuuaaguugacuuaucucagauuuaaguuaacgcugucagccuguacuguauggcuggcaggagggcaaacguuucuccagaggaaggagcugagccaucaugagaaaagaaggggugcuggagacaugacucagcaguuaagagcacuggcugcucuuccagaggaccaagguucgauucccagcacucacaugggugguucacaauccuguguaucucuaguuccaggggaauccagugccuucccucuugugccuuccucgggcacugcauguauguggcacauagacguacaugcaggcaaaacacucauacacauaaaagagguuuuuaaagguagggccagugaacacauggaauaugaaauacuuaccagagauaagauggggccagacuaccagaagucaguagaaugccaggcuaaagagcccagucuuuauucugccuagcagcuagacugugccgcaauauuuggauuaagaacagucaugcaaagaaguugggguaaacacuggaccaacgcaugcucaaauccacaggcuccacugaaacgcucuacugcccaauauuaaagggacacuggaauuuuauuuuuauuuuauuuucgagacagggucuauugcagccuuaacugaugcagaacuugcuauguagaccuagccucaaacucaagagaaaucuaccugccucugaguggugagauuagaagucguuuaucaccacaccuggcugacauuggaaguuuagauguucucuagccucugggcagaggccaacucugucaagaccuaacucuaaguaggaauucucuccccuggucucuugggaccgacccacugaaggauuccugggaccaagcaaggccuaugcucaucaccaucaccaagccuacacaucgaguaagcaucaaucauuguugcugacuaaagccagcucguagacuguggggacaacuuccacccgcaccagacagacucagcuccugauucuagcucucccgacccagaaaagcacuggcuaacucuaccuauuccugugacccauguggggaccacaaacucuauucaagagcaaucauguucuucucuggccuguuugcucaccuaauuguccagaccacugccugacacacucccauggaugcaugggagcacuauccucccggugcacaaaugaggauguaccaguuuggcaucauaacaucuugguaggguuucgcagugaaagcgugcacacugguugcaggugcuagaaucuguagauaaagcaacgccugcacgcuuaugcagagugacuuugcaacugaguccucgguguagcaaccucagugauuaaagggcuuguuggacuauaacaaaggacucuuuucuuacugggggcucuggguuugaauccugucuugccuuucaagguugcucagcaagcuauuuuacuuuauucuacgcucauuuauuaugcacucuugggagucaagcucagggucuuauucucaucccagccccguguucugacauaaaguuagacccccccagccauuuuuguaugugugugugacaggaucucacuguuguaguucaggcugaacuugaacccacuguguguaaucuacaaugacuucaaacccccaauccuucugccuaaguuucuuaaguucugggacuaucaauguauacaauaaaacuuggucuugccaggcgguugguggcacacgccuuuaaucccagcacuugggaggcagaggcaggcagauuucugaguucgaggccagccugaucuacagaaugaguuccaggauagccagggcuauacggagaaacccugucuuggaaaaaaaaauaaauaaauaaauaaauaauuaaaucaaaauaaagcuuggucaugaaagcucauuuuauuuuauauauauuuuaagauuuauuuaguuuuuuauguauaugaguauuugccugcaugcauguauguauaucacguguaugccugguguccacggaaaccagaagcagguaucagauccccuggaagugaaguuauguugugcccugaguccaugggaaacccagacaagcccaagaauugcaaagccugcugcagcaagagucuuuuauuuaacuugguucccacaccuagcacucacugagugaaugcuagcaagcaacccugaguccagaaaacauuggguuucuauacauagggauagugugaauauucacacaaaaggggaguaggggguggaauaguacugaagcaggugggggggugguguuaaugguugucuguucaaggacuaauuucauggccagucauaacugucugugaccugaccucuguuuaccauuuuuccauggucucccucgagcuuguuauuucacuaaggucucaaggacaggcaccuggaguuucgcugcuuaucagcaggaguguugagugcuaugcuaacgcugggggagggggaggggggaugggagccucuggcggggaacgcagaggcaaacugucucuacaacacugaagucucucuaguaucaguaauuuggggguuacaacaguuacagaguggagcuagagacaguagugagucacucuuuggguaccagaacugaacccagguuggucuuccauaagaguaccaaaugcuggagagccggcucucuagucuccugaaggcucauuuaaucagauguuaucugaacaguggcugggccuccagcuccuuccucuagcugcaccagugagcugccugcagugagcuuaccuuugcuaugaucagccguggugaauacuuaguucgcccggccuggcucaccucucaucuccuaguagucuccaaggcuacugagcgaccucucugccacuuggauauccuccugcugcugaccuaugcucggauuccugcaucuggguccucaguuccuggacuuccaggcucugucuugccugguucaggcuucauuacauguauugccuggaauuuacccccaguuccucaauugguuuccuuugguucagauggacccaguagaguucucauuuccucccugccccuugguucuauuuguguugucuguuccucagaacugccuugcuagucccucagcuguugagcccuuccugacccucugcucuugacuuaaucccaugcauacguccuggcucacuguguguuguucaaccucuuucugcugugucccagauaacgauacagacagcaguacagcagcaguacaaccauacagauaaccagugucacuuuuacuaccagccucccgucuaaaccuggacaccuuggaggauaaaaggaaugcuaagaauugcuuugauucaacaaagguauccauuguucuauuccggucaaacugguagguguggucaccuugcuaucuccaacaucacugcaaagagugauauuugguucuccuuccaucucgcucauaugucuagguauccccugugagauccuaacuaacacuauccucacuuuuuuucagacggaagauggagccucggagcuggagacuauggacaacacuaucagcuggcaaaaccaguaugcgagcccagauaucuaaauucugcacuguuuuacauguguuccuccagugucaucgaacuguugucuagacauagaacaugugguagccugagaugagaagggacuguagacauggaggcuuaugcagagaagaggcucaguguguaucugguggaugaaugaucccuuuccguuagaaauggugaauuuguucuguuacaaaaucugugugccacccccagcaucccaguugucuguguauucauccagccauguauccgauuaacauuuguuacacaccuacuaugugucaguggagauccccacugacacaccuacuaugugucaauggagauccccacaucaauagcucuccuaaauauauuuccuugccauauuucaagaugguuauucugagaaacggcccacaaaaauaugugcugaagacguuguuuccaucaaucugcaucagcaggaaaaaaaaaaaaaaaaaaaaaaacagcaggcacaggcagaaacucucuugaagagucucuccaucugcccaggaaagaaccuuagacaggaacgucugggagcacccuucccacuaccccaggcagaggugaccacagguggcugcuuuucgaagggcaggcucugaucgaucccaaggcagcuucaugcugaacuuguuuggcuuaggucuucaccucccuucauccaggaaagccucauacccuaguccuuuguguaacacaaaauguuuaauaaaugucaaccaacugaccuuucccuua

SEQ ID NO: 2139 - RNA, 28122 nt, Mus musculus
guuugacucuagaccacgcauuuugacguacugccuuugacuuuauccaaguuaagugcuuuuuugaugaggcuuuagaagaauugcaaaucucgaguggguuguuugcauuucaggggucuccaaacugucugccuuuucuccccaacagguuccuuuagucgcaccgggacaucucuaggacacuuucuuacugagacgccaaguccauuaacagcauuuccuguuccaauaugcaaggaaaugcaagguggccuguggagccugagaaguaagaucuuccacaguggcugcugucuggacgccccauccuuuacugcauaaggcagcagguaaaccugugaauacaaacagaaaggcagcugguccucagacaaagaugcauucggcucuuccccugggcccagugcuaaggcgaucgaucaacaagcugccugauucugguuuaaggauugggcaaaaugggggcauaggaaaguaacugacagucagaucuggaauucugacauugaaucucuugcucugcaguucuuuguaugagcuuucauuccuaaagacauuauuuauuaucauuacuauuauuacuuuaugguaccagggacugaacccagggccuuguccacguuagccaagcaugccucugcugaaccaccccccgcuccccccagcccaaggaccuuauucuugacagugcccagauuucugguacuaacagcucacuccugcuaaccguguaagcucaagggagacuugggcggcacgccugcccgcugcuuucccuggaggccgcauuucucagccucucucuaacuaggcuggcagggagcguguaccugagagcacagccaacaucuaugcuagcuauugccugggaucuugcagaaacagcucuugcucccauaggcuuggcuccuaggcugggaugcggcucagggguagagcagcuacacaguaugcacagggaucuggguuucagccccaguugcuuccuaacuguaacccugcggggucaccaagcccucuccacagacucugccccuaaacacugacuauagaguguggugaguaugaaucuggcucugacaggaaaacugcagaacugccucucgagggcaaaaaaggugcaacucggucuccucgcuauugcagacucagccugacuccagucuacagcaagccugccuuggcuuccuguaugggaggagaagcugcucuacaagcgacuccacugcaguuggagggaguaaaacccuucuucccugggguuagaaaaccgcaggccucucacagacagauagacuacucuuccaauaaacacuuggcucugcaggacuacccaagccaaggacagugacaugaggucaguuaugacagaauucuuuauuaaaaugugucaucaauaauguuagcauacauacaauauacacacauacauauguacauucuuugacacaccucacagauugccaacaucaguuuagccaauaaauuaaaacuaaaaaugagaggauagggggagggauacuagaggcaaauuucauuuuuuaucugguaagaaauuguaaauuucucagaacuucccugggggaacccugaccagagaaucuuugaaacaaaauacauaaauccccacccucccccgaaaaagauuccaaaagaugcaguuacaacaagugugcuucucagaacaggggccuucauuccacuucauacucuucugacuucaagacagucuggcccucagcuggagcagcgagguucuugugggcacuugggcucggugcaccguggacuugggggguggaggggcaggcugcagcaugggagcggggcgagccacacucaucugaggugaugucuggcacgucaucugacugcgugucagagcucuccaggucacugcggaugcucucaggcugggccaggcugaugucccaagccuugcuggccaggcagucuuucuguucacagcuuugguguuuguaagggggaucgucuucacugccaccgcugccaccaccagcaccauuacccucuucuuccuucucugccaccugagcauggacauggagcgaguccucugugcugcugccacucaccaacugauagugacuugguuuggcuucaauguccacuuggauuuccauauuguugcacucucugugggaacaaaauucacugugcugagagucacgcauagguuauguuauauuauaccugcuccuaaaauaguuucuggguuuuggcuuaaguaguuagaagagguggguccacguagaccagagcucacuucucacuuucccuuuacacacacacacacacacacacacacacacacacacacacacacacacacacgcuugcucuccuuaaaacaucuaaaaagagcuuccagagggacuggagagauggcugagcaguuaagagcacuggcugcucuuucagaggucuugaguucaauuuccagcaaccacaugguggcucacaaccaucuguaaugguaucugaugcccucuucuggcauguagguauacauauaugcauacucauuuacaacaaucuaacacacaaauaaauagcuuccagaauucaacuaaguaccucauccuaccuuacuuuuaauagaaauguaagagcaagcuggcagcuuguuacgacugcaucacagucagaagccauucauuccuccugcaguggaacggagaggagaucuagacccaggcccuagcuaacaucagucuagcucuuuaaacuccauuugaauaauuccacuguugcaacagcuagacaaaagaaggaaaaggugggaaagagauggugagggaagaaaggagggagggaggaaagucaaaggcuaacaagauuuaagagaugaacacuccagcacaauggauucagaagcacgccacaucuccacuagauggcacccagggcccugagaugaggaagggagcgcugaggaccuauuacccaaugaauacagcugucccgggcucugccugcucauaccuguccuguggguuguaggaacugauuauggaaccggccauagcacgagugcuugcgcugucgcuaauugcaccaagacuggcugugucuuuggggaaaauuuccuuuuggacaucagcuugaacuucuaaccuguguaaagaggggaugugcaaguuaacaggagaagcaggguucugacgguuuguuuccuggaacacaccucuuccauuauucucuugagaacugugauaaucuguuggaucaccuccaacugccaaacaguucaaauacaugccagcauaguuccucucuuacauaucaagugaaacugcccccuccuuucugucccuuuaacauaaguccuugacuaaaaaaaucaacaccgggcuuguguccagcagccccuaaauucaagucaagcaacuuuccagagcagugucaacgcaggccaagacccaaccauccuaaaaucucuuaacucuuggcccccuuccugccuacagacaucuguggccuucccgaccugcuagcggcuuggguuccuuuucuuaccccaauuccagcaucacaaccccugaguuuucauucuguaccuccauggcuuuguggaugcuaugcccugucucaaaaguuucucuuucucugccugaacaacuuaugccaggucuuuaacaacaaaggacuaccauuuccucuuacucucucucuuccagcacccggcaggcaccuccagcugagugcccaacccucuucugcaccaacuuccacaccucucuccacugcucugugaggccccggaaggaagaguucacaacucauuccugcuuugcccuuucuaccuuggacacagaggaagaacucaaacacguaguaaucagguaaccuccaggcugcaggaaugaagggcauauaggagccaaccuccucccucaucaacagcacuuuccuaauaggguuucaaggcugggaaccccuaacugcuuccuuucuggcucagcaccauuuuguucugcacuucaguauuucuucauaauggguuucgcaguccagcccauuugacucauucacuucccauaaaggaacggcuuucacuggaugcagcagcugccggcugcacugcagucucagcaagucacgcuccaacuaugucuguggcucauucaaggggagcugguuuuaagagagcacagcagugaauacuccagcaugugggggcaggggccguuaacaagggacacuagucagaagaugcagcuaggucagcagcagcuccaucccgcugccugugucucugccccacacuaggaaaugagggcaacuggggggugcucucaggccuguguuccagcuucagcucugccacacacucaguggucaaagccuuucucagaaccuaccaggucaccuccuugguggcugccagaggcugguucaugccagcggcuacacuagaaucaucuggggagucuucucuaaacauagaccacccucaggucccaucccaggacagccuaaguuauuaauucuggaaauaugcuccuagagucuauuuuaagagguucccaggcgaaugaaggacaccaaggugaagaucuaguccacucgccaucugccacugcaucuucuuugcagccaaaucgccaucugcucucgcccuaaccgcccagguccucugugaggcaguguccucucuggggccuuccuacagccuccuccauguucuccauagcacaugaaaucaguggaggcugcugccugucagucacggaguacuaauccuuuccuagcaggaucccuccagguaccugagacaaugcucugucucccucaccuccugcucugcugugcuccacgaggccacucuuccccacugaacucaacuaacugcuucuccucuaacgccagcuguauauguaaauaugaauaacuauggcauuacgguagggcacaucagcaaaaugcaaguacaucaguuauuuuuauugacaaggcuuucuguacucuuaacacaaauucacagaacugauuuuccuacucuauccagugggaauaagagggucaugaagaguacaguaccagagucaacgugacacagcauaaaaccaacgacaagccuaacagagcgccugccuucugcucuucuugcuuccuagagcaggcagcagaaugaagcagcaagaccuaaagucaacauuauucuuuaaguggaagucacuaugaugcaaagaauuugugaacuuugaaaaauaaaauaccacugaugcuuaaagugguauagagauguggcucgguguguccucucuuacaaauaauuccaaugccugcuacagaccaccucucuacuuaccggcuguacuuucccuugccgcuggagagaauaccaccacucagugugcccccugagagggcagcgaagcuggcugucucgcuguauggucccugcaugacacugaguccaucuguagggcuuccgcugguacucagcacacuagucaggcccucaaugcugcuuucuccgaugcugggguucuugagggcucgccaggcaucugccacuauggguagaaccagacacccccauuugaaacaacauacaaagagucuggaaggcauuuuccugaagagacucuucagaguggaggauuuucaugcugaaaaguacuacaaauucacuuaacaagcagcgaccgugugagacaacagaaccagacugcuaacaucugcacuuaagccucucaguaacuuagugauuaggagcccugauuucaaaugaggaaauaagaauuugaaauuaaaugacuacucaggaucaaauaagucacaccacauuuuaacugcaagcccacuauuauuucuguauaagucuacagcaucuauuuuguuuuguuuuguuguuuuccgagacaggguuucucuguauauucgugguuguccuggaacucacucuguagaccaggcuggccucgaacucagaaauccgccugccucugccucccaagugcugggauuaaaggugugagccaccacugccugguuacagcagcuauuuuuaucuaccuuaguagauuaaaaaaaaaaaauugagacagggucucucauucuauagucuaggcugucuugaauuuaguacuuagcccacucuggccuuggauaucagugcuaggauuaaagaugugagcaauuaugccucacucguauuucucuuuuuacuuugagucagggucucccuguggcccagacuggcuuugaacacaugaccuccucugccucaccauccccaaugcuaggauuauagggaagugcucucaaaccccuuuacuuaacaucugauuagcucgcgugcagcuucugccgcaaagcaucaaaaacacccguguugcaaguaggugaagacaguguucaaguaggagucacaagauuugcucucaucucaggucugcagaagcccuugcuacuaaaauacaagcuaaagcaguucccgcugagauggggaugauagccccggccucccucuucagagagcuguuguaagaagcaagcaggauaaaguauaaaguccuccgaaacugacggagugcggcacagacgcggagcuuucugaccaccccgcuagcacacuccaguuacuugaagcccuauugccucauaccugccauacacaggcaaguaccagaggaauuaaccuaauaauucuggaaccaagaaaugaaaggcuaaaaauacuuuaccccccacaaagcucauuauccaaagaaauccagugauaaccucuguaaauaugugcucaauucuacugacuuuuaucuuuuguucuauagauucaaauggaaauaaaaguccuuccuuuaccugugauuggaccaucaucuucaucaaacucaauuuuuacccccuuuccauuggcugugcuaacuccacagccaccuccacggcaaagagaaaugggcacaaccccauaaacauaugccagcauaauggggacaccaauaccuggggaaagagauggaaacaugucaucaggucaacaggcaauuguccugguucucccucccagauugagcacaagcaagccacuagggccaaagacaaacauggccaucugaagaggcuaucugguauaacacaggagcagacagucacaaaagucuggaugucuuggcuucaguccuuuggcugucuguucauagaaccuuuccagugauaaagaaaauauacauguagaauccaaugcauccaacauauguugauuuuauacuacucccuucauuguugaagugcuaaacugagaauuaaucaagaaucaaagacugaaggcuggagagaucacucagugguuaaaagcacuggcccagguuugauucccagcacccauggcagcucacaauugucugacuccgguaccaggggauucaaugacauccuguccuccagggcaccagguauacaagugugugcagcuauacauacagauaaaacauacacauaaaaauagacacugggcgaauggcuguagggauugugauuugaggguuccucagacucaauucuccaaucacacugcuguaugugcagaguagcucaguuguuacauguuaagaaggaagacugucuugauuuggggcuggaaaggucaaucagcagucaguuaggagcacugguugcucuucuagagagaggacuugggaucaauucccaucaccuacauggcagcucacaacuguuuuguuacuccaguuccaggggaucugauaccuucaaacagacacaugcaaucagacaaacaaugcacauaaagauaaauugaaaaacaagcaagcaagcaagaagucugccuggauucaugucccagugacuugaccuuagcuccauccacauagacuguaccuuuauauuucuaauuaugcugacuuuguggcacuugugaagucuuaauagauuacauaugagacacccagaaccacugcugacaaaugauaaaacucaugaaauguugguuuccaauuaaucuuuccuuucuuacuuuuguguuugagauaggauuucuuucauguagcucaguuugguuuugacaugcugaggguggcuuugaacuccugaucauccuguuucaccuccugaaugcuaggauuacaggagggcaucaccacgcuaggcuaaauuugucuaaaauaaauucucauaccucccaagauacugugaggcauuaauagaaaauaaguguuugugugugugaauucuuuaacaaauaaauagaagagggggcuggagagauggcucagaaguuaagagcacugacugcucuuccagagguccugaguucaauucccagcaaccacauggaggcacacaaccaucuguaaugggaucugaugcccucuccuggugugucugaagacagcuacaguguacucaaaugaauaaguaaauuuaaaaaaaaaaaaaaaaaaaaaaaaaagagcugggcgugguggcacacuccuuuaaucccagcacuugggaggcagaggcaggcggauuucugaguuugaggccagccucgucuacagagugaguuccaggacauccagggcuacacagggaaacccugucacgaaaaaaaccaaaacuaacuaacuaacuaacuaaauaaauaaaagaaaaggaggaaaaguaaaagucuaguguuuaauuuucauuaauuagugcaaccuuuucugugugauagacugaguuguaggcccuugucugagacacauccugauaaugcaguguagcugaaaaaccaucauaguuaacagugucuacgaagaugaaucuccaggcuggggaaauggcucaguugguaaacugcuuaccuugcaggcaugaggacacgauuuuaaugccaugcaaagacaacagacaacaggagugcuggcgcacaguuauaaucuggagcuggaaaggcagacacagguggguccaaucgucucagccuccaggcuagccacucucgcccauuuggcaggauccuggucuguaagagacccuguccuaucuuaaaagcuagguggauggcuccugagaauggccccugaggcuggucucugcuucuaauagcacucuugcauucacaagugccucugccuccaugccauauaugugaacacacagaaaguuaucuagcaggcuggugacauggcucaguggguaacagcacugacugcucuuccgaagguccugaguucaaaucccagcaaccacaugguggcucacagccaccgguaaugaguucugacacccucuucuggugagucugcagucagcuacaguguacuuauguauaauaauaaauaaaucuuugggccagagcaagcagggacugagugagcagggccaaccggagcaagcagagguccuaaaaauucaauucucaacaaccacaugaagggucacaaccaucuguauagcuacaguguacucacauauguaaaauaaauaaaucuuuuaaaaaaaaaaaaagaaggaaagaaaaaagaaaaaaagaaagauaacuagcaaagugaagucggcacagaacguagugucuccacaguaagcaccuggccugccggcugaccugcuacauaagcuaacagaggagcuggaggccacucgcuuaccaacgcuaacagcagcgauuacuggggaugcaaugacugacaaggucacuccuccugugauagccaaauuccucuugugcuuggagguuuuccuucccucguaccugcugugaaucuaagaauaaaaagaaaauccaggucagcaggucaggacaucaguauuuugccagggaaaaaaaggacaaaugcucgcuugcaagcuauauuaaagacacccuccacccaaagagggaucuuucuuaaacuuuaaccuaacccagaccuggaaaauagaaaugaaugcaggaaaaguuaauccaagaaaagaaaacguagcucaagggaauuucaccuuaaagucacugagacaaaccaggcccaggauguuaauaagaacuuucagaccucaugggggcuuauaaaaauccauuuaagaaauuaaaguuauuuuuaucuacaaaccagcugguuuucacgcagcccugaaauauaaggccuuuccuuuccuuucaaacuauugccaacaaagccaaagcuggaacaggccuaggaaggcaugucuuaccuuucuccccacguauacagggaugccgaugaccauggcgggaauugcaaugccagcaaugagugagauccccaccggagcaccgaucaaugugcccaacugccaaagaauuuucuuuuugcggcuccauggcuucuugccccagaauguacagccagagggacuauagaggaaacaugcucacguuaauggcagcaucacaaacacagcugcuguggccagaggcuugauaggaacaacaaccaucuuuucaguaagagugacuaagugacaggaggcaacagaaaacagaucucuuagccaagggggagcaaaggacaagggguucugggcgucucagguuuuuuggugaaggcagaccuccaaaacugacauucuuuccuuucuugucugacacaauaccuacgcugaccugaucacccugaccagcacuaccugagaucccgaacaggucuguacuugacaucucacccaaugugcuguguccugcagcucaugacacagacucugaaguuucauggcacaugucccuccuuaccuaacauacacaaaccacauucuuggggaaagagagacucaucaugucuucccuaugaguuuguuacugagagugguuacuuuaaccuuagccuuucugugucugauucuucuaccucauucccuuugugcuacuuucucuacuccauaagucuagcaguauuauuccaaguagaaauccugucuuauuugguugguccugugucucuagucaaugucuguuacauagaggcuuuuaaauuuucacucaacuggaaaugagaugucucacuucacaacgaaugcuacacaauaauguccauaaauguuaacuucuuuagaguaauaauguaauauucacucaauucuuuagaaacuuacuggauggaggaacuguaaaaagaucccaguuaaugagaucagacaugacagugaaguaccaagaaguacaacacuuacagcagauucaggaauggcagugagggacgaagcagaaacgggaagccuggcggaugaggugcacuuaagguguuuuucauggauaaguaggaacucuguagaccaagccuagcggcacauguuuaugaccacggggaagcugaaucaauuuagaaaccaauucagaaacucauuucagaaaccaaucaaaggccaagcauaguggugugcaccuuuaaacaggaggcagaagcagacagaucucuuugagugaggccuggucuacacagguagcucuaggccagagcuacacagugagauccugucucagaaaaaggggacaagggguggcaagacagcucagugcaagcaugacgacuuagguucaccgccuggucaugcgguagaggagaaggacggacucucacaaguuguccucugaccgcuacauguauggguggugcacacaagugugugcacacaaguguauacacacacaaaagaaagaacuuuaaagaauaaguaaguagggcuggagagauggcucagugguuaagagcacugacugcucuaccagagguccugaguucaauucccagcaaccacaugguggcucacaaccaucuguaacgggaucugaugcccucuucuggugugucuaaagacagugauaguguacucauauacauaaaauaaauaaauaaaucuuaaaaaaaaaaaagagagaguaaguaaacccaaacaagccuaccaagaacugaaauaaggggagauaaagggguacgaaaggaggcugaaguggucagaggucacugagaacaaugagguaacgugaacaaaucuggaggcaagagacacuguaaacaagccagcucagacugucuggaacagcagugauuagaaaggucgacuaaaaccagccauggaaagccuuaaaagccacgcagcaggugagaaaggaagguaauggaagucagucaccgagacugcuggagaaagcaccaggcgugcuuuaaaggagcgucuuacaauuuccuccuccuguaaaugacaucaaccauggcucuuugguagcccuuuuccuaacugagcaagggcagagaaggacaaggcaauggauaugugucccaccuaccugagguaaugcaagucagagaucucuuucaugcaaagccagcagaauucacagccacacacugcacaggucaugugguuacagcucccaucauucaucuugauaauguaagcacugcaucgugggcauggcuugaugucaucugcuagguagggaaggaaagauaaaacaccccuuguuaaauucagucugacuuuauuauuccuaagaguguauguaagaaaugagaacaaggcagucaggagauuuugccugacgaucccaaaguguguaauacuuuacuggaaggcugacuauauuaacaacucuugcuguguuuguuuguuuguuuguuuuggggacagggucucauuuaucucaggauggcuugaaacugcugaggaugcuccugaauuuaggaucccucugcauuuagcucccaagcauggggauugcaggcacagccccauggcugacuggguggugcuggagauccauccuaaguggguauucuaacaccugagcugcacacccagaugcaagaacuuguguaaaauggaccucgucucauauuaggcugccaauuccaauaacuagcaucuuacauagcacucaagucacauuugggcagggagacuccagcagaaagguuccaaggcaaauggaauuucuacuagccaaaggcuaacagauuaaacccaggccauuagagcaagaaauuucugcagccuggucagcuuaaguuuugacagugguucccccguccccucccuacaacugcaucuuugauuacauuuuuacucaaauaggcugucucuauuuuuuucucuggaauuaaacaaauuuuaauaguuuaugcagcaggcuuuuuucuucugugguagguuucuucucugcuaguuucagugguuuuguaggaagccaacuuuugucauuaacaaaucccuuccuguaacacuuucaaauuuaaacaucaaaaucaauggaguaacuguauagcaugcagcaggucauuuccccaggaauuuacaaacuauccuauccaaaugacaauuccagagaguauacucugcuagaaaaagcaaauggcauaauuucucuccuacuaacuugcucaaaugcgaucaguaagacaaagaacaucuaaaagaaacugacgucuuaaagauuguucuacacaaucaaaggugggaagugucugugacaucccccucagggacagucauuaacucacacgaggauuuaucuccuuuucucaaaucugugcccuacuucaaaagcugugaugcacucaagauagauggcaagcaggacacacugaacgcuaaauuaaauguuucucugucccuugagagaaaaaagaaaccaaagugcucuccaagcugagacacauauuaagacagcagcuugagaauuccauuuuguuguaucccaaugucacacagcuaggauuaacuaccuaucuuggucagcaagaagcaacauagagggguagguaggccaaaaaaaaaaaaaaaaaaaaaaaaaaagcagcagcaacauagcagauguaucauuaaaaguucaaccaagccagaaaaugugucuguagucucagcuauucagaagaaucaaauuucugcucucugaucucaaggaugcauggcuaagacaaucucuuuuaguuuuggagacuuauauuauagauacccaaugagacagugagauaaugccagcuuauaccugguccagauucuugcccguaacugagaccugaagugugcuugguccgaacucguaaagucugagcccucugcugacgggccauaucgcaggucugguuuggaugccauaucugcuugcagugguagcagaacucagucuggcagcccucccucucacagguuagcuuugggcaacuggcacagccauaggcaauaacagcauaacuggguaaggaagcaagaagagauaaaagugaggugagcuuauacuguuugguaccacuauauaugauacaaagacacacacacacaaacacacacacagagagagagagagagagaggcaggcagacagacagacagacauagacacaaacacacagacacacagacacacacacacacacacaaacacacaccccaaguacacuaacuaacuguacuugcuuucuugugaaaaacagcucacuuccugacagcagccuggauugcuagcaaguauucagucagauuaagcuguuucaggagugcuuuagcacagcagcuucauaaauagcaggguauacaacaauuuccuuucaauggugugcuauauuuagagaggcuugaacuuguuuacaugaaaagucagaacaguuguaaaaauaaagagcuacagcacaaacucaagcacguaugcucuuccauguuaagauccauaguggaacuggucugcucacagcuugaaacaauagcuucuuuccacagacucagagucuauugaaagaucauuuuugguuuucuuucuuucugcuuuuaaaagauuuauuauuuuuauuuuaugugucugaggguuugacugcauguuauauaugugcaccaagcaugugucuggugccugaggagaccacagugggcauuggaucaugcugaaacugaaguuaucagucagcugugagucaccaaugaggguacugaggacugaaccugggucuuauggaacaaguacuacuaacuacuaagccaucuuuccagacccuagacuuauuuuuauuuuuaauuacagguaugcuguguguguguguguguggggagggggggauaugugcauacgagcagugcccagagacuagaagacgacacuggauugucugcaguggaagucuaggcaguugugaacuacccagcaugggugcaggagcugaccuuggguucugugcaagaacagaacacgcucuaacugcugagccuuuacuugagcccuugcuuuuagcuuuuuucucuuuuucuaauuuaaaucugugccuuuuaaugcucuuuauuuuuucuuuucuuuuuuuuuuuuuuaaacguuguuuuauaugcauggguggguguuuugucguaugcaugugcaugccugguggccauggaagagggaagagggcaucagaucucucuggaacuggaacuggaguuaaggucguuauagguccucuggaagagaagcccacaauccuaaccaacugccagcucccuacuguguucuuucuuaacagcucauaaaaccuuccuacugggcuggugagauggcucagugaguaagagcacccgacugcucuuccgaagguccgaaguucaaaucccagcaaccacaugguggcucacaaccauccguaacgagaucugacucccucuucuggagugucugaagacagcuacaguguacuuacauauaaauaaauaaaucuuuaaaauaaauaaauaaauaaaauaaaaccuuccuacuaaccuuuuaccaacacagcaaagccaugccuuccucucccucugcugagguauguuaaagaugcacuacugcagacaggcugcacuagcaccaaccauccuuacaagugcuguuagucccucacaaauaacuacugacauuuuaaauuaauucuuaauauugucaaggaaucgcucacauugcucuuauaagugggcauuugcuuaaaauuaaagggccgggauguugcucagcauuugccuaauaugugcaagacccuaaucccaggcacuguaaaauuaauuaacuuuaaaaaguacuuuaaagaagcaaauauaguuuuuaaaaaugauguuuuauuucuaauuaugacuagaugugugggcauguacacacaaaggugggugccuguggaggucagagcugucagauccccuggaguuggguuggaguuacaggcaggcaggugaccgugcaaaucaccugauaugggugcugggaauugaacucagaucaucugaagaauagucugagcuuccccuccuccccugguuuuucgagacaggguuucucuguguagcccuggcuguccuggaccucacguuguagacuaagcuggccucgaacucagaaacuugccugccucugccucccgagugcugggauuaaaggcgugcgccaccaugccuggcuagucugagcucuuaacugcugcaucaucucacuagcccucaaacacaucaaugauuguugguuucuugcugucuauguuuugcuguccucuaguuuacaccuuucuccaauauucaaagaccucaaacaacuuaaauaaaugcuaguaagcuuuccuuauuuauccuauaguuuucuuauuaauauauauguugaguauagcaauuugauacucagguugacuuaaaaaguauacuacagccaggcgugguggcgcacaccuuuaaucccagcacuugggaggcagaggcaggcaaguuucugaguucgaggccagccuagucuacaacgugaguuccaggacaaccagggcuacacagagaaacccugucucgaaaaaccaaaaaguauacuacagauauaaaggacaauguauuuaucuccugucacauaauaugcuuccuuaauauucucagaaggaacaaagugagacuagaucaauguguaaauaugaugauucacuuccuguagaaauucugagcccauuuaccccagcuagcaggaaaaacaacuacuaaacaauguaucuuagaaaaaaagugacuggcuuucuauuuuguguuaacugaaaugaaaagguacagauggcuucuaaaaguaauuagcgaaguucuaaagauauaaaguaagaagaguaccaauggggggggggaggcuuaaaacuuuauaacacauuccuacaucacaugauuauucaagugcuuauuuccucucucuccucugucucugucugucugucugucugucugucugucugccugucucucucucucucucucucucucucucucucucucucucucucucuguguguguguauguguguguguguaggggauuggaccuagcacucuguaagcauauauugcacuacggagccaaguccuccagccucaacauuucuuuuucuuuuucuuuuucuucccccaauuccuucacugucaaaccugggcacggcugcuccauucucugccuguucugggucuauaugacgggaauaugaaaguaugugcugcagcuucagauuucauucacauuaccccguuuuccuuuauuuuggcagauuuggcauccuuucacugggcagugagcagacaguccucaaauuucaaggcaugacaaccaagcaguacagacaggccacagacuggcaggcaaacaaugggaaaccaccuuuaggaguagaauuuaguuccgaggaaguaaaauaacccccaauccugaugacucuauggcagucuaucacuaugacacagacuuacucaggacauaagacuuagaauuccuguuuuggguaccuacucugugcugauucauacugcaugacacagaugaacuuaaauauccccaagccuuacuucucucccucuacuggagauagagcagugugcugccuucagguauagcucaacauucuaaaacugcauucauaacuuugcacugaaagccguaacauauaaugcacuggacuucuggccuuugccugcucucuuuuuuucugcccagagaugucuuuccuuucuucuuucugguaaauauccauuuaaaaaccagcucaagcugggcgugguagugcaagccuuucauuccagcaauugagaggcagaggagguggaucucaugaguuccaagccggauuggucuacaaagugaguucuaggaaagcuagggcuguuguuacacagagaaaagucugucuugaaaccaaaaccaaaacccaaaaaagagcaguucagaugucaucuucucuauaaaauguacucuccaggcugauagcgagcuauuugugcagugcaguuuuaacagcauauuacagccuguguaugugccugucucucccagcacacuggaccucagaggcucagcauaccugugguggccacaggacaaagaccccccuuuugcuccgcugguccuuuggcuuucccuagggaacuuuagcucuucuccuggccacauuuucauccuagccauguaugguugguuuuuuacauauuaugcaguauaaucuaauccugcaauuuuauaaaaauucaucuuaaggguaaagcuucuaguuaagggaaaauuucccuggcuggacuaaaagccucauccaugcgcuccagcuccucuggccauguuguuccuuuucuuguauguccuauacuagagggaacuucucuccuacucugcuguuaguuuaaccaaggauucaaauuugcuaauuagaagcuuaaaguaggguauaaaaaguuacaugcugccucaagcucagaaugcucucccucaaguucacacaaccuuuauguuaaaucuucagaauuaucaguguggcaggcuaucuuaauuucaggccuggaaaaaaauccuauuaguauaaauuuaauuaugccucacagauuucaguaguuucuauauuauguguuccuauauaugucuauacuuccaguccuaaagucuuauauuauccauuuacaaauggacccuaagauucuuuaaaggagauagacaugggaugagggagauggcgcagugguuaagagcccugucgcucucauagaggacucucguuugagucccagcauucacaugguggcucacaaccaaaugucacucuacuucuaggggaucugaugcccucuucuaaccucuucaggcaccaagcaugcacuuggugaacauauacacaugcagguaagacacccauacacauaaaauaaguaaauaagaauaaaaggggucccuccuuagaauggggaaccaaauacccauguaaggaguuacagagacuaaguuuggagaugagacgggaggaacgaucaugcagagacugccccauccagggauccauaccauaaucaaccaucaaaugcagacacaguugcauaugccagcaagauuuugccgacaggacccugauauagcugacucuuguaaggcuaugacaguggcuggcaaauacagaaguagaugcucagagucagcuauuggauggaacacagggcccccaaauggaggagcuagagaaaguacccaaagagcugaaggagucuguaacccuauaggaggaacagcaauaugaacuaacuaguacccccugagcugcauauguagcagaagguggccuagucagccaucauuggaggagaggcccuuggucuugcaaagauuauauaccccaauacaggggaacaccagggccaggaagugggaguggguggguuggagagcaggguggggaaaggguauaagggacuuuugggauagcauuugaacuguaaaugaagaaaauuucuaauuaaaaaauacauuaaaaaauaaauaaaaauggaaaaaaaaccccaaaaaacaaaacaaaacaaacaaacaaaaaaagagaauaaaagggguuagaaagccaugcccuuacuaguuccuuuuucuuguuccacuucauaauccacucuucaaccagacaacuguaaaggccuccacaucuggacuuccuauuucuuacaccaauucacuauucacuuuagaagguauucuauccuggaguuacucuguugcuuaaguucuuucaaugagagagagagagagagagagagagagagagagagagagagagagagacugaacagcacuagcacucagaacacugagacaggaggagggugaauuuaagagcagugugagauacacauaaggucaaauggagaaggggaagggagaagagggcuggagcaaagaguguggcucaguaguaggguacuugcuuauagcacaucuagauaucuggguucaauguccagaaucaaaagaaaaagcaagcaaaaccaaaaguuacaacaaggaacucaaacccucaacucauacagcuuaguuaugucuauuaacuuggauuuagucuacuuuucagacucaagaucucaguaaugugguuagaaguugacugagacagacuaugcagccagguaugcauuucuacucauagucucaaaugcugugaucaaauaccaccuccuuuucaaggucuuucuugauaguuuuaugcaaaacuuaaugguuuuacacuuaagauacuuaggaguuuccuuaguauuuauucuguuacaacuaaaauccaucugucaauugucaacuguccaucuuugaucguccauccuuucugaaauacucacccaggggucaucaccuucccacccuccuccucucugcuccuguaagaaugcugcugcucagcucuuugcccuucuccucacaccuacucaucccauucuucugagaccuucugagacugggacaaggacacagaauauggguagccuacuccacaggagcuguuuuuauaaucuacugagcaaaagagucacuguuugagacccuaacagaaggcaagccagaaugguagcaauuaaaggacuuuagaaaauggcaaauaaccagauagugguggcacaugccuguaauugcagcacucccaaagcagaggcaaguggaucucugugaauuagggucauccuggucuacagaguaaguuccaagacaacugagagacaacuacauagggagacccuaucucaaaaacaaacaaacaaaaaacaaagaaaauggcaaauaguuaagccuuaaagauagcauggcuaguuggagacauguaugauccuugguacucugaauuuggaaaguuauaucauacaccacauggcauuugcauuggcaaauguacaguacauauuaacauacuuaaugauguggugucaugcaauguaaucccagcauucaggaucaggaaugcaaggucagccugagcaccauugaaagggagaggccgggcuggcuggagagauggcucagcgguuaagagcaccgacugcucuuccgaagguccugaguucaaaucccagcaaccacaugguggcucacaaccaucuguaaugagaucugaugcccucuucuggagugccugaagagagcuaugaugcacuuacauauaauaaauaagucuuuuuuuaaaaaaaaagaaaaaagaaagguagaggccagucugggcugcauaaaaccauaucuuaaaaagucaaagaaguuaaaaaacaaaacaauaacaacaaaucaaaaaacagaaacaaaauaacuauuuguuuuaguuuauuucagcuaauauuucucuaucacauuugaucauuuuucgagacaggguuucuuuguauagcucuaguuguccuggaacucacucuguagaccaugcuggccucaaacucagaaacccaccugccucugccucccaagugcugggauuaaaggcgugcaccaccacugcccagcaacauuuuuaaguaauaucuauaacacaccuugaaaaacauugauauagaaaauaaacccccaaacugguagaaauuaguaggguacagugucacaugcauguaaucccagcacuugagaggccaaagcaagagggucaaugucugaggucaucaugggcuacauuacauaaggagacccaaguucagagcaaaaccaucaaaaagauaaugggaaaguuggaagcuauaaagaagcuugaaaugagaacagauuaaauggguaaagucuuauuuuucacaaggccuugcugcauuguuuuaggcagccagugaacuugcuaugauaaugugcuaagugagccagacuccaaccucaggaugcugucuccuguguuuauaccuccauauagugcucacugcacucagguuuuaaacgcuuuaucugcuuuuuugucugccagguaugaauuucuuuaagacuagccuuaaauuugcaguaauccugucucugccuuucuuuggagucucagaauuauuugccuaacaugguccaugugucaccauguaaagcaaguaagugauuuguuuuuugguuuuuugguguuuuuuuuuuuuuuuuuuuuuuuuuuccgagacaggguuucucuguauagcccuggcuguccuggaacucacucuguagaccaggcuggccuugaacucagaaauccaccugccucugccucucaagugcugggauuaaaggcgugcgcuaccacugccccgcaaguauacacagaacuuaucuuauagauaaucagugagcauuuuuaagcacuuuagaauaaguacuuugcagauaugggaacugagcuggaagguggcuguacacagaggcugaaaaagacucaggggaaagcugcagaccaggaaguaaggggccagauuaacagaaaagggugagggcuguggggauguagcucaugguagaaaugcuuauccagcauguacugagaccaugaguuccgugccuagcaucaaaacaaaacaaacaaaaaccguggcaagacauugaggaaggauagggaaggaaagguccuaguugggcaugauggugauacacauguagucucagagcucaggaaucagaggcaagaggacugcugcacauucaaggcuaacaaggauacaccgugaaacccugacucaaacaaacaaaagaaaaauccuuuacugaaugugaaacaucucucauccucucucaugaauguacucuauauaaguuaauguacucuacaugaaugaacagaagcuuccuguuuauaagacaggccaggccaguaguguggggaggccaauggcugagaccaucugcugggaucagugggaaguacaacucuguagggaauggagggagcaaugaggccagagccuggaccagcaacggauaggucaagauagccuuagugcuucuucuauucugaggaccugugugacaggaaauucuguugacuacucuacucaccccucagucucccagagauucugaaaauuaaagauggacaauagagcaccugagagaaaaacaaugcaguuauaacauuuguggguuucugaaaggacacacuuaggcagagauucaaagggguaauugaucagcugcacuacuuacuagcuaggaagcagucacuccacauuuaaacuucuuugaacuaguuucuccuuuacagaauuauccucccaccaccuaucugcguguggccaaagugaauuuacugugucacugagauaauacuuuaaagacucacugcaaagaacuacaaaaaaugcaagcuauuugcauuuuaagcuaauuuuauuucacuugaaaguauacuuuaagauuacacuuguugcuacaguauuuggcauaucaaauaauauugugucuauuuucuacugaaauugguucucucauugauaaagccauaugaaaaaagaaguaucagaauucuguucugacccacaaaaacuuaaaaaaagaaauuucuuaauuuaugguguucucauuaauuuagucauaguaaaaugaucauaauucuaugaggucacuuauaugaccccuuagccugaagauguacacauauauacaugggaagacuuggucaauuuggcugccaagacugacgcugugggcaauaaacauggucagguguaggaagagauaaaugagguuuagggccucuuuucuaaugcuuacacaagauuuuugccagacccagaagaauaggauauuuaaaaaaaagaaaggaaaaaagaaagaaagacaaacaccaaaagaaaaaaaaaucuacacaugguaaugcacacauauaauccagcauuggggacguggagacgggaggaucaagaguuugagacagucuuugcuaaauaagcaagacugucugaaaacccaaauuaggauuaggaauauaacucagcaggcagaaagcuugccuggcauccacaaagcaccagauuugauucccagguaguaguggcagacugcaggcucaucacucagcagguagaaguagguggauuagaguucaaggucaucaacaaagcaaaauaagaggcuguagcuaggcauggaaggccacacuuuuaaucacaauacucauguggcugaggcaggcagauccugugaguuugaggccagccugggcuacagagugaguucuaggacagccagggcuacccagucucaaaaccaaaaaaaaaaaaaaaaaucagaaguuguaacacuuucuuagaguugcuggggaaggcagagacaagaggcaccccgggccuuaauagccagccaaaacugaccucuggucuccacaggcucccagauacaccacacacacagacacacacagacacacacacacacacacacacacacacacacacacacacacaucacagagccuauuuuucuucuggcauuaagaagagggggcagaacaacuguccauggggaacucagacuauuauuuggaaagcaaaugaauuaccgagggacucuuuguguaucuaaccaccuuccacugacaaucacuuuauaaaaguuaauuaauuaagccucuuaagucuuaagacaggauuaggcuuuucugucagauaagaaaaauaaagcagguaagacuauuaaauacagggaugggaagagaaacuggagucaagcaucccugggccucaguauuguucccaagccacacuuccuagaacaugcccaaaauggggacugugaugacaagccaauacuugaguugaaaaauauuauuggcuuuggaaguaagacuauuccgacacuggucugcuucacugccuaccaguuuguuguuguaucacccugaacaaaguauuuaauuucaugaaaugccaguuuccucauuuauaaaacuaucaaaucaauguccuaucgcugugaagaucaaaaucugcaugccuggcacaaaggcaccucggugcugguuugcuuucuuucccuaaauuuuauuuucuuuaaauacauagauacugacaaaaagugugcauauauaauuguuagucugacuaauuaaaacagaauaugacagaaucucaaaacaacaaaaacaaaacucaaaaccacacacacaaacucagaaucggaugagcccacccuaaauccugcuaaauuaagaagacucaaguaacucuaaaaaccacucaugguucuuuauauuucuugucaagcuuuuauauuaauuucuguccauuuaugcugaugugagugaagauacagguugacuuuaaaaaaccaauuggggagcuuuccccaaaagaugaucagggaagucacauuucauuguuaaaauucaaauaaacucucauuucuaaauaaggaguuaauacacuauuaugcaauuaaucagguagugcuuuccuaaacuacuaucccuuugguucagaaaauagacuaaaaagaguaucagcaaaacuugaauauucuauaaauuaaccucucaaaagccaguaagaccaccagacacaagcagaccuuuucagauggccacgaggcccuuccugguauucgauaaacagaaagugaaagccaucuggguaccuuugaccacaucuccgaguaauuuagaaacucagugagguuaaacacacccacuucccaacaagucuggcacuucugaguacacaguuccuucugaaggggagacaaauggcagcauccuggaaucucagcucagccuugauacacaggcuacaauuaaaagccuuuaaauccuuugaagcaaggguucacauaccuuuuuacuagcauuaccuuuacacuaggcgcugcaagugcccgagagucuucugcccccaaaacaugacacacaagaauauaauuaaucuguccaaggucacagaacagguaauggcagucugacuccccaucacacugaagagccccuucuuggcugcauuugaccauucauauauuggaaugauagagacaaccaaguuuuuuguuuuguuuuguuuuaaagaaaggggguggaggaccuccacugaaagcuucagacagagaaaucaguaauuccugcucuaaagaguauuuuaacucacugaccuuugaaaucaagcauacauggaacauuaaaaagacugucauacagauuucaagacugaaaagguaggcaaacacauuuucucacaccagaucaacuucuggguagacaccgccucugagcccuauugauuuuucuggucaaaaagucuguugugacuuugcccucggcagcacguuaggaaccacaaggugccugccaguggcuuagcacagcacgcagugcccagggugccccuagagcuguuagugagcugccuucucucaucaucugcaucucaacuuucagcagcgguuguguggaagaacacgccuucugcaaugcugcugcuaagugcgccccuagccauauggacacaccccucggaagcgcggccccuucaguaggacauuuucauucucucuccuauaacaaauauuccuucucaaucauuacgauaacacgcacauacacacaccucucccuuccugggcaaagagaaagaaaacaaaacaaaacaaaaaaaaccccugcucacccggauauucugacuuaauggacaguucccuucucuuagcacucagccaccaccucaagccaccucaagcaaguagguauagggugcugagugccaucagaccgguugcaaggcuggucugagggucgguuacucgugaucguccguccucuaccuccugcugggcaccauccucuccucccucaaggugugugacacccguugcacccgggacgacccccgcggccacgcccccgcgcucacccgcagucaggggccggacaccagcggcagucgggguccgaggccagguaccggcgcagcaugaacucuucguacuugugcaugagcggcgggucggccagcagcagacggaugucguguggguugagccgcucgcugcacucggggcagcugaugggcacgcggcucucgcugaucuccaggcgcagguaguggcggaggcagucccggcacgagcgaugcgggcagcugaggaggcgcggggcccgcucgggcggcaggcgcaccaggcacagcgggcacuccaccuccuccgcgccgccgcccuccgccgccucguccuccuccggcccggcagccacggccuccgccucagccucggcagcgggcucggagggcagagcuuccaccggcggggccugagccucaaccggggccggagcgggcggcggcggcggcggcggcgcagccgggggcggcgguucggccugaggcuugguccgggcgcggcggccgcgggccgaggcggagaagacgcuguggaaggugaggcgccggcgccggccgccgcugcggcacuuagggucgggggcggccgcauggagcgagguggagcgcggcgacucggaguccuucucggagcccauggcccgcagaggcugaggagccaggggcgcccagcgccgccguagcucccgccucagcgcccccucccagccggcgccccggccgccgccgccgccgccaccgccucggcaguccucccagagacagaagccgaccagccgcuacgaagugguuauaaagccuccgccccgcgcgccgcgggcaacugcgcaggcgccggccucagacaccucacaacccgcgcggccccgcgagaggagcugggcggggccuggagggcggggccugcaggcugcggcgaagccccgccuucugcggucaggugguccggcgcagccauauuuugcacaggcuccacccuccguuccuuguccaggagucaggggucuucuuuucaaugaggaugccuucauuucgucuguaaaaagaagacgagcguugaucugguagugauucccgccgauccaccgcccaacauuucuguugaugcuagccauuaagugguaaggaauauagucacucauu

SEQ ID NO: 2140 - RNA, 1357 nt, Mus musculus
aguaguuccaagugaccuuuaauguggggaaugaaauugcaaagguagauucuguuggggauuaaagaacucaacuuguuucuuagcccaucuuguucaguagcacaaaucauuuaucacagcauuuuuuagcuuuaaaccuugugcauucguugcaggcaaagcauggaccuuagaagggagaaagaccacuggaaauuacucauuccauuuuuucucccuuaacagccuuaugguggucuacuuuauuuuuuuauuuauuuauuuauuuauuuauuuauuuuuauuacauauuuuccucaauuacauuuccaacgcuaucccaaaagucccccauacccucccccccacuuccuuacccacucauucccauuuuuuuuuuggcccuggcauuccccuguacuggggcauauacaguuugcguguccaaugggccucucuuuccagugauggcagacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauaguuguuaguuuuuuagacaggagaaauaccagcaacaaucuuuuugaaaguuagaugggaggccuuggggaacacugggagaauuaguauauagcuuguuccucaggcagguaagaggcuaugggaucagguagcagugaugaccuugauuacaguguagccuucgaggaggggagucaaccuccugcuggaggugaaggagggguuuguguagauugaggaaguaguagguagggccacaggaucuauguaaaucccccuuccaccacacaauagaccucaauuccccccuaucagugggauuuuuccagaacacuuucagcuagcguuuucuuaaaucgggcuuaagaaauaaugugaauauguaucugccucuccaaaugauccugggugucaucccgaggagagcucuggauucuccccauagccuuacucuggcucugagguccgcaaucggagcuugcugaauuagccugcagcagaacaccaaggagcugcuacgcggcuggcuucacaaaggggggcggaacuuaacuccagguucuaagaacacaacgucccaacccggccucuccuuuccucgccucgccuucuaauuggcggucuaacgagccugccgaaauuggcccggagaggccacuguagucagggacuaccgggaaagcuagcggcugguuggugggacccgaggacaaucuuacacaccauuggaucgagaguucagaggcgggacaaaucgcauuug

SEQ ID NO: 2141 - RNA, 2407 nt, Mus musculus
ugaaacaucacuaaagggacgacauuuauuccuuuuccaaauguuacaguaaauccggguggaagaaugguuuuagcaguuagaaaaaaaaaaaguacaaaucugggguuuggccauuaaaaguuauuuacaacaaugggagggggaaaaaaaaagacaacaagaaguuguuucacauuacagaccucccucccuccugaagccuaacacuugcuuaucaagucagagacaugguugauuucacaagcuggagguuugaacuugaguaagacauuuauaaaaacccagauggggcaauguccuccccagcccaggugccacuaggcacagcacaagagacuaagaauucaacaggggaaaggcuggacacucaggguuugggaguauaagcccccacuucuggcucaggggguugagaagcaggauaaacaaaacgaacuuggaaaagaauuggaaacccagcaauugccuucugcagggauggggcucgggaaagagguagggacagggcaucucacaucacuaaccuaacuugggaaaccguaagggaccaucuucaacuggccuuaagaguaagaccaaauggcugaugggagaauccacaggagggcgaaaagggagcguggcugggagggggcaacaagccccuuccuuucugggcacaggaaggcagccagggcacaagguccaggcagugaccucacaaggacagcacaguuuuugcagcuuagagaucacccaccuguccccaccccuacucauucugcucagcacuggcagguguggggccacucucugggcccgagggaguggauggcucugcagccuggggcccugccuccucuucugugucuccuuccuuggaggcagcacuagccucugcccccuuggccuggggcucuuggcucucagggguggcagcggccuucccuucuugggcagugcccucgucgcugcaggcgcucaucucgcccugcuccugcucuuccucuguuggcgaggaggcugaggaaucacccccacccuccuuccgauuucucuugaaggacaggccacucaauuugaaaggcuucuugaaagagaauuucuucuucuucuugggggucuccuugggggcgaccucccccuuggccucagcuuccuggcuagggggcgcuggcucgauggcaucaccaguagccccagcugccucaucuguuccguucacggguggugacuccccuucacccuuggggguuaagucuccauugcuucucacguggccauucuccugcggggcagaggggacagcagugagggcccgggcccuucuuccccucccccagcccgcuucuggccccucgcaggccaccgccgacauccaaaggcaaccaagucuggcuuuggccucacucccauccaacaucacccucaccccucacaggcgcgcagggacgagcgcagccagcaggaggcgcugggguucgggcccccaccccccucccgcggggcgcgcucucuauuuuccgcgcggaaccucaccgggccuggauccuucgccggcgggccagccuugcccagcacuacugggcgggaagcagcccuggggcgcugccuccccgcaccuggacggccuauuuucccaggcuugcgcuuugugugaucagcccccacccaccccagagucuccccgcaucucugcuccccaccgcuucaaaagccaccgcgggcugccgggaucggggcuccagauggggcgcccugggcgccgaguaccauccccacggcccuagacgcccccuuggugcggccuagcagcgccuuuguucccgcgcggccuucggggcggccugggggcagcgcccgcgggccgggcgcgaacaaagaaggcgacgagcccggccggcgcccccucccgccccuccccucguucgcccgcgggggcugcggcgccgagaacaaagggaccgggcgggggagggggcgccgcgugucccgggccggacaaagcgcgcggccccggcccugggccccagagggggcgaggccggcgggcugggggccgggauccgccgcuccgagcgcacucaccuguccguuggccuucgcgggggaagcgcccgcugccuccucggcggucacgucgccccggggagccuuagagcucuggcugcccaugaugggggucugcugggggcgcccggagccgccccgcgcuggcgccgcaggggauaguucggcugggacggcccggcgggcagagggguggggcugcguccgagggggagggguacggggggcaaagcgcacugcacccccgcuccgcagccgacccgcuagcugcgcccacugcugcugcgcuccgcgccagaaugccgcccgccgcccgccgagccgccuauauguacgcgcccgaggcucggggcgg

SEQ ID NO: 2142 - RNA, 6009 nt, Mus musculus
auuacagugcuuuggcuggcugaaggugggauuuggggacagaaguuacaucagaaugucagauggaagaaaaacaagcuggcccugggcaaaaugcucaacugucagccccgcaaguagacagcugugugccggacaccaccuagcugcagcaaacaucuggccagcagcagcuuucaauaaaucuacagcaaacaaagcuuagcaaauguuuuauuuguguugaguaugcagugucucuggcaggaucacaugaggagguagccuccacagaaccugccugugggccugugacugaggaggccacaccuacugugagcccaggaggcauggcuucuccagaacagguugcugagggcuggggacagagguggcugggagugguugucccccaguuuguaucuggagcucccagcucuuaagauggaggagcaugggcggagguuggggcuacagcuucaggcccaggcugguguugcgcagacaaggccucuucugcugucucugcugcccucugguggauguguggagacauacagagcuaugugugugcccaauuugcauggacugccagagguccccaaccaggaaaggcgacuacuggauauuugaacgccucacaagggaaacaggaagccaggcuuucagauuuagaucugcuuagccaccaggaagacgagccuuggagcccagacuuuagcucagaucucugcccaucuuaaggcucccugguguccaugugaugggcuuaccugauccacaggcuccucugugcguguguucucauccucauucacuuccugagccccagccgucuccuuccucggguauggagccccauacacucccguaacuccuaauaaagaggcagcauuggccgaugcccaggcuguagggcccucaggcuccugugccuucaccugcuacaccaguugguuccccgcagcuguguccacauucgccaacgccucggagggugacugccugugugacgguggaaggagggaacugacuccacagaguuguccucugaccucuacauggccauggccugcaugugcccaugugcguguguacacacaacagugaauacagacggaaauagaagcaagggacaugcagguagagggguggcacauagcucugcugacucauucugcugcagacaucucccagcagcagcaaggcccauccucucacgucagagggggacuaaugugagagcuuuccuaguuuguguaagcacaggugcugaugcaaagggccagccccagggcccccucaccugauggagaugagagagcagggagcuugcuccagggcugcuggggccuggcauagaaaguggauggcccaguuuccccuggcuccuuuggaaaaggcugggcugcugaggccuuguagcccuggaccuauagaugggacacuggguuagagcuucguauguuuucaucuuucucacuucccagucuacgcuucggugugccuugcugccugugcaagcuugggagaggccgugugccuucuucauagccugcagccugccugccuucauuccuaccaggcugucuauccagaaauaguugaauugacgcuggcauucagagaugcccagugaaaccaggcugcuuucuacucuugggccacauaugcacuggcucaucuggaggaacagaggccuggaacagggccgugaguggaagguugggcccugcucugcccaguagccaguuccaacacccagccucgugaggaggccuuuuugccuaggcuugagaacuugaguucccaccccaaggaaggggggagggauggaauccuggcuuuucaggcuugcugagcaggugcaugggguguggugugcggguguuccgguugacaccuacccucuuccugugggcuuuguacuucaggccuggaggacaccugcagugaaggggagguuagaggugggucagagggcacucacuuccugugauccuccaccucagacaaaccuaccagcagccccuggacagagaggggcugggcaccagcagcuccauauagggcagggccuugaauucuucuucuccaacagccacguaguaauggccguucaccagagcagucccuguggacaguggaagccccucgagggugcagagucugugaggagagguaacaagaaagagcuggugggugaaaggcaacuuccuacccaguaggcacugugcuccagcagaggaccugagucugguccuccaggcaacagucaacauaggcucugcccugacuagaagggcuggguuaggaaacgcagcuguccugggucaugggacuugacauggacauagcuguccucaggggcauaggaggaaggccugcuggacagcacacacccuccccaggagcagacacacacaguggcguuccuuagggugcauucucccuuguuccauacucguguacagcccccccucaccccccaccccgugcucacuguguacagcccccccugcucacuguguacagccccccccccauguucacuuguguacagccccaccguguaacauugccccuuguccuauacucacuuguguacagccccacucuguaacguaaccuucucacugagcagcuucaacaccgugucccaguccuggauggcagucugggacagcuuuagacuaaaggggggacuuagcagguccccguuccugaacacacugagacagagaacagccaaguaaggggaaggauccccgagacuccugugugaaaggggugcaagaaccaaaugguccaagaaccauucucauguuggguuuuuaaucuuucuauuggaauuggagcuccugaaaaaagagccuacuccuacuuucuuggccucagggaggcacaagucuacaccccccaucaccccccugcucucugagguuggcacucacuggauguagcagggggcgucugcuggcaaccacuguccaaagaccccaucacaugggcgcugagacacaggaggcuccugaaaccaagucagcucuucaagucagaaguucaggacuuugguugagacugggugguucuaaacaugggcugagcaggcaggacccaaacuugugcaggagaguagugagcagggaugagucuggucacaccuuucugacaggagcaucugugcuuccugggucacauaacuccugucuucugcccuugugucuuaccauuuacuuauuccuuuggggaccauggccuggagauuacguaaaagacugggacugagccagggauaguguccucaagucccacaacccaggacagcagcagguucuagagugagugugaugugcccccugaaaucacaacucuugcugcuuccagaacccuguucaaaauucgagcagucccagggaugggacgagagaggcuacagacaguggccccccagacuuacauguuguugccuagucuuuccaccuggguguuucauuccaggaggcaaauagcugaaaggacagauagguccuaggucaccuuaagaaaguguaaaccuuugccauccagguuuauacccaucaaagccaagacucuaucaucaucauggcugcucugcggagucuauucugcaggcugaccuuucccuugacaacuuugcaauggguaugguggcauaugccuuuaauucuagcacuccuuugacuaggcauugguggcacacaccuuuaaccucagaucugggaggcagaggcagguggaucuuuguguucaagggcagccuggucuauggagugagaauuaggacagccaagguuauauagauaagaaccugucucaaaacaaaaacaguccuagcacuccagaggcaguggcagggggaucucugagcuugagagccgccugaucuaccuagugagauccaggcuagccagaguuagaaagugagacugagaugggaggguggaauuuccccagguuagccucuacucugaguguaguggaagaugaucuucaacuucggacccuccuaccucuguguaccaugugcgaggauuaugggccuacaguaguuauuagccugccuccagauucuuucauuugaccuccugcccacccgccacagcaaacagucaucucuucauacuucuuccugguacagcuaaacaucugacucucccuuaggcugggacuguccucugcagggugaggcaaucuuccaguagcuucccagcauccuaagcaucccuccucacuggagcacuuucuuuuuuuuuaaagaaagaauuauuauuauacauaaguacacuguagcugucuuuagaugugccagaagagggcaucagaucucauuacagauccaccaugugguugcugggauuugaacucaggaccuucagaaaaacaaacggugcucuuaaucacugagccaucucaccagcccgagcacucucuuuuugaaccaggaauguagauaucugagccugacuuagggucucugaguaccgaguaaggcuguaaauucagguggacuuuagguacaccacgguuggaggccaaaggcaagcaugaaguaucuuacuuuaguccagaaauuccccagucaugcaugaggugacuuuuuuuuuuuuguauaauagucaaagaagcgacuuuuucaagauuacacaggaagugacugaguccagacaccuuguuccuucccuauaguaaacuccuccacugagcucucagagcagacguggaggcucaggcugaguuggaagcucugaucucacuguucuccugcuaaggaagacagucucaucuugcacagucucaucuugcagagaugacccuaaucuaacaggaguuucagaugcuaagugguaggcacauuuagugucuggugaugguggggauugcagcagcagcucagggcugcagacacaaagcuauuuuguugccaagccugaccaccuuagggccuacauggaggaagaaaagaacugacucuggcaagguguccugaccugugcacaaaccauaaugaauauuaguacgcauacacacacacacacgugcgcgugcgcgaggcuggagagagcuaagcaguuaagaguacuuacugcuugcuuuuccagaggaugaguugauucagcacucggaaagcagaggcagggaguugcaggccagcuuggucuacagaggaaguuccaagccaaccaaggcuauacaaugagacccugccuuaaaacagauuuuggggggagggguuuaugagagaguuucucuguguagcccuagcugucuuggaaugcacucuauagaucaggauagccuccaaaucaaagauccaacuacuucugccuccugaaugcuaagauaaaagguaugugccaccuacugccuagcuuaaaaaaauguaauuacuaaacaaaaaacacccuucagaaagauguccaacuugcagaauuguccccacagguuuguccuggcugugauggacauacaccuuaguaacagaacuuaaucugaguuccagcucaauuuauuugucuacauagccucuggcuaguuucucagugugauucugcacucugguagugcagucucuccccaggcuuuggaaaaacuaagccugcugacuugaaguacuagauacacuauuauucccaccacucucuacaggcacuuuagccagccccaacccacucacuggaucuuguggaaucguucaaagccagcagccacauacuguccuccguucuguaggucagccaaguugguaacaggguggccaucacuaaguguguagaggacacguacagccagcggggcuugcacagcugaugucaccucauaaagcaaagccuccauggugggguagcggcguugggucaccaccagcugguggccugggaagaaggcauccccauuucgauacaccaauauccucuuggcugccauuguauauccucacucacagacacagagcuguugccaaggaacuaagagugggcugggaguugugccaaagguagaguccug

SEQ ID NO: 2143 - RNA, 46722 nt, Mus musculus
uggcugagauacagguaaggcaacaggacuauuuaauguaaaauucaucaauagcaagucccuggcugcugccaauuccaacgcaaacugggaacgggaaaggguacaaaaaaaaaagcugucagcacaacuucaaacaaguauggguggcaaaggaaagcagucauggggacagaggcagcccuccuacccgaggcuggucaagggcagucagaugccuggugguccacacaugcuacuaagguggaggggggcuggagcaguucucugcaggcugcagccccucuguggacaccugggcaguuccacuggccucuggguuagcgcucuggaggacuaacaugauggggacuaggaagcguuaaauaaccaucuuuacagaaacauucuuacagaaagugccuaagcuccgaccaugguccaaaaaagccucauggaaaacaacgacaaaaaguggggcugacauggcauacacgaaguucuccccuggacaaggaccuaaauauuguuuguauagccaagggcccuggacuccaagccauacccacugugguccucuagagaaaaagcuaacaaucuaagaaaccaacauagcucuugguccuaaaaugaggucaugugcaggggacuugcccaagugaggaaggcgcuggcccucucacagacaggcagccucccugaagcuggcccagucuccugggcugacuuuggaaagcagagcagcuguagugacuguagauauggucagaggggagaagguagaagggagagauuacuaucugcauugcccugggugccuacaaguggauggagggaaagccaagguucucuggccugccacacugagacccagcagcugucacccugcacaagcuuuaagagguagcugaagugaggcaagccaauguaguggaccacacaagguccuucugucuucaaggaggcaggaagaugccucacccuuacaucucuguggccuaaggagccccauggguuaacaggucagaucucagccuggagugugggcugaggccucacuggaaccggaagaauacuaugauuuccaagauauaagaccuugggagaaauuccacaggacaacagauuccagcuggagauggcaaagccucaacacacagcugcugggcacccugagugaauaaauauaccaggguagcaaguauuugaaaugguagagccugugacaugggaaaggggucauuaauuuguaauuucuggauuuaaacacaugaucaucagcacgagauguuuucuuccagcuguuuacuuuuugguuuccugacaagggguccugcuuccuagcucugcugagcucugggauuacaggaauauaucacacacccagcucaauguuuaauuugagugugugggggcuuagaggcuaguuaugaaagauaaacuugcaauaguugaaauacaagaagcaaaauuccauccagucucaguguauggaagagaagccucagcuucccagacggucacuccagaaaagcuguuguggaaacugacucaacaccuuggcaggugugcagucacgagagcuucagcagagccccgagaccacaguaacacugaggaggguggggagggacggugaagacaacuccucacagcuauuuugguuccugggaugucuguucuugaccuaccagccagcuuaggcaggaagaagugaaaucccaaggacucacuuuuuggccaagaggguucgaaggaaauggcacaagagcaguccucaaaaaccacaccucugagauggaggugaggggcaggagccaagaaacgaccaugcgccaaggggcacgugggccugcgguccagcaaaggcugcauggagaagugaugggaaccagugguugccuccuaggcugaagcccauaggcaagcuuguggcaaagccauuagaagccucuucccuucucugaaauaucucaucuucccaagcaggauaccuuggcacccacauggcaaaggacccugacagggugguuccaagugggguacuggaggccaggcaccugaggaccacugcuagaguaucccuguuccuuccuuugaaguucuuuaauacaaacucuuaugcaaaacaagcaaacaaaaacccucccaaaagaauccuuugggugacauuugucaauuauuugugcaggcuagaggcaccugugaaugauaaggcuacugagaacugagaagcgacacuggccuggaccuggcacuaucggaggagaagugggccugagggauucccucccacacaggcacaccuccacuucugccccacaaagacucugccagggacaccauucccagguuaagagaagcaauggaaccuccagggcagcgagggagggacgagagcccaaaucgcccaaguucugcucacaaaaaggaggaguccaggccugggugcuuucacuugucaugagcucugaaaaggccaagaggggucugagccuuagagcuggguaggaaaauauuggagucaucugaccugccagcuuacugugacggcagcuucagaugacaucuucuaugacucuuccguuuucagagucuccaacuucaucugcacacuguccgaggugaaagcccacagugcaccuacagguguugacuauagaaccgcaugagggucugcacgccugcccauccauguaagacuaacccacaaaauucacaauugccaaguguccgacggccucagcccugggcugcuccguguggaagccuugcauggacgaggccugacugggcugcugcuccugucccagcaugcccaagcaccgugaucucuaggcaguggcaggggugggcucuccaggcccugucuggccugcuguuccugugcucggggcucccgagcagcaaggagcgucuguggcccuuggagagcuggcugguugagccccaggacuuucaaccccuuguuccuuggaggcagugguggccucuggccuccgcucagagccaaugucagugaugcccccugcagucagguccuguacccucuuguugaggucauugcgcucggucugcagugcucggcacagcuucuccagccgcuggauuuucaccugcaggcccuccagcucuuugucccggacgguuuucuagguagagaaaugaagcauucagugagacguucacauccucaagucugggcagcuuaaacccaaaagcuggcccauguaguaaacagccccagccgagggccagaggauguauucuacuugucugccagauacccugacacaccacaggcaucuuuaaacugucgauuguuaaacaggaccacggaccacucucagaucucaaaaaaaugugcagacauaaaaaagguccccaaaagggcucacuuggauaagugcuccuggaaacgcagccccaguucccguguagugucagugacugagugacagcaggggaaaaggcccacagaccaguccgcggcccuccacccaccucuucagccaucuccagcagagccuuguugcugcuuucccaccgggaucgauacauggugguuucuuucuccagcuucuugaucuucuuugucaucuguuacaccacagaugaaaagaaagggucagagaugggcuaucugcacgucucugccaacugggagccucaaguuaagcugaccacugaggggcugacaagacugcuuaggaaauaaggagguacuugcugccgaggcuaacgaugagcuccaugccccaaacccacagauucaacuccuguaaaugguacuuggauaauugccauaugcauagcccauacacauacauaucuauucacaauauuguuuaaaaauaugcugggugccuuuaucccagcacucucgagguagaggcaggguggguauuuaugaguucaagaccagccuggucuacacugagaguuccugggaaaccaggauuacauagagagacuacaucucuaaagaaauaaaauaaaauuaaaaaaaaaaaaaaagcuaccauugaagccuaguagaaugcauauucucuauuuaaaauuccagcauaaauaaagaaaucaaaccaaacaauaauagaaaaacaaacagaaacuguccccucuggcaggagagggagcuauggccccuucuaacuaccucuugauauauagagugccugugaggcugccagggcagcucaggucugaaggaagcggccagaacgcccaccguccuggccaggcugagggccucccuguguuaccuuuuccaucuccuguuugaacguggugaacacuucacugcuuuuggaaaguguguucuggaacuccucaaacuucuccguguacagggcgagcugcguaagaagcacaggagcacgaugaggaggaacgcggacagagccacucuacugagacaccaucuccuaauaccacacaagcaaagucgugcacagcaaggauguguuccaacacgacaauccugcaaagucagccuugggaagacgucagcauguggagacacuggucucauacaaaaacaaaacaaaacaaaacaaaacaaaacgaagcauacacugauagggcugaagggacggccagagguuaagaucacuggcugaucuuccagaggaccuggguucaauucccagcaccuacauggagaccacaacugucuggaacuauucuaaccucuaaagguaccaggaacacaaguggggaaaaauauacauccaugcaaaacacucauaugcauaucaauacagcaaaauaaaaguagacagaauugagcuagaccugguagcuaacgccucaugcaucugggagucagaggacugucacaaguucaaggccaccagagagccuggucuacaagguaaguucuggguuaguuguagccacagcuaaacucagagaccuguucuucaaagaacaacaaaaaugccuggcaugauggcacaugccuacauuuaaucccauuacuuaggaggcuaagacaggcaaaucucuguguuccaggccagccugguguacaaagcaaguuucaggacagccagggcuacacagagaaacuuugucuuuggggaaacaaaacacacauaaauaaaagacuuggccgacaccaacaggccagcuggcacaaagccaggcuaugacaguccugucuccacugcccugcagaugggcccuugugaaagcauccuggaaacugcaggucagguucccgucucaccugcugcuuuaggugggucuccugcugcuucaucagcucgcacauccucugggacuccaccgcuuccuucaggagcuauuuccaagacaggaccccagaaccugucagaagccccugaggguaugucugaccuucuuuagccacaagcacuggacccacugaggcuaccugcucucagacugcugucuggacaggcaauuacuggauugggcaggcaaaaucucucccauccauaagaaauagauugaacuaagccagaacccagcccacuuccuuccagccccaccacagcccuggggccugagccucacaaacuccuucucucgcuggugccgcuccucugccuccuucagcaucuccugggccugcuggagcuuggcguccacuagcugcugcugcagguccuuauguuugaagacuuugucgauaugcugcagaaaagguaauuuauggagucaggaguucccuuucaagaaagccccaacucuaggaaacaaggcacuucauccggucuccugccgacccauguccuugggaauggcauggucugauguacaggucugaugcggagcugggacgaggacacgccuccacucuagcacugaauacucuacagauguccgguucagacaccagggauaagcacugguguguguguguguguaaucucuucuuuccauuuauuucagcuccuuaucuacaggauacaucucuugaaggaagagcaagcccaggccugcaguugcggccccaggcccuggcacucacuacagacucccaagcugcuggccucaaucgccugcagcucaccuccucacgaagcucguauugcucgaucaacuucuugagccucucggcuagcuccauauucuccuggcgcagcuuggaguuucgcucguuaugcuguuccaucugcagcugaaugucauucagugucaccuggaagugugaagucacuucuuugcgcuucuccuccuccucacgggcucgcugcacgccuucuuccugaagaaaagaauuguccauaguugccagccuugcacaaagcuccccuaacuaguuccaaaguccagucuuugccaacagcgauuugggcccuggggagcaccaaggauguaggacgucauacaaugggguuuccuaacaugccucucuguaaaucagguguuaucaagcgacucucccaagaauacucaggguccaugcuaagugccauucugcaacagcuggacagccugaauucuuguucccagacucuagauuaaguauuucugcuuguuucaauuuguguccauuuuaauguccuuuagucccuccuguuccccacagagaacaauauaacaaaauguagucauauucaggacuagcagaguuguaagaaaugaggcaccuaaacauucccacuuuuaugaagacagccuagacgauucuaucaauuagccacuuagugcugugcccacugacccagccauuucacuucugaaauuuagucuguagauaaaauuccucagcacacaauugguaaaggacauggacacacauacucuuaccuaguuuugguuuuuaaguuuuuuuuguuuuguuuuuuuguuuuuuaaagauuauagcugggcgugguggcgcaugccuuuaaucccagcacucgggaggcagaggcaggcggauuucugaguucgaggccagccuggucuacagagugaguuccaggacagccagggcuacacagagaaacccugccucgaaaaaccaaaauaaauaaacagauaaauagauauagauaaauaaauaaauaguacugcacaugugugcaccuagaggccagaggucaagugccaucaccaagcuuucuuuaccuuaguauguauauauguauguauuuauuuugguuuuucgaggcaggguuucucuguguagcccuggcuguccuggaauucacgagaaguuuguacuuuuuaaagagagucauggaccuccugccacuggaguuagacaguugugagcugccaugugagaggugggcacugaagcggcuucucuagaaaagcggcccaugcccuaaccacuggguuaucugucugccugucacccacuggguuaucuaucugcccacccacuucuuguugguuuuguuuuaagcuuuuuuauuuauuuaguuuuuauuuuuguuuuuguuuuuuucgagacaggguuucucuguguaguccuggcuguccuggaacucacucuguagaccaggcuggccucgaacucagaaaucugccugccucugccucccaagugcugggacuaaaggcgugcgccaccacgccuggcuuaagcuuuuaaaaauuucuguauauuuaugugucucugugaauguaugucacauguaugcagguguccagaagucagauuagaguaucagaucuccucaaauggcuugcggacagccgaaugugggugcaggaacaguaaucggguccucuggaagacuacuagguuacuacucagccaucucuuaguccuccauacuucaccgagguacacuacuuaggccagcucugccgccgggcuccaggccuuaugcuggcagugggaagcacgcucuugguugauccaucuccccaccuugcauccugaggucccauaaagguuuacuuggcaggggacucuggagccuacuguggugcccaaggucugcugaaacggcuuaggacugggaagugugcucuugagcagcucugcugucccacacccuccugccacacccugcuccugccccucucagcgcagaucugaaaagccaucagguuccccuuaucauggaugagagcuuuuacacugggugucaggacaaacaaucucugugguuuuaggaagcugaguguuugcagagggagcugacuccggcugacgcaucuggugcuuccugcacgccaggcaagguaggcacagcuguucuuugguggaccugggacugagcuaagccuaagcugcugcugcuguuacuucuucuucuauaguaaaucuuccuaugaaauccaagcuggcccagaacucacuguauagcauagccgcaguugcccacaagucccaauggauacugaugggccuaccuucagggaccgguugugccguugcagcucccggcacagacucucaagcuugcuucgggccaggacagccuugcuguguuccccucgcagaugguccuucuccugcacgagcuggcucugcuucuucugcaggagcuucaucugcuucugcgaguuccgaugcucuuccagcugagaacaggaggcauaagugucugcagggcaccguuacacagcucuagagauuccuaagcuaaccacuauucaccccuuccacuccaggcacaacagcuccaacaagagccugcucacacaccaaaagcacgggaacuucucaugcuccucccagaaacugugcaggcuaaccaaggguuucuuggggaaauaauaaugaauaaugaccaagaccaaugaaguccgccaucagaucccagccucuaucccaguugacuccacuggaugagcccaugguccacucuguugggauacccacauccuaucagacaacuaaucuacaugcuaccaauucagagccugucugcaccacacuccuuucucaagacacugcuuuuuccaacaacugcuacucuuuuauuuggggggugggggggagguguugaagaugagguuuuuuuguguagcccucgauauccucgaacucacagaaauccacuguugugccucuccuccugagagcugggauuaaaggugugucaccacugccuggcuacaacuacuacuuuuuuuuaaaaguuuuuucaagacaggguuucucuguguagcccuggcugcccuggaacucagaaaucugccugccucugccucccgagugcugggauuaaaggcgugcgccaccacugcccgguauauuuuacauuuuaaucuuaggccuuuaaaggcugaugcaguucucauagcuuagcagauccaaaucagacuagccaucuaucagcuggggugaggcugcuguccugaguagcacuggccuaucacuccacgccaggaccgucaccacuucuuuaaauccccaucaguauuuaugguuccuccauuucucauccuaauagacuugcaacuacugggcuucauucuuuucuccuaacugacucaccuucuacccuggcuuauucuuuaaucccaguaaagccccuuucccuuaugcugcacaaguaccgaagcaacccugcuuaaagaagucuuccuuagccgggcagugguggcgcacaccuuuaaucccagcacuugggaggcagaggcagguggauuucugaguucaaggccagccuggucuacagagugaguuccaggacagccaggacugcacagagaaacccugucuugaaaaaccaaaaaaaaaaaaaaaaagaagucuuccuuauaccaauccuuggaaggcucccuucugcccagaaaggccaccaccacuuucuccaaugauauacaccccuuuccgagacaacugcuuaucuccucuuuauaucuucccaccccagauauugucaucauucuuguuucccuggaaacucagaggaaaccaggggacuagcagcacacgccccccaucucugacuguacuugucuucuucacuuacagacagguacagacugcuggagccucccuccuugugcguuaggccuuagcccccuccuauauuaagaauguuaccccaggagcucaauuccuccuccuuuguagcaucaguauucuccuaguuaaagccuuccaaaauggacuuuguuuuucuuucuggaacucacugucaauucacucuguagaccaggcuggccuucaacucaaaagauccaccugcguaugccucccaagugcugggaucaaagguguauaccacucuacuaggcucuguauuucuuuuaauuuuacuuaauguuucuuuguguuuugccugcaucuaugucuacacuauacuugugggccugguacuugcagagucuagaagaggacuucagagugcccggaacuauaguuaaagaugguugugagcuaccaugugggugcuuagaaucaaucccagguccucuggaagagcagucacuguuuuuaaacacugagccaccugaccagccccuccuuuacuccucucuaucucucuacccucaauccacucuacacuuuuacaauaagaaagguggcaagaccauacuuggcauucuuucuuugguggugguggugguggugguggugguggugggguuucauuuucaagacaagacccuguagucugggcuggccuugaauuccugauccuccaggaauuaacuaacggacacaccaccaugccuugguauuucccaugauccaacauggaggucauuaccuugucucaagaacugaaucaagcuccuagagcuaacuuucacuucacucaggacugagagcuaaggagguaaaagaacaagagccaccccaaagacggccaaucaggaggcagagcauccuggggagaugcauguacagacacaucaagauauaacuacacaauaucugggaccaacgccagaauucuaccaccugaaaucauugggaaauuuacuaauaaaguuucucuucuuacugacuggaaacuaauuucucauuuaacagauagcagugggagaauuaaaagaaaaaguuaacagaaauuaagccaauauguguuccugcacccuagcuccuaccccagguagccugaugacuuuccaaagggagggaggguaugaaaggaggaaagggcauggacugaccagcucagcauacuucuugcacagugcagccagcuucuccucugggguacucagcguguucagugucugcaucagcagagugaucuccuucccugaaaagcacaggggguaaagcacacacccuucccgaggguucccucuaggcccaagccuacacuucggagugcuaaggcaguuuuccugugacacuaugguacuucauaaagaacuguggcucaauccugcagcuucaaugcacauucccacugcaaccuaagugguaucugcaguguuacuacuaacaaauguucauuaaaugaacagagcagucucuuugguaagcacugccagggagaggagaaccugucugaagacauuacaaacaggagaaagguaagccuacugauaaacccagggcuacugucugaugucccuugagaaauuagccaaacuccugucaugagacauagcuacacaguuauguuuaaagauuuauucagccgggcaaugguggugcacgccuuuaaucccagcacuugggagacagaggcaggcagauuucugaguucaaggccagcauagucuacagagagaguuccaggaaagccauggcuacacagagauacccugucuugaaaaaccaaaaauaggggcuggugagauggcucaguguguaagaguacccgacugcucuuccaaagguccggaguucaaaucccagcaaccacauggguggcucacaaccaucuguaacgagaucugacgcccucuucuggugugucugaagacagcuacaguguacuuacauauaauaaauaaauaaaucaaaaaaauuuaaaaaaaaaaaaagaaaaaccaaaaauaaaaaagauuuauuuuaugugaguacacugucacuuuuuccagacacaccagaagagggcaucagaucccauuacagaugguugugagccaccaugugguugcugggaauugaacucaggaccucuggaaaagcaagcagccagugcucuuaaccagcgccaucuuuccaaucccacccacaguuaugcuuaagaugcaucucuuucauaugugacccugugacuuggggaaaaaaaaagggcaagaaaucugucuuuaagacagaugacaaaaugaggaaggaggaccagugacgugguuacaguacuagagagagaugagagagagggucuugcuauguaguccaaguugccuuugaacucagucuuccugccucuguuccuccuagucgcccauuagaggcauacacuaccacauagguucccauuagauucuaaauucauauuuucauauuaucccaccaccccugucaaaggacugccauugcucucuguuuuuauucauuugagauaagguuucauuaugcagcuggcugguccggcacucaagagaucuacuugccccugcuucucaagugcugugauuaaagguggaugccaucacgccugauugccucuaccucagccaggaagcuuuacaauugucucccuuggguuccacuguauucagucagcacagaccagguuccugaauugucaguccuggaggcccacgagauuggcauggagauggcaaaccccaccaguggauggcuuugcuugguuucuauuauuuugguugccaauuauucagcuggucagaugagagugggggacuaaccagguaggagucaauuuuucagaucaagaaggcccuuucuugaugauucugaagaggucuguggcuuaccugguucauguugauauuugauaucucaaccuugguguagccuaauucuauugcuauagaaacagggaaacuaagacccaggaguggagaauaaacauguccaaagucaagcagcagcuaaaaguggugcuggcaagcacucgggccuccuguucuccauauccucagugagaugcuagcuacacucugccuccacuucccaaggccaggaggcuuugcacaagugagugaucuaacagcucaaugcuaggaccccaucuuugaguaaacccgggcgggggggaggggagauaacacacauacugucuugaaaagcagauucuuuugaguucugacagagcagguuagcccaugagaugacagguguuaacucccuccccucaccaauagcuccccccucaccuagacccuuggcuuucuucuucuccuguggccuccgauggucucggucuccaacuucaucacucgcucggaucuccucuguuccaggcucucccuuagaggucuccuucucgccguugacgacuggaaugccugguucaggcuccccauuccuggcugcauagguucgggacuucuccgugucuuccggcucagugggcucacccugugcucccuccucagccgggccucccugauuguuguccacacaguauguacucaggaugucuuccaacugccggcucagcuccucagagacgucacagagggccccaggcugagcugcuuuagcucgagccccuacagcaggaaagaugaagacacgggauuaaaguucaguggucauaccacucgcuuggaucuucuuuaagcccagauaaacacacugguguggguuaaauguuguuuuauuuauuuauucgguugaguuaggcucucucuacagggcccuggcugucuuggaacuuaguaugcaggcugaucacaaacuccgagaucugucugccucugccuccugaguucuguggacaauggugagggacacuaggccuggccucaauuuaaguuuuuuuaaacccuaaguuuguuuaguuauaaaacaaguauuucuaacacccaaacauacuuguuauaaaagccaacuguguaaagcaccccugugugaggagcaguuggcauguggcagacgcugcaccucaugaaggacaauuacccaccacuggcaaguguucucugggaauaugacuuugcuuacggggugcuucauuugacugucuucguuuaaaccagucagagcaugcucccaagguugcgccccacggcuaagagugggaagguucaccaccuccccaggaaacaaaaggaucacacagaaugagcaucguucauucuauaguuccuucuucuuggguaaacacuggccucagaagacagaccaguaccagaaacuccucccucugcccacuggaaaagcagagcuggcacacacccucggucuucccaggagccuggcuuguggaaccuucggcuuccgccccaggagcugucugucugggucguccaugggcucccuccgguccugcuucccguugccccgggcugcccuucgaguuggaguguuuggcaggcccauucuuuuugucuugguucuucauugugaucugcaaggccagaaauggggcagauccuuuaaggacccaguugcuuuuuuuuuucuagacuucaaaauucuucuucacaacuagauaagaaauccccaaaucugacgcucgaagcuucaaacagaccggucggucuucgcccgggauuucacggucccauggaagguuuccgagaagcugccccugagugagugagggaaggaagaggccuccuuucucccgaaugccacuucucggcaccacacggcucccucucggcagccggagcgcgggauuggcucagagccgcagacugacguggcgggaugcuccagucccgaucggcuccccgccccaccaggucccacgugggacccccgcgcgcgcgcgcgcacagaagccacccacaccccacgcgcccucuagaccuagaguacgcacgcgcaacacuggggcaggccgcccuccccccgaccccccgaauuaguuguuccucuacggccaacgcguccugggccacagacccucugaagagcucgucccacguacagcccauagacauacuucaccacggacguccggcggcguccuccucuccggccgagcaccggaaaccuagguaacugcugccaacaggaccgcccucuccugccgcagccaaucaacagcaaacgcgggcgcggagcuugcugggaaaaaagaagucaaggcggcuuuggaggcgggagugggaaaaacuacgagccccuucaugccucgcggcgccgcacaacucccgagaugcaaccgaaaagcauaggagccaaauacccugaggguccgaaauuaugucauuggucgagagauuuuugucagccucuuuucugguacugaagcuaugauuggccuuaaacuuuggcauucuggucuuuuuuuuuucuuuuuuuuucauacacucauuaguccuuuauaaacauguaugacuuucuaugaucucugagaacucggaagagggauagaaagguaaacuaauuuguuaugugccuggcauuuuuuuccccucuauuacaauagaagguuuauaauaauucaaacguuuuuuccucguauccaguagcuugauucucauaauuacucggauuaaguacaaaauacucagugaucugugaaauauacgauaguacagaaaagccuaguuaaaauaaaacaaacuacuauuuguuuguuagagacaacaucucguuauauguggcuuuggcaggccuggaacucccuauguagauuaaauuggcuuugaacucaagaguuuugucugucuuugccuccccauggcuuggacuaauggcaaaggccaccagguaaaggguaaauaguuuaaggcuccaucaauauugugugguuauagcagauucaaagcuggaagccugacaccagcacccauccuuuaaaaauauuucuuugcccccugagucaggguuucuuuguguagccuaguguguccuagaacguaaucuuugacuaugcuggcuucuaacucagagcugccuaccaaaaccgguuggaaccauucuccgacaccacagcuguucucugaggcaauuuaugccccgccuucuaaccccaccagcuuggcaauuacucccucagaaagggauugaagccagggaguuuggcuuuaggcagguugguaaacucccacccuaccaccccugccccacuuucugcaaaguaucaaguguuacugcuuuaaaauguuagauuuuucucgucuuuguucuucauuaugauuugcagugccaguguaggcucagaacauuaaaaaaaaccccacaauugugauuucaauucuuuuguuguguggaguuuguuuuguuugauaaggucuugcuuuauagagcuggcuggcguguaacucucuauguagaucaggcuguccuagaaacucacguguugaaauuacuguuggcuaaaugcugcagccucaagaggcuagagucaggcugugggguagagcauguugcaaauugugcuaauuggacuuuguuuuaggguucuuaaaugaugucuauuuuucuguaauaggucugccaaacagacucagaguagaguucugucuguucacauguaacuuugagagacaauaaacucagugacagaguacuuacccggagugaucaaagcugaaaagagaaagcguuggcacuugaccaguuuacugagggaaccgaaucucagaaagguuugcguuaaagguaccuggaaaccacugcccugauugcuucucaguaaacacuuggaaaucucugaagagguagcaucuacaucaggucuuuaccaaauuccauacaaagaggaaagcgauucuggagcagugguucuaaaccuucccagugcugcagcccuuuaauacaguuccucguguuggggugaccuccaaccauagaauuauuucucuugcuacuuuauaauuuugcuacuguuuugaaucauacaugucuguuuucugauggucuuaggcaauacuuaugaacacccagguuacaaaaaaacagguugcaucagggcaagacuguaaucccagcacugaacagaguacagaagaguucugucucuaacaggcucacugccucuggccuccaaaugccuguacaugcauguuggcaguuaggucgcccagcuccuuuaaacuccuagauuggagcaguucugccucgacccuggcuggagaaacagacacacccuacuccagcaucucugucauucccacugcuagguacaaacucauaccuuccucccuccacccccuuuauggcagggucuauacagcucugacugucugggaacuauguagaccaggcagaccuugaacucugagagaucugccugccucugccuagugugugcugggauuaaaaccccaccaacugcuuggcagcucccaccuccuccacccccgccuugauuuaggaauauuauguagccaaagcuggucuuaaacucacuaggaggcguuuuugguuuuuuugggcagccaauaaucuugagcuccugacauucguggcucugccucccccagcaagugcugggguccuaggcaugucuuaccaugcuggccaaaacucagucucguagagccaaagcuuacuuuuugacagcagcacugauacuggcuuccacauuguguagauugugacugcauucuucuuuacgggagugguggauuucaaagucacacagcaaaaguugacgugagaaugaaugaaugccagggacugggugugauccuguacuuuaugaucgggaaaccuuaaaguuuacuacauauaaagaaaugacuaacccccaacagcugaugcagcugucauucuacagacaugcuaauggguuaaccacuuuguuuuucagauaggguuucauauagacaggcugacccugaauuucuggacccccucccucuacaagcagugucuggcuuaugugauacacaggguuggauccagggcuucaggcaugcuaaucaaguacucuaccaucuagagccuaggucucaugugcacuucccaguccagggucacuccaaaccaaagaagacaauuuagaacuuugcaacagguuuuuauuuuugcuuuguaucuauuacaguguuugaaaccuaaagaaauacauuuucucuucaaauuuggauguguauauaaauaucauuugucuggacucagcacacgcaacgccaugguuucuuggccuauuucugcucugaaaucaagcuuuguuugucuacccaggggcccugagaacaugaaaaaauagaguuuacaguucuuagaaaaauaaaagcaaaugaauuuggaaaacaaaaccugugaggauuaaauccaccuuucuaggguucuuaccuggaaaccccaagcugucccugggcgauguuccaucugcuggguagcugagaccucauacccacuucauuuauauaacaggucaaaaaaagcauuucccaaaaaagccggcuaacaaagccagcaccccugcccaacuucugagaguucguggugugagccccugacagguuuccaggcggucucagucuuccuucacaguucccugcacaugcuacacaguucuuuucucuaaacagaaaccuuaacgucagagccacaggagugcagggugagugggcaucaucagcuuugugugcuagugugagcaucagaagucaggcuggccuacaagcagguagguaagccuaagcccuugaagacacggucacaagagcacuccccucugguaauagggcgccccgguuucuggcugcuuuucucacagccagcuuugguccugcacauaguucaggcuucagacaagaugcucucucagaaggaaaacaaguuuucacucagauuuguuggcguugaccuuagcuucuucccuugcugugcauccuggggugggacuaggggauagacugggagauugagucagcuaugaaggccuuuggccaaagagcagcuaguaucuaccacauggauccuuacaggggcaaauucucaguuuguuggcuuaacaaaagaauacaaaagauaaaacaaaaaaaaaauauacuggacaaaacuggucuagaaugugccaggaagccugucucuuaccaccucucagggaagugcggcuugaagcugccacugcucagaaucuauaguucagugcaccuagccuugcacacuuccccagccugcuagggaagcuugucacuaacuauccugucuccguccuggaucugcagggaccuggagaaguuuggguuuuuuuccuuugagaaguuagaaucuaagccugaaaaauacccaagaggauggauaccaaaaugagugagccuggaagagaagagcuggggucugaauaaagagugcagaggccuccaggacguguagaacugugagcugcuagcucugcaggcagacagaaacacacuuccucugugugggaagugugucuuuguaccggcuugguuucaaagaaagaaacuccacgcagaagcaccgucuuuuccucucccucagcuaaaaucccacugcagcucuagcccacaguuagcuucagaacauaggcuacuggggaugacucccaggggcagcagaaaggggaagugguagauacaaggucccggguaaaggggacaccaaaaggucuuccaaaccaggcuaccaauaccugcuccucggaagcacuugugugcacagacccagguaacaacgguaccaagcaagcuggaacucauacaguaauaccaaaaggcuacaaccaacauccagggccaugaucacuggggagggcuggaaacugaagucagucggccaggagccgacugugagggacaccuagaguagagcagcuagauagauaaccaaccucuuccauguggcacaggaucugcucugaagccagagauaauggaaaacgggcagaggaaagcaggacauuugugucucaugcugaggaucuggcuccagggccaggguccuaacugucacuugagagguucaggggucuacucuucagauaaggacgaugauggcuucauagaggacuuuucuuugaacuaggagcaguuucagucagguuaaaaacaaaagggccagcaccuugccuucccggaaggcacucgccagcgugguccaauguugguugaacuuuucaguauuaacugccugcccugaagaggaaucuggagcaggaacucaaaacuaaaggagagacggcagacggaaaggcagaggccagcagcaagaaccucaacuucagaucugcaaauguggggcacagagagaucugcuggaacaggaggaacagugcuguucuagagagcggcuaagggugugggggaucaccacagcagggcacugugcugccaccuccacagguggucugcccagcugacacuguacccagcucccagagcuugguuuuaguguacuguguaaccccugaaaacaggucagccucugagguacugaacugucuuuauucaagaaggagggagggagagagggagggggagagagagggagggaagagaggaggaggggggagagaggugggagggggaaagagggagaaagggaaaugcaagcuagguacaaggaucuuuagaagggagaugccaacaggguucauuguggguaacagugaguuagagaaggcaggaugcuuuuugcuugggagcaaggaacagagagagcagcagacuccaucaggccuugcucccuucaggcugggaacaaucagacccagcugauuuacuucauaaagguuccagaagugagaguuggucccaagugguggcccagaauacaagcagagaaaauaaggacugaguucagcccugugagcagaaacuuguucgucuuucuggucuuccucacaguaucccacucacauccaguuuguccuccuaaaaccaauuaagacugaccuacuuaaaauacagacuauuaaaaaaacaacagaacuuuuugccauucucuccuuuggaagugaaauauacaugauccagcuauggcagaaggaagaagaaaggccaaaggcagggauucaugacuaucccgauacacgacacuaacuccaaccuccucugcaacuuaggggucaucagagcaaggacuuucuccucaggagaaggaaggaccacagccccccaucucaagcucaggagaaaacacagccaccucagagguucauucaacucugaggugaauuuucaaguaaacaaaugaaguugggucgcaccauuuaggagguggguaggaaacagggucaguagcuacacaggagaagcccugucuaaaggccugugccccucccuuccacuccacugguauacuugcuccaggagagugagggggauccucccaaacuaaagaggucuuaggcauaggguuagagggagggagggaucuuugucucaugggggccuccccauuagccucuauuuccagacgaugcugguggcuggguuacuaaauccagcuuuuugggaagaacaaccuuaauacaagaaaaaugugcaaaagaaaaaauuaaauaauccaagcauacaagauuaauaugggucagagcaagaacacuuuguuugggacuucuccccuccccucccaccucccaccucuggaauauuccaucugcucaaguacccaagaguuacacacgucagggcagaggacugggauggaugaagaaagauaauugggaaggaagucaccacuaaagaaaauaaaagaaaaaaauuuuaaaggugcaaauugauuaccucaguccuccuuugucuaccccugggcuccuggguuaaagacaugugcagccaaaauaguguaaggaagagaaacccacacguccccuucuugucucaaaacccaaugugagccucagaugguucugucuguccagagggcgcuugcucccuccagggaaggggaugaacaggucgagagcacagucucggggcagcaggugugcggggcugcuggugggguggcugcucuccugcccaccagaaggcugcuccucucucugcuggcugcuggugcuucccgugcccuccccuccccggaggcagacauuauagcuggaagcccuccaugggggccucaggcugcuggaagaugaacugcuguugcgucucauccaccugaggagccaggcugcugucgucauccucuacaccaaaguagugcucaaugaggucaaaggccuucugguagauuuccugguucucguggcucuggagaaacucaauuuuauccaagccuacgguguaagaagaaaacaggucuguaccucuccuuuccugaaguacaaguucccaaccaaaagcagugggaacauauccaccccuggcuuguguaaagugcuugcccugaaaaccugaguucacuccccaggaugcaaggccaggaaugguggccggggccuguaacccuagcagggguugugggaagaggauacagucgggacaaaccagcugggguuuguuuucugguuggcuuguuaaccuagauuacucugaggagugauagcucagacugaccucuggucugcacacacauauacaaugugauugacuagaggguugagaccaaauucuguugcaagcuaacucugagcuaaucauggugagcuaguuaacaucuaauuaacaucugagcuaaucaucugagauggguugguuaaggcaaucaggguuuuccaggagagacuguuggaaugcagcuucuagcuccugguaguagaaccaaauuuuacccuguuccuccuugcauacauuugagguagguggugucuaugagaacagcacugaccuauggcuccucagagggaggaggagauggugggacagggaaacuugauagugauaauaaccauuacuucuaucuacccagcuggucaguacgagucagcuacucccaagggaaagucugaaacccugugcuuggacuagcuuggcugcaacaggaacucaucacugguuuuagaagcagagacucaagggcuggugagaugacucagcagguuaaggugauuucugccaagucugacaaccuggguucaauccuaggaaccaacauggugaagggagagaacugacuucuucagguuguccucugaccuucaucccacaugugccauaucauguacacccacacucauacaugcauaugcacacaaaugaauggauaaauguauucccaaguuucacagaacaauugaaugugcuccaacaucuuccccauuaacagacauaggugaggucagggagaggaccuaccauaggcuuccucgaugaggccacaguagggauugaccccugagccacuacgcuugcuuucuugcucuccaagccgaagaauguucucuaguccauugagggccacuugcacaauuuuugaauccauuacagucagcaagucacacaggggcuuaaugcagcccagugauaccagguaccuggggaccagagaggacaugcgcgcuacaugaaugcagaacacauaaagugcaccaggugcuuugaccugugcgucucccucacacaccaauuuucccaacaaggcacucuuccuguugcccaccuaagccaccuucuuaacucugcacugaccuauucccuaaugaacacggaguccuauuguccccuuggcuacaacguuauuacccuacacacguuaagaaguuccucagguuccuauuuguccugaguacaacuuguacaguauggagguacagacugucugucaucuggacccuuccucuguagcucuacucagaauauuccauacugagguuauuaaauugugcucaaagaucuucagauuucugacuccuggaccuuuauauauuuuuaucuaaaaaggccuacauauaaugcuguauuuacuccuccucccuacucuggcacccuuuuaaacaugauuucucuuuguagcccuagcuugcuugggauucacuacaugguuggcugacuuuguucucagacugcagugguacacacgccaucauguucaucuuauguuuucuuucuaauguuuaagucaauagcucuuccuuucuccugagacaucaguauguacagacuuuauucccuuucguagguuauaauaaggggaaagacgcauccaacuugcgugguuccuccuaauguucagaugaugaacaccagaauaaaggggcauaaauacaaacuggaggcugagacauguugucagcccccgagaggcuaaagcaagaggaccacaaacucaaagagagcuuaguauacacagagagcccuaaucucaucaaaacaaaacacaaacaaaaauccccaagacaugccgggcgugggugcgcacgccuuuaaucccagcacuugggaggcagaggcaggcagauuucugaguucgaggccagccuggucuacagagugaguuccaggacagccagggcuauacagagaaacccugucuugaaaaaccaaaaaaaaaaaaauccccacgacuuagcuggguacagacauaaucuacacccagcauuugggaggcagagguaggcuaggucagccuaucuugacucugucucaagaaaaacagucaccaucaacaacacagcaaucuauuccagaguccaagaucacuuagcagcuuacuaauuaaaccuuaauaggguuagacuugggacgacuuuucccaucaaaagccauuuagagucacaugaaaaccacgaacacaggagagcgagcacacauucucauuuaagacgcgaggaaaggauccuaccugauuugcucaggaguuccuccugauguggcguuggugauggcccaggcugcuucuuuccuuguacggaacucugcuuucugaaggauuucaaucaauacagggaagauguuugcaucuaugacagccugaaagagaaaugaggaaggaggauggaggcaguuuaaggaggaaaagcagagggaccaggcauggugaaauaugcuugugugauuccaauacuuggaaaguggaggcugaaagaucaugaauucaaggucaucugagguuagccuggacuacaugaaacacugucucagagcaaaagaugaagaucaaaccuaguauaagaaucacaacugggcuggcgagauggcucaguggguaagagcugcucuuccaaagguccugaguucaaaucccagcaaccacaugguggcucacaaccauccauaaugaaaucugacgcccucuucuggagugucugaagacagcuacaguauacuuacauauaauaaauaaauaaaucuuaaaaaaaaaaaaaaaaagccaggcgugguggcgcacgccuuuaaucccagcacuggggaggcagagaugggcggauuucugaguucaagaccagccuggucuacaaagugaguuucaggacagccagggcuacacagagaaacccugucuugaaaaaccaaaagaaucacagcucaggcuuuuuucuguuaacugccugcagguucuuugcucucacuagagaagguguggagcacucacugucacuaugacaaacugcuuugcugguguugggcacugaauccaggcaauucaauaggcaaacauccuacuacugagcuacgcagcuugcuugcccuuugccuugccccuaguuucuaaugggaaaagaugccuuuuuuggaagcaaaucuaccuguauuugagcccuguugccagcagugauguuugaaaugguccagcaagcuuccuuccggauugauuccuuagagcugcucaguagguggaggaggcaagggagggcugaacaauuaagaaugaccuaaaacacaaaagcauaagaaauuuaucaaaauuagauauuuaguguuaacccauuuaaaauuagauaugcauaucaagacaccauaaacagugcaaagcaaaccugcagaauauuagaaaauacuugcaaaacauguauuauuaagaguuaaaauccagggcuagagagauggcucagcaguuaagggcagauugcucuuccuaagguccugaguucaauucccagcaacuacaugguggcucacagccaccuauaaugggauccaaugcccucuuuugguguuucuacaugaaauaaauaaauaaauaaauaaauaaauaaauagcccuuuaaaaaaaagguuauuauccagaguauguaaauaacuuuuuaaaaaaagaacuuaaaagagauacagcgauuauguauuagcacacauaauaggcucaagaucacuuaucaaauaaauagagaaacaaaaaucaaaccaggagacagcacuuuacacucacuagaauggcugauauaaaaacagaaaaugagaugucuuagaaagagggagaaacuggaacauggaacagagcugauagagacauaaaauaacacagaaacuaaacuuauaaauuagcauaaauuaccauguuaucuaaucuauuuugcauauacaugaccaaagaaaugaaagcagagacuuuguagcugcauaaccaggguccaaaacagcauuauucacaauagcuaagcagcagaaacauaaauguuugcaagauggaugaaggaauuuaaaaaauaguauacacagacacuggaauauccuucaaucuuaguauaagaauucugacacacgaacgucacagaugaagcuugaagacauuaugcuaacuaaggcagcuacgagggacuaauaugguuuaacuccacucacaaggacaagucuacaguaguccagugggauaaaacuacauaucaaccacaagagggacuggaguacacacuaacucauggagacuauuggcugacaaagucagacaggaaaucagcagaguucuaacuuuugaacaagagaaauuucuggugcccucccugugggaucauuccuacuguaucuuccaucuccauguucacgugugugcagggucuucugagacaggaccuuguugaacugugcaggcuggucuccaagcccugggcuccuuccaccccaccucauccuccccagcagaugcacacccacucugcuacugguuuguaggaaauauuuuucccguuuuuggguuuuugagauaggguuucauauagucgacuauggcccugaacuagcugagccuucugccucuaacucacaagugcugggauuacagugugugccacacggcugaaaaggcuaacgugaguuuagcaugaggugaaggccuagaagcauuggugaccccacagcuuuuagugucucaaaaggaucauggaccagacuucauuccucacaacacuguugcagcaaacaaacccagucauuccauuucgcuuucuuugcucaagcagcagcgggaugauuuguuucuaauuugcuuaagagaagaaggaacuaugagaauacagagacugccagugcuacaaccacuuaauuuaaagucacacuuucucugcuagaccaugcaguuacccaggaagacuuuggucuacagcgcucucucuguucucccacagcugaccuaagcuaaggucccaccccucuucuuccucaccugggucuggaugucauccccagugacaauauuacccacagcucucaaggcaggagacgccacuuuguaaucguugugccuacagaggaagagcagcuaucaguggagagacagcgcaucagucgguccugccgacugccgaaaaccaacacagguucuucugcccauauuccuugcagcuccagaccuuuguaggucagcuaucugcuguuuguagauuuuuuguuuuuuugcuuuguuuugugagacagucuuuauacugcagcccacccuguccuugaauuugucauucuccugucucccaaaggcugggauuacagccacaccaccaugccuuuggcuagaggucuuugaacuugguaaagcuaaggaaacuuucacccucuugaacucaaaccacucacaucagaagcucuaccaaucuccggcagacuccagagucuaugacugccuggaucuucucauuggggccaucagacagguaggagagggcccagcaagcaucugccagcaagucugagucacugcugaagagcagucgggacaauacaggcaaacaaggagagaccuguuggaagcagaggaggacugaucauagggcuacaucagcucucucaccaagccuaucauggcuuaccccuucccaacacggaauucuacacccugggaaugccaucaaaccugcaggaccaccuuuucacucuccuacccuggcacacaaaaucgcccucuacacugaugauugccuugucuuucacaugauuugagacucuaaugggucuucccaaaacuuacaaagagauccuaugacggaaucuggcaucacuuguagcuaguagguaguucucaccuuugcaaacucuggaggaggguucuugccucggcagagguuugacagggcccagacugcauuccgugucauugucagucguguggacuuaguaaggagucuguaaacaaggaagccauaaucuuagcacugaccuccagcacagggcugugaccacagacccuagaguauaacccaggcccuaggacuaucuuguucgugaaaaugggagguuguucaguccuggauagucugaaacuugcuaacguagacugggcuggccucccaagggcuaggauuaaaagguccgggccaccgggugugguggcgcacgccucggaaaaacaaaacaaaacaaaaggcccgugccacuaugcugggccucauuacuuguuuuugucuugugacaggcuuuucucugucuaacuauggcccuccuggaacucauucuguagaucaagguggcaucgaacucagaaaucugccugccucugccucccgaaugcugggacgaaagguuugugccaccauccaagguuuuauuaucccccacauacacugccacguggccacgcugcagagccccgggauuacucacguuaacaagggguuaaggauggagcaauucaagacauaaucccugcaaagcgagcuaucuccagcgauguuuccaagcgcccacacugccugaaaagggagcagacaacugucacccagagccuggcagcuuccgugacuacuuacaaagcgguccgacagggugaggacagcacacuggagugagccaccuagacugugucuaggaggacucuugcugagcacuugcucuuuuagagcuucuccccggaagcccuguucagugggaaaggcaggcggccacacgaacugaagccagagacaccaaacuacagacuucaucaucccuucauaggaagggagaaagaaaaagucuugacucucuaccuuggcccagacccacacgagguaaagagagacuccaucacugcuuuccauuucugugugaguaccacaggcuaacccauuuucauacgaggagcagcaagccuuguucaauucuccauaguucuccaaauaugcaucaauauuuauuuuuuacuauacuguaaguacggccaaaacauugaccaaauuuugaguguuaccuguucuuguacaucuucaaagucugaguuaaguaacucuauaaaaauggggacagcuccugcuucaaugacaauuuuggucugcugagacguuccagaggcaauguuuguuagagcccaggcagcuucaaacugaaagggagaucacaacacaacugagaggucugcagacugagcagcccuaccuacccaccugccucacaacagccaaucucuaguagcaacagaagcccaaaccaaacucgucuuuccccaccauccuuuagcagagaggggacuugcaugccgcugguaucaacccuguggcaguccucaugucccagccuacugcaugcugaaaguauuaauauaugcuggcuaaaaguauuaguguggcuuaaagcuuccccgcucccccuuuguauauauauacuguggaaacucagcuagguucacauaauuauugcuauccaaaacccuuuucuuuauuuuuugugucuguauguucaucuaugugccauaccaugcuuguggaggucagaggacaaccugcagacugcaggagucaguucaaucauucuaucaugcaugaguccugggucacacugucaggcccaaugggaaccuuaaucugaugagugcccccccccccccgccccaacucgugugugugucucauuuaaaaagacacucacuguggagaacaggcuggccucaaaccugaagguuuguucacuuugcuaguagcacaggcuguacuaccacacccagcccugaagcuauuuuuaaggaagguaauuucccgauauuacuuucccauuuccuaaagggaugccacaaagacaguccacugucaugugaggaacucucaucuggccauuccaccuuagagccauuaccugcaauguacaauucucauuucucuucagaaacuccacaaaccgaucaacuacuccuggaguguuaauaacuucaucuauuggaggacucggcucuagaggaagacaggaaaggcagaaaaagucaggagaagcuuggacugacccauucacaacccgagaugcucugaccaauuuuguagacuuuccaaaguaguccuuugcucaucuacagcuuagaauaccguuggcauguuacaaauacaaaggcaaccuagucuagguaugcucaccucuggcuuccuguauguaagcacgucagaaaaggagagagacagagacacagagagagagacagagagagagagagacagagagagagaacccgagagagagagagagagagagagagagagaacccgagcucgcaccaaggaaugagcaaccuuagccuauacauuugccuucuaacaaagaccugcuaggcagugguggagcacaccuauaaucccagugcuugggaggcagaggcaggcggaucucugugaauucaaagccagccuagucuacagagagaguuccaggacagcuagaguuacacagagaaacccugucuugaaaaacaaaaaaaaagaaaaaaaagaaaaaagguagcugaaggaagugcugaacauuuuuuugggaaaaggauuauuagaagagggaauaccaaguauaaaagugggaauacacccacuugacauauucaaagaaaaccuggccagcaagguaggaugagcaaugggcaguaaagagacagaaggcuggggggaggguauaggggacuuucaggauagcauuugaaauguaaaugaagaaaauaccuaauaaaaaauuggaggguggugguggcgcucgccuuuaauuccagcacucgggaggcaaaggcaagcggacuucugaguucgaggccagccuggucuaaaaugugaguuccaggacauucagggcuacacagagaaauccugucucaaaaaacaaaacagaacagaacaaacaaacaaaaaaagagacagaaggcuaaauuccauggccccuuucugugaaggaccagguucuguaccuuuggacaggaguuuccggaauuucugcgugguugcuaacugcaagucagagucguccgagaagagcaucucuaccaucucucucgugaucacgcucuccuagaacagaaaacagguucacggccuugcggucaauaauacagccagaagggaacacacaaccuuguacggcuucugcuuccuaagauccucaagugauaggagggcuuauccaauccacgucugcuucaagguacaauauuuaaaagggauucccuaaauguuuccucaggguuugcaucaauggaucccugguggauuguccacagaaggcacagaagagcuucccaucugacuucugugcccauaguagcugugaccaggccuugaaaggcuuaccccaguuguagagcucacguaggaauccaucagcagacuaucaaacauggcagcuucuucauuaaucagcucuacauuucuccguuuaaaaagcugaaaagugaagaggggagacaggguaacaucacucacaaacugagggcagauuaugacauaaugacaagaaacuaugagcaugaggaaaaugaggccaacauuuaauuuaagcagacaugaaacauguucaaaagcuuuguuuucuaugauacaacuauucacauucuuuuuaaaaaauuauuugaaaaaaacuuucacuuuguguaauggugaggagaaugaaaaaaacauuagggcuggugagauggcucaucgguuaagcgcacugacugcuuuuccuaagguccuaaguucaaaucccagcaaccacaugguggcucacaaccaucuguaaugagaucugacacccucuucuggagagucugaagacagcuacaguguacuuacauauaauaaaaaauaaaauaaaauuaaauuaaaaaaaauaaaaaagaaagaaaggggggcuggagagaugacucagagguuaaaaacacuggcugcuccuuccagagguccugaguucaauucccagcaacaugguaguggcucacaaccauuuuuggugagaucugguguccugcaggcauacaugcaggagacuccugcauaugugaucaaucaaucuucaagaaggaaggaaggaagaaagaacagaacagaaccgaacagaacagaaggaagauagguagguggguaguggucacccaccuuugaauuccagcacucaggaaacacagucaggcagaucacugaggccagccuggucuacagaaggaguucccagaagacaaagaaaagugacaaaaacaaguuccaugacugaaucuagagcugcguaauuacaucuagucacacaugguggugcaacuauaagauugauuaaucagucucuggccugggcaaaucuuuuuuuuuuuuuuuuuuuuuuuuuugagacaguuccaucuguguaacccuggcugcccuggaacuugcucuguaaaccaggcuggccucaaacucaaagauccaccugcuucugccucgugaguccugggauuaggagcacggauccacugcugggcuuguccuaaguacacuuaauacagaagacucuuaaaagaacagaaggccagagacauggcucucuguugcugguaaaggggacuuggguuugguucccaguuccgggggauccagugcucucuucugaacucugcagacaccaggaacacauauauacacaaagcauacacaugaaaucaaagcgcuucuuuguuuugcuuuguuuguuuugcagacagggucuuucuauacagcucugguuguauugaaacucucuaguccuucauaacagaaggcagcccagaaugacugcuaagucucuauggccaggccaaacccugacuacacugugugcaguaugaagacagaaggcacaaggaagcuggcagaggaggugucauuuucuucagugguauagccacugguaaagugucuagcugucauuaagaccuccacuuaugcuccuauaaacaacucucauuaaacucaggagggcacagaaaugagagccaugggagugggaggaguuacugggaggagggguuucagcaggagaggaauaagacaaggaaacggagaacugugacuaacauaccuuacccacacagauggaauuaucagaauauucuuauuuauuuacuuaguugguuuuaugagacaggauuuuucugugaagccuuggcuauacucacucuguagacuacccuggccuugaacucacagaaaaccaccugccucuucuuccuaagugcugggcuuaaaggcaugcaccaccacugccugaucaaaauaauuuuucucaaguuuuuaaauuaaaaaaaaaauuuuuuuauacauauaugcgugugugccugagugaguucagguagcaugagggagcccacagagggcagaagagcacgucucuuagaagcagagucaugcauggcugcaaaccucucuggaggugcuaaaaccuagguccuguucaagagcaguaagcaccauuaacagcucagucaccucuccaggcccagcaaagaacagggcaaagagauggcuccgugugugaggaccugaguccgaggucccugcacagcacauaugaagaguaucugucaugcagucagauggagggagacaggcuggcacaggcagcagucaucaucauaccacacacaaaggagacccaggcucagccaaggcucaaggugaggacugacacugagcggcuguccugauccccacuugcacaccacgccaugccacgccacgcacauacacaucucaagcaaccaagccaggaaaaccacagggaacaggagcuacaucuccagugcagaauaaaaacgacacaaguugguuuaauuuuuagaaaaggauuaagaaauugguuuuugggcuggugagauggcucaguggguaagagcacccgacugcucuuccaaaggucuggaguucaaaucccagcaaccacaugguggcucacaaacauccguaacgaaaucugacucccucuucuggagugucugaagacaguguacuuacauauaauaaauaaauaaauaaauaaauaaauaaauaaauaaauaaauaaaucuuuaaaagaaaaaaaagaaauuggguuuuuuuuccuuucucaaaguuuccaauauuugcuuagaaaaggaacccagaagucuggggagguggauuaaugaguaaaaugcuuauaaagcaagcaugaggaccggaguucaaauccccaauauguaagugaggugcacagcuauaaucccagcacuuaggagacaggcucucuagagcacacuggcuagucaagccaaucaguggguucagguucagugauggaaguuaagguggacagaaacuggaaaagaugguaauaucaaugucuggucacacacacagaacuugcuuacaugcaaacccaccuacaaaacaaauagguaaacaaauuugaugacuagccugcuacauugauaaagcacauuucccuaugccaggguuucucaacauacggguugagaucccuuugcaggcagggguugccuaagaccaucggaaaacacagauauuuacauuaugauucauaaguuaugaaguagcaacaaaauaauuuugugguuggggucacuaugacaugagggacuguauuauagggucucagugucagagagaugagaaucgcacugcccuaggcagaaggaugaagggaugagugcaccugagaaugcugcaggugggcuggagagauggcucagcaguuaagagcaccaacugcucuucugaagguccugaguugaaaucccagcaaccauccauaaugaggucugacgcccucuucuggugugucugaagccagcaacaguguacuuacauauaacaauaaauaaaucuuaaaaaugagagagagaggacgcugcaggugacuuacuuguuguucccgcuucuguuuccgaagcugaaugcccucuuccucccuccuucgucucauuuccucaggguuuaaggcauuguucuuauagcucuucauucgauaauuguccuucccugggcuugccauggucucuagaagagagcagauugucagaguugaguguagcauuucuuuuuucccacgugaucaaaaugagaauaucaaugaugagaaagcacaggaagauggcaaacaaguucuggcccugaaaagaaauggaacgaagaagcagagaagcaccucuggucagucucucuaggacugcuuuggaaguuuacuuggcaaagcccauaaagauuuauuaucuuggggguuggggggagggcugcugaagagauggcucaguguuuaaaaguauuugcugcucuugcagagaacccaggugcaagcgcagaacccauaugguggcugacaaccaucuguaaacucuagcuccaugggauccggugccauuuucuaacaucugaaugugccaagcacauagguaggcaaaacccucauaaaguaaaacuaaauaagcagagaagcuggaaaaaugauugcugaaguagcugagaacacgugcugcuccugaggaggauccaggcucaggucccagcacccacagcacagcuccuaaccaucucuaguuccaguuccagggcaucugaugccucuucugaucgcuccaguuucuucacgcauauggggcaucagguauauaaaaacacauguacauuaaaaauaaaaauguaaacaagaaagcaagccaucaaaugaaauggcucaguaggugaugguccuugccaccaagucucaauauccaguucuauuacacaguugaaggagaauucgcuccugcaaacuguccucugacuuccacaugcacacaaugacaugugugcacacguucacucacacacacacacacacacacacacacacacacacacacacacacacacacacacacacacuuacaagggucuacaguggccucuccuauggguaccuaaacaggcagaggcgagacuacuaaaggcaagccccuguggaaugcuguccuuuacuaccugacacauaguuuuucaugauugagccugugcugucccagaggcuguccucuccuuugagcacaguugacaguuaaacugaaauagaaaccacauugcuucuuuaguuaccauggugacaaguaacuaucacaaauaucuacuuaugacuucacuggagaagcaggcaacaaagaauagaaggaugaacaucugcagaagcaccugaggaaacccuguuacuacagacccucccaccucgagaccaugcuuuguucccucuggcuuaagagcgccccaccucaccagucauacucauuuuuacaacacauaguuuucucuuacaguaaauucucaggauagacuaaaguacaagcaacaacaaaucuaaacuuaaugggggagacaacaccuacaaaauuagaauaaucaaauaaaaaaaucuccggaguacaaagucagcuacaauguugacacuugaagggugggaugcuaacacgacacaggagagaaggacaaacccaaacaugcagagaugcucuucuaaaccacacgucacuuacugucuucucuguguagcccuggcuggccucaaacccagagccccaucugcucugcugccccagugcuaggacugugccaccaccgccaggcucugucacucacacuucaucuucaguucuucagcuuucuugcauuuugguaauuauuauuaauaaggaaggugggggaccuguugcuuacacacacacaaaauacucagggacuggagagauggcauaguguuuaagagcacuggguguucuaacauaggacccagauccuauucccaguaccacugacacuggcucacaacccuuugugcuucagucauagggaauuugacacacucuucugaucuccauaggaaccuggcaugguguauagacaaacaugcaggcaaaucacuuuugcauauuaaaacaaaaaacaacaaaaagcucaaaaacguaaaaaacaaacaaacgaacaaaaaccuacuugccagguguggcaacagcagacaccuuuauuucagaagugcuauguccgaggcaggcagaucucugugaguuccaggccugccaaggccauguaaugagcauuugaugggcauacugguucaugacuuuaaucccagcaacuggggagacaaaggaggcagguggagguccaccugcucugccucccaauuccugaaugaaaagugugcuccaccaccaccuggcuccucuaccugaguuaaaagacugcaccgccacucucuccucccauacucuuuuuagccuaauaucugcacuuuuuguggucugaguugauucuauaguuucaagauauauagagacaaacacacagauaaugaaagcucauucccagaccccaccccuuuacgucuauauucacuugucuuuuggaugccuucccucaggaaacagacguauucuaaauugucuacauuuagacacauuucaguauuuccauccacccugcugcucaagucaacaggcacaggaggcauacuugauccucaccccacuccgcuuugccaccacaugacaccaaaacccaaccagagaacucacucuuuuuuuuuuuuuuugucauuguuguuguuuuucgagcgagacagaguuucucuguauagcccuggcuguccuggaacucacuuuguagaccaggcuggccucgaacucagagaucugccugccgcugccucccaagugcugggauuaggggcgugcgccaccacacccggcucagaacucagacucuuaaccuuuauuccuacuauggccaccugagucacugccaccaucauaaucucuuucagggacuaccacacuacuuaaggaaucuccuaguggcggccacugagggcacagcaggucauggugcuaccaccaaggcugauagucuuaagaagcuacccagaggaagggacacuuccgaccuccacacgugugccauggcaaacccacacucauacccaauauauggaagaauuucuagaauuuauuacacuccagaaaugcucacaugcagaggaaaugaguagaaggcagcauaggcaaaaaugucacaaagcuagaaaaaccaacaggaaaccugcagauugggauuugggaaguggacugcgucccugagauagagaggacugacaacaccagguauguguuuuaggaacacagacaaacacaccuaacaaagggcaggccauacaacuaugguucuuagccuguguguaaccaucagaaaacacauguuucugaugaucuuaggaacucccaaccauaaauuuauuuuuguugcuacuucauaacuguaauuuugcuacuaagcaguguuugaguuccuaagaacauccuaaguacauguuuucugauggucacaagccacgaguugagauccacuaucauagaggacauucagcuugagaguuuuuguagcacuaaacugcuaugguuuacaaguguuuuuauuuugucuuguuuucugauuugagacaaagaguaucaguuaauagucuaggcuggggcuggagagauggcucagugguuaagagcacugacugcucuuccagagguccugaguucaguucccagcaacugcauggcggcuccaaccaucuguaaugggaucugaugcccucuucuggugugucugaagacagcuacaguguacuuacauauaauaauaaauaaaucuuuaaaaaaaauaaaguaaaaaagaaaaaccuacacacagagcagcucaggagagacugaagugacaguaucacaguguccaaccacauuacagaacagggaaaagaaagaguccaagauggguaagguuuugugccgauggguaagguuuuguaccaggccaggagagaggcuugauacuaaugggacacucaggugacgaguauuuagugucuccucucagguggcugaauaaaccuagaggggcacaaauaaauaaauaaauuaauuaauuaaauuuuuugaaggggguguucuggcuuaccuggcuagaaguacuaucaguuuaaaagauuccauuauuugcagccaaaaacaaauuagaaaacuucauuauccuaucuuaacaccaauauaagacaucuggggacuggaaaaaugaaugacucaguagcuaagagugcuagcuguauuuccaaaggcacuggauucacucugcagcaccuacaugauagcucacaaccuguaauuccaaucccagggaaucugauguuaucuucuggccucugcagauaucaggcacacaagugauuuuuuugagaguuucucuguguaguucugacugacuaaaacucacuuugcagagaucugugagauaugccucuauuuccaaagugcugagauuaaaggcaugccuguuuacuuaaaauauuuuuaaaauauuuuauggcagcucaaagcauggagaaagcuuuuucuauaucuguccucuguagcuaacuccuggucuuauuuagccuaggcuagcccugaacuugcuuguagcugaggauggccuugagguucucaucuucagaccucuaccuacacagugcuggcauuacagguauuugccagcauacauuguuuaugaaguucuggggaucgccucaguucuuuguacauucaagacaaaaauuuugccaacuacaacccuagcucuucacucaauuaaaaaaaaauuacaucuauuuugcguguauauuggcuuggguguuuguguagagguccaacacaacguuuagaacuuugucaucuccaucauccauaugugauuuuagguuuggcagcaagcaccaccuugcuggaucuacccacacuuuuaaacuaccuauuauuuacaaauuaugccucauaaucuuggcauugcuaguggcaauuucagaguccgaaaagaacuuuuugcagaagcagaacacugcccuuaauagccuauauucugguaacaacuauauagaggcuauuaauagacuacuaauagucauagcaaugggauauguucugagaaaucauuccuuuuuuguuuuuguuuuguuuuuuuuuuuagacaggguuucucugcguagcccuggcuauccuggagcucacucuguagaccaggcuggccucgaacgcagagauccaccugccucugcuucacaaguacugggauuaaagccgugcgccaccaugcucagcucugagaaaucauucuuuuuuuuuaauuuauuuauuuauuauauguaaguacacacuguagcugucuucugacacaccagaagagggcaucagaucucguuacggauggauaguugugagccaccaugugguugcugggauuugaacucaggagcuuccaaagagcagucgaugcucuuaaccgcugagccaucucuccagcccugagaaaucauucuuagcagauuucaucacugugugaacaugauccuacuaagaugguguauuuuauuauacacauagauuauauaguauagccuauugcucauaggacuaaaagcaugguaugauacugaauauuacaggaaagacaaaauguauuuuaugcaucuaaaauaaaaacaguacgaggaacugggcuugguggcgcacgccuuuaaucccagcacucgggaggcagaggcagguggauuucugaguuugaggccagccuggucuacagagugaguuccaggacagccagggcuacacagagaaaccuuguccaaaaacaaaaacaaaaacaaaaacaaacaaacaaacaaacaaacaaaaaacccagacaaaaaaacaaaaaaacagcacgagaaaaaaauaaugcaguagagaaaaggcacacuguauaggacaccuagucugacuggagugcagugcuaagucacuucaggagaacuaauagugagcaggguaucacuguugcucucuccacagguaaccaacacugccccuaaacuuacaacuuuuucuucucuggggcuguagagacugcugggucguuaagagcacuugcugcucguauagaagaucccuaucugacuccccggaucugugcaaacuugguggcucacaaagccuguaccuccaguuccaggggcucuucucugaucucuacagguuaucugcaaucacaggcacauauccacacagaaacauacauauaagaaaaauaauuuuaaaaacaucuuuuauuuuuaugugcaugaguauuuugccugcauguaagggaacuacauauaugccuggugcccuugggggucagaagacgguguuggauccacuggaacuaaaauuauggguggcugugaguugaaucuggguccucugcagaaacaagugcucuuaaccacagccagagccaucucuucagacugaaaauaaaacuaaaaaaaacaaaaaacaaaaaaaacaaaaaaaauggggcuggagagauggcucagcgguuaagagcacugauuguucuuccagagguccucaguucaaaucccagcaaucacaugguggcucacaaccaucuguaaugggaucugauggaugcccucuucuggugugucugagacagcuacaguguacuuauauauaauaaauaaauaaaccuuuuuuuaaaaaaaucaauggagcuggugagauggcucaguggguaagagcacccgacugcucuuccaaagguccggaguucaaaucccagcaaccacaugguggcucacaaccaucuguaaugagaucugaugcccucuucugaagugucugcagacagcuacaguguacuuacauauaauaaauaaauaaaucuaaaacaaacaaacaaacaaacaaaacaaaaccucuaaaacguuuuuauuuguauacgucuguaccuauacgugcaugugugugugaucacagaugccugcagauguaauguaguuacaggcugcuguaacugcuugaugugggcgcugggaacugaacuuagauccuguacaguaauaaaugcucuuaacuacugagccuucucucucuuuuuuuuaaaccuaguuuguuuguuuguuuguuuuuaauuaauuuauuuauuauauguaaguacacuguagcugucuucagaugcaccugaagagggggcaucagauuacgggugguugugagccaccaugugguugcugggauuugaacucaggaccuucggaagagcagccaggugcucuuacccacugagccaucucaccagccccgucucucucucuuuuuuuaaagcuuuauuuauuuauuauauguuaguacacuguagcugucuucagacacucuauaagagggcaucaaauuucauuagggaugggugugagccaccaugugguugcugggauuugaacucgggaccuucggaagagcagucagcacucaguuaagccccugagccuucucuuuagucccaaaaauguuguaguuuuucagccaagugugguggagccugccuguaauucuagcucagaggaagcugagguagaaaguuccaggucacuggugcuauagaguaagguccugcuucuaaaaagcccaagacaucuggggggggggggagggagagggagagggagagggagagagagagagaagaaaaaugauauuuuuucugacuuuuucagcuggagagauaguucagugcuuauagcauuugcaaagcagcuaguucaguucccaacaacuaucucagcuccaauuccagaggaucugauaccuucuucaggcuuccguggacagcaagcacacaugugcuacauagacauauauccaagcauucuuacauguacauaaaacaaauaaaccuuguagcuguugcagagauggcuuagugguuuagaauaacucugaaaaagaccuggguuuacuuccaaauacuuacauugcugcuuagaacuauccagacuucaggucugggggaucuggaguccccugcuggccucugcaggcaucagccacacagugugcacacauguacacacaggcaaaacacucaguuuuuaaaaaaggcuucuuguuucuuuuucaagacagcguuucucuuuguagucuuagcuguccagaaugaaacucacucuguagaccaggcuggccuugaacucagagauccaccugccugugccucugaguccugggauuaaaggugucagacacccuaggucugcaguuacaguugugaaucaaaccccaguuuaaagagcaacuggugucuuaaccacuaagcauaucuccaguucaauuuauuaaguguauggaggcagaggcaggcagauuucugaguucgaggccagccuggucuacagcgugaguuucaggacagccagggcuacacagagaaacccugucuaaaaaaaaacaacaagaacaacaacaacaaaccacacuaagagcuucuucagcuacacguucucuagacaaguuccggcuuuauaauccuaugcauuucaucauaaccgcaauguacucuucacagaaaaguuguuauaugguacaugacuauucaagaccauucuaugauuuugccuggguucaauacccagacaacuaaaaaacaacaacaagaaaacaaaagggcuagagagauggcucagugguuaagagcaccaacugcucuuccagagguccugaguucaauucccagcaaccacaugggggcucacaaccaucuguaauaggaucugaugcccucuucuggugugucugaagacagcuacaguguacucauauauacacauaaaauaaaacuuuauaaauaauaaauaaauaacucuuccagaagcuccagaaccuucagaucuagaucuaaguagccuaaaaucaacauugccuaggacaauggauuacaacaaggacugguuugaaguuucacuaaccaagacucccuggauuuggagagauaguggaaauuuuguuaagacagccaguacccacuagaauucaucaggucgaggucuuugcuagagauggucaagaauaguugcaucacccgggcagugguggcacacaccuuuaaucccagcacuugggaggcagaggcagguggauuucugaguucgaggcuagccuggucuacagagugaguuccaggacagccagggcuacacagaaacccugucucgaaaaaccaaaaaaaaaaaaaguugcauggccaacacaggcaaacaguauaaaggauagguccuggaagggaacacaggagaggcagugacauacacgggccucugggagggaaggcuggcucuauuauaaccaguacccaacgggccuagauugcuagccuugcacuaguuaccuaucuucucaaagcaucaauuuacuguugcuaaagggauuccucaaacuaccgaggacuacacacugugauuaaauauauccuuauauuagacuggucacugaaguuagcugaaaagucaccuaccucuacauacuaaaaauucuuucaugucucauucuugcacugaagaacuuuuuuguuugcuuguuuugguuuuuugacacaggguuucucuguguugcccuggcuguccuggaacucacucuguagaccaggcuggccucaaacucagaaauccgccugccucugcuccccaagugcugggauuaaaggcgugcgccaccacccaucuaaugccuuaaaucuuagaggcugcugugaaguaaaaugugaaagaaugucguuccuggcugacucucaucagcuauguuagcuccuucaagccuguuucucaaucucuaaaaaaacgucucacagacgaugccuuucccucuagggcuccaguuaccucccagaaucaaucuauacuuuccagaggaucuggaaguguagagugcuuuagggaaaagaaccgcucgcuguauucagggugggaagaaugcuguuacauuguuugcagaguucuugcuagguuacacauacucccuuccuagagaugugaaggcucagaaauggaggaacguagggcuuguugcaguguguuagacgccuucucuaugcacaguuuuguuugaaaacuggaugagaggugggaaguggcaggccagaucugauucugaaaucacuggcagagaaagucuuuucuguuuccucagaauuagagauuauagcaaacuuuagaaaugcacuacucuuuacaauaggcggaggucagcaauucacucuaaacuuuuccacuuucauucagacuaaagauuucaaacuggacccauaucaaaacacaacuucccaacuuuacgcaggguuaaaacuguccccccucucucucaucccaccacuagagggccagcccauaaaaggcaccaguuaauuccuagggcucuggagugaucacccugguuuaaucaccgcgugaccuuggauaaguuacuuuaccacucuaagccucaguuuccccaucugcaaaacaggaauaacagcagcaccuaucccacuagauugcaauuagguuaaacaagacacguuaagcacugacaauaacgucugcacguacagauuggcaaauuuaaaguuuuucacuuuacugaugccaacaaauuaccaauacugguuucacuucugaauucgaagaccaucaucguauucuuuugagcaacggcuuucguauccggaaugcucuuuaaaaaagaucaacaggucucucuuuuucuccuaaccagaguuggcccagaaacaguaagucccugaccugucugugccaagaagucuuggcuuuggucucucuaccacugcgaaggcugucacugagucuagccgaaccaccccauuccugcgccgacugggacauuuuccuggccuucaaaggcccaagcucugcuggacccggccggcccuugguuaccgggccggagcuggccugcccugggucuccucuccagaggacucuacccucuacguaggcagcuaggacuucacuugguucagaagcccggcguccaaaagcccgaggaagcaggcucuccgcggccaggccugcugcuggagcccggagcccggcccccggauccacggcaggcgcagggcgagagggcagggcucugcuuaccccgggaagcgcgagcucugacccgaggccaccacguggggacagcccaggacgcuagcagugcggaacaagcccccagggcugcuccccgugcgggcggcccuacgccagcccuaaacuggcccgaggggcgcucccgaucugccuucuccucccaugccucucuggaugcuuccgacaucugcuucggacgagagacaggcccucgccagaccccgcuccccgacaccucggcccgaacacccaucuccugagccgcuucacucacccaucgcggcuccgcucgcucggacuuggcggcggccgcagcgguagcuucagcgguagccucggcagacaauauggcggaccugcaggacggcggccugacggggacaaacg

SEQ ID NO: 2144 - RNA, 2017 nt, Mus musculus
uccugauccaguuuccucucauaaaauggaccaaguaguaagaguccaccccucacagaguuauuaggaagaacgaugugauuccuguaggcauaugcuaugcuauacgguaaaguguaacaucacuuuguaggaguuuucaaagcaggccccucacuucgaaauaauuuggacaaaauaaucguccugaucacagaguaguuuaagagauuagucucauguauggaaaguggaaugcaaagucaaauggguuauuaccaagcuuugauuggccauagucacagacuaaaagauauuuaaaggccuaugugguuuauauagcauuucuuacauuuacuuuguguguguguuggggguggggagagggcggcuacacaugugcacaugcacaggaauuauuuuuuucucuaucaugugggucuuggggaucaaccuucuugggccuuucagcaagccccuuuacccacugagucaucuugcuggcucccacacagcaguugggcccccauugugcccauaugaagacccuguaagcaugcagggcuuauuauuuugacuuauagcugaggagcaaacccagagaggcuuagaggucucacauagcuggugagggugaggccaggguuagagcuuugaauuccacuuauugcauacuuggcagaagugaguagaggccagugugggcuccaaguaggaagaacuaccacagccuggcuucccagacuccgccccacuugcuggguuuugugagauguuaaugggugcucuugauagaggauccugugguuaagcaagcuugggaacugcucuguuaauacagcgugguaaugcucacugcaaaucucccagaaagucauagaaugcgucauaguccuaaaaacuuucuuaaccagggaccacccuaccccaucuguuuugaauuacgucugcucauuguuuugugacaagcugguguuccacgggagcucagguugggaaagcauucccauaguacauauuuuuaguggcugguuuguaucagaauuaccugagagcuuguuuaaaggacagauuugggccccaucuaagaccugcucuaagcuuagauggcacagaucccacccccaaauugugagggguguguguguauuuaccuguguggggacaguaaacaucuguaaaccaaaaguugacaauugaguggcugccucaguucucaguuguuccccaacuuauuuuuugaggccaucucucaaugaacagggaacucacugagccagauuaucuagccagugagggaucuucauugccucugccuccccgggcauacuuuguccuaccuggcugaggauccgugcaaguagguugucuugcuuucauggcacacaguauaccaguagagugauccuccuagccccaguaaucuacgucuuaauacguguuaggaaugauuuguauacacucuagaagcaguguccugggcaagaauccagcucuacccacuuaaauguuauaugcccuuggcuacaucauguaauggcucggggcuuuaauucucuuaccacagaaagggaggaauagggccuguggaaagggugcgagaagggugggaugcugcacagccuguagggagcucugcagucacgggugcacaggguguggcguggcggugacacucccugccauugccgugacgguuacuuugccaggcugccugggcuucuguugagggcagaauacugaaagggagcacuagaaggaaaugucuggaauagaagaagaaauauagcuuuuauucccaccuuagaguuguccgccuccucaucccagguguucuaagaaaggaaaacugcuuguuugaagucaugcagaggcgcaggcagugcugccuccuuccacccacuggauacuuccgaggauuacagccguuggugggagucacaguuccuguaauuuuccauugccuccggcccagggugcacaggcgcugccuugguauugaaguagcaaaaguugagugccguuugguucagugagg

SEQ ID NO: 2145 - RNA, 10671 nt, Mus musculus
accugguauaaaggagauuuauuugggaggaagggaggggagugagggccuagagaagggagcagagccauggggacagaggaguggggacagaaaggacagaaaaggggggugagggaagagacccaccaggaacaugugggaacagagaggaaaagagagagccaacuggggcgaucaugggaagcaguccuuuuauguggcacccacaccugguggccacaguuaauggccuugauugcuaggucccugggaagaucuuaucagaauugccuauaagccaccaacaguucucaucauuugaggagcagagagggcuccugaggcugucauauucugacagguuucacguagcccaggcuggccuugaacuugcucuguagccuccagcaccaaguacugugauuguaggugugcaccacugaggcacaggguuaggaggcuugucacacaggucccugcguccuggaaauuaggcugggaccugggaugggagaacaggagaccuugacagaaagaaaagagagguuaagaagggagagagaaggggugggaggggaggggaggggagggggagagggaggggaaggagaugggagaggaggggagggaaggguuguaaccacuagcuauuaggcacugagagccuggggauguacuauagggagaggucugucaggggcccaacuugucucaggaauagggaaaggccagggucagucccuaccuacuggauuacuucuguuaauuggagggccgggccacgcccucucauuuguguguguuuguguguguguccugcaaguggcugggugcagaggauuauaauggaaagggcacuaagauuucuuguuuauccaccccugccugccacccagugaugugcuauccuucucucccaccccucucccugcccuuaugucagggucucauacacuccaagguuguccucagguuuacuaccuaauccaacgauaaccuagaacucagaucccugugucucuaccucccaagugcugggagcacaagcuuguacccugcucucagcuuucaggaaguucuuucuguugucuagccaugggccacuccagcuuugacguguuuugcuuuuuguuuuuuguuuccaccuugaagacucccagacacuguaauuaucaauacuuugguuuuauuuuaaugaaaagaaaaauaaauaucuuuaaagaauaagaaagcaguacugagaauggaaagguacaaccaaaauggaggcuagggagauggacagaauucaucaaaaagaagaugagagagaggguggguaggagggugaugagguuggggugucuuagcuccuguggucuuggccuggcugaccagggaccuggaaucugucuauacucccugcaguuuccaaacagggcccuucccaguuccggcugugauaucugggggcuuccgccagccuggugcaucuuugucuccuaggugggauucugccuuagcgcgcacgcgcggaucugagucuguagagauuagcaccuggucccgaagugcacacaaggcuucaucgggcauggcccccaaggccucuucuguggcuguggaucccaccucgccuaguggcugagacucaguggugccccauguccuccauucccacgcgaccccagacgcccagcacgaaggucucgaugucgcacucguuggugccacgcacgauccggaaguggccccuuucaccccaccaugggccccacgaguuggcagcagucugggagugaaaaggggagagacaugaggcaaaagacagaugauggagggcucagaagggcaggaacuugggacucagccucgcaccagagacucacccaguacuuaaugguccuuccgucuggcagcgucucuucuccccaccuagcggcaaagcaagagggagagggggcacugcuugcaccgggucucaacaucuggaucgcagcacccccaagcuaccccugugacuucugaaaucugagcguagccagggaccugaugaguguucaccccucucugcauagccugucacucagugguuggccagaguugggacaaguuuguguuuugagacaagguuucacauaguccaaacuacucgugaaguugaaggcaaaggugaccuuuuagcuccgaauccuucugcccacaucucagugcugaggucccggaugcgcucccccaaccccaccccauuagcucuugaauucucaaauucaagggggcaguuucacuguucccagacacccuucaaagcuccucacgguccccgcaccccugcaagcagccccuccucucugugucuguuuccuuuuuggcaaugggaggagggaggagcagccucaguuuggcagagaacacaaagaauuucagagaauucccagaguaaaugccacugcuccuagucccaugugcccucaggaaccucacucacccagugaucuugacugagugagucccaugucugcgguacugcuccggccuccccuggcuuacagguguguggcuguagaugccacgcugguacaagaagaaguccucguguacuuccaugagugcugugggcagagacaaagacagggcuuggccugcuauucugagcauccagacaccagagccucauauuagacauugauuuaaguaggagcuuccugcaaagaaaggguaacggacccuccacuccucuuacaacugcaucugguaccuaaaguuggagagauuucuuaggcccugcgcccagccuccagcaagaaguuucuggaaccagagaaagccuggggaugguuaccuugaacagggccguuuuccauuagcuccuucaugaucuccuucuccuggggggggggggguggggguggagaaagguccaucaguguaagauuuagcggaccaaacccccaacucuugcuucuccgcccuucccauguuuagacuuacaucagagcccaggcgguaggcaggcgugaccugguagaugucguuggaaucaaccugaccauuggggcagcgggaaguggcuuggcgcuugccccgccccauggcgcggcugugcaucauacaacgaggaguggggcuggccucguucugcucacggccggagaauggguaacaguugucagacaccacccuagagaaagaagcaagagccauagcgcuauggcaccacaaagccuagguucuaaagggugcuauauccucuuccagcccacaaccccugugcgcgugcguacccgcggcgccgcaggaaccaccaagcgccaucaagacgcccaccucggcagcccugcuggugguggguaucacaggacagcagguuuugcggugauaggaugggugucaugugucccaaagaauggauagagacgcgaucagaugcgacagcuaguggggaaggcagaaagagcugucagaagccaggccguggcccuccucucuagugccagcuccugccccuggacacaccugcuguggagaaagcccaggaaccugcacaauugcccugguccaauggcucguggaucagguugggccacuucucugaagcuucaaaggcaguggguagcacuuccccuuggcccagcaccgucuguaaaaaaaaaaaaaaaaaaaaaaaaaaaaaaaaaaagugauuccacuugcuuucuagcaugguccugucaucccaugaacccacgcuuuggaggcacaaugagaauccagagccuccggcauugggauccgguguugcccugcuucuggggguggggugggguaguggcauucccguuacuugaguggaauaaucagcccuguucagggacccgcaaagauuacacguggguaaugaggcacggcagccagggccacccgcuucccacucucuucuccugccacuuuucucuguaccuucugaucagccacacccuccuuccugccguggcaguggccuccaagccccaaaggacaggggcgggaagaaacaguaaggucccgugaccaggcaggccgccaagacaaacagcagaaaauagcaaagcagccccagggagaaaggcagggccaggggcuggucacccuggccuugagcagaaguccccuggccucucccugucugcuuugauggacagcagagcccugcccaggcugcaugggagucuuuaccugcccccacucucccuaagacuggcagggucugguggaaaaacagaagcccccuccucccuaggggauucacugagucagcaguuuuuccgagaauuguugcuuucuggccagagcugucugucccucuuuuccuaaaauaccaaggugacccccucggccccuugggucuugacccagcuguacuggacccaacagcauuuuuucccaggcugaggaggcaggaggggcugcuucaagcaccagaagguuuggaagcacagucccaucagagaaggcaaugauaugcccaaggccacacagccucauccuggaggacaggcucuuggcaggacaagaagaggcucaucguucccacgugcuaagucauugggagauagaugguagggaugugggcgagcacggacuuacauaaaucucauucauauucaugacaguggaggaugggcggauugugcccaggcgguagcgaaugcccucauccagggucaugccccagaaggcacugugguucccagccugccaccuggaggagagaagggaaagucaaaccugucaaggcuagagguccuggagccgugacagcuacaagggacagaagucaguucuaacaugugugcguagcauaauagccaugugugaugaucaugugugugcacagguaugcacccuccugugcccacugauacccagggccucucacccguaguugccucgguugauggcuuuaaucaugucuggguccacuagacacggcuccuggucgcacucccaaugcccucccucauggcaggugcuagaauggaaaaagaaaagaaauaaagaaauuguggcuaaggggcugggggcuguagagccccagagauccaugugggccugggauucugagccagucacuggaguggaaccccugaauggucccacccagccugguggcuuugaaaggcaaguccacaauucuuaaguuuaucucugcugcccaggaucucguaguuccucaacaucaccauuguggggguguagcaacagguucugcuuaauguggguccaaguucuagaucauguuacuuccugcagcucagacucaaagccuggagucaccuuugaccccucacgcguugauccagugcacuccggauccagaccgugccucauucucucucggccaccucugcccagccaccuuucaccugauggcugcuacagucucccuggcccgcccuccacccugcgccaccccacguggccgcagccauccuguuaaggcuaagacacgucgcgccucugcuccaacccuccacucacaccacagaaaaagagccagaguccuucacggcaacaagcgcugugaccuguucucccgucgccacccccacccccaccuugccuuuuuuucuuacaguauaucucacguaucgaaagcuggccuugaacucucuauuuugccccaagacgguccuugaacuucugauccuccugccucugcaccgccaagucagguuuuagguggugcugaggaucaaaccuagggcuucuaaccuacuuggcuggcacucuacugagcuacauccucagcccacuuagccccugggggucgggggggggaccuguaaaugaugaucauccaguaaauauuguuuuucguugucuuugggacugaacccuauggcgguuaagcagauguuccucccugggccacggucccuucugucugucuuuugagacagggugucacuaaguuaugcaggcuggcuuggaaaugacucuggaguuccaacuaccuuuggccucagcauccuccugccucagcauccagcauagcugggauuaugaaccugcauccuaguuuauagcuauugaguacaugaaagauugagacaguacugccaagcagcuaagaccauggacugguccugcuggacuguuuuguggccucgaggagguuauuuuuagagccccacacccucugucuauguucucaucagcaaagcgaggacaaugccuaguaccacuuuccagggauuccguggcaagccucugaagggcuuggcccauugugggugcuuucggcuuucauuguucacauaucaggagcccugggucccccuccuucuuuuauagcucauguucagcugaccauaccuccagauguguaauggugcccggcggugguggcgcaugccuuuaaucccagcacucgggaggcagaggcaggcggauuucugaguucgaggccagccuggucuacagagugaguuccaggacagccagggcuauaaagagaaacccugucucaaaaaaaaaaaaaaaaaacuaacaaacaagcaaacaaacaaacaaaaaagauguguaauggcauuucagauuaaagccauccagccuuccccuggucugcuccucccacuguccucaucuuagaggucaggugcuggagucuaccgugaaccugacaugugcccugucagugcgugccaaagauacauaucaugaaccuaucuaucuucaugccccuccuccucugaugccaaaccaggucagcucacucagcaucccugucccagaugcucugaggccaggccgauccaugagugauuucaguuagacuugaggucuugaaugaacuucccuuagauacucagaaacuggaacauggcugaaccuucuccggucucugauguuugagggucccaccaaaaagaacucaccuaugucccacuuuccccucagugguaccccuucugagugcauaagucucuuguuugucuaauacuccaucauaaagccaggcgccccccacuuaucuucccucuuuguguaacauccaugccaguuuggcgugacaucguauguguugcuuuccuguguccucugggagacuacaagcucccaugggucugucucccuccagcuguaaccuccugggcccaacacagugccuucgacacaguaggucuucaguaauuaggcaucagcuggaggccugaauucuagggauucuacaauguuuuuacaagcucauaacucugcuauuacaagaugcuaaccagccuccuuccaggcaccccagggcaucugccuccaaugccaccuuauaaggagccucaaggggagccaagccccaauauggcugggucuuuagcccugaugucugcggguggugcucaagcgagcaggagggggcuguggggauagggaugcccccucuuuuaccuuccucaacacuccucaacaugaccugaggaagagucccuguguggugauguccagccuggaaggcauauagacaaucuuccccucgcaagugggauggauacuugcggcacucaggcaccaggaccuguccugaaggggucagcuaaugcuuuccaguccucaucucaugagccccagggcuguucaagcaggucuagacaggacugguaacagcaggucccagcauuccagaggggccugggacagcaauugaaacguuaaccccuuggcagccacccuaucagagcagcagaauucugcagacaccccgcccuucugagcacacgcacgcacacacacacacacacacacacacacacacacacacccucccucacccagacacaugccagcacccacggacacauggucucccuguucccacagugaccccggcaccccucacccaugaggcaaagcaaacagcuaugugcaacacauuccaaaaaguuuccuucucccaggggccucucaguccaggcagagggagggguggggcagguucagggcagcagagacccuucuguuuccaguaaggucuccauaguugccaccugaucuacuucccagcucugaggaugggcuagccauggccccuuccucccccugccuggaacuggggguuuggggguagggagagggcacauuccagggaaggcccugcugcaggccacuggcugauggccaacgcagucaucccugacccuucaucccgcccaggacagcggaugcugcagagguuuccuuccuggcguccccuuggacucuccugugacagcaagcccagcugggaagguggccagcccaaaccaggaggaguggagaaaaacuucuggcuuagguguggcccccagccaaccuaacgauggcugaccacucccaggcuugugacuagaaucuuauuauaugagauggcguggucaguuugaaaguuuccacauuacagaugaaaacacuugaggcccagagaacaaaaagaacucaucccugggaaaugggugauagggguuggggccaagucuguuugccacauagcgaucaaauugaguccaccccaaucucucacacucaccaucgauugcaguugucccaguagguuccgaagacuggguagauccggcccccaugcaugcacccuaccagagggagagaaggaaagaagaaauggcuaaauccucgaggauuuuuuuuucaguguugcuugaaagagucaaguaagacuacacgagggacuucaggaggagcagccccaaaccucccgagcuggugguaaucacacaccaaucccagcccaacgaaaucuagagacaaacuacaucccaaacuacauccuagaacauccacggguucccacacagggugccacacacaagcuguucaaggacuccguuuggguccaugucguuucaccuggaugccagccaugacauuccugguacccuuugucacucaaaugaguugggacuugcccaugggcauggaaggagcuuuaggaaagaaacugaagcccagguaaggcaagcaacuccuuuuaaaaggcccagcauuuugauauaaagcaacuaaggcauggguuuuccuuagcccaaagcccagcaggguuugggaugcgacaggaaggacuuccguaguucuccuacugggacagggaaaggacacgugcaggccauucucagaggugcugaauccuaagugaggucucuggcuaugacaaccuggcugggcccuucgugcucuaucagccucaggaugagucagcagguggggcugccaccuuccccauacugacugagagauagugcuggagccugucugcccugcccuagggccuaacaggacuauuuuuuuucaguguugcuugaaagagucaaguaagaccacacgagggacuuccagaggggcaggaaacagggugaggauuucuuuucuacauuuuucaaagccuggaaauacccauuaucagccuuguuccugagccucguugggacugggagugacaagguggccgcucugcuggccaucucggugcccaccuuggacgggagggaagggggguggaaucccgaggcagaagucccagaagucggggcagcagucagagacggugcgguugcagaagaggucacaguaacagguggcucccagguagggcagggcacacucgucagcacggccucgacagcacauguccugcucuuggcaguaucugccaccggcgucccggaugccccgcaggugcagcccuggcgccagcucccugcgccaacgacuccgccgggccuccagggcagccuggccagccagcagcagcaagagcagccccagccaacauccccacauggugccuccuagacccgaggagaacagaggucaggggucagagguguuggcuucuggagacucccuaacaaacgucaagggugggucucccuucacacguccuggagcuuuccuaggaggcucagcaaagcggggaacccugacucccgagucuccgggagggaaaagacagcacuagaugucaguccacucaugggacaagaaguagaccccccucccugaccuguuuagggacugucauggacaaggaaaugggaccuugacauuuccaacacgcauucuccucuccugcccuuggucccucuaccucucugacgcaucugaguuggauuguugacucuguguuuccuccuuaugcaugcccccgcccuucuguccuugugucccucugacccucugcucugcgucccucugacccucuccucugugccucucugcccuggguccuucucccucagugugcccccuccucgcugcuccuucucucaacacccucuacccucugaucagggagagucccuaccuggugaggggugugggcuggacccaggcugcccugcgcgccuccgccuccaagcucgagacugccagaccgagucaagugaggagcgcagggcgggacgcuuuuuguaccgcccugccggcagcacccgccccaaccccggacugugggaggggagggcggggcccacuuguagguaccuggaguagcccuuagcuccgagggaacggcuuaaggacaauguguacgcgacuguccuccuugagggaucucuugucaauggaacccucuucuuagggagcagaacugcaacucacggagaaagaauuguggacugauaguaggaaggacuuucccagcgauuuuacgaagcugaaaacgugaacagaagcgggcgaggaggcagcuacgaucagaguuca

SEQ ID NO: 2146 - RNA, 10671 nt, Mus musculus
ugaacucugaucguagcugccuccucgcccgcuucuguucacguuuucagcuucguaaaaucgcugggaaaguccuuccuacuaucaguccacaauucuuucuccgugaguugcaguucugcucccuaagaagaggguuccauugacaagagaucccucaaggaggacagucgcguacacauuguccuuaagccguucccucggagcuaagggcuacuccagguaccuacaagugggccccgcccuccccucccacaguccgggguuggggcgggugcugccggcagggcgguacaaaaagcgucccgcccugcgcuccucacuugacucggucuggcagucucgagcuuggaggcggaggcgcgcagggcagccuggguccagcccacaccccucaccagguagggacucucccugaucagaggguagaggguguugagagaaggagcagcgaggagggggcacacugagggagaaggacccagggcagagaggcacagaggagagggucagagggacgcagagcagagggucagagggacacaaggacagaagggcgggggcaugcauaaggaggaaacacagagucaacaauccaacucagaugcgucagagagguagagggaccaagggcaggagaggagaaugcguguuggaaaugucaaggucccauuuccuuguccaugacagucccuaaacaggucagggaggggggucuacuucuugucccaugaguggacugacaucuagugcugucuuuucccucccggagacucgggagucaggguuccccgcuuugcugagccuccuaggaaagcuccaggacgugugaagggagacccacccuugacguuuguuagggagucuccagaagccaacaccucugaccccugaccucuguucuccucgggucuaggaggcaccauguggggauguuggcuggggcugcucuugcugcugcuggcuggccaggcugcccuggaggcccggcggagucguuggcgcagggagcuggcgccagggcugcaccugcggggcauccgggacgccgguggcagauacugccaagagcaggacaugugcugucgaggccgugcugacgagugugcccugcccuaccugggagccaccuguuacugugaccucuucugcaaccgcaccgucucugacugcugccccgacuucugggacuucugccucgggauuccaccccccuucccucccguccaaggugggcaccgagauggccagcagagcggccaccuugucacucccagucccaacgaggcucaggaacaaggcugauaauggguauuuccaggcuuugaaaaauguagaaaagaaauccucacccuguuuccugccccucuggaagucccucguguggucuuacuugacucuuucaagcaacacugaaaaaaaauaguccuguuaggcccuagggcagggcagacaggcuccagcacuaucucucagucaguauggggaagguggcagccccaccugcugacucauccugaggcugauagagcacgaagggcccagccagguugucauagccagagaccucacuuaggauucagcaccucugagaauggccugcacguguccuuucccugucccaguaggagaacuacggaaguccuuccugucgcaucccaaacccugcugggcuuugggcuaaggaaaacccaugccuuaguugcuuuauaucaaaaugcugggccuuuuaaaaggaguugcuugccuuaccugggcuucaguuucuuuccuaaagcuccuuccaugcccaugggcaagucccaacucauuugagugacaaaggguaccaggaaugucauggcuggcauccaggugaaacgacauggacccaaacggaguccuugaacagcuuguguguggcacccugugugggaacccguggauguucuaggauguaguuugggauguaguuugucucuagauuucguugggcugggauuggugugugauuaccaccagcucgggagguuuggggcugcuccuccugaagucccucguguagucuuacuugacucuuucaagcaacacugaaaaaaaaauccucgaggauuuagccauuucuucuuuccuucucucccucugguagggugcaugcaugggggccggaucuacccagucuucggaaccuacugggacaacugcaaucgauggugagugugagagauugggguggacucaauuugaucgcuauguggcaaacagacuuggccccaaccccuaucacccauuucccagggaugaguucuuuuuguucucugggccucaaguguuuucaucuguaauguggaaacuuucaaacugaccacgccaucucauauaauaagauucuagucacaagccugggaguggucagccaucguuagguuggcugggggccacaccuaagccagaaguuuuucuccacuccuccugguuugggcuggccaccuucccagcugggcuugcugucacaggagaguccaaggggacgccaggaaggaaaccucugcagcauccgcuguccugggcgggaugaagggucagggaugacugcguuggccaucagccaguggccugcagcagggccuucccuggaaugugcccucucccuacccccaaacccccaguuccaggcagggggaggaaggggccauggcuagcccauccucagagcugggaaguagaucagguggcaacuauggagaccuuacuggaaacagaagggucucugcugcccugaaccugccccaccccucccucugccuggacugagaggccccugggagaaggaaacuuuuuggaauguguugcacauagcuguuugcuuugccucaugggugaggggugccggggucacugugggaacagggagaccauguguccgugggugcuggcaugugucugggugagggagggugugugugugugugugugugugugugugugugugugcgugcgugugcucagaagggcggggugucugcagaauucugcugcucugauaggguggcugccaagggguuaacguuucaauugcugucccaggccccucuggaaugcugggaccugcuguuaccaguccugucuagaccugcuugaacagcccuggggcucaugagaugaggacuggaaagcauuagcugaccccuucaggacagguccuggugccugagugccgcaaguauccaucccacuugcgaggggaagauugucuauaugccuuccaggcuggacaucaccacacagggacucuuccucaggucauguugaggaguguugaggaagguaaaagagggggcaucccuauccccacagcccccuccugcucgcuugagcaccacccgcagacaucagggcuaaagacccagccauauuggggcuuggcuccccuugaggcuccuuauaagguggcauuggaggcagaugcccuggggugccuggaaggaggcugguuagcaucuuguaauagcagaguuaugagcuuguaaaaacauuguagaaucccuagaauucaggccuccagcugaugccuaauuacugaagaccuacugugucgaaggcacuguguugggcccaggagguuacagcuggagggagacagacccaugggagcuuguagucucccagaggacacaggaaagcaacacauacgaugucacgccaaacuggcauggauguuacacaaagagggaagauaaguggggggcgccuggcuuuaugauggaguauuagacaaacaagagacuuaugcacucagaagggguaccacugaggggaaagugggacauaggugaguucuuuuuggugggacccucaaacaucagagaccggagaagguucagccauguuccaguuucugaguaucuaagggaaguucauucaagaccucaagucuaacugaaaucacucauggaucggccuggccucagagcaucugggacagggaugcugagugagcugaccugguuuggcaucagaggaggaggggcaugaagauagauagguucaugauauguaucuuuggcacgcacugacagggcacaugucagguucacgguagacuccagcaccugaccucuaagaugaggacagugggaggagcagaccaggggaaggcuggauggcuuuaaucugaaaugccauuacacaucuuuuuuguuuguuuguuugcuuguuuguuaguuuuuuuuuuuuuuuuuugagacaggguuucucuuuauagcccuggcuguccuggaacucacucuguagaccaggcuggccucgaacucagaaauccgccugccucugccucccgagugcugggauuaaaggcaugcgccaccaccgccgggcaccauuacacaucuggagguauggucagcugaacaugagcuauaaaagaaggagggggacccagggcuccugauaugugaacaaugaaagccgaaagcacccacaaugggccaagcccuucagaggcuugccacggaaucccuggaaagugguacuaggcauuguccucgcuuugcugaugagaacauagacagaggguguggggcucuaaaaauaaccuccucgaggccacaaaacaguccagcaggaccaguccauggucuuagcugcuuggcaguacugucucaaucuuucauguacucaauagcuauaaacuaggaugcagguucauaaucccagcuaugcuggaugcugaggcaggaggaugcugaggccaaagguaguuggaacuccagagucauuuccaagccagccugcauaacuuagugacacccugucucaaaagacagacagaagggaccguggcccagggaggaacaucugcuuaaccgccauaggguucagucccaaagacaacgaaaaacaauauuuacuggaugaucaucauuuacaggucccccccccgacccccaggggcuaagugggcugaggauguagcucaguagagugccagccaaguagguuagaagcccuagguuugauccucagcaccaccuaaaaccugacuuggcggugcagaggcaggaggaucagaaguucaaggaccgucuuggggcaaaauagagaguucaaggccagcuuucgauacgugagauauacuguaagaaaaaaaggcaagguggggguggggguggcgacgggagaacaggucacagcgcuuguugccgugaaggacucuggcucuuuuucuguggugugaguggaggguuggagcagaggcgcgacgugucuuagccuuaacaggauggcugcggccacgugggguggcgcaggguggagggcgggccagggagacuguagcagccaucaggugaaagguggcugggcagagguggccgagagagaaugaggcacggucuggauccggagugcacuggaucaacgcgugaggggucaaaggugacuccaggcuuugagucugagcugcaggaaguaacaugaucuagaacuuggacccacauuaagcagaaccuguugcuacacccccacaauggugauguugaggaacuacgagauccugggcagcagagauaaacuuaagaauuguggacuugccuuucaaagccaccaggcugggugggaccauucagggguuccacuccagugacuggcucagaaucccaggcccacauggaucucuggggcucuacagcccccagccccuuagccacaauuucuuuauuucuuuucuuuuuccauucuagcaccugccaugagggagggcauugggagugcgaccaggagccgugucuaguggacccagacaugauuaaagccaucaaccgaggcaacuacgggugagaggcccuggguaucagugggcacaggagggugcauaccugugcacacacaugaucaucacacauggcuauuaugcuacgcacacauguuagaacugacuucugucccuuguagcugucacggcuccaggaccucuagccuugacagguuugacuuucccuucucuccuccagguggcaggcugggaaccacagugccuucuggggcaugacccuggaugagggcauucgcuaccgccugggcacaauccgcccauccuccacugucaugaauaugaaugagauuuauguaaguccgugcucgcccacaucccuaccaucuaucucccaaugacuuagcacgugggaacgaugagccucuucuuguccugccaagagccuguccuccaggaugaggcuguguggccuugggcauaucauugccuucucugaugggacugugcuuccaaaccuucuggugcuugaagcagccccuccugccuccucagccugggaaaaaaugcuguuggguccaguacagcugggucaagacccaaggggccgagggggucaccuugguauuuuaggaaaagagggacagacagcucuggccagaaagcaacaauucucggaaaaacugcugacucagugaauccccuagggaggagggggcuucuguuuuuccaccagacccugccagucuuagggagagugggggcagguaaagacucccaugcagccugggcagggcucugcuguccaucaaagcagacagggagaggccaggggacuucugcucaaggccagggugaccagccccuggcccugccuuucucccuggggcugcuuugcuauuuucugcuguuugucuuggcggccugccuggucacgggaccuuacuguuucuucccgccccuguccuuuggggcuuggaggccacugccacggcaggaaggaggguguggcugaucagaagguacagagaaaaguggcaggagaagagagugggaagcggguggcccuggcugccgugccucauuacccacguguaaucuuugcgggucccugaacagggcugauuauuccacucaaguaacgggaaugccacuaccccaccccacccccagaagcagggcaacaccggaucccaaugccggaggcucuggauucucauugugccuccaaagcguggguucaugggaugacaggaccaugcuagaaagcaaguggaaucacuuuuuuuuuuuuuuuuuuuuuuuuuuuuuuuuuuuacagacggugcugggccaaggggaagugcuacccacugccuuugaagcuucagagaaguggcccaaccugauccacgagccauuggaccagggcaauugugcagguuccugggcuuucuccacagcagguguguccaggggcaggagcuggcacuagagaggagggccacggccuggcuucugacagcucuuucugccuuccccacuagcugucgcaucugaucgcgucucuauccauucuuugggacacaugacacccauccuaucaccgcaaaaccugcuguccugugauacccaccaccagcagggcugccgaggugggcgucuugauggcgcuuggugguuccugcggcgccgcggguacgcacgcgcacagggguugugggcuggaagaggauauagcacccuuuagaaccuaggcuuuguggugccauagcgcuauggcucuugcuucuuucucuaggguggugucugacaacuguuacccauucuccggccgugagcagaacgaggccagccccacuccucguuguaugaugcacagccgcgccauggggcggggcaagcgccaagccacuucccgcugccccaauggucagguugauuccaacgacaucuaccaggucacgccugccuaccgccugggcucugauguaagucuaaacaugggaagggcggagaagcaagaguuggggguuugguccgcuaaaucuuacacugauggaccuuucuccacccccacccccccccccccaggagaaggagaucaugaaggagcuaauggaaaacggcccuguucaagguaaccauccccaggcuuucucugguuccagaaacuucuugcuggaggcugggcgcagggccuaagaaaucucuccaacuuuagguaccagaugcaguuguaagaggaguggaggguccguuacccuuucuuugcaggaagcuccuacuuaaaucaaugucuaauaugaggcucuggugucuggaugcucagaauagcaggccaagcccugucuuugucucugcccacagcacucauggaaguacacgaggacuucuucuuguaccagcguggcaucuacagccacacaccuguaagccaggggaggccggagcaguaccgcagacaugggacucacucagucaagaucacugggugagugagguuccugagggcacaugggacuaggagcaguggcauuuacucugggaauucucugaaauucuuuguguucucugccaaacugaggcugcuccucccuccucccauugccaaaaaggaaacagacacagagaggaggggcugcuugcaggggugcggggaccgugaggagcuuugaagggugucugggaacagugaaacugcccccuugaauuugagaauucaagagcuaauggggugggguugggggagcgcauccgggaccucagcacugagaugugggcagaaggauucggagcuaaaaggucaccuuugccuucaacuucacgaguaguuuggacuaugugaaaccuugucucaaaacacaaacuugucccaacucuggccaaccacugagugacaggcuaugcagagaggggugaacacucaucaggucccuggcuacgcucagauuucagaagucacagggguagcuugggggugcugcgauccagauguugagacccggugcaagcagugcccccucucccucuugcuuugccgcuagguggggagaagagacgcugccagacggaaggaccauuaaguacugggugagucucuggugcgaggcugagucccaaguuccugcccuucugagcccuccaucaucugucuuuugccucaugucucuccccuuuucacucccagacugcugccaacucguggggcccaugguggggugaaaggggccacuuccggaucgugcguggcaccaacgagugcgacaucgagaccuucgugcugggcgucuggggucgcgugggaauggaggacauggggcaccacugagucucagccacuaggcgaggugggauccacagccacagaagaggccuugggggccaugcccgaugaagccuugugugcacuucgggaccaggugcuaaucucuacagacucagauccgcgcgugcgcgcuaaggcagaaucccaccuaggagacaaagaugcaccaggcuggcggaagcccccagauaucacagccggaacugggaagggcccuguuuggaaacugcagggaguauagacagauuccaggucccuggucagccaggccaagaccacaggagcuaagacaccccaaccucaucacccuccuacccacccucucucucaucuucuuuuugaugaauucuguccaucucccuagccuccauuuugguuguaccuuuccauucucaguacugcuuucuuauucuuuaaagauauuuauuuuucuuuucauuaaaauaaaaccaaaguauugauaauuacagugucugggagucuucaagguggaaacaaaaaacaaaaagcaaaacacgucaaagcuggaguggcccauggcuagacaacagaaagaacuuccugaaagcugagagcaggguacaagcuugugcucccagcacuugggagguagagacacagggaucugaguucuagguuaucguuggauuagguaguaaaccugaggacaaccuuggaguguaugagacccugacauaagggcagggagaggggugggagagaaggauagcacaucacuggguggcaggcagggguggauaaacaagaaaucuuagugcccuuuccauuauaauccucugcacccagccacuugcaggacacacacacaaacacacacaaaugagagggcguggcccggcccuccaauuaacagaaguaauccaguagguagggacugacccuggccuuucccuauuccugagacaaguugggccccugacagaccucucccuauaguacauccccaggcucucagugccuaauagcuagugguuacaacccuucccuccccuccucucccaucuccuuccccucccucucccccuccccuccccuccccucccaccccuucucucucccuucuuaaccucucuuuucuuucugucaaggucuccuguucucccaucccaggucccagccuaauuuccaggacgcagggaccugugugacaagccuccuaacccugugccucaguggugcacaccuacaaucacaguacuuggugcuggaggcuacagagcaaguucaaggccagccugggcuacgugaaaccugucagaauaugacagccucaggagcccucucugcuccucaaaugaugagaacuguugguggcuuauaggcaauucugauaagaucuucccagggaccuagcaaucaaggccauuaacuguggccaccaggugugggugccacauaaaaggacugcuucccaugaucgccccaguuggcucucucuuuuccucucuguucccacauguuccuggugggucucuucccucaccccccuuuucuguccuuucuguccccacuccucuguccccauggcucugcucccuucucuaggcccucacuccccucccuuccucccaaauaaaucuccuuuauaccaggu

SEQ ID NO: 2147 - RNA, 2120 nt, Mus musculus
aaaaacaaaaccagaguuuuuaauguauuuucucuaaugauuuccaaauaucucccauuucaaagaugaaacugauuccaagugacuuaagugaacugcucaagaccacauggcauggcuaguauagcugugaucgggucuagaacacagaucuuuuugccagcagcuguccgccagccccagaucuccagcacuacauuccacacuccauguaagcagacugcucuggucccugggucucaggccucucaggcuuugagagaagaggcuccuugccuaaagccugugaccuugaaucagaaaccaucccaugcccucccucccuuggcaccugcucuaucgcugaggucaccagggcuccaggcccagcccugaggcccgucccuguagcuuuggcagaauuggaccucucagccuuuuggcaacuagacucuccaaaggaaucaagacaggggugagaggacuuuuccucacuggccuccuucccagaacagcccaugggugggagaaaggaacuuccacggggacagaggcccaggaaggaggccucaccacacugcagguauacuggucaggcuccagagcucugguaaccguuccggaaugacuacccugcacaaccuucuagaggccaaaguucugugcuuaccacuccgucccguguagagagcucagaaauucauuuaugucccucuuccucugaauccccaagucaggacaggucccuccuagagucacucccagagggaguacuuuagccuguaccuugauccauguggacuucuccaaagcagggcccgcacaaaccaggagcuuacuuugagagaguaucuugccuuggcucagacuggcccccaacucaggaaucucuugccuccaggugcaggugccguauuaacuguuggcucaagccagagcagcggcacacagcuguaacccaggagacagaggcaggagaaucuuuaguucaaggucaaccccugcuacacauugagaugcugacuugguaauaauuaaacagaaacugcugaacuaaggaauaggcuccacugagguucccuuacucaccuguaaaaaggggaugauaccaccuaccaacgaaaaaguugagugugaccaugcccugaaguaggcuacaaccaucaauagucgggucuuauuuaauaacguacuuuaaggugacaagcagucuaguggcagaagucaggggaaaaaacugacuucagcagagggucgcggcuuuccgggaguuaagguggccgaggccggaagaacccucugaauagacaaauugucuucgcggagugaagaacgacccuggcacaagcucagaggucaguaaauaaagccugaagcgcuuucaggcagcggcgacgggugggacugcggagaaaggcgcaggcgggagacauuccgcagggaggggcuagcacguguggggcuagcaugagggaagcaaggucacguucuccgccagcaggugaggcgcugggcagcucagccauccgcgguguccaaggcaacucuuuuccacuugucugguaggagcaagagggcucaaaggccacuagaccaugcucucuguccaggcuccaauucuuuuuuacuuacggcgaccgcgucauuccucuccgagccucugagccucuucuacaagaagaggacauaggaccguugagauggguuuuuggguaaaggcccuugcugucaagccuugacaaccccaguuugauacgugggacccacacgguggaagcagagaagggacucccgcgaguuacaacgaacgccccagucucccaccccuuccccauaaguacgccuacacgagcauacacaauauaagaauaaaaccacagcgaauuaaaaaacaaggcggcagaaggaucaagcggcguuucuccagcguggcaccagcucaagggcgaguuuccuuucaguauggccgggggaugcucuacuuggguugcgggaagcgccccgcagccaggccagggauggguuagauggcaccaacaggaccgcgggcgccgcugacguaggcgacgggagggcugugggggaugggccccagcccuuugcgggagugcaagccccggcuuccuauuucgggagcgagg

SEQ ID NO: 2148 - RNA, 6874 nt, Mus musculus
uaggcgacgggagggcugugggggaugggccccagcccuuugcgggagugcaagccccggcuuccuauuucgggagcgaggggugugggccacuuucaucaugugaugcgagggcuauuuaaagaggcuguccagccgggagcugcgguucucagugccugcucgccuccucacucaucgcaccauggcggacgccuuugucgguaccuggaagcuaguggacagcaagaauuuugaugacuacaugaagucacucggugagcgaacgaacggcgcaggaucuagggucaggagggccggcaaggcggucuuggcgcugagcucccagggggagugcccccaugugccucccgcaagcuccuagccaguccagacagggaauacugaggugcggaggguggccugggcugaagccacuccacuccaccccaccccaccccggccuccugggaggggggugucgcgguccaagcuuggcgagccucguagcuggaggggaaggguagaggcagcuguggccgcagagguccgggaugggaggcuuucuaggaagcaguguaggugauccggagguggaaaggggagggaaagaagggcgggaggcuggccgcaggagaaggcaaagaggagcauggugguccagaaauugaauuccgaaagggaauagagcagauaggaguguacagagccuggaggaagacuaaagaaaaucagugaauuccaucugggaagaggugaagauacagccaggcagucagcaacaagcccuaccccuccauguugggguagugaagaggccucucucuggaagaugcccugguucucaccagccugaccuucaccuacagugugugcagccaccccugggaucagucggagacgcugcugcuagagcagggcaagacgaccacuacacauaggcuucccggccgcaccagucggccaccggaucagugcuggggauagggugaagaaagccugggaucgagcagagggugucagaagaaaggugaagagcuaugaagggagaguguggcuuggggcuggggaaauuguguggugugggcggugacacaacgccuuuaaccagcacucugggaagcagaggcaggugaaucucccgaguucuaggccuggucuauacagagagaauuccaggacagccaggacuacacagagaaaccaugucuugaaaaaaaaaagaaaggaagagucccaugauuuacuuaauaggaagacagcuugggacacaugagcucaucgccucauaggaaagcccaggauuucuuuuugaagacugaacuagagccuugugcaugcccccuacugcugaguuauacuccccacucacacacacacacacacacacccucuuuuuacucuguguaacagguucucacuaacuuccccagguuggcuuugaucuuguaaccugccaucucggccuuccaaauaguugagaacccagaacuaccuagaguucuucccauuucaacaguggggaaugucacaugaaccacuuauccaagacggccccagcccuuccuuucuugccuugagcuuagauaaagaccucuaccugcggagucccuggcuauaucauccuggucuaggaggcuggggcagggaaaacaggacugugucaugccugagcuagcuuccacuccgucuuccccgggaaggagggcuggaaucggacauguugagggauguguguaguugccucucaccuacuuccagcucuucucugaaacaggcccacaaagcaauuuguccuuuugguuuggggaauggaacccaaggcccuuugcccgugcuaagcaagcacugcgacugcugaaccacaucuccagacagggcucccaccggcaccuacccuacccugaggcucuccaggaaggcagcuggucuugucuuuuaagacaggguuuuacuguguaucccuggcucuccuggaacucccuaaggagaccagguccuguugucucugccucucccgcacugggguuagagguaugagcccacacccagcuaguuggcugucaaguuagggaguacuagauuaccugggcuuaguucuguuucacugagcugccgcugccuuccuagacuucuuuuugccucagggcauguugucuucaggccauuguucugugggugcugaacccagcuuuagucaggggacugaaauucuauuuagccuaaaaauaucgacaggcugaaggccaguaaagucuagaugcaccccagcuuccagcaguaacuggcuucacuggcacccuacaccuaccuguagguggguccugggaaaacagcuugguucacugcugaagcccaacucacacagauaccaguaggcaaagccaagccucucacuucuugcuguguagccaaagcuccugacuuauccuauagaaccaaagguucuuaggacaaagcagcccagccuaguuuaagugacuucaagcacagaugguggcuugaaggguagaguauguuauuccaagaaugauauagugagacuaaaagagaguuugggaaucuaugucacuaaacucggauuauuuauuuacuuagccuuuuugagacaggguuucacuauagcccauacucuggagcuacgcagcccaagcuggccuugaauucucggcauuuccccugcuccaguccccugccucuugagugagauucuaggggagucaccaugcuuggcccguuugacuuuggcuaagacagcaccgugucucagccucguuuguaaauggaaacuauaaagcuuagguuuagggcugucccaaggauacuuggccaccacuuagagcuugugcagugugcacagcuugcagcagaugcacaauaccauagccuuauauugggcugccuccugccacaucgcugaggauggcucagagugugcuggggccagacgacagguagucaaccauggaagauuccaggaaagcuacuaacccaaagcaccaaaggcuugacccaaggggucugugaacuuuaccugcuugagggacaccugggaccuugccuaggacucagauccaaugauuaugucaggagucuccccagggacuuccaagucaugcaguugucgcuacuuuuuucagcccucuacgucugugguagacaagacuccuuuguaucucuaaccaggaggcuuugaaacugacgcugccauacagacggcagagagcacugcugucucaguuuucuggguggaaaugggagacgacccuuguccaggggacucuagaaggcaguugacgaucucuugguucuucaguccuguucuguguguucaggagacuagaagccagcggguacccagcucuggagcgacacagugcuuagcagcuuccaucugaauugugacccuguucacaucuacaaaaucuuccaggggcaggacugcgugaggggcuggcuauguggcucacaccccaugguaccuuccuugccgcuguugccgacccugcccugcauccacaugucucauauuugacaugaguuuaacagcugccgagcuaagggaaagagcuaagggaaugagaaaauggccccacacaaagacgugggccacugaggaucgccuuccccaugccuaggccacaaacuucucuuugggucuauauaacacgucucuacccuaccuaauguguccucaacuaucugccccugcccuuaggugugggcuuugccaccaggcagguggcuagcaugaccaagccuacuaccaucaucgagaagaacggggauacuaucaccauaaagacacaaaguaccuucaagaacacagagaucaacuuucagcugggaauagaguucgacgaggugacagcagaugaccggaaggucaaggugagucagagaaaggggauggagggcacuggauggaacaccacaggguaagaggcuggcccucuuagcuccuuggcuuuuuaaccccaaggggcagguucauaaagccugcucagugcugcgauggcccagggacuaaguauaagcucuggccuguuuucuucucaccuuccugggaaggaucuaucagcugucacuggagugggcagcagagccaagauauucuuccgaccuugugccuccagcuccagcugggugaccuuguacaccaagguacccaguggcucugaggacaucagcagccauggcugugaccugaaguguuuuaggaaugaugcccagaagucagugcucuacagcgaggucauccuggcucuggcagcagaggaggcagcugggaacaacaagcugaguucuauccacagguuuccugcucuguagcucccaggcuagaccacugaccggaacaaacuguuuccagugccaccaguugacaggcaccugcguuuaccaacaggagugcuguuggguguccauagucucuucaaguauuuauuuaaggguaugggagggagugucuaccuccagugaugcucaguuaucucauggugguuaucuucuuagcagcuugcucaaaaucucccagcacugggccacgcacagaacuaaguaacaucuguaucuauagguuguccuuauacaguauccucuacaucacaacccuaaaauucaucucuucagcucuuuccuccucacaguugcccccagaaagaacaggguagguaccaaccagucuugcaguuacagaggcgcuaaagcccagcccaggaccacacagcaagcuggccgugaagauggggaaggcgcccugcugcacccugcuccaccacaugucccaccuaccuacaucuuugaacuugccaucuuccuugagagaccagauuucacauuaaauauaacagugguccacugggaugucuggacaauggggaaugaagauuccagaagguggaauauagacaggaaagagaugagugacagccaucaccuuucuagacuccuaccgacaaacccugcuuagcucuccuucugaccugcaacucccaaauuccuaaagcagauagauuuggggcagcugcccaacacgaacuagcugagauaggcuggcagcaccaaggaccgaauggucacuggagcuagagcuagagaacacuccaaggaugccuggguccuugguccaaggaccuugcaauugccgcucuuuugccaguuaagggaggucacaugguagaaacaaaagucuaauuugccaauauaucaaggcugagcugccugccaugcccacugccagagggccccgccccugcagagcaggaagcuugggcagcugggcuggaggugggcugucugcugaucccagcaccaucacugguuagguuccugguuuguccuggcucuggucacagcuuaggcucugucucuuuccacagucacuggugacgcuggacggaggcaaacucauccaugugcagaaguggaacgggcaggagacaacacuaacuagggagcuaguugacgggaaacucauccugguaagaugggcagugacgggccuuaaagcaacaaguaccacaccuucuccagcccgacuaggacaagagaggcaggggugggguccuggcuguggauuuacacaggucuugguucaagcaucagucuaaaggcuaucugacaacacauaaccuucaagggccacugaaaugggggcugcugggaggccaguguauucagaguccaaagcacuggccaaaugggaagaacgcaguaggcacccacaaacacuuccuccugcuugcuguucccugggaagaggcagaaagcaggaccaguagaucccaggcuggagaggagcagcugccauccucuccccuccugaguagaaaugcaggagucugcaggaccaagugugugccuggugggcacugccagggagcagcccccuccuuacucacaauuuugucuacugcuccuggcuuccuggaaauaucuauugucuagcuaggaggugauacaaccaggccugcagaucugcuuugggacaaguuugaaagcaucccuggaauagucccuacauccucguaggacuguaccugggccaggagcauggaccacaaugucagcaucacagaccugggucgcucaguggaacccacugauugcauauucacaugagacugggguucccacugaguuagaagugaagggccuagcucuggaagggagguaacaaagaggaucauguucacuagguagcuagaguaaggugaggccauggcugggcucuacagugccagaauacugcauguuaggggagggaggaaaaguuggcagcuuagcaguuucucaaggcucuguucuuaucacccguuugucugccacauacaccaggcacccccuuaggcaggugcugaaaugaacacaaaggaggaacaggaauguacuggaucuugaccaguuuaccuccucucucaagggccuauuuuucccccaaaucucuaaaaugcuaauuauaacaucuuaaaagauuuguaucagaaaaaaaaguaaagugccuggcacacaguaggugcucaagugcuggucaggaugaggguggggagcacucccuccucugcucugccccaucugaaaccugucuuucuuucuagacucucacucauggcaguguggugagcacucggacuuaugagaaggaggcgugaccuggcugcuccgucacugaccgcccgcuccucugccaacuggccaccccucagcucagcaccaugcugccucaugguuuuccccucugacauuuuguauaaacauucuuggguugggauuuuucuggagauacggggcaucagccuggacccaguuccuacuauguaugugguuuauuuuuuaaaacuguauccaaagggugcuccaaggucaauaaagcagaaccaaggccacccaguug

SEQ ID NO: 2149 - RNA, 6874 nt, Mus musculus
caacuggguggccuugguucugcuuuauugaccuuggagcacccuuuggauacaguuuuaaaaaauaaaccacauacauaguaggaacuggguccaggcugaugccccguaucuccagaaaaaucccaacccaagaauguuuauacaaaaugucagaggggaaaaccaugaggcagcauggugcugagcugagggguggccaguuggcagaggagcgggcggucagugacggagcagccaggucacgccuccuucucauaaguccgagugcucaccacacugccaugagugagagucuagaaagaaagacagguuucagauggggcagagcagaggagggagugcuccccacccucauccugaccagcacuugagcaccuacugugugccaggcacuuuacuuuuuuuucugauacaaaucuuuuaagauguuauaauuagcauuuuagagauuugggggaaaaauaggcccuugagagaggagguaaacuggucaagauccaguacauuccuguuccuccuuuguguucauuucagcaccugccuaagggggugccugguguauguggcagacaaacgggugauaagaacagagccuugagaaacugcuaagcugccaacuuuuccucccuccccuaacaugcaguauucuggcacuguagagcccagccauggccucaccuuacucuagcuaccuagugaacaugauccucuuuguuaccucccuuccagagcuaggcccuucacuucuaacucagugggaaccccagucucaugugaauaugcaaucaguggguuccacugagcgacccaggucugugaugcugacauugugguccaugcuccuggcccagguacaguccuacgaggauguagggacuauuccagggaugcuuucaaacuugucccaaagcagaucugcaggccugguuguaucaccuccuagcuagacaauagauauuuccaggaagccaggagcaguagacaaaauugugaguaaggagggggcugcucccuggcagugcccaccaggcacacacuugguccugcagacuccugcauuucuacucaggaggggagaggauggcagcugcuccucuccagccugggaucuacugguccugcuuucugccucuucccagggaacagcaagcaggaggaaguguuugugggugccuacugcguucuucccauuuggccagugcuuuggacucugaauacacuggccucccagcagcccccauuucaguggcccuugaagguuauguguugucagauagccuuuagacugaugcuugaaccaagaccuguguaaauccacagccaggaccccaccccugccucucuuguccuagucgggcuggagaaggugugguacuuguugcuuuaaggcccgucacugcccaucuuaccaggaugaguuucccgucaacuagcucccuaguuaguguugucuccugcccguuccacuucugcacauggaugaguuugccuccguccagcgucaccagugacuguggaaagagacagagccuaagcugugaccagagccaggacaaaccaggaaccuaaccagugauggugcugggaucagcagacagcccaccuccagcccagcugcccaagcuuccugcucugcaggggcggggcccucuggcagugggcauggcaggcagcucagccuugauauauuggcaaauuagacuuuuguuucuaccaugugaccucccuuaacuggcaaaagagcggcaauugcaagguccuuggaccaaggacccaggcauccuuggaguguucucuagcucuagcuccagugaccauucgguccuuggugcugccagccuaucucagcuaguucguguugggcagcugccccaaaucuaucugcuuuaggaauuugggaguugcaggucagaaggagagcuaagcaggguuugucgguaggagucuagaaaggugauggcugucacucaucucuuuccugucuauauuccaccuucuggaaucuucauuccccauuguccagacaucccaguggaccacuguuauauuuaaugugaaaucuggucucucaaggaagauggcaaguucaaagauguagguaggugggacaugugguggagcagggugcagcagggcgccuuccccaucuucacggccagcuugcugugugguccugggcugggcuuuagcgccucuguaacugcaagacugguugguaccuacccuguucuuucugggggcaacugugaggaggaaagagcugaagagaugaauuuuaggguugugauguagaggauacuguauaaggacaaccuauagauacagauguuacuuaguucugugcguggcccagugcugggagauuuugagcaagcugcuaagaagauaaccaccaugagauaacugagcaucacuggagguagacacucccucccauacccuuaaauaaauacuugaagagacuauggacacccaacagcacuccuguugguaaacgcaggugccugucaacugguggcacuggaaacaguuuguuccggucaguggucuagccugggagcuacagagcaggaaaccuguggauagaacucagcuuguuguucccagcugccuccucugcugccagagccaggaugaccucgcuguagagcacugacuucugggcaucauuccuaaaacacuucaggucacagccauggcugcugauguccucagagccacuggguaccuugguguacaaggucacccagcuggagcuggaggcacaaggucggaagaauaucuuggcucugcugcccacuccagugacagcugauagauccuucccaggaaggugagaagaaaacaggccagagcuuauacuuagucccugggccaucgcagcacugagcaggcuuuaugaaccugccccuugggguuaaaaagccaaggagcuaagagggccagccucuuacccugugguguuccauccagugcccuccauccccuuucucugacucaccuugaccuuccggucaucugcugucaccucgucgaacucuauucccagcugaaaguugaucucuguguucuugaagguacuuugugucuuuauggugauaguauccccguucuucucgaugaugguaguaggcuuggucaugcuagccaccugccugguggcaaagcccacaccuaagggcaggggcagauaguugaggacacauuagguaggguagagacguguuauauagacccaaagagaaguuuguggccuaggcauggggaaggcgauccucaguggcccacgucuuuguguggggccauuuucucauucccuuagcucuuucccuuagcucggcagcuguuaaacucaugucaaauaugagacauguggaugcagggcagggucggcaacagcggcaaggaagguaccauggggugugagccacauagccagccccucacgcaguccugccccuggaagauuuuguagaugugaacagggucacaauucagauggaagcugcuaagcacugugucgcuccagagcuggguacccgcuggcuucuagucuccugaacacacagaacaggacugaagaaccaagagaucgucaacugccuucuagaguccccuggacaagggucgucucccauuuccacccagaaaacugagacagcagugcucucugccgucuguauggcagcgucaguuucaaagccuccugguuagagauacaaaggagucuugucuaccacagacguagagggcugaaaaaaguagcgacaacugcaugacuuggaagucccuggggagacuccugacauaaucauuggaucugaguccuaggcaaggucccaggugucccucaagcagguaaaguucacagaccccuugggucaagccuuuggugcuuuggguuaguagcuuuccuggaaucuuccaugguugacuaccugucgucuggccccagcacacucugagccauccucagcgauguggcaggaggcagcccaauauaaggcuaugguauugugcaucugcugcaagcugugcacacugcacaagcucuaagugguggccaaguauccuugggacagcccuaaaccuaagcuuuauaguuuccauuuacaaacgaggcugagacacggugcugucuuagccaaagucaaacgggccaagcauggugacuccccuagaaucucacucaagaggcaggggacuggagcaggggaaaugccgagaauucaaggccagcuugggcugcguagcuccagaguaugggcuauagugaaacccugucucaaaaaggcuaaguaaauaaauaauccgaguuuagugacauagauucccaaacucucuuuuagucucacuauaucauucuuggaauaacauacucuacccuucaagccaccaucugugcuugaagucacuuaaacuaggcugggcugcuuuguccuaagaaccuuugguucuauaggauaagucaggagcuuuggcuacacagcaagaagugagaggcuuggcuuugccuacugguaucugugugaguugggcuucagcagugaaccaagcuguuuucccaggacccaccuacagguagguguagggugccagugaagccaguuacugcuggaagcuggggugcaucuagacuuuacuggccuucagccugucgauauuuuuaggcuaaauagaauuucaguccccugacuaaagcuggguucagcacccacagaacaauggccugaagacaacaugcccugaggcaaaaagaagucuaggaaggcagcggcagcucagugaaacagaacuaagcccagguaaucuaguacucccuaacuugacagccaacuagcugggugugggcucauaccucuaaccccagugcgggagaggcagagacaacaggaccuggucuccuuagggaguuccaggagagccagggauacacaguaaaacccugucuuaaaagacaagaccagcugccuuccuggagagccucaggguaggguaggugccggugggagcccugucuggagaugugguucagcagucgcagugcuugcuuagcacgggcaaagggccuuggguuccauuccccaaaccaaaaggacaaauugcuuugugggccuguuucagagaagagcuggaaguaggugagaggcaacuacacacaucccucaacauguccgauuccagcccuccuucccggggaagacggaguggaagcuagcucaggcaugacacaguccuguuuucccugccccagccuccuagaccaggaugauauagccagggacuccgcagguagaggucuuuaucuaagcucaaggcaagaaaggaagggcuggggccgucuuggauaagugguucaugugacauuccccacuguugaaaugggaagaacucuagguaguucuggguucucaacuauuuggaaggccgagauggcagguuacaagaucaaagccaaccuggggaaguuagugagaaccuguuacacagaguaaaaagagggugugugugugugugugugugaguggggaguauaacucagcaguagggggcaugcacaaggcucuaguucagucuucaaaaagaaauccugggcuuuccuaugaggcgaugagcucaugugucccaagcugucuuccuauuaaguaaaucaugggacucuuccuuucuuuuuuuuuucaagacaugguuucucuguguaguccuggcuguccuggaauucucucuguauagaccaggccuagaacucgggagauucaccugccucugcuucccagagugcugguuaaaggcguugugucaccgcccacaccacacaauuuccccagccccaagccacacucucccuucauagcucuucaccuuucuucugacacccucugcucgaucccaggcuuucuucacccuauccccagcacugauccgguggccgacuggugcggccgggaagccuauguguaguggucgucuugcccugcucuagcagcagcgucuccgacugaucccagggguggcugcacacacuguaggugaaggucaggcuggugagaaccagggcaucuuccagagagaggccucuucacuaccccaacauggagggguagggcuuguugcugacugccuggcuguaucuucaccucuucccagauggaauucacugauuuucuuuagucuuccuccaggcucuguacacuccuaucugcucuauucccuuucggaauucaauuucuggaccaccaugcuccucuuugccuucuccugcggccagccucccgcccuucuuucccuccccuuuccaccuccggaucaccuacacugcuuccuagaaagccucccaucccggaccucugcggccacagcugccucuacccuuccccuccagcuacgaggcucgccaagcuuggaccgcgacaccccccucccaggaggccgggguggggugggguggaguggaguggcuucagcccaggccacccuccgcaccucaguauucccugucuggacuggcuaggagcuugcgggaggcacaugggggcacucccccugggagcucagcgccaagaccgccuugccggcccuccugacccuagauccugcgccguucguucgcucaccgagugacuucauguagucaucaaaauucuugcuguccacuagcuuccagguaccgacaaaggcguccgccauggugcgaugagugaggaggcgagcaggcacugagaaccgcagcucccggcuggacagccucuuuaaauagcccucgcaucacaugaugaaaguggcccacaccccucgcucccgaaauaggaagccggggcuugcacucccgcaaagggcuggggcccaucccccacagcccucccgucgccua

SEQ ID NO: 2150 - RNA, 44827 nt, Mus musculus
cggagcuggcguucucccccgcccccucgggcgcgcagugcaucgugggugagaacgagcggagcagguuuggcguuccuagcuaugaagcggcuguccugcuaggcgcggacgcggagugaguguguggggaaucaggcggguggcuguuccaaucuggaaggugcgagguggugauaggccugagccugcccuuuucagcuaucagccuuagcagcaugggguggcaggaggugucgccggaaagagaagucccuugguaggcuggagcggagcuuuggcaucucuggcuccaggacucgaacccucagacggcuaucccuugacagcugcucugcaggaugccaauucugcgucuagcucugugcuggcccgaguccuggccuccaggcuucagugccggacuuggcugaggcggcggacuuaguugucacugauuuagccgucuuuuuaaaagggcuuuaauuuauguccccgagacagccagugaugaggaaaguaucagaugguucuuccgaagcacaguuuaguugagaaaucgaacaaucaugcuugcgugccaggucuucucgaaagugguccaaaugauauuuauugugcagugcguuugggggucauucugaagaaauaugguccucuaccccagagugugggaaacguguuaaacaaauuugauguuaaacaaaaaccauuugaucggaagacuaccuaaacaagcgaugccucuugcugugaguuacuaauauaaacuugaaggcuuuuuaaaggaaaagacaucugagcgguuccuaucugaugggacgguucuaauuaggggaagagaggaagggagaacguucugcacagaacagcagguucuaucagucggaaagaugagggagacacaaagagccgguguggggggagagagagagcgagagcgagagcgcuagcuuaaagugaauaugguaugggaugaaccuggaagucaugaagauuugcaggaaguugaagcuuuuacuuuaaaauuaauaggaagccagcgauaguuuucucucuccuccagaauguggugcaaaagaggacuugaucccucaggcuuaauggugugaugagauuggagaaagauaagagguuuacugggaguaaauagaccauuucgggagcaugaacaguaguucugaucagcaaugccagugagaaccaagcuggagcugugacugaagacagguuuaacaguaucuugagauagcaggggaguaaauuggacagaauagauuggaugaugcucuuagucccaacacuggaggcugagacaggaggucucaaaaccaaaagcaacaaaaccaaagcuagccugggcaacauugggauuuucaacccauaccaggcugcuagcgugacacauuguuucaucuucuuuuuuuuuuuccccuaagacagggucucaauauguagcuggagcuccugaaacucacucuauagaccaggcuggccuugaacucagauccaccuguuucugccuccccggugcauguauguauuugucccuuaggaaugcccagugcuagcaugugaacuacgauugagugcuagaaacucuaaccccaaguccuuuguaagcgugucuuaguuaggguuuuauugcugugaacagacaccauguccaaggcaacucuuauaaagccaccauuuaguuggggcuggcuuacaggcuuagagguuugguacauuaguaucagggcaggcauggugcaggaguagcugagaguuccauauccucaucuucuagauugaaucucucuggcagcuaggaggagugucaaagcccacccccacagugacuuccuccagcaaggccacaccuaucccaacaaggccacaccuccuaauagggccacucccugggccaagaauauacaaaccaucacaaaaaguaacaagugcucucaaucucugagccaccucucucuagcccuugcauagugagauucuagcucacagagccagggccugcugaugugaccucugguuucaguccuuagcacugcaagaagaccucuuccaccaaauaaaaauuuuaaaauugcuuaaggccucuguucuguggauagagcaaaugaaaaaaaggcaggguggaguggugcucuacuuuaaucccagcacucaggaggcaaaggcagguggaucucugugaguucaaaacuagucuguguuuuccauaguguucuugagacagagaaucgugucucgagagaggauggggggguguuauuagauauugcucuucauaauuuuauuuagguuuauuuagaauuauuauuuuauguguaugaaugcuuugcuugaauguauguauacuguauauuagccuggugcugaaggaggccagaagaaggcaucagauccucugggaguggaguuacauacuguuaugagccaccgugugggugcugggaaugaacccgaaucugcuggaagagcggcgcuuuaaccugcugaagcuuuaacagccuaauucugcaaggagccacuuuguguauuuccaugacuaauguguguggagaggaacugggaugucugcccacauuuugggugucccagugcuauuauagauucuauacuuggcuaauuaacuucuuaagugugguagugauuaguaaaggucucauaauagaaccaugaaguucaaauuaauaacacuuguucagccaugugaggcugggcaaaagaagggaaagucuggagaugaaaccgcauggcugggaaauaggugggggggggugcacucagucaugucucuagaauguuagaucagccucuauccuguguucauguuccugugugcaggugugcauguaugcacauguauggagaugagagauugacauuguauuuuucuguuguucuccacuuuacuuauugagauaguaucucucccuaaaccugaugcucacugauuccauuagauuuauugacuaccuggucccaggaauucucaagucacugccucugcagugcugagauuaugagccugcacaucugggcccagcuuuuauacuugggugcuggagauggaaaggaguucucauaauacaaagcaagucuuugugacugagccuucucaccaguccccaaaggugugcauuuaaaauuaaaagcacauagaaaaguuggagaaacacucagccauuaagacuucuugcugcucuuucaaaggaccaggguucaguucccagcacccacauugaguagucacaaccaauuuuagcuccaauuccaggggaucuucuggugcucucuucuagcuuauaguggcacacacacacacacacacacacacacacacacacacacacaaauaaagaaagagaaauuccuuuuuuuucuguauaacuuugauuggcuaggaacucacuguguagacuaagcuggucucaaacucagagaucuaccugccucagccuuacuuuuuagggggaggggguucaagauaggguuugucuguguagcucuggcuguccuggaacuugcucuguagaccaggcuggccuugaacucugagaucugccugccucugccuccugagugcucagaucaaaggaguacaacaccaguacccagcuaagacuucuguaguugauguuuuucaggccuggccaggagcauuagacucugggaucaaauucgacuguugcuaggucucggucucucucucucucucucucucucuuucucucuuucucucuuucucugucucucucucucucucucugucugucugucucucucucucucucugucucucucuguguguguguguguguguguguguaucucacugugcauuucaggcuaucuucaaacuuucuguucuuucuccccaaccugaguacucaggcaugcuaggcuuucuauaacuaagcuauauccccaaucauaggccucagacuuucuguguaccccaggcuagucucaaacucacgaccguuuccuaagugcagggauuguugguaauccaggcagaggucauuacauccagcuucauugcuagguuuuaagccuugugaucugacuccuagaagcuguucaucauuaauauacacuaaugaauagaagcuauauuuuauguccccugcacagcaguguaccuggacauaguaaaugcuugguaaauguugucuucuuaccauucuuacaaggucucauuguauaaccucggcuagcuuguggaucaucuggccugagaccucucuuucugauauguugagaucuaggcacacguacccuuucuuuccaaagucauugcaugacaagugaguagcagcaguagugauaaaaggagugagcacugcgcagggaugaugccacuggaguagugauucaggacaguaagguaggaaaaucacuucaucucaguucagcaggggucuagaacugggcaauacagugucaaaacagucaugcaguucugucaccaagucuugcuuaacauguaccagguucuagauuugauaucuauuaucauaaacgaacaaaacugacccuaaacaaagccaagcaugguugcacaugccugucaucccagcacugaggaggcggaugcaggaagaucuucacaagcucaaggguaaccugagcuacacaggaaaacucuagccucaaaaacaccccacaaaaauaggcuaggaagaugguucauccaguaaagauauuugcugugcaggugugcgggccugaguucaaaaccccagaguccacguagaaagcuguaguuacuuguguguaugaauccagggcugugguggagggaacaggguucacuagugcuggcugacugccuggcuagcuccagguuagugagagaucccgugucaagggaaaaagauggagugcccucaugcgcaccaauauacaggcaugcccauacaccguagacacaaagaaauguaaguaaaauuaaaagcaacggcagcaucccagacgaacuagccaaauaaccaaauccccugcguagacuaagaguacuagugauuggguaaguaacaaaucacaaagaaguggcauccagguucccagaugucccacaguuagaaugcugagaugggaugauaguacauuguguggccugacauuauuacuuuuuggagguuacccauggccugucugcacauuucuuucuuugcguuucuggggauaaccuuggggggucaugcugcaugcuaggcaaccucugccaugaccuccauacccagccccagucauuauuuccuuauuuguauguguuauauauguguucauauauguaugugcacggguguacaugcgugugugggcauguuggaggccagagguggauguucaguguccuccuuaaucacucuucaccuuaccuuuguggcguuugagacugggucucacugugugucuugggcuaccauggggaugaccuggaacccacagagauccaccuccucugccuucagagugcugugguuaaaggugcgcaucaccaggccuggccuccuuaccuuuugaaacacagucacccacgaggcuauccggucuauacaucacugacuuggggucugucugucgcugccccucccacugugguuacagacuugugccacugcgccuggauuuguaugggucugaacucaugcuuacacaguaggcgcucuaugacugagccauauccccagccccuccuucuuuaaugcagaugucucucuaauuguuguuucuuucugaaaggacguuugaauuagcuuuagcagaagagagauggaggagccauagacuguuaaggaugaauucaggaaggccugagaccauggagaacuugccugcacuguauacuauuuuucaaggagagguauguuuugcgcuuugaaacuucccuuuuagagaguguggaagcgucugagggaggagagcgucugggguuacuccacuagaggcugucacagaccuucucuaggccacagaccucugugaacucacuugacaccucacagcaucucuaccuuacauuuuaaacuuuuuuuucuuuuuuucacaaaaugggucucuuuaccagucuuuuuuucauuuuagcagaaggaaucgcuaucuauuuguugccaaagcuagaacucuggucauggcacuugauuucauccuuugauucgcuguugcccuuucuucuuuaccucccucaagaguccuaaucauaccuccagucuaugugcugauucaugccuuugcuaccucguagucugcaucucucgcuuggcucugacuggaauugccugcuucuauugcagccccucuccaauccguucaucgcucuguacacagaauaucauuccaaaacaaguuauggcuaggaauguggcucaguuggaagagugaccgcccagcaugcgggaggcccuuggguucuguccccagcaccacaaaaacaggguguggugcugugagccuguaauccuagcacugcggagauggaggcaggaggauuaggaguucagcucaggcugucaggcuuggaggcaagcucugccugcuaagccacuugacagcucuguuuuugcuuaauuuugaggccaggccucacucuguagccuagucuggucucaaaguuacucuguagucaagccuuggccucaaguaacagcaguacuuagguaucagccuuccacaugcuggaaauuacaaacaugaaugccuacacuuggccuaauauauguuuuuauggguuaucauuaugaaacaugaucugaggggagacagaacuucacagcuuuucaaaaaauuuuuuugagguagggucucacuuuguaguccuggcuggccuagaacucacuauuuagaccaaacuggccucaaacucacagagauccaccugccucugucuccugggugcugggauuaaagaucugcaccaucaacacauccagccuugaaguuuuucuuugagaggaaacuuggggaggaaaggguuuauuuuacaucuacaucacaggccauaaagaagucagggcagagagucaagguaggagucuggaaacaggaacugaagcagaggccagccggggaagaaggcugcuuuuggugugcuccccugggcuugcuuaacugcuuucuuauacgacucaagaaccgccugcccagguguggcaccaccuauagugggaugggcgcuccacaucaaucauuaaccaagaaaaugucccacaggccagucuggugagggcauuuucucaguugagguuccuucuucccagaugacucuagcuugggccauguugacaacagucuagacagucuagaagucuuuguguaguccaggccagcuuggaacuugugguuuccuucccacuaucuccagaaugcugacgaacuuccgaguccugaugcuuuuucagcagcacacgguguaagguucuccacacacacuggugcaugaugucagugcaugcuuccagucugcugucuguaacuugacaauugcaggcaaggggauccuaucuguuuaggcuagccugggcuacugagugauggccugucuugaacaagccaauuaaaagaaaaguuuauaccuuuaguccccugggaggcagaggcagguggaucugugaguuugaguucagccuggucuacagaaugaguuuaucagcuaauauuuauauggaggaccaguuuacauuaagauugaaaacaacggccagguguucaucccugccuuugggaaguagaggcaguccaaucucugagugcaagaugggccugguguacauagugagguuuaggccagccagagcuacacaguaagcccccaucuaaaaacaaacuugaaaccaaauuaagaaaaaaaagauuaagcuucugaaguguguuagugugugagugcucgagagcuuggcagacacacucacacucacuacacucacucacacucacaccgaggguuaugaauuauccauauagguaacuucuuuuagcggguaagaaggcucuucucaggcccaguaaucacccagugguuaacagaugaccaggcugcguucuaaaucuuccaagucugcugucuccaaaaucuagcugggauugacugcaggagcacacugacauaugaaggagccggaagccacaucagaggauguuuuaagugagcggcaguggagagggcugcuaggccaguguguaccgaugcuucugcuccagcguuggccgcaguagcagucugacuuugcuaacugcuuggaacgcucuaucucggaaauccagauucuuuuacaaacagcuuaggcuuuacuuuuuccuuuuugagacaggaauucuguguguagcccugacuguucuagagcuagcucuguagaccaggcuggccucccaucucagagagauuuccuugccucugccucauuagugcugagacuaaaggugugagccaucacuucucaggaggcaucuguuuuuuaaaaguuguuuuuauuuccuacucucuggcuugguaucuggcauacauagcugcuacauaaauaauggaauacagcugucccucaggcugaugcugugacuuguccuugaagaaacugguccagcuggaauucuaggauucaucucuuaacgggcauaacagggaugguggcagugugcagugacugagcagaugagaagccagcauccauuuucuucuuguccucugagaucuugcugccagugucuauuaaacauggcagggguguaaggauagcagugggagcuagggcuuaucuuagauucaccacagacuagggaaaugccggagggugaucagugacgguagaaauacugcuggaggcagauuaaagaacgcucugugccuggaugcacugcucuccaacucaggacccggaguucugagccucggguucaucauucacauuaugaggagagcaaguuucagggccaacgcaggcucuuaucuaaagaaggaaagucauuuuacccaaggcccgagugucuguugagauaaugacugaauuucuccccccaccugugcuccugagucauuugagugauuauucuugggaccccaggaagacugugugcucaucugcggcaggugccauccucuuaauuuccacucugacgacacccuaggagacacagagguggagacaccuggugcuggaaggcggcaagagcgccuugccucacugaaggcucgaacgcuucuuucugaagcucauuaaccuaucccuuugggagaagcaaaauuaaggucuguuauuaccucuaaagacgauaaugcggcccuggggucucaggacugagaaguuauuuugucuuaauuuacagcagcaaggugguuugggccauaacuucuggaugcugcuguuaaguuuuuuccaauaacugugguccuuaauaaugccagugucaggcugcucaacuugucuuucagaauccgagagcaaugucagagugcuuuagcugagacaggaggaagacauuugcuuuuguuuuuauuaaaaaugggaggacuuggggcuggaaagaugacccagugguuaagaguauuugcugcucuuacagaggacacagguucuucaguugguauccacaugguggcacauaacuaucuauaacucggguuccgggccauacaguguccuuucugaccuuucucgucaacaggcauguguauagugcacauacauauaugcaggcaaacacuaauucauaaaauaaauaaacauaauuuaaaauaaaaaaggaaauacuuuuucaucuggggccauuuucacacagaacaaauuacuuugugagcugggguaaguccuugguaucucuggccuucacuuguuucauuugaaaagaugagaggguuggaccagcuaaagucuuuguugauuuugagacagaauuccacucugccaguaaucauggacucacggcacacuuucugcuucaugccuucuucccugccucaccucccccaugcuggucaugcaggugugcaccgcugggccuggcugggccagcuuguugcuaacgucuggucuaacgccuuuucuuacuuuuaaaaaaauauuuauccuuauuuuauguguaugguugcuucccuuugcaugugugccuauguaccacaggcgugcagugcccuuggaggccugaagagggcacugagucuccaggaacuggagguguacauaguuauguauggcuaugagccacuguguggguacugggaacugaaccugaguccucuguaagaacaagagggaguucugagccuuggguucaucguucacauuaugaggagagcaaguuucagggccaacgcaggcucuuaucuaaagaaggaaagucucuggccccuuuacuaucuuucauaaagcccuucuggcuccaccuuguugugaucucuuaauuguacugguuuuggguuguuuuguuguuguuguuguuuugguuuuuuugaaacuguuuuauccuuacuuucccauagcuuguuucucaagacaguagaauuuuaggguuauaacccuuucuucacgguggcucuggaaagaauauaguuuaacuucauggucagccuugccuacacagugaauuggaggccagccugcauuaccugagauccucugucaaaaacaauaaagagaaaagauugauucucaguugugcaacauugauuuuuuauuuugucuuuauagguugcuauggugacagacuauggagcuuuuaucaaaaucccaggcugucggaagcaaggugggagcccuuaauggggaaugaauucagcacuuccaccgcacucauuggccccacauccucccucuaggaccuacauuuuccagauaguagcuuguuuauuuuacuuuguucucaguguagcaauagggaugaagaguuuuaugugcauguaccuguguaugugcacagugcccgugccuugaucuuaggauuaccggucucuaguaacugagcacugauugauguguguuuuuaaaagagacugaagaagcauuuuagcaguaugugguggcucaggcuuguauguaccucagcacccaggaagcagaggaaggagggaugccccaaguuccugaacaguuaaagacuacauggugagacugucucaaaaacuuaaagccaccacaacagaggagcuaaggagauggcucugagagcuugaggaauugagcucaauccccagcacccacaaaaacagccaggcacccauacauuguaaccccagcacuggacacauuguaacccagcacuggauacauuuguaaccccagcacuggagggcagagacaguggaccccuaaagcucacuggccagccaacccaaccuaaagcgcaacuguccuguucagugagagacugugccucacagcagggcagcagagggugcuggagggaaacacccgcugucccgcuguggcuccugcaugcacgugugcaccuggaagaguagguuggucucgcagacuauaagaugaggaaagaaagcggcucuggacguggacaguggagcauuccacaggagagaccaaggcagggcacugaacguggagcuggggaggacccggugguugaaagaaggaauuuuaggaucugaaacaaagcugcaugucauggcuuaugccuuuaguuccagcucucugggguccaugaugggaguauggugcuugagugugagaccagcucgggccaugagacccugccacagaaaccaaaacaggcucagugcguaaaggcaccugccaccaagucagaggaccugaguucaaaaggcugacccugcgugguagaaggagagaauuuacucuugcaaguucucagaccuccacguguguguccuugacacacauaguuaguaaaaacagauaauaaaagcaagccagugaaaacuaaaagcugggcaugguagcauacacuuuuucuuucuuccuuuuuucuuuauuuuccuccccucccccauuccccaccuuuucuccuucgcuccggccaacaggcucuuuuuuuacuuguuucucaucauggaugacugagccaccaugugauugcugggauucaaacccaugaccuccagaagagcagccugugcucuuaguuuuuuguuuuugguuuuguuuuuguuuuuugagauaggguuucucuguguagcccuggcuggcugcccugauacucacucuagcccaggcuggccuugaacgcagaaaucugccugccucugucucccaagugcugggauuaaaggcaugcgccaccacugcccggcccagcccaugcucuuaaccacugagccaucucaccagcuccugguugcauacacuuuuuguuuuagcacucaggagacacaggcaguggaaucucagugacuuccuggcccuccaaagcaaucuaguaagagaccaugugucuuaggguuucuauuccugcacagacaucaugaccaagaagcaaguuggggagggaaggguuuauucagcuuacacuuccacacugcuguucaucaccaaaggaagucaggacugggacucaagcaggucaggaagcaggagcugaugcagaggccauggagggauguuccuuacuggcuuguuuccuuuggcuugcucagguugcucucuuauagaauccaagacuaccagcccagagauggcaccacccacaagagacccucuacccuugaucacuaauugagaaaaugcccaacagcuggaucucgugaaggcauuuccccaacugaagcuccuugcucugugauaacuccagccugugucaguugacacaaaacuaggcaguacaccaugucucaaaaauaugaaguaaacuauacacaaaaaaagcaaaaaaggcagaucuugguuuacugucaugggaagacucuaaaauaauaagaauuuaaaaaccagucauagagcauucaugcgguacguguacccuuacccuuauagaaagucuguacugugucucuguauuuuaaaugacuguucagagacuauagaccaaacuccucccaguggccuccuguggugaguuggcuugcugagaaaagggcauacagaggaagggauuuuuuacuuuuuggagucuuucauaacuuuuucugucagaaagcuguacagaucuguagcuuauaacacugugccauuagccuuggcgacaacuguguggugcauuucaucuuugcacuaaguggcuugccugugguuuucaagcuggcaggcagcagucuguaauuaaguuccgaguuuuaugguggcugggacuuggggagguggagcucaccccacccucagaacucacaccucuuucugccuaaagacagauuuucuuguuaguguacgcgcuauggcugcuggugguaccaauuucgugugggcauuuaugugacacuuuggggacaguguggagaugaaaagccugcuaccuuucagcagucaguugucaccugcucguaguuuuuaccugucagauaaugccugugauaguggcugacagcuuacaaguggaucugucagcugacagcuguggcagacucacagcgagggcucaggaagccaaauaauuagguagaaucugggagcucuaauccuagcaucuuauguaggugugguggauaaccgaguaguugacuccccugcagugucuagcuucucucuaaagggggauaucacuaggucccaccuuggaguucugagcagugaguuaacuguggucugaucagaacguaacaucuuucagggagacgcugauuugaauuacuuucucagagucuguuuucagaauccuuuaacuacuaucaaguuaaagacugguauucagaucaaaacuagucuuucuuuuuuaacauucguuuguuuuauguaugcaaauggggcuuggggacacgccauaacucugugugggggucagaguauaacuuggagguacuguccuuccacccugcagguuccggguuugaauucaggucgucaggcuugguggcaagugccuuacccauugaacccucucccuggcccuaaccucgccucuguaguuuugcucaauggaacuuuaugugcuggugggacuuacagauuuguucucauuaguugugucacacaaaccgguuuuucacuuauuuuggacaccaacaagauauccaacaccuuuugauucaauucugacauaucaacccugaauuaaugucaggguccuauaguuaaagggguucugucccacaaacuuaccaccucucagaugucccuaaagaugaucagccagucuaacuuagaggugugacccccuacuuaaguuugguaauuagaguaggucagguacuguguacacuuaugauuccagcacuugggaaacagaggcagggagaucagaaagcaggccagccuugucuacguaaugaauuggaggcuaaucugggcuacaugaaacucuguuuaaaaaaaaagaaagagcagagcauagugaggcacaccuuuaaucccaguauucagugggcagaggcagacagauaccugaguucaaggucagccugaucuacauuguggguuccaggccagccaaggcugcacuguaagacucugucucaaacaaacaaaacaccacaguaaaaguucacagaacucaggaaagcauuuauucccccuugcugguuuacaauaaauccaguucaggaauaaacaaacaaugaagggacacagggcaggcugaguggagcggggugaaggcgcuccugaaucuguucuguccagcacugcauacuccaugaugugugcagggacuguccuuaaaggccgcucgcuccccacuccugcauucccggcugugggagcuggauggaugggaccaaguguuccaguccucucauuacucucaugacuggauucuuccugugacugcccggccagagacugcacgcacauacgcacgcgcauacacaaauguguauuuuaagguuuuauuauuguuguuggcauucuugggugucauggugcacguguggaggucagagggcaguuuucaggagucaguucuuuuuccacauuagugaugcugccugguugcauacuucaggcugguuagccuguaaacuuccgggcagcucccccgucggagugcuggaauuacagaugugagccucugcauucagcuuugugucauuccagggauugaucugagguccucaagcuugcagucaguuagcugcugagccagcuugcugccauuuguaauuuuuuuaaggcaagaucucacacuguauccuggacuagcauucacaaucauccuucugcauccgguuccuagguggugagauuauggguaagugucauucuacccagccaaacauagcuuucuuuauguuuuauaguuuaccacgucugcaguccaauacuguagcugcugauuuuuauuuuccccaugaaauguaaaauagcagugcugcuuguggcugucauaggcgcaguagagcccucucccauuacacacaggagcaaaugaaagcaugugugaggaagguaaugaagacugcccugaauccaccucaguuguucagauagcucugggccuaguacagugucggagagauacuggacaucagugagucuuauuucguaaacacaugaguucaagucccagcucaggcauuuaccaguuucuugacuugggaaaaucacuugguuuugagucuucaguuucuucguuuguggaaugggaugaugugcauaucuuagacucugguuauuugaucaauagaacugucuuccauccauccuugauccauuuuugccugcaauaucguguuagugaaugucugaccguuucuaaucccaagggagaaagggcgugaaaacacuaacuucucugcaaguguaauugucacacgccauucacuggagacucgagcaguaccccagagaucaggcagaguuccuucugccgagcucuggcuguaccuggccucuugugaauuggcaaguuuaccuucuuuuucucuuaccaguggaagcugugaaagagauuaacguugagucuaaaacaguggagagacauucuaggcagugguaauaagcacuuaugugugcuugcgcucucucucucucucucucucucucucucucucucucucagugucagggcuguguucuuuucuccucgugcugacagacauucaguugggacucacucuguuuaagugucauguugaguuuauugaacaugaugauggauuugaugcccuuugggcauuuguggcuucacgucaggaaugcaggcccaggagccgagaguaaagcuggguggaacagugcucaccucaggauucagucuucagaggaaaguaagacguuuaugugucugcguguggagaaucugcuagaguagaccgacaagcugcucagcgcacgccuuuaaccucagcacuugagaggcagaggcaggcggauuucugaguuugaguccagccuggucuacagagugaguuccaggacagccagggcuacagagaaacccagucucaaaaaauacaaaagcccuggaugcaugauuauacccaguuuggagauuauaugugaccuaauuaaaaacauagcuuauaucuacauuguauggacauauguacgcaguaagcauuuuggagaagaaaugccaauccauagaaucaucugucuuagauguaagagacccauuggccacagauaaagaaaaugguagcuucuaauagaagcucaaauagaagggauaaacaccugaauuucaggccuguacaacaaauacucgugugugugugugugugugugugugugugugugugugugugugugagcaaguuuguuaggaggagacucuucagcagccagaugagggagugcuuguccacaagugcacuuagagucugagucaggccucacaaguuugaggccagcguggcucauauagugagaaccugucucaaaaacaaaacuaagaagucucuuaacuuacugaaaauaagugaaagagugucuguaauauugcuuucaacaaagcaaaagcucuuagggaggaaagggggguucgaguuuguuuguuuguuuauuuuuagagacaguguuucucuguguagcccuggcuuucugaaacucagucuguagucuagguuggccugggacucuuaagauccaugugccucuuucucucaagugcaugugccugccaggaaaggguuuauucagccuacaucucucaggucacauucugucacugagggaacucaaggcaggaacuugguagcaggaacugaagcagaggccauggaggagugcugcuugcuggcuugcuccuuguggcucucucagccuucucucuuacagcauccaggaccaccuggcuggauccauaugucaguguguuggggacauuuucauguuaagguucccucuucucaaaugacuagcugguguuaaguugacagaaaacuagccagcacagauacuauaucuguuguuagcauuuuucgaguaauuccuuaacauuuuaaagaugcacuuuuaagcauuugucgucacacuauguaacuuuguauuguacuuuauuuugccaugggaaaugcuguauauucacaguacuguacacauuuucacuauaagauaagucgcuggcauguuuggcuggcucuucuggcaccagccugggauuaaugcaguugccgugcuuguguuggguguuaguuugcuucuagauucuccugucaugaugcauugugccagcauggcagccugcaucuguagccccagcuacucaagcaacuaaggcaaguagaugagucugcaugguuaacggucagcugggugcacagcacaauccagccugauuauuuucuugggcaggauuccuagguguaguuauaaugagacugacagccaggacuggugcaaaggggcagacccguguuuuuggcugauauugcaagccaaggacuucuaguuucuuccucggcuaguaucagauguaucagguauuuauguuuuguuuugccuuuaaagaagggaucuccauucauagccucgagcucugaccucucccgccugcuuggauuacagaugauuuagcucagacucuugaucuguguuuacuuuuuccuggcagacuccugccaccuacuggucaggcugcauauuuacagcauuuuguaguuagugguuuguaucucuacccaaccagccaauugcuauggucaggaggauggaguuccuugguugacuagacugucuugggcccgcagcagggaauuaccuuggaauauagaaagaagguuguucucuaaaguaauucaccuucaacagcaggaaaggggcauucuaaaauuauuuaaggggccggagagauggcuugguuguuaagagcauguagauuguuguuuuugugcuuuguggggguuuuguuguuguuguugcuuugguuuuucgagacagggucuuacucuguagcccuggcuguccuggaacuccaucuguagaccaggcuggcuuugaacucagagcucugccugccucugccuccuuuggccauguuuuuuuuuuuuuuuuuuuaagauuuauuuauuuauuuauuauauguaaguacacuguagcuguccucagacacuccagaagagagaaucagaucuuguuacggaugguugugagccaccaugugguugcugggauuugaacucuugaccuucggaagagcagucgggugcucuuacccacugagccaucucaccagccugccucugccuccuaagugugccacugcccagugugauuuguguuuuaagacaccucucucucucucuguaaccuaggcugaccuggaacucacuacguagaccuugaacccacagagauccacuugcccccaccucccaagagcuguguaucucuaugcccagccaaaguuaaaacuauuuaacauuuaaaauuuauuuuguggugcugcagaagacauacauguuaaaugccugugcugcuuuccuucccagacuucucauuuuugauaguuauugauacguaacuucuaaaaguuaauucuaacuuaauaauguuucuuauuuuucuguuuucaccaauauugguuauuguuuuucuaaacauuguugccaguuuaauguugaaaauaguacuauggggcuggugagauggcucagcaguuaagagcacugacuacucuuccaaaggucccaaguucaaaucccagcaaccacaugguggcucacaaccauccgugacgagaucugacgcccucaucuggugugucugaagacaacuacaguguacuuacauauaauaaagaaauaaaucuuaaaaaaaaaaaagaagaagaaaauaguacuaugccaggguauguggcacagaccuguaguugagaucuguagccaagguuacauauguagugagaaccuuuuuuuaaaaaaguacuuuuucuauuuuuuucacuuaacaucaacuguaauuauuuucuguaacuaauuuaaaugguugcuuccuuuuccauuugacugauuuaccaucguuugucaagauguucuccaauuauuaguuauuaaaguggauuuggaauucugcuguucuuuuuguuuugaaacuggguucagucuguaacccagacugccuugaauucacuauggagaccaggguggucucacaggugugauccuccugucuuaguuuuuugaguacuggacuaacaaguaugagccgcuguauacaauucuuucuuaaauuuacuuacuguauuauuuuaugcaaaugaguauuuugccugcauauauggggaacaugugcauaucuggugccuucagaagucagaagaaagcauggcuccccuagggacuggaguuagagaugguugugagccgucauguggugcugggacucaaaccugccuuugcaagagcaagugcucuuuuuuuuuuuuuuuaaauuauauuuucugugcauugcaugaaugcacagaauguguuuugcguauaugucuguaugaggauguuggaucccuuggaacugaagcuagagacaauugugagcugccaugugggugcuggcaauugaaccggggucuggaagggcagccagugcucucaaccacugaaccaucucuccagucccggaaauaagugcucuuaacugcugagccauuucuccaaccccaauucuuaauuuuguuuuugauuuuguuuuccagacagggcuucucuguguaguccuggcucuccuggaacucagagaauccccuuuccucugccuccuagguucugggauaaaaggcgugggcugcugccaccgucaccaccagcaucacuagcagcagcaagaggcuacaguucuucauuuuuaacauucauagauaguaauaccuacaguguuuuugcuccugggugcuuugccucuauugauguuuuuucuuugggaacaauuccagagauuuuucuagcaaaggucugaaggccuuggucagggguggaagcaugugacuggcgugugucaggucugaagaauaaaggaucagcacuacagaaggaagcccuugcuuugaaaggauuuaccaacuuguauuucuaucuacacugugggaguggggcugggaagacggcucagcaguuaagcgcaauuggugcucuugcaggggaccagaguuugguucccagcacccauguuggcugcucaccacggccuguaacuccagcuccuggggcucugaugucuccccuggccucugcaggcaccugcacauaaagacacacacacacagacacuccuggcauauagacacuauacacauaguuagaaaucuuuugaggaacuggagguguaaacucagucgcaggauggacaccuagcauauagggggcuccguuucaaucccugguaccauagaaaacagaacucagcucagucuucaugugguugcugucauuguguuacauauuuuuaguuuuccuccuaucucuuggugcuaggaauggaauccccagccuggucauacaaagcaguuccacugcugagcucuucucuaucugagcaguuauugaaccaacguugacuggcacuggagagacagcucagugguucagaacacucgcuaugcuuucagaggaccaagauuggauucccagcacccugugacagcucacagcugucuguaacuccggucccagaaggucucuucuggccucuuugggugguagccacacaugauguacagacaucuacgcaggcaaaacacccaugcacauaaaguaaaguaaaauuuaagcaggguugguugguugacuggguuaaaggcugaucuuaaauuguuuuaguuuguaguuuuaaucuauauaaaauguucauuagaaguuuaaaaauucccuguuauagccugccuuuccuaccugugcauuuggaguacaaauguguguuuuucuuucucaccucaggucugguccaucgaacucacaugucguccugucgaguggauaagccuucugagauaguagauguuggagacaaagugugggugaagcugauuggccgagagguaaaguguccugccccuucgcgugguugaaaggcuuauaaaaugcugggcuuucauuggaguucauaacgguguguaaacguucgugauggcugacguccuuauuuuuaaaucuugucccagucaucugucuugaguuugaaucuucugguugucuguccugcgggccugggagaaagaacaugaagugcagaaguguagugggggaguguguguucaugggacucuccuccugaggcuuagauagaaaagagccagagauggagauuuacucuuuagcuuagcuucagagagcacuugucacguguacuucaucuuaggccggaaggaaaaagacacacaacuugcagccauuucuccuagaguagaugggcagcucgggcaugggggugcaugccuuccgugggcuacgagggaauggcaggcagaaagccagggacacuaguaggaaucugaaaacuguugagugcuuccacguguuagguucuguagcuguaagacggagccagagcugaauguggugucauacuucuguuacuuuagcauccaggaggcugaggcaggagaguguguguaugucuacugucugccuguccacucaugcaggccacaguguguguggagaucagaggacagcuugcugcagucuccucucucccugcaccaugugaauucugggaauugaacucacgauguuaggcuugacagcaggcaccuucacccacugagccauuucacuggccccuccaagauaggaauggaugaagaccauuuccuguaccucuucagccguuacgucugcccuuuuuacuucuuguacaccccccccccacacacacacacccguguucuuagcuuaguacuuagucauuuggagguuagucuuugcucugguguuuacagauugggcucugaggugucacagaucaguggucagguauucaaggggcuugggaacauagcucagcugguauaugcuugccaugcaagcacgaaggccugacugaguucgcuuacacuagcaccugaguggaaagcuagguguggugauguacucuugugaucccagugcucaggacgugcagauaggggacuccagggacuugccgguccuuggcugaauggggcuccaggucucaaagaacaacguagagguuccagaggaaugaaucagguugacuuuuggcuucuguacacacgugcacugacaugaacacuccccuacacacacacacacacacacacacacacacacacacacacacacacacacacacacacggguuuuggugacucuuuuuuugucuuuuucagaugaaaaaugauagaauaaaagugucccucuccaugaaaguugucaaccaaggaacugggaaagaccucgaucccaacaacguugucauugaguagguaaaggguuugcagagcucaaaucccacacauacagauggcaguaaacuagaguagguugggcugcugcuguugguggcgguggugugacugagugucgcagcguaggugaccuuugcuuuuuuauagguggacccaugcuuuuugaguguuucgaggcagggccucgguguguagucugcauggccucaaaucucagugcucuuaccuuagacuccugcaugcuggaugucaggggugcacaccccaugcagccccaugcagcuguguggagcugaagaugaaaggaccccacaggaauccucucagcagcuuuguucuuucuccucucguccuguccccacccugucugccagcagcuccugaggugcugccauggccucuccugagacgcuccuuucugcauuggcucugaggaaaaggcuccuacaucugugaacacggcaccuuccacuucagaauggaagguugucucuugaucuaaggguggggucuggagauucaggaaguuugcuaucugacucaaauccuguauugaauuuuauuuuuaagaaaaaauuaaaaagcauccauuucuuuauugcggggugcauaugugggaacaguucuuuuccugcuaccauucagguuucagggauagaccucagcucagaagacuuguauggcaaauucuuuuguuuugucucaugggggaggauauguguuuuuugaaagugucucucuauauguaccccaggaagaaauguuucaauuccaggagaauugcuguuaccauauucccuuuauugauuuguuauuguuguuguugcuauuauuguuguuaguauuguuguuguuguuguuguuguuacuauuauuaagaaagggucucucaacauaugcacuggcuguugugaaacuuacucugucgaccaggauggacuuuuuaacucaagcgauccacgugacucugccucccagguguugagaucagugugucugacccuuuauugacuuucuagccagaauuugcuuagucucugagagcccucacuggggaaaggccuuugcugugaucugaguucagucccugcaaccccugcagagguggaaggagagacccaguccuaucaagcuguacauuuccucacggcccucgagaggcuuaguaacuguuucuagugcuucaagcaagucaacuaaaucacacacuuaucuuuaaguugacuauguuauuauuuguugauuuugauauuaaacauguucuuccugucugacagugacauuauugauuaauaaauaaaccagauguggcagcacauuccuguaaucccagcuuuugguagacuaaggcaagagaauauguaauuaaaggcuggccugagcuacauagugagauccuggcucuggaacacaaccacaaaagauaaugaauauaauuugaaugagaucuuuauugcaaaagaaaaauugaagcccucauauuucucauucugagaaaaauugcuucagcuaugaaggaauuuuaucugaaguagggagguaguguugacugaaaagaucuauguaccagacauaaggcaggcgggccucacaguaaccuguacgguaaggccggucuucugugucgcuuccaauuccuaguuuguggcuggagauaaguaaccaugauuguguagcaaauuaugcaggucagacacuuacauauaggaccagguguuaaagcacguguccugcgugccacugcgugugacuuagccauucauaguuuuguaguuuaguugcuaaauauugauguauuuguagagcacuucaguuguggugguaaucuuuuauaacucaacguagaaacgcuaaagccuggcaccgacugaucauauugucauaaaacuaccuucucuccacagaaccccaagcucugcagacucaccaaaaaccuguggauuucucaaagcuaaccuuauaaugcuaaacuauaaaacaaguuuuauaaaaagaaacaaggauaagaaggaaagacuuucuguuugcaggccgugucucuauauagagacuguuucuaguacaagcccugagccugagcaggguuuguuuucuuuucuuucauucuuucuuucuuuuuucuuucuuucuuucuuccuuccuuccuuucuuucuuucuuucuuuuuuuuuuuuuuuuuuuuuuuuuuuuugggauuuugagauaguguaucucugugucucuguguagcccuggcuguccuggaacucgauuuauagagcagacugacuuugaauucagaaauuccccugccucugccucccaaguacugggauuaaagacuuaaaccacugucuuagucaguguuucuauuccugcacaaacaucaugaucaagaagcaaguuggggaggaaaggguuuauuuggcuuacacuuccacacugcuguucaucaccaaggaagucaggacuggaacucaagcaagucaggaagcaggagcugaugcagaggccauggagggauguucuuuacuggcuugcuuccccuggcuugcucagccugcuuucuuauaaaauacccauaagguauuuuauaagaaauauacuccccccuugaucacuaauugagaaaaugccuuacagcuggaucucauggaggcauuuccccaacugaagcucauuucucugugauaacuccagccugugucaaguugacacaaaacuagccaguacaaccaccaccuggcuuugagcagauuuuuuuuucaacuuuucuuugguucuuugugauuuucacaucaugucccccaauccauuccacucauuucccucuccuuucaccccucagacccgucccuugcaaccucucccccaacagaggaaaaaaaugucucaugguaacuauagugugucaguguguucuacaguauacccuuuuguccacacuucuuugcuugcagaggccucuggcuucugcuacucuaucaaugcuggauccuuacugggacuccuggacauccugguuuugcccugugucguggagaucguguaguugugaaucuauaaaccuggguccuucguauacuccaguucaucgaugggauagaugugggggugggccaauccaaagcucuggaucugggucugagaggcaucugagauggucagcccugcaggucuccugcucucagggcuggcucacccaaaaccccagccaccagggccaucucuagccugcugcccaggcaaggugcagagccugcuuugagcagauucuuagucguggugaaccucagguuuuuuuucccccuauaaaacaaaaguaaugcuacauaucuuaaauaugacagaaugagggcccaggagauggcucaguagguaaaggccuccagauacccaccuaguagaaggaaaaacugacuccuacaaacugcccucuacacauguaccaugguacaagugcaugugugcacacacauaauaaauguaauaaaauaaaaagcgacaguaguuuaagaaaugucuuauuagcgaguagucaucuaaauggcuuuacugucaugaacacaguguagcuacuugugguuuuuaguuugagugccucuuugcuuucccgguacugagccugaagacgguguguggcucgugagcacggcggucugucuuacccuccucguccccuguaguaccugaugucacauuccuuucagcacagcauugguucuuguccuucuaucgaacaugacaaggcagcagggacaguguagcugauggggaguucauuucagguucccauguccagagagaaggcgacauuugagcuagguccugaggaauggauaugguauuuucagaaagcaggagaagggaugguguuacagccgugaugacuuuaggaaaggcacagguagagaagccauagcaguugggguccugggagugggagagaugaucaauuacagcuguuucuucuggcacucaguaucucuuucuuauguucaacagccugguuuccagcugcuaccagugggcuagccucucguuuucuaucaaggucuaccugucuucccucccuuucuuuugucccuuuuuguuguuguugcugcugcugcuguuuguuuguuuguuucuugaggcagguucucucuuugcagccuggcuggccucagacucacuguguaccccaggcuggccuaggacucacagagaugugccugcucugcguuccuagugcuguccugcacuuaccuuccagcaucaucuaaucuaauaggugucucuuuguguggaaagggguuaaagguaguuucuagacagguauaauugacagcucuuaaaacucaccgugaagccacuuacauggcuugggugucuccuucuccuagguuauaagcuccugggaguaaagaagaaaugggguggggugggucgcagucuuuuguuuuauuguggugcuggggacugaaccucaggccuugugcauccuggacacacaugcucuuguucauuugcuccugucacuaguacuaacgcuggggcgcaccacuuacuaguuaguugauugaucugugcccuggguggauuggaugaagaaacagagagacguggcaacccucgaggaagccguuacuugggugagcuuugauacugcugacuagcacaguggcagggggaauggaaagugaccuggccucgugacaccugugacguaggaggucugauugagcguguacuguguuagaaucccagaggacuggaguugauuauaagaaggauguguuugaacacaucagaccccuuaaagcucugcucuucaaacaaggacaccugaagaccuggcugcucagaugccugucuugguuuuucuuacucagacuucaguauguuuugaaagagccuauuucuauaacucauaccagaaaauugacuuuugugcacuuagauucuuccagagcaaaagccagacaucugugcagacauuuucagaacuuacauuauaugcuugucugcaauguccacuuggguagcuacgaauaacauggggcuauuuaaauguaaauuaaugaaauuaaguagaauuucagaaccagguuugauggugcagcccugcagcccugguuacugcccaggcagcuuggugagcgucuugucucaaaauaaaaaguaaagagagggcuugggugaagcucggguguagcaugggccuagcauggaaagggggcugggauggagcuccagcauagcacuuaccuugcauggaggaagucccagcucaagccccuguguuucagaaguagaaacaagugagauucaauaccuuuuuggguuuuuuugucucgucuuuuuuuuuuuuuuuuaauugguauagguguuuugucugcauauaugucugugcaccacuuguauuguggugcccucagcgucuaguagaggauguccuauccccuggaauuaaaguuacagauggcuauaagcaauuuaggcguugggaaucgaaccucaguccucuggaagaacagcgagugcucuuauccucugugccaccuuucuagccccgcagaauuuaguucuuuguuuuguuuuguuuuauuuuacuuuguauugauucuuugugagcuucacaucaugcacaccagucccacuggcccccccaccccuuguacccaccuccacuccugcaaccucccccucaagagaaaggaaacaaacaaacaaaccaaaaccuuguucuggaagcuguagugugucacagugucccacagaaaaccccuugucaacauuucuuugcuugaaaauguucaacgacucauuggucugacuccucugccuucugcuacaccaucaauacuggauccucccugggacuccucuuggauauccuguugcugccgugucauggagauacuguagugcuggaucuguaggaucggccccuucaugcacuccagcaguucauggaugggguagauggggugggacaauaauucuguagucacacuagcuacauuuaaaaauguuuaguaaaccauauuuuucucugacauugugacauaaugccuucaguucccccagaggcagauggaucucugugaggucaaaguuagccugucuuugacaacaguaaaauaauaccauauaccaaugagaauaaaugacucacaacuauagacaacgaugcgggugaguuucacaaacaacagaauuauacaggaaauauccacucugucuguguauguguguauguauaccuuuugguacuaaaaguugaaaccagggauuuuuguauacuagacauauauucuuaacaccaaguuaacauaauaccccagguacuuuaguauuuugauuuuuaagacauuucccugccaaauugcucaggcuggucuugaccuugugaaacucuucccuaaccuccccagucaugggauuauagggguguaccguauaacugauguacugccagcuacuguaaaaagaaaagugaauuugugcuuuuagaagcuagaauggcgaacacucugagaauaggccugacuaagaacugugacucagucccuguguugguuaaaagggaaaguucagacuagaaagaaacuaggugcacugugcacuuacuguaagugugucuuuuuuguaggagcuaaugcucauuaaaagucugauaggaguaaacaaaagguaccuguggcccaggagcuccgggaagagacuuggaagagggagacucgggaccucuggguagcgagugcauuguggagggagugaaggagguuggguguugcagaguggaucuaaggggaggcacucaccuaugaaaaguagaauuggcuauugguguuaggaaaauaagaagggggcuggaaaaggaguggagaaaguaacugaaaaccucaagaccaagguuuccuaaggaacucggccuugacuuguagaaagccugcaaaagcuuuuuaaauccaugaaugaacuuacaagagcuuagaguguuuucccauggugaguaauuauucucucugugugucuuucuuucucucucucucucuuucuggagacaggguuucucuguguagcccuggcuguccuggaacucacucuguagaccaggcuggccuuggacuuagagauccaacugcuucuccguccugagugcuaggauuaaagaugugcaccaccacugccuggcaauuauacuuucaaguaucuuuccuguauauuauugaaaggaaaccuaggcucacucauaauuguuaguucaaagccccacucuaaaugagacaaaaaggagcugcuccauuguuucgcucaccacgcccaccacgucuccuuucguccccuuuccuuguucagaaccaaaacaaaaccagcaagcagcagugcacuguaacauaucugcccacuucucugaaaagcaccaguggucaggaugucuuuaauuacaggcaagaagagaggcgcagacgguccuuccaggauuacacugggcagaagaucacccuugaggccguccugaacacgaccugcaagaaguguggcugcaaagguaggggaagccaccauuucugucuccuuuccuugagguugcucugccggcugagggagaccguuaguuuagcuccguguguuucucagucagcugcugcugcacucacucacacggugcuccgagucacacuuaccuccuagcacgauuacuguucugcagaaaugaagugucucggaaaugcguuccuuacggauccaaguuagacccuuucuuucuucuucauuuuuagcucagaauuagguuccaaauuccuaacagagugcccauuucguaauagagauagaggacugucacuugcuuuuggcucuauuuccuuaggguucuuuuagucuuacucaaauauuaaaagcuuuucaaccuggcuucccuuauuggagcuauaaugagagagauugcugucuucucaauuacagagugaccucaauuugucaccuccugucccgagauucuacccgucaugcuuuguucacuuuuacuuauuuuuuauaaagauuuauuuacuuuauuuuauuuauaugauuauauucuagcugucuucagacacaccagaagugggcaucagaacccauuaaagauguugucagccaccauaugguugcugggaauugaacucaggaccucuggaagaacagccagugcucuuaaccacugagccaucucuccagcccuuauuuauuuauuuuuaguauagaauagaguuuauuugggggcaugggaagggaaguugagaagggaauagaggcagagaagagaggggagagaggagaaaaagaagaggccagcuaggaacacguauggguggggaggggagagagggagaaggggucagagagagaagcgagucagagccgcuuuguucacuuucugcagugaugguagcagaucuguguccugguugaauuugugagguuuguuguuguuguuguuguuuuuacaugcauugcugcuucaccugccugcaugucugugugaggaugucggguccccuauaacuggaguuacagacaguuguaagcugcugccacguuggugcugggaauagaaucugaguccucuggaagaguagccagugcucucaacugcugagccaccucuccagccuugaauuugugggguuuuauaagccucuacuuuuauuagugaagagagagaaggagaaugugagggaaggaguccccuggaggagauugugugugguagcaucccugguauuuggaaaauugugcuguguucucuuuccagacuucauuuaacuucugggcucaauauaaaaacacguuacacuuagcucuguaguuccuucguguacuucuuuccuacucuugaaaugagcuaucuagaaccuucuuguggcuccaggggauuggacgcccucuucuggucuccuugggccccugcacgcaugugcacauaccccccacccccaagugugcauauauagagcguuuaaaaaaaccuaaauccucacccucaaaaacagaagcgacccucaguaauaccacaggcccagcgccuuauccauacccaccuggugcuccauagagcagcgagaauaacaacaaguagaguuugaccccgucagcaaaggucaaguugaaggugguugguuggcuuugcagcacaaagcagggagacaucuguccugagcugaguguuggcucugcugccguguggcccugagcuacuuaacucuaggucucaggaccugagauacagaugcaggggguugggguucaugaucucuguggcccuugccagaccugacagccugcgacuucucaggcacccugggugucugccugucucugucuguuggcuuggaugucaguaccacauauugccagcucucucccuuuaggccuuggccugcaguucaguucccucuguuaagcauucugcucucuggagcagccuuucauugucaggaccgaguuccaaaauagaucuuuaaaaauuaauaagccccauugcuaagggagggcagcauaagucugcuugcucgugccuucugccauuuccagggccgcaccggcgacucucacggcuccugcaccagcugcucgccuggcucugguugagugagcauugccaccuugagguggcagaaacaccgccccagauaaacucaguaauguuuugacuuggagggcccuguggggagccuccaggaagcauccaccugccgaggagaguggcuucuucccucucuaacccguguguucuuucccacaggccacuuugccaaggacuguuucaugcagccagguggaaccaaguauucucugaucccugaagaggaagaggaaaaagaggaggcaaaggcagaaggacuugagaagccugaucccacgaagaauucuuccaggaagagaaagaagguaagagcugccuugcugcuaugggucacgguuugguaggccucagauacaaaugcuucuuguaagcauuuagaaguagagaauaauuuacaaagcaagcccucaagcugggcgugguggcgcacgccuuuaagcccagcacucgggaggcagaggcagguggauuucugaguucgaggccaaccuggucuauaaagugaguuccaggacagccagggcuacacagagaaacccugucucgaaaaaaccaaaagaaaaaaaaaagcaagcccuccuuaucuuuucagagacaguuguuuuucuuuuguuuuguuuuguuuuuuuagauuuauuuauuuuuauguguaaguacacuguaguugucuucagaaacaccagaagagggcauuggaucccauuacagaugguugugagccaccaugugguugcugggaauugaauucaagaccucuggaagaacagucagugcucuuaaccgcugagccaucuguccagccucagagagaguuuuauugguaguuugggcauauucuaaacuuuuuuuuagccaacaauauaaguagaugauuauauacauauaauauaaaauuauagucauuguagguauaguuuaguuucuaccuuuucauuuuucuuauuauuuuaagauuuauuuauuuuuauauuuuauauauaugaguguucuuucuucaugaucaccaaaagagggaauuauaucuuacuauugauauuugugagucaccaugugggugcuaggaauugaacucaggaccuuuggaauagcagccagugcucuuaacugcuaaaucaucucuccagccccuaauuuguuaaguauucuuaaguguuuuuaaaaugcuugauguuaaaagccauguaauggcagauucccaagaguuccaggccagccugaucuacagagugaguuccaggaaagccagggcuacacagaaaaaucccgucucaaaaagcaagacaaaggggcugauggcucagcaguuaagagcacuaacuguucuuccagagguccugaguucaaaucccagcaaccacauggaggcucacaaccaucuauagugggauccagugcucuuuucuggugugucugaagacagcuacaggauacucacauauguaaaauaaauaaauaaaucuuuuuaaaaaagcaaaacaaacaagcaaacaaaagagccacauaaaguuuuaugcuaugacugugagcauugauugauugauugauugauugauugauuggguuauuucuugagacagguucucuuguagcucagacuggccucaaacuuguuauauagccaaggaugcccuuaaacucuagauccuccuuccaagugcaccucugcgcuuagguauaaucauuaauuuaauucauugcuauuagauacuuagacugucaacuuucaacuucagcucuaggcuguauaccuccuuaccuuucuuuguguauguuccuggguuaagcucagugaguugaggcucaguaauuaagagcacuggcugcuccugcagagggcguggcuucuguugccaguacccaauggugguucacaaccaccuguaacuccaggugacuccaggagaucugagacccucuucuggccuccaggggcacugcaugcauguggugagcaugcuucugugcaagccaaacacccauacauguaaaaugaaaauaaauuacucuucuccaaagaggggagaggucugagagaugacucacuggguaagagcuggcugucuagugcacccauguucaguuuccagcucccaugucaugugucagcuacaggcaccuguaacucucacuccagagaagucugauaccucuggccucggugcccugcaucacagacauacauagauacaguaaacauaauugaaaaaaaaaaaaagaauaucuuuaaaaagauuacagcaucaagggagccaggcugauugcucacaccugucaucucagcacucaggagacagaggucgguggauugccaagaggucagggcagcguaggcugcagagugaguuccaagcauuuugaggaugcagacugagucucuguuuuuuuuuuuuggggggggaggggguggguaaguggugguggaucugugaguuggaggcuagccagggccugucuagaauacauagaaugacccugucucaaaggaagaaugagaagaaacaaacucaagaaaacaauaacaaaaaagauauugaaaacuuuagggcacuugggguuggagagcuggcucuguaguuaagggcacuuggugcucuugcagaggaccuggguuugauucccagcacccacaugguggcucacaaccauucugaacucuaguuccagaggguuugaugcuuguggugcacauaaacacacauaggcuacucacacucacgcuaaauaaauuaaauaagggcuuuuaagauucuagauagcguugucuucaauuuuuaccaaaacacccuugccugcuccuguuagugcacaggcacugcugucuccuggaguugucuccuuucacugcuuagaacauagcgauucauaagcagauuguguugugguacagacagaaacugcgauguaaauguucuaugcagagaagaagggaaagucagccgauaguuguuccuuaacuugcaggauauuucugugauugguuauugaguuuuguuuuguucuguucuguucuauugugguugcuguuugaaggguaggggagaacagggccucucacuguguaguccuggucuagccuuggaacucuguauuuguagacuaggcuguccucaaacuccccagagguucaccucagccuccugagugcugggaucacaggugugcaccuccacacccagcuuuuuugguguuuucuuuuuuaagauugacuuucacgcugcagcccccagcuggcuuuuaacuuucaacagcccucuggccucagccugcugagugcuggauugcaggugagcccccgcacucaccuuuuugaaaauuuguuaaguggucauuuugugucaggcuugcaaacucucuuuuugcucaggggcacccucgugaauggaggguuguugucauuguguagguaagggaaaggguccauuauaccauuagaagaauuagccaaggagcauggaaaucauuggcuuguguauucucugcaugucccuaaccugggcucucccuagcacuucagacuucggauugagucuuucaagccuuguuugaaguccuugggaacuuguagcuggcuguguaaguuuaaacuaacugcgguucuuugauuugcagagugggauuguugugaucuuuggcaguguucccucugaggugaugccagccccucagaauagaaagugaugacacguuagucccuaauugaaucucaguuuuaggagacauggucucaugcggcucagacugagcucagacuccuuauguaguucaggcugaccuucaacugacccuccugccuccaccucuggagguucuucaccacaacacccaacuccuacacucuuaaacacgcugccauacucuccagucccuuggaguuuuuuguuauuauuuaauguuuguggguguuuugccugcaugcaugucugugcacuguguguacaccugaugccagcagacaccagaauggggaguuuguugugagcugcuauguggauggugggaauugaaccuggguccucuacuagaguugcuuaaccagagagcuaugucuccagcccccacauaaucucuuuuaugaacucucugaccaaacacacacauaccauacuuccuguuucugccccuaaagagagacgcuauaauagcuuuaucuuauucucugucucacauucaguucccagggcuauccccuccuccuccucuucuuccuuuuccuccuucuccuccucuuccuccucccccuccuucuuccuucucuuccuuuuucuucuuugcugagacagugugugacugcuugcaucccaggcuagccuuggauuggugauccugugacuggccuccugcgugcuguugcuuuguagcugugccuggaggagggcauauuuuaaacauuuuaaaaugacagugcuccugccucgcauguguccaggacagugucagacauuugauguaacaagacaguaagaucaccuccagcccguuuuuguuuguguguuauguuuuuuguuuuaugagacaggguuucacuuuauaacugugguuggccagacagagcucuaccugccucugccuccugagugcugagauuaaagaaauggcuuagccaguuuauuuaaaaaugaauuauuuauucauuuuguuggagaggaaugacaucgccuugcucuuguggagguccaaggacacuaacuuagagaugacuguucucuucccgucgugcaggucgucagggcuggaagcaagccaagccccuuuacccugagcccgcccagaggcuuuaucuucuagguugcauguagacuuauuucuaugcaucauauaaaucaggcucaggucucccagguuccguggguccuuuuaucuguuccuguacucucuaaaucuccuuuucccuuuccccuuucuccucuuggagacgggguaucccaggcuggcuugaauuuacuguccuccugccucaccugagcaccacuaccgcugccccaccaaaccuuggguucccuuagggaugggcuuuccuuuccauaagaaauggacuuugggaguccgugugugggcuuggacauuacuccaguacucauaguucuggggccacguacagaacugaacauguacagaucugaaggucauuccauccacacugccaacagggaugggaaccggagugacuguguguagcaggcgucucacaugaaguaaggucacaucauucacucagccaauugcuuaaggagaaagauaaccagcccagguaugcacaguaagaaaggagagaggccaccggcucucaugaccuucaaaguguaggccugcucaggacuguagccggaaagucacugguggaagccauuuaaccuugagaagaaccauuucuucucaagucugccuucugcguucuaauacaaagccugugagacagaagaugcccugcaaagucuguucagaagccucagugccucagcuuuaaaaaaacuauauucauuauuucaguguauuauggugugugugauggcgugcucgugccacaaccugugucagaggucagagcacagcuucauaaggccagcucucucuuugcacucuucucuggguucugagggacugaacaugggucacaagguuuguacagcaagugcuuaucuugcugagccauccuccugccucuccccacccucuccuacuucugagaggguagugggggauguguagugggggauggaugaccuuacacgccuggucuuccugucuccgucuaccggaugcugagaucacaccuagguacgcuacauccacuuuugugguauggcagcaucucccacccuucccuccacacacacacuguacuugagccccgugcacugauggagcuucuguuguguguaccucuguuccacacacacacuguacuugagccccgugcacugauggagcuucuguugugugucccucuguuccacacacacacuguacuugagccccgugcacugauggagcuucuguugugugucccucuguuccacacacacacuguacuugagccccgugcacugauggagcuucuguuguguguaccucuguuccacacacacacuguacuugagccccgugcacugauggagcuucuguugugugucccucuguuccagucauugagggacagaaugaagaaaguggccagagucccuaucucugcauugugaguuaguggaagagauguaaacaaacacgcugugauguucauagaccaagcagugcaaacgccacggagaaagagcucgggaguuguuuuguggcauuggacccagcaccuugcgcaugcuaggccagugcucugccacugagccacagcccagcccuuuauugccauugcacauagggugcuacucuuagagaccgucaucugaagccaguguaauagugagugcucuccuguaaucccagcacgagaggcugggggagucaaggucaaggccuaucugggcugcauagcaaggccuugucuuaaaaagaguauuauuagccaggcagugguggcgcaugccuuuaauuccagcacuugggaggcagaggcagacggauuucugaguucgaggccagccuggucuacagaguucuaggacagccagggcuccacagagaaacccugucucgaaaagccaaaaaaaaaaaaaaaaaaaaguggggggcuuauuauuuggauaaaaauauuaucugcaucacugcaguagcugggugcugggccugagcuggcacacuucaggagaugcggaggcaguguagguagcauagggugaguggcagacgaggaggccuggagaccacagagggccuggcugcuaguuguaagaccuucauuuuccacucaaguagagcuuuucagcagugcagugaugaucugacagucucacugccuaguacuggcugacccagaacuugcuguguagaccagcccggccucaaacucacaaagauccaucugccucugccuucccuuuuaagauaauuguucuggcugcuguguggaaacgugcgagugagaaaguaaggccagaaucugcaggccuggugacagacacuuaauccaggugaaugcaccuggagcgugcuggcgugaccacaguagaaagggugagagaggaugcguggguuugcaggcagagcugacagggucugcugagagauuggauggauggcaggggagggaacugcuaacgacggcaucaaaauuggacuguaacugaaagauccaaggugagagacacuagagaagcugucaagaucuuaguuugagccgggugggaguggcacacaccuuugauccuaguguccaagaggcagaagcaggcgaaucucugaacucgaggccagccuguucuaccagagugaauuccaggacagccagggcugcacagagaaagaacccugucuuggggagagguguuaguuugaguugcugucuaugaagaugagaaggagacguggacgagguugagucugugagaagggaugggcaaggaguugaggugccuguuacacacccuaaggagacugugggauagacauuugauucacauuaggguucaggggagaagcuaaaguaaaagacagaaauguagacgucauccguguaucaauucacuuggcgucccagagaugaccugaagguaaguuaguaggggcggggcgugugaggcuggauggggagugcccaucuuggcugauagauggaggaagugagaucuaagaacuggccauuagagggugcaccaguaaucacagcggaacugcggggcuggcuucaagugugaggcuagccugagcuacaucuugagugccaggcuagccagggcaaauagugagacuguuugaaaaaacaaaagcagagcuaagcccugugggauacucucacacaagguagagaagccaugugcuucuuguuugccucuguccgaggguugggcugucagcucauuuaccuucccaggacugcccugccuaagaagggacagagccucaccaggcucucaagcccacagcaucagugauaagcugccaaauugaaaccaaaucauggauuuaucaccuuucagucacauggauguacccccuagccacaguugcuagaacuugggaacgcaggucuggaaggcauuuuuuuuuuuaacucucuacuuuuuugaagaaaucuuuaacuuguuggcucuacuuauuugcugagacugugaggagaccauuugaaaagcuagaccuaggaguugcugaacugaguaagucuaugguagaacaccugccuggugugcaugaaguuguggacucaguucccagcacugggagugaggggggcuguuagguauugcuuagugccuguaaugugucaggcuuagagcuuacccuuagagcuuccuucaaagucaacacuguuaaauaagucuccugucccagcgacagggugagucaggugacagaccuggaauuuaacugucuuauucuaagauugcgguucugaccaccauacuaugaggcuccccgucaccuucacggaggacggacagugcucucaggagauacauccgucccaccauccacaugcaggguucaacccugccucugugaucugggaccgcgcuucuaacuucuccacaucauggauacuguuucacugaaucaucacagcuugugguguggcugcuauucuuaucuguuuuccauuugaagggcuaguccucagugaggugagaugacuggccaggcugcagaacaguaaguagagcucaggccuaggucugccugacaccuggcucccuguccuguucugcccaggcaaacaggcuugcaggacgcuggcuacaaagccugcagggguaagagccucacuucuccgcucucccucccucccucccucuccucuuaggaacucugcugaggcagcuuauccagugugaagaacuccccagguugccccacaggagccuaggagccagccugccaacucuguggguuuaugcuguuagcucuggugacaugguugugugguuguguaucuaacuuuaggauucccccccuugugggaaaaaaaaagagugaugcgaaauguuuguuuaccuuugcaacuuucuggcacaugcugcuccuucucacagccccugcccuuucuuugagggugagggaaggucacaugaccaugcucccuccugaagcuccuucaugccaugugcagcucaugauccuuagugcccuuuggggcaagagagaccauuguuccaucgccagcacaucaguggggccacuguaaggucaaguuugaaucacaguggggcuagagucuacauucuggcagccaccaggggaucaggacuguccccaaccucuguggcggugccucaccccuccaggguucuggaccccccaagccaugcucugucgaguaagcuugcuuaugaagauauuuuuuauugaaaauuauagcagaggggccagugguguugcucagcacgugagcgcagcugccacguugaggccugaguuggaucccuagguggaagagaagcgacucuugaaaguuguccucuaacugccaguugugggcuauggagugcagugcacaugcgcacacauaaauuauaacaauuacaguagaggcauacauauuucuuccaaagaaugcaaauagccgacaugguggugcacucaugcaguucuagcacuggggaagcugaggcagggggaucaggaguucaaggagaaaccuaggcuacaugagacccugcuucaaaaacuccuuccccccaaaauacuuguuuuuccugauguucugaacauuaaaaagauugaccuaaacuuacuuguuuugagacagggucucuuuccauagcccugguuaucuuggaacuauauagaccaggcuggccaagaacucacugaggucuaccaugcccagcuaguagcccgacaguggugacacacacccuaaccccugcugagucaggcagaucucucaauuccaggccagccuggucuacagagugaguuccaugacagccagggcuauacagagaaacccugucucaaaaacagacaaaugacaaagacgagaugcuuguuuuaaaacaacaaaccacugggcuggaaaguguuacucaaguucacagaguucaguuccugggacccacauugggugucucacaaccacacacaacuaacuccagccucagggaguccuagggcauuaacugugcacaagugaggguaugagugugugugugugugugugugugugucucugucugucugucugucuguccaucugucuguguuuuauacaucagcacacuuucacugugguucaaauaggauaaaagucuacgaguguugcgugucuuaguggucccucucauuugggauuuuacugccguuuuuagucuggcugggcuggaacucacagugugcgcccucccagaucugccucuggagcacugggguuucgggcuugcaccacuuugcccggguuucuuuuugcaagggcuugugcaguccugccugaccuucaacucuucauguccuuguccccacuuucccaccgcugcaauugcgggccugcaccacacacagcgguagucgccugcugaucaccugcuguggcuuucacguuacagagacacacauagauguugaaacuuuacauuucccuuuuaggaaaagaagaaaaagaaacauagagacaggaagucaucugacugugauagcucugacucugagagugacacgggcaagaaggcgaggcauucaucaaaagacagcaaggccaccaagaagaaaaagaagaagaagaagcacaagaagaagcacaaggaaugaggauggaacaggccgcggcagcccugacuccugcaaagacucacuagugagaguguggccugccuccuacccagacuuguccccauggucucagauggcuucucccccugcagcaagcagauuggggccccacagggccccucccaacaugauuuucccuuguugcuccugacccuuugcaagcgaccccugcagccauugcauucaugcgcucagugucuucauuucagcagaagguucuagucccaaccggcugccacugcccgagcuggaguccucugcaggaguccaugcuggagccccgggugcugcuguggaggggagccuggccgugagagagagagcagccccaaccugccugcugucugcgguggcuguggguggacucugcggccuccauccccucagccagggccuguacuccagugacugcugaaccagagauuugcagccacggucauugcucugcuuccugucugucacagugugagugacugguuccauuucaagccucugcuuaaacuccuggcauaaauggaaauguguuugguuuuaaacuuuccaaaaaggcuuuauuccuauaauccuuccugggcgacuuacagacuuaacacauuaguucacagaaaacacuuacuauguuauccaagacccuggaaagaggccaagccgaggcacaaagccaaggccaccagcaggucacagcuuucuugagauuacucauaaaccuucucuuccauagugaugaccgcuuucccuuguauuuguaacccuggggacuugcugggcaugagugggcgacucuuagcagucaccucccaccacaguuguucacaccuggaccuugauguccugagccuguacucuagagagagggugaccacagcacaccauacagcaaauccaggaaugucugugcaggaugaaugugaaauagccacacagugacagccagcugcucugccaugggcaggccaguguaagggcuugcauagaugcuagaaugacagcuagcuucucugagccuuggcaggucaguguaaggguauuacauaggugcuacuguucccuaacugagccuugagccuguccacucggcuccuugacagugcugcuucccaggugaccuauaggccuucauuucaaccugacacacaggaaaggaggaccaaagacagacaacuggguggccuugguucugcuuuauugaccuuggagcacccuuuggauacaguuuuaaaaaauaaaccacauacauaguaggaacuggguccaggcugaugccccguaucuccagaaaaaucccaacccaagaauguuuauacaaaaugucagaggggaaaaccaugaggcagcauggugcugagcugagggguggccaguuggcagaggagcgggcggucagugacggagcagccaggucacgccuccuucucauaaguccgagugcucaccacacugccaugagugagagucu

SEQ ID NO: 2151 - RNA, 1701 nt, Mus musculus
ugccacucugcaacugccacucugcaacggcuucccacaucuccuccuuuuuguuuuaauaaaaugaggcuggucuaggccugugcaauuauguccauccgccauggcuccuguuuuagguuguuccucuaaugucacagccuuucccgucuuagguuggucugugcaugaggaaaguugccugucucuggauaccgcaguacugugugacaguaacugcuaaaugaccuagggugaacuuauggcccacaaagguauacuuauccuggucucaaucaucaggagcaggaucaucuucggauucaucuugaucuuucacgaacccaaaguggauuuuuuucacccgguaccgccguuccucagcugaagaguucugaauccacgcaguccggauccuucucagcagucuguuuugcaggaacacuucauuaccaccguuccccagcugaagaguucugaaucuacgcucgauccuucucagcagucuguuuuacgggaaccuuuauuaaccgcuccuuccccgugaugcaguucugaauccucccuguagcagggggucuuugcucgugccugaagauguuucuugucccggguuuucgacacuucuugcgcgcgcucgacuggccaggaagaacgacgcugcaacaggauccuucugcacacguuuauugggagagcucgauuguagaggcgaaaagacccugagcccagaacuggugcugcuuacauaggccuaggagaggcgugucucacaucugauugguuaacuugucuuggcaaaagaaccuucacugccuauguaugugugguggccagcaguagccaacugccacucugcagcugccacucugcaacggcuucccacaaaaaagaccaggccaugaagcugggaugcuguggcucagagcagagcacauccucaaaugcuagaggcccugggugauugucaguacaccauuacgucaaguagggucuuguugcuccuaagguuucuucuaaagcuuggcaauauguguuuauuucagaauauagaugccuacacacccauagaguuacauccuuuuuguuuguauuuucaaaaaauguccagugcauccuaggcuggccucaaguuugccaaauagcugaugguaacuuucaaauuccgauccucacguguucacugcucccgcucugggauuaaagugugcacugcaccuaauucaugcagugcuagggaucaaacccagggcaagauccacaccaccugcacuaucuccucagcccuacacucacuccccaacagacugggaguccacacacugaucccucuggaguacugucucuuauccaaaaaugcuuauucucaauaagaacccaauuaagguuaccaacuuauagaaagaaaaugagaguucacacugaucguauuugaacauaguaccacaggacucauuuuaauuuuccucuccuuuuuuuuuguaccaaaaaacuccauuuucuugagagugagauaucuucuugcgauucuaaauauuuuuacauauuugaucuggcucugugcauguagccaauuucccacuuucccuucaacucuuugccuuccucacuuugguuguccuuaggaggguccuccucccagccacacugaucugacuuccuuaacaucucaagaccuuaucccaagaacccauucccacaacaagaagaaguuugaugucu

SEQ ID NO: 2152 - RNA, 118246 nt, Mus musculus
auucagauuccaaaguucuguauuuuuuucaaaauaaagaucacacauuguuuagagacaaucuacacaagaguuacaaaaaauaguugcccaggcauaagcauacacagguuuguuaauuauacacauaugguuacaagugugcuugcaaaaaguucauuggaaauauacacaaggcucuggaaauguacaccguguaguguuacagucuauauucaaacgaggguugacaguauguuacauucacuuacaaguagacaaaaugcaaaauacagcucaucuguacaaaacggagggcgagucacuuuacaagggguggcgcugagcagggagggggcaggcgaaacuucugcacauccuuuuugacugucacaaaauaagcgaaacauuaccuuuuuuaggauuaaaaaaaaaggggggggggggacacuagugugaacugaagcaucugaaguaacauuuagaaaggcucucacuaccgucuugacuagcugacaaauaaaccaagcuauuuuuuuuuccuuuuuaaacauuaacuaggcuguauaaagaacauuuauuccuucaaaagaaaaaaauuuacuucugguugaaauuacaauuuacaauauacaacacuaucugcuacgaccauaaaaggugggauauacagagugcacgggcuggcugauucucuucuuaccaaaaacguguucguguugaucaaacuccuccacauuuacauuacagguauacaaauguacaauuguacaaucaaaaguauguccgacuacuaggguacauuauagauacagauuagacaucaaaacaggaaaauacuacaaauccguauauaugcaaagucuacacaaguauacacuauguaucuauagaagccagaccagggccgagcuggguauucucucaugcuaaacagucagauccugcuucccaguguucacacaggcaaccacaggcagcaaguggccaugcccacuggccuugggccucugggguccccgcuccuccuggaucugcagcuaccaccucccucagcacgaggucaucuccaaaaaaagagcgucauaaacuccauaucacaggcugaugcucuagcaacucugaaacguucccauuucauauauguauauauguauauauauauauauuuuauaaacaguguuaaaugccaguuugagaucauuuaacuaaaauucaaauuucucagguuuuuuuuuuuuaauaauaaaaugaggagguggggaagagcuauuugcaaaacuugccacaaggcaaaugaguuaaaaaccuuuuuuugucuuuuuuuuuaacuuuuuuuguuaaaccaaccacccugaaaguguccacauguggaauauagauacaacauugaacaaagcauguggccucccauguacacugauuaccuauguacaaguuccuauacaccaguaaacagcagggcaauuagucaauuaaaaaaaauaauuaguacauguuauguguaauaaaaugaaauuuacaaaggccuuuccacaaguggaucugauucuguuuuuuggaggagggagcaaucccggagcaaccguugcccacuuccgacgcugagcugggcaccucugguugcugguuggaucugccagggucagugaggucagcgggacagggacgugggugcacuguucagaugauaccauuagggggaccacaaaugggccccaaguccacgccauucuucauguaguacuucucgagcuuggccaggaugugcuugccauagguguacuuucgaagcgucgcaauguguggccggaucuggagaggacaguguggguauuacucuuggcuggagaggcaccuccagacccuucccagacagacccagacacagaauauacaguguacauauauagugcuucaucccgaaagguacuccuguccucuuauugcuagcaagccacgagguaaagacgggagcucuugcccuaagcacugacaaaggacagagaaccaugacagaauagccuaugccagccagcugcacguagaaaaccagguuguccugacaguuggggcuuccuuuggggaaccagaugucugaacucaccaccagaucccugccucgccagggcacaggauuucuuccaguuaacagugaccaauugcacuggcuaguuuuuacaucaacuuuacaaguuagacucauuaugguagaggaaaccucaauugagaaaaugcccccaccuaauugggcuguguguggacaagccugugacgcauuuucuuguuugaugauugaugugagugguaccaccaugugcgggugguucugggugcucuaagaaagcaggcugagcaaacuacugggaccaagccaagaagcagcaguccccgugacuucugaaucagccagugccagagcuuccugcccugccugccuuggaugauggaaaaacuguaagaugaaacaaaucccuuccugcucagcugcuuuugguguuguucacaacagcaacagaaacccuaagacauaacuugguaccaggucaguagugcugggagugcuaaggaggauugugguagcaccugaaguuugggcuggaaaagccaccguaugcucagagcuuagugggcuucugugggagcuuuaagauaauguugcuagcaguacagacaaaaaagcacuauuuguuaagcgucugagggaagcaagggcucuacuggggccauuuaagugauauuuguauuaaccgcugaagugaaaccuuugcuuugcugguacaauugauacuggucagcuggggcugugauuaagaaaagaucagcagcggggcggugguggcgcacgccuuuaaucccagcacuugggaggcagaggcagguggaucucugaguucgaggccagccuggucuacagagugaguuccaggacagccagggcuacacagagaaacccugucuugaaaaaccaaaacaaacaaaaaacaaaaaacaaaaaaaaagaagaagagaccggcaucagugaagcaaaucuuccgagagcauuuccucagggucaguacacagacgcuguagcccaggagucaaggggcucgucaugcugcaacaaaccuugguaacguguaagacacucuugccuguuaagaggucauggaacgacucugaaccuuggcacugugagaggauaggaggggccgcugauggggugcagccucaguggguagaaggccuaagaugcaaugaagcaugagagaaguugaagcuugguaauaacauggcagggucagaaucccugaagaauacuccggagagguuacugguaaagguggagaccaauacaguccuuaaugcugcuucaaggauauugaagaauauuuacacuagacuaggaggacaagggaguaggcucagauaagaauauuuacacuggacuagcacaaggcccaagaugaauacaguugaggaauauauuguauuccuuuuaucuuggucauccugauaaaccccuagacacagugacuaugggacuuucuguauugcuuguuuguuccuugacgacuucauccucgaccuagaacugauccuacucuucgcauauaccuagaaugguauaaaugcagacugacaacaaguaaacccgccucagcacuggcuggagucauguuacaauggugucuaagcguccuuucuuucuuuaauucucccucccucccucccucucuccccguugacugcuggcuaagcuggcuuggccccagcuaugcagugcagccagccgaagacuaggagauaacuaagcgggcugugggggacuguggggggcuuguccaagcccucggggggggacccaaaagaccccggugaauccagaacucucacugcugggcuuugguuuugcuuugagucacugugcccuacucugccuucuuggacuaagaaaggauuuaacuuaguuugcucuuacaggagccagcugagagacuuucagaguuuuagggacuauggauauuuuagaggcuugaacuuuuaaagagacuggauauuuuaaagaaacugaacuuuuaaaguauuuguaaagacuacagggcuuuaaacauugaaauguuuuauauuaugagguuaauauuaauaagagaucuuggagaugaacaggguuaaauuaagcugacaaggggcugacugcuggcuaguuuuuaaugucaacaugauacaagcuaguuacuuuagaaggaaccuugguugagaaaaugcccccaccugauuggccugugggcgggacaccccuggcugcuauaaacaaucagauugaacaaggcaagccagcaagcagcacuccuccugccuccagguuccugcuguucaauucccucaacaauggaguaggcuaagugucuguuuuaaagaugagguagccccuuuccuucccaagcugcuuguggucauugugcuugaucacagcaauaaauaaauaaauagaaaaggaaagagacaagugaagagggcagacacugugccaaugcagcucaaggacagagcggaucugacugucugucuuuccaaagacaaacuagggauaaggaagcgcaaaggcaucacaacccagaaacccauucuuccaaccucacgguagucaccacuccccagcccuaacccccaugccuuacuccuccauccgggcauucaugugcacccaggugagagaggaccucacuuggagcgcagagacagcuacagugcugacuuccuucugcucagauauuaaucuuuccacucaggaaacagaagaugggguaagggguguuuuaacuguucccaaccccaaaucauaaaaaucucaaggaguaccaugccaaaggagaggggugaagccuacaaggucagcaguuagucugcucaacugcaagcucagagcaaggaaagggccaaggagcucuagaaauugcuaugaacccacaaagacuacaggcuagaaaauaguacaccucuaucuggguaucuacagggacaguggauggcaacaaauuguucuauguagcaaucuauauaccuucccaaguuuuccuauucaaaggaccugcacccccagguguaguaagaacccaguauucaagaagggcuucucaaagacucaaguguccuuguuugugccaccuccccaccucaaacacccccauaugaguguaaucuagcuuuuacgguucugaaccuucacacagcccuacugcacucccccccccccccacacgaccuaacuguaugcagacagauccuggccucuugauuccagcuucuacugaccacuucucuucagucugaaaaacacuaccagcuauuagcucagcugcuuccauaacuuccccugaagcuacagugguggugcaugagcaagacgauuauuuaaagcacaguccuggguaugaaugauuguuccguggguaaagucacuugccacuaagccugacaaccuccagguuucauucucagagcccacaggguagaagaaaucaaguaugcuguccucuggccuucauaugcacgcugaagcacacauauaacgugucuccucucugguccccaggucuucaucacugugcgccuacuuccagcuccuacauacacuagccucgccucacagcaccuucacacacaagcaaggugugagacucagccucaagugcuccaggcugcaccagccuucaacugccaccaucugcacacuggcugguaguggaauuggucugaaucagagcuggugggauccugucuggcucagaacgaguccauaacaaagauucucauuaucgaacuuuguccucagugagggcaagugggucaucaccgccagacaauagcaaccccuccgcugagaaggcugagggagcucagagcaccaaggugaggaguacuggcuagaggccuuggagcuaccugggacaaauagcuguggugcgugugccuucccuaccuguggaucucuugggugacuccaccaucaacucccacucacugccugggucucugcucccuuucuccugucuaacucuccccagccuugauucugcaguggaggcagugagggccucccgcacggccagcacuguuucccacugcuccugccaccugggccgguggcagggaccaggccuuagccaugugcaugcugcccaccgccuacacacagcgagcaggcuucagcauugugaccagugaacaagaggaagaaugaaggaaggccugggcugaauaacacacagcucagguuugcuggauugucugguaccacuuaugaggaauaagcagauuuaccucccuggaaaggaacagcaggaaaguguaauggaaugaguggaaagaggcaaggagcuccaggaagcaggcugccucuggacugaugagcugaccucagagaccagggagggauuuaccuuacaaacaagugcagcacacgccuacaauuccagcccuuagacagcuaaggcacaaagagccugauuuuaaggccagcaacaaaguaaccccuccaaacacaggcggauguggcuuaguggcagaaugcuagccuagcaugcaccaggcccaccccagaacauuugaacacaggaaauaagcuucuuaaggaccaacaacuucaguggguaaagggcaccugucaucaaaccuaaccaccucagugcgauggagacgugcacccuaacauccacacucaacaaaauguuacaaaacauguagcacauagguaugcuuucagacaaaacacccauacccauaagagaaaagaaaaaugaagaaaauuaaaggaaaaaggaaaaucccagaaauaagacucccacaguggugagggcaggaaggggaagcagagaccacagugacuccacacaggacgagcaggcgacacagaacaagccuggcacaaaaccacaaacaagcccaaucagugucugcugcccucugcacacucugggcugguacccaacuugcuuaccuugugcaugacaaucuuccgcugacccggcucagccacaucgaucaucuucuggaccacauaguuagcauacugauccuucaucaugguguauaaggcacuguggggaccgucguucauggugcacaccucaucaaugagcacagcacgcucuguacgugaggcgugaguaacacacuucuccacaacauugcugucaugagacaaauggagaaaaacaaucagaaaacauccccucuuaggcuacaucugucaggauggacauugaggggagauggcacacauagggagggaacucauuuccccagggucuggcucuguaaaauccauguuuugaucagaaacacugggguaccaagcagugagucaucugagccccagugcuccaggagagaggcccuggccugcugacacgagaaguaaugaucuugagaagccagcagacugacacacaaggcucaccacagagcuuucuaauagcucagcuggcucacaaucacuauuucaacacgaaucaagacuuaggacgauguccuugcauuggugagcucacgcugggcuugucacacagcuucugugcaggacacagacacugggaaauaaauggcaguaguccaggaucagagaaggaauuucauguuggcccacugagggcccugugcugugucagcacaugugagcaccuugcacaguucaucuaggagagcaguaaagaaauaagagcuuccacaaaggcaugguuugcuaauaguaaaugccucgcugcugcacugauggcuaggcccuguccugauugccugccuuuauuagaugacauguauccucaccgcagucccaugggcacagagcugugcaagucaacaacagcaugugcuuaugugggccacugucauugagcccaauacccaauaccuagaauaaguaccgagcugguggggacuggggcaaaggagaguguugggucccaaauccucaaaaagaaaagacugaaaagaagccacaccuaccuaaagcagacauaaccucaagaaacauaacuccaaaggugacccuugcaggcauguggccugccagccucucuauacuaagucacacauaagugcuuugauuaaucuacuccauuuaagcuccacaugggggccauggaagaugugcaugaacacccacacauaccacacaccaugcacccacacaauucuaaaaacacaguuuuaaaaagauuucccuaauuaaaagugaguauuaauaaauaucaauguaagaaccuacaaccauugagucaugcuaucugucuagccaaucccauaaaagcuuggggaagaaaauacuggaaagcugagcaguauuguguucuaugagcagugagaaauaacgaaucugcucagaagaccagaggcaugggaggcuaugauuucccaagccugccacucggaagcugagaagcggaggccugggcagggcugacaaaggcccguucaggucaagagggaggugagugggaacaccucgcaaugcccacccaagggaggaaacaaacgccacaggacggcaugcuggagacagcccuuagauucccuuggcaacugcaaaggaguagaaagagcacuuaacauauugcuugcuuuuuacuuguaagauagaaaaagagaacccacucccccagauuguccucuagcuuccauacauagaccuggugcggugcacacgugugcgcgcacacgcacacacacacacacacacacacacacacacacauacacacacacacacacacacacauacacgaauguaagaacuuagggaacgacucuacagcuggagagcugcccaauccuugcuccccagagcacacaccuugcaaacuugugcugacucaauacaaguacauugccucggaucucugcuacaauuuugcuuuuauccucaggacgaccaugcuccaguacauguuggauuacauaauuuccauacugauccuauuugagaagcaaaaaaaacaggaaaaaaacaaaaacaaagaaaaaaauacauaaaaaaacaguucuguggauuccuaguucuccaucuaaucacuguuuaucucucgugaggcagaggaugggguaaugacauaacagcucugaagugcaucugaaugggaagggaccugcaagcaauuuguaaauagaucgguaguaacaauucucucuuauuacaaaacaagaacacacugugacaugacagcagacuauuuuucuuuauauauuuauggaccuacuuucuaccugggcuuuucacaaaugacuaacuacaaaaaaguagaucuauaauuauuuuagaauugggaaggauuauuugaggaguagagaaauguuuuccucuaauagaaagugcaaagguucuucauuacuguauuuauuaguagaagaggcaaaugccaaagaagaaucaaccaccauuugguuugugugccaauggaguggagaccuucaaccaacucaaagggcacggcuucuaauuacugucuauauauuacuggaacacacaaagaucugaagggcuuugaugacaugcuaaggcaccccccgcccccggccuauaggaguccucuccuggcaaccacaguaccugcacaagcugcucugugugcuggugaagcuccuccaggauggggagggucuggucagggagacagugcucuaggauccucuggaucacccuacagccguacgggugcguagacaaagcaaacaccugaagcagacagauccgagacaaucacuucagugaggucacaucauuaacccaccccuccugcuucacagacaaacuuaacccacuuauguuguuuagaaaugcguguaagugucugaaguagcugaaaccaacuuuuccaagaagucuaaaaugaaauggaaaugagucaaggugaugcaaacuccuuaggaggcagaggcagguagaccuccgagguccacaacagccuguucuagaguuccaggacagucaguuacagagauaaauucugucucaaaaaacaaaacaaaaaaaaaaaaaaaaaaaaaaaucgaaagugucaagcaauugccuuuccaaaagauaggaugaaaaacaggagggggacaaacuggacauguggcuagcaccucuaaucucagcacucuagaggcagacggggaucugcuccaggguagcaaaacuaaacaaaaagguuccagcaggagcucacugguacagugcucguucccugugcaggcacaccacaaagaagcccacauaucaggagugaugauuaaaucuaaaugcuuccauauaaacagacagcugcacaaaaggcuggcuggggugcuguuagguucagagcaauaagaaaguacaugagcauuuaauuguccucuuugauuugacucuugugguacuggggauugaaccagggguucuuucuuguacuaggcaagcaccccaccacugagccgcaacccaagccuacauccccaggauccugauuccagcuuuuccuagaaaguacuaaugugagcgcacaagaguuaaugucuuuaaucccagaacgcagaaaaccaggauaggaguaucaugagguucaaucgaaacaccaaagugguggugguagugguguggugauucccacaagcagcaguggcagcacugcacugagaggaccuuccucggauucagugcaugaagcacucucaucucgauagcugcauggcccuacaguugcuaucugcaaagacacagccugcucauggucuacaacagcuuguagugggugggucggucuaaugcagcuuguauuuuaaugcuaacacuggguccucaaaauauugcugaccccaaugagaagaugcucacacguacucaagccaugucaugugaccuuucuccccaauguaacuugucaauaaaaggccagagccagcgauugggcaguggagggaguaagguggcacuggaguuuuuuguuuuuuguuuuuauuuuuggggggugggggguggggguggggguggugguggguggagggaccgaggaggaggaagcugccacagaccagaaccacguggcagggagaaacaguuaaguaacaaggggcuugauagcuggggaauaaguuggaaaauagcccuagauuugcacaauuuaggcauuuagcuuaucaauaaccuaucuggacugcgcgucuuuuauauggacuuauuaggaacauaaaaauuccaacaccagcaguuaauuucacuuggcaccauaguuuccaaaacccacuucuaagacuagggcugucuccagaccucccuggcuagaaugucuacccagcauguugcuggcaccuagacaguggcucacagacaucuacacugcaucuuuauuguuuuuuuuuuuaauuuuuuuuuuuuaccucagugugccuacugcuaauuaaaacaugcuaaauaggucuuucaccagauuauuagccaagugcuagaucaaagaaauacaaauaaugaaaucuaagaugauuguuaucguugauuuccaaaguggcugaagcacaccguagugcagcugugggcccagaguuccucaccacuccucaaaaacagcacagcagucauucuucuccuugguuuuacuauccguacauacuguuauuaauuuaauguuuuuauagauuaaauuauaugcauuuaauuuuuuuaauagauuguauuuauguaugugugcccaccaaagccaggaagaggugucuaaacccccuggaacuaguuacagacagcugugaguggucaugugggugcugggaaccaagcccaugucuccugcaagaauaacaaaugaucauaaccaaugagccaucucuccagcuccaaugucucuuuccccacaacugaucuaaaacucccaguauccccuagguucuuugucaucuuaagcgugugguaagugagcaagacuccuguccugaaagaacucuaagccauuuaagcacuucuuugagaaauauuuccuccuuaaaaaaaacaaaaauucuugauucaaaugcccaaaaaaggaaguuugcuuaaugcccuaucccauuaacuacagcaaggugggaaaguuuuuuuugguuugguuuguuuguguguguguguuuuuuuuuuguuuuuuuuuuuuguuuuuuuuuugccaaaaaaaacuaacaauuauauccaauuuagagccacucagaaaauuaauggcauaauaaaaugacaacuuuagcccaggcauguccauacccacuugaacggcuagaauacuccaaauugggagccuagccugggcuacaugguaagauuacauuucaacaacaaaucagugacgggccuggaggugaguguucugcacauuucagaucaucaagcuccacacacccucagcuguaagcaaagguacuugguuauuuuaaacaugcauucaaucaugaucuauuagauucuaucuuaauuuuuuauauaacaaaagauuuuaaaaaucgggaaaauaacuagccauggaaaaaauaauccuucagauaugaauacaucuuagcaguucugcugccaauggcagaccccccacaggguaaagggaagagaccuggucacauguucagguugaaaccacugcacaugacugcuucugacugacaacaugacccuaagugacuuaccugccccuugaaugcaucgaugauaaacugcaaagacuggggcuguacacacucaaugcacuucugaaccacaugguugccguucuggucuuucacacacuucaggacauggccaucuagcucccgcaccaucucguucuauuggagacaaagaugagaaggcaccaccagaaucacaggcagcaaucauccagauagccccacuuccuaacaagcaguaagcacugcacagauccgacaaucaaagucaacuauagccaaguagcaacacagcaagugagagaaagcagaugggacaucaaacuugccgaggcacuaacagcaugacaccagcaggguguaauggaagacaccucuaacuccaggucugaggagcugaggcaggauuggaguugcuacacagcaacuucuaggccagccuacacuauaacuaucaaaaccuauuuugaaaaauaugcccgggggggggggggggggggggcgcuagagagauggcucagccguuaaaagcacugacugcucuuccaaagguccugaguucaaaucccagcaaccacaugguggcucacaaccaucuguaaugagaucugaugcccucuucuggugugucugaaaacaguuacaauguacuuacauauaauaaauaaauuuaaaaaaaaaaaaaaaaaacaugccgggguuggaugguacaaccuguacuuuaagugcugaugggacggcaaugggaucaagagcucaaggccaguuuuaucuauaaguaaguucaaggccgacccgagcuacacgagacuucuaaaaaccuaaaaacuaccaaagucaucuucaaauagaaaaaagucaugaggugagcaggauugcaaagcuuauacaauuuagcacacuuauaucaugacaaccauguaagcgucuauuuuuaauaagagugcugacucuagauuuuacccaggugagaaagauccaagagcugggugugcuauauagcucccuccuaacagaucacguaggaagcaugggagcagacaaguuacaaaaucuguuccaaaagaccuggacuaccaagccucaaacacaaggaauggggcgccaugaugcagccuguguuugcgagaaaaccaccugucaauuaucacaucucaaagggcuccuaccucugguagagucaagggacacggggacagacacaaagcaauagaaaacaaauuucagagcagucacacgauggcucgcaauuuaaaagucagcaggaaugguuuucucaguucaguaaugguguccaaaaagugaauaaagacagcagauagacauguucagcaacaauggauguuuggugugugcuggaaccaacugagauuuugacuggagccuuuuucauggguacuaccugccucaugucaccuauauggaaaugcaggaccuggcuggcugggcgucugcugauucuaucuguacuuaucuguauuucugcuagaaugccacagccacuuuaguaacagggcaccacuuaugaacugugacuggaucccugagauacuaacugcagaguaaaugagccauccucuaauagaagacauucaugaucacaaugacuuagucaaaggagcauguauuaacccaacaccaaagaagagccuuauuuuuggccagggauacauacucacagaaccaauaaaacuugacuacuaaaauaaagcauaguccacagcagaaaaguaguccaaggcaccacagagaaacagggcuauuaaaaggacaaauguaagaacucugccugguggcacaagcccgugaccccagcuccucagaggaggccaagcuaggcagaagucuuucaaggccaguggugggcaguuauccaaccuguauaaagcccuugcuucaaccccagcacugccacaaaagugggaagaggaagaaucggagaaaaggacagagaggaaaagaagagcuucugggaaaggcaugaaaaggggggaaagcuggcaaaacagcugcucagugagacggggaagacaccacgaaaagggugcuuuugguaaguggcuaucaugauagaaaagaagcuuccauguggagaaaaaaaagcaacagaauuaaugaugagucacugagucacaaaacccugagguuauuaaaacucauaaugcccaagugaaugacagaugacaaugaacaacuaaugcuagccucaggucugccuaugacuacaaauagcaccuuucuuggagagugggggcagggucuggcuaucuagcuuucuauggguggcuucaaacuuagggcgaucuuccugcauuuggcucccaaugugccugaauuuuacuguguacauccacacucagccagauagugcuuucuuaucuguucugcacaucuggcccagaggucuguuuccaaucacacucaccuucacagcaccuucacacaccaacaaggugugagacucagccucaagugcuccaggcucuaccagccuucaacugccaccaucugcacacuggcugguaguggaauuggucugaaucagagcuggugggauccugucuggcucagaacgaguccauaacaaagauucucauuaucgaacuuuguccucagugagggcaagugggucaucaccgccagacaauagcaaccccuccgcugagaaggcugagggagcucagauuuaccucccuguaaaacuagcuacucaggcuacacuggaaccagagagaugaggcugcaaacuaucugaccauuagaaucuuguaaacuaacugggcaauuccugcuuguucugcugauggcaagccauggacacaaccauaaaccagcaaagaaccuccauacugacagucuucacaguucacugcacgaaucacagagaaacagcaagagaaaagugaaaaggaaacuuacaauuaccugcuggucugagggaauaaacuccaaagcuuucuggaugacucggcagccguacaucugcagugccaaugauaggacauggccucgaauccguucagccagagccagcuucuguucaugacugccaaacuagacaugauguaugagagacacuauuacuugaguaaaagagaaagaccagagaaaacaaaccuuaaccuguguugugcccagccucugccucuugcuguccugccuacaaucaaccauaccuuaaagaacccugaagaauuaaagcauuaacauuaauuucugaagggaaggagcuagacaccuguuauuccaagccagcagcagggaugggacugucuugaagguuccauacacccaggagugauguaguuaauuguguugcauaggcagacaugugcaaggucugugguuggcaagccuuucacccaagucacucugccaagugugagguaaaguacagacaacacuuucauggauuagugguuuucaaggacugcugacaguaacgggaagccuuugaaaagagaagucaaggaacccgaaaugugacaaaguucuccugaaaguuguuuuccaacuuuggcuuuuuguagucauuugaauacaaaaucacagacuacccaagccuauauauuccacgcacgggucuagagaaguucucuggcuuacucuaaaucacaagacuacacacacacacgccacacuuguucugacauccagccuuuagcccuaagucagugacauaauggcagugaagaucgagaaucagagaggcacagcugccuguuucuuaguacagcugaggacugagcaacugagugucugcgagaaguggacagguaaagucuaagaaaaccacuuuuaaaucuucauacaaauaagaagccaugagaaauuugcagauguuggcagauaagcucagaguuccaucaacuauucccagacccaauccuuucucucaguguuuuugugucauucaacagcuugaagcugcuaacaauaagcaaugucaauagcauuauuauaaauguuaauaagaauuuuaaaaguucccaagucucugaaauuugaacuuauuagagggagcagacagacaauauucaucacuaauuuacuuccaaagacauaaucauguuaaugggcaaaagaagguggcaaggccaaaagauguccccacccagcuucagcuuuucacuguggccugaggcuggguauggagccaacuccuuaggcaucuuucauuguuuuucacuuucacacuguugcuguaaugcugcuaaacuaccgaugaccaucuguaccacugaggcagaggcugcagaguggggcucagcacuuagggcuagugagcaucacucuuccaaaggacccaagucugauucccagcacccggcauguagcucacaacuacuugguuccagcuucaagggaucuuaugcccuccucaggcaacucuccaaccccccuauauuaacauuauuuuuuaagaaagcaaucucuuuuaacgcacccaggcagggugguguaugccuuuaaucccagcacuuggaagacagaggcagaagcagguggaucucugugaguucaagcccagucuggucuauauucugugcugggucucuuguagaggcaguuaucacaccauacucccagagcaucuaacacaucgagaaggacaauggugaccgauaaagaacuggagaaauacugaacacuucucuuucagaagacccuagcacuucauuuuaaaggcuggaaugagcuguugcgcuucaaaaagccaacaaaaaucaaaugcucugaagauucucaaagucaaagugcagaauaaaagaagacauacuucaaaaaacuucugaaugacguaauuuccaaacacauccaccauaaguugguacgcagccuggaggauuucauugaagacaagcuggcgcucagcugcuguggcacgcucuaguuucagcugaaugaaucugaagaacagagugaaggggcaaugaaaccacacacagagaagacuugcaaagacucgagggcgucacuugacagagaaguucugcaauacucagccuaugggcccaauaaaugcacuggguuuugcuuuguuuuuuagguucucacuauguagaccaggcuggccucaaacauaaaaaagaucauccugccucugccuccccaagugcugagacagcagucccucaacagaaacuugggguccuuaacccuauccuauaaucccuauccaugaagagucauucacuagcuucugaaguagugcucccugcuuuacuccuucaggaaaccccugcugucucugcacccgccuaggcagcuagcagaagcagggaccauuaagaguaucccuaaacagaaaugggacggagaaugagugacacuaccucaccucgcuggaccccuaggcccagugcaccucucugggcagcuccuggagcagcagggaugagagcaagugcuagaccugcugugggugcuccugggaccuggggacccacucugccggaugacagugccuccuccguaagaggcaucacagugcugaccuaugcacugggcuuccugagaaggcuaccucuucaugaauagagauggauguaaccaguguacaguaagaugucugaacuuguagcaaggccccugccugucucuuggguacugggauuauagguuaugugcagccauagccaguggcaaacaacagcauucuaauagauucuugugaaauagaaacacaggguacuuguucauaaagguaaaaaaaguuguucaaagacaaccacgguccagaccaauaagagcuauuuuaaacacguggccaucuaaugauccccaugaccaauucccucugaaacaagcacugagaggcaaggcagaggcauccugugaaucacaaaaaggcagggaugucuguggugugguauauacccuauaccacauggaggcauggaauccagagcacagauuucaguuaugcugugggccaaagacacguccuuaccuagagccaugcuggucuugagaaaauuccauuauaugcccagcaaucucccgcaguuguaaauuaggguaccgguuguuucgaaaaucuuccagaagucugcuccugccagagggcauaacaucagacauuccauaucgcaaacgagaggaagaaaaaagggugcugcuggggcugaaaaggcuggaggcacugcuugcacugcgguacuuggcuucggcaccgggagcagcagagauguaucuuccacugccguuugugaguccuccuguugguuauagaacaaaaagacuugaguccacgaucagggcccucaucuaggaggaagacgcaccacugcacugcuccuucaccuccacaagccucaccagcucucuccuccuaugucacugagcuaucaucgggcaauuguucucucuacuguggcuuucuaaggcccauacaccaaucugaaggaaacauucgcacagaaauuaagaaagaaauauuuauuuuguuuuuuuucuuuuuuuauuugacuguuuuguuuuuguuuuaaccauugcuagcaaaccauugcuaggaaaauuagugcuuuaaggcuggagauacagcucaaagaugaaggaagcacuugcuagcauguguuaggaccuagguucaauucccaguacuaccuaaaaaggagaaaacaaaaccaaccaguaaaaagaauggagcacuacaugguauuuccuuaauaaauaaagugaggcacagcaccuacaguaaggauucagaaaauacaaagcgagcacacugaggcuuuuuauuucuuuuuuuuuuuuggggggggggggggguuccgagacagguuuucucuguguagcccuggcuauccuggaacucacucuguagaccaggcuguccuggaacucagaaauccgccugccucugcugggauuaaaggcaugcaccaccacgcccggcucacacagagccuucugagcuucuccacuccaagcaacauucccucccagccaaacauggguguggauacagcacugcuugggauuguccuggugcugcaagcagagggaaggaaaucaacacauccucuuuuauguacaggaaauuccuggaaaacuuugugugaaggaacaauuccaaggcagaugguagguuuaagguccucaucaacaggcaauucuuaccauuuucuacgagacaaagcuuaugugauacagcaguaacagccucguaugcccuuuguacugcugcucugauuggugacuagguuauaaauccauacacaguaagaugcugucaugaccaaaaggcuuaacaaaagcaggccugggcuagggugugggucagugguagagucugugccuaacaugcauaugacacugggcuccaccugguaaaacacagacacagucgcacacaugcacacagacacaggaaaauagcauaguagguuaacaacugaagugcaccccaacaccaggagugauuuucuccaaucacuguaaacaagccaacuuaaaacagcuaaguauagagaaacagugcaucagccacaacgcaguugaugaacagcaacuccaguccacggacaaugccgcacacgcugcucccuuccaucuacaugugcucuggauaaagcuuggcauggcaggcaaaggcaccacagaaagacagcucacuugacuuuugccacaaauuccaggacccaacuuacaaaauauaggucucacucaaacuaauggaacaacaacaacagcagcucaacaugacacuguggagaacagucagugagcaucuacagcuaguucuucacagguacauuuaccccauaggaaacuagaacuaagagggaauaaccggucauccaaaaaugcaauuuacaguucuaagaaccagauuagaaggaagccaggcccuuggcgccaugugccucauguucagacucgguuaccucaaccuuccucacucuucaggguacugcuaacucucaccgccacagugcuugcuucugaacacaguggauuuguuuaaaaagaaaagagcagccaaaugauuguucuuucugacaguaagaaaccuuguucuuggagaaaggacaaagaaauggucacaaggucgguguggcagcaggcacugcagauguggugcucguaacaaacaugaccauggaagaccagcacaaacacagcuucugaaguuaagccaggcauuuuugccugugggucacugaaaaaggcggaagguaugcugaaaggaagccaggugcuuggcaacuacgucaaugguggaacaaacuaacccucaacacugcccuacaccucugaauuuccaguuauaugcacuaauaaaugcagugcuguugaagcuaacauuaacuagacuuuguuacuguggccaaaaauauaccaauauauaauucaaaggguuagggggaaugauagcuaauauuaugccauacauuauguauuuauacauuuaugcuuaaguuuugacauacuggcucuuuuauuacugaaaaaauaaaguauauacaaaucucugaaagagaaaaacuuucucaggugauuaaucuggcaauucacaaauguauucugcaugggccaagcagaauuuaucuauacauuaaaccaaucugucaaguuuugcuuagcacuuaaguucucugguccuuucugaaaagaccaucuaggaaacagauuuucaauauuuacuagccaaaucgcucuuggauuaggaauuugggaagcagcaguuaaccacccaguuccuagcagucuaccugcaggugcugggcaucugaaagccuucugugaaagagacaauuaacaugggcuuuuacaagcucacugaacuuccccauuucuacaguguuuggacaguaucuugaagcauuuaagggcuaacauggucuauuuauuuauauugugucauagcuauuuaaaggguugguguccaggcaucgccaucucaccccucccacacucccucuacaccagcccccccgccccccacauucuucacuguggugagaacugaggcuugggcauuccugcuagguaaaaacucaaccacuggcuacauccucacuuccaauauuuaauacaggcugcaguguucauugaugcuuuaacacaucuugguaguccuaaauuaaauuaaaauauguccaggcagucaaacucauagaugacagugcccagggagagacuccugcuucuuguugcuuuuguccagccgggauaaaguucaggcagaaaagacuuuaucuaugugcuaagaaaaaguaacuggucuccaaauauggcucucucucaacccugcaguacuagugcagcucaggcgagguacguagauuucugaguuugaggccagccuggucuacaaaggaagacccugucucaacaaaaauacaaagccccuaaaugguagaagauaggccuuuuucaccuugaacagagucaggaggacuagagugugcuucacccgugguggugggaacaggcacaacucacccagguucaagagccugaggguugcagacuguacaagccacgcaaacucucucaacaacuucugauucucaagagcuuucuaaggcacaacucaggggcugcagaaaacuauaugcauggagagacaaaccagggaacaggaacacgauggucgcagaagagauguguggcuaagcagggcagacagaaauaacagccgacuuugggaacauccacaacagaguggccaucaacccucacaccuuuccugaggaagcuucuuuguguacauccacaggcuccaucuaauccacauguacacugcagaggagcucugugacaacagcucgacuauguggaagggaugccugcuaccucagccuugcuuaaacucacauucuguauaucuuucccaagcuugaguguguguucgcauacagugcguauauguguauguguaugugugggacugggcaaccaacagagguccccaggcuuaccuggcaggaguaccagcugagcuauggaaccaguccuaacuguauuauaaaugaagaugaaauggacaaaucuccuggaaagcccaaccgccacuacugaaccugacuuagacacaaaaccugccguuuggcagcgucacauccaagccuggucuacacgaguuccaggaaagccagaguaacacccuaucucagaaaauaaaacaaaauccaguggugacaacagugaggacaaguggugguggugcacaccuuuaauccagcacuugggagccagaggcagggagaucucugauuucaaggccagccucaucaauacaaccagagcuacacaaaagaaacccuggcuugaaaaacaaaggggaaauaggaaagggggaaggggaaacagacagaaaaaaccuaaagccguguauaaaacccagacauaaaagaauguaauuaaaaaccuuaagaauguuuuucugccgggccuguuaucacacgccuuaaaucccagcacucaggaggcagaggcaggcggauuucugaguuccaggccagccuggccuacaaagugaguuccaggacagccagagcuacacagaaaaacccuguuuggaaaaacaaaaacaaacaaacaaaaagaaugguuuuuacuggugaaucugcaaaugaauagaguagaaauaacaccuguacuacacaacuuccagaaacuacugggauacuuacaauagggcaagaccacccuggcaacaggcauguagcacaaaacguuacacacacacacacacacacacacaaaauacucuauuucacugauauagauguauaacucaagaaaaucuucacaaaaugaguccuaccaugaucaacaaagacaaaaaguacuugacaauaucaaaacccauccacaaaacaaaacaaccucaacgugugacaguggggagcuuucuccuccucauuaauccaccacaauaaccaacugucaacaaacuucagggcaaaugaacaaauacuauccccaggaccuggaugcagccaaaauauauguuccuuccugcgcuguuauagagaaauccuugggaauuugccugagaccauuagaauaaacaaaacaaugaguuuucuggauaaaaucagugucuuaggguuuuacugcugugaacagacaccaugacuaaggcaagccuuauaaaggacaacauauaacauauaauuggggcuggcuuacagggucagagguucaguaucauuaucgagguaggaccauggcaccgcccagacaggcaugguacaagaggagcuaagagcucuaccucuucaucugaaggcuacuagcagaauacuggcuuccaggaagcuaggaugagggucuuaaagcccauguccauggugacacaccuacuccaacagggccauaccuucucccugggucaagcauaaacaaaccaucacaaucaguauacaaaacucaguaguauuucaauaaaaaaaugaacaacccuaaacuagaacacacucucacucauaguagcauauaaaccacacauugaaaacuacaaaacuuuacuagaaaaaaagugcaggaacaaaccagacagccacacgucaagaugaauccuaacugacaagaugaaagcauuagcucaagaugagugccuaagcuuaggaguuaaaacaauaaagcacuugcugcgcuccuacaggacgggucugguucccagcauggagcucacaacuagacacuggccucuuagcggggccugcacucaaacgcacagacccacgcacauaauuuaaaauuacaaaaauacaucuuaaaggaaaaaaauaacaucaacaacaaaaagcaguuuuuaaaaaaaaaaagguaaaacauuuagaagauagggaaauauuuccuacauaaccaaaauuucaauaaagugaacuucaucaaaauuaaaaccuggcacacuuuaaagacaccgguuuuaaaauagaagaagcaaaagaugagaacacaaagaucucuuucuuauaacucaaguaacccaaaguuuuaaaugagcagagauaacuaaaggcuaaaaaagcacaggccuacaaagccaggccuacaaaacuagucccugggaggauuauacaguuugaaagcagccuagccuauagauacuuugucucaacccucucccaaaauucuuuccaucacaagcugggagugcaacugaaaaauaaaaagcaccaugagauacuauuccugguccacugacagagcuaucucuaucagaggcgggcaaaucugugaguuccaggccaggcaggacuacauagccagaccccaucucaacaaaaauaaaaugcagaucauaaagcuaacauacaagaacgccuaaaacagaaacacuugcauuaaaauguucauagcugaaugccacgcaguggaggcacaugccuuuaauuuaauuccagcacucaggaggcagagguaggugaaucuguguuuccaagcucagcauggacuacagagggaguuccaggacagccagggcuacacagacagacccuguuaaggguugggggagugcacagcuguagaacaaguaacagccaaagcagaaacaaaagaugugagacagacaaaagguaauaaaagggcucacagaaauaauucaauaagaaggaacuaccuacuggcauauaauguaucauagacaaauaagagaaaauaaaaugcaaauuaaauaauacaucaguauuaacugcaguugagaaugagugcagauggguaugagagauuguaaacauuauaaaagauuuaccuugacagccacagaacuuacagccaauaaaaucuauccaacagauuacaucaaacgagguaaauuuuacaagaacuagaaguuuuaauuguuaaauuuagaauggaaacaaaugguaaugaaaagucacuggggguucuuaggcacauacaaguaauuauuaagcacauugauugcuuucuuagaauccucaaaugcauacugacuauagggggucacugagacugcacacagacuuaaagaggaaaggccugcaucagcauuuucagauccaaugugcugacccagagccacuacauauaguucaggaccuaagcucuaggacacaggaucugucuggcuaccaccaauuuuuuuaacugguuuaauuagaaguuagcuaggcuggagagauggcucagcagauaaagaacccuggcugcucuuccagaggcuccagaauggauucccagaacccacaugguggcucacaaucgccucuaccuccaguuacaggggaucuuuuccucucuuuuagccucuuuggacaccagaaaccagaaacacauuuggugcacaaacauacaugcugguaaaacacccaaaugcauuuuuuuaaaaaaaauuuaaaaaaaaaaaucaaaacaaugacaaaauaugccaacaacaguaacaacacaaacaacucagcaaaacuuuuaguuacaaugugcuggcucaaaagauauacugggcacaucauauaaaaaggucauacauuggaaaugagugauugagaauuuuuaaaauauuucaaaucuuauacaagugaaacaaacuacuuaagcucugagaaggcuccccacauguggaauggggugcuaccccaucccugugcuucccagaggugcaggaagugagaguugcugugaggagggcagugcagaucaguggcuguccaggccuccucagagccuaucacccucuugagccuccugcagccaggcgcucagaaaacacugucacacagcaugccccagccacucaccuauccaugguggacagucaguaagaauguccuuccaaguuuucuccaccucagaaaacacaugugugcgugcacacacaugcccaugcacacacaacugcaugcaucacuuccuucaaacuguucuaaaauaacuauuguagacuuuaucaucagacuuuuccuagauugcauaaauguaucuccaaaugagaucaugcuauucacuuuuauccaguuaucacugccaagucccugaagccacauuuaaacauguuaggcaauggcagaaucuucuggcaagugcauucuugcugguuuguucaggacacucucauuuaaagccaccaccacaaaaauaacaacacucucaccucgccaucugcucauaaaaugugcucuccacuucucuaauucaacuuuccccaucugggaaauaaaucauuaccuugaaauccauaccugagagacaacgggaggggggguggggguggggguggggggcaugccuugugacuggguaagaacucugcaccccugcccagugcuacaacucuaaucuuccuauauucuuaaagccugcuguuuggaaccuucaucuacuuauuaacagacuauauauagguuuggacuuuuuaaaauuacuuauuaauacuuaaaaaucuggcaaaaaauuucaauaaaaugcuuugugaagcuacuaacuuuuauaugagggagggggggagaaccuaaaagaaauuuagcaguauauucagagcucucuaguaacuaugaggcuuuacuaguaacuauucuucugccucuguguccuucugccucccugcaaugacuuuacuguguuugcccaagagaaaauguucacacugaggacagagugaauacacaagguguauccagaugcuaggcaauccccaacugcuaggaagcugcagguacaaccugagcaacuugaggaaucuaucaaaggcacagaacaccaggacacuucuaggauaaagggacuguccuuugcuuaugcaaaguacuugaaaugucaucaguggcaagagacuucuagcguucaaggugguguuagaguaaugguucuuacccagguuuaagcuugaagaggauccaugugaagagagggaaggagguggugucugugaauguccuggucccugacuagggagaggcaugcccacggguccaggagaggaggaauagcuaaggcugcuauaaaaacuguguccaaugggggccaagcugcucgauguccucuuauaaaggucacugcugccagucagggagucacggcgggagccacugccaguguuggaguuugcaacuaaaauggaauuaaaacaaugcagauaagcacaggccuguucuuugaagaacaagcccaguggccuguuccuaacacuuugauccagacuccuuaccacugcaaaugugucagcagagacagccuaacuguuaauguagcaguucuaggggcagcuaacgucauaaagaggacauggcuuggguuaacagcuauucaagccaucacacaaauauggcaaauuucccuuccuuuagugucgcagauagaaugggaugggggcagguuaaaaagcccugguggccacaugagcuacgggaaagugaaggaaaugaccuaaaugccuuucaacaccugaaagguucuagcagaaaaauggaauacaggaaggaaaaaaaaaaagguguguaggugggguacugcccaccacuacacagaacuuucuaaugcaggccugucaucuuugggagcuacugcuagccuacaauucugauuagugcaccuucucucagacaugcaguucuguucugaaaucacacugcugauaaccacuccacguaucccauuguccacagacuacaugcuugcguucuuuucccaucaaaacaaauauauuuuggucuaacauccuuccucccaauguuccacagcaucucccuuaccaauguucaaaacacugaauuaaaaugccuaauuguuuaagacguuccagccaagccccgggcacaggucugaauguggagcacccagccugcgaccuucugugauuccuucucucucagccuaaucucuaccacugcuagaguccccuccacaagcucccuaaugccugaagaaccucucucuaguuuucaccgccugaaacaagcugacaaagugaacauaaguaaguagcaacgcgaacauggaccuggcugcauaacuucuauaguccaacaucucaaagguuaggugggcuggcuauacugccagggacuugguccacauuugccugugguaucugugcaggaugucaugcauugucaggguugcagaaagauuauaaaucucauucaaaauuauuuaaacagcuucucagccuaacuuguaccugcuguuccaaacccuccaagggccgaucccaggguggcaccaagggaacugcugcuuccgaaucccaaggacguguuggcaggcugugcagagcccugagagaagagggagcugcucugggaguuacugcucagagaguuguugccauagaaagagcuggaagccagauuguuacugggcugcugcugaggcuggggcuggggcugcugggugccuaaaggucgaaaugguccauuuguaguuccggcaagaccaccagcugcuccguuugcugacgcugcagccgcugcaacagcugugaggaaggaagcacaacguuaggcggagaacggcgcuagccacauacccagacucuaccguagccacuuuaagaaauacuuucaacgcuacauuaucuuuucaaggcggacacagacuuuauaaagaucuguacaaauccauuuugaugccuucaucugaagcuuuuacugucuauuucuauuacggacuugaauuaaaaguuccacacaacaagcucuuuaugcuaggagcagauuuaaaguggcucaagcauuauauagacccauuaaauacaacuuccuaaaacuccuaaauucuauacuuacucccacaugagacuuuuucauggaacucuuuuguccaucuauuuaaguccuucaguccuacacuucuuuuaacaugcagauauuuucguaaaugcccucuacucucauucauccacccaccuacgcuucuagggauaggauugcauuauguaacucugacugguauggaauaugaacucaagagauagcuccaccugccucugccucacaagaacuggaaucagaagugugugcaaacacaagcagaugacucucauuuaaaacaaacaaacaaacaaaaaaccccucauguaaagagcuuaaaaauccaaauuuuuccauacugucaaucaauacauugcuaugacaguccucugggguccccacaguuuuacuccaacccuaugccaaagcaguuccccccaauugggggggggggggggaggggagagacaugacacaaaaauaugucguuagccuuugaaugcugccugcugugccauuuccugugcaucuaaucaggugccauacaauugccaacagaaucugaaucuaccaaaaugccuugcagcuacugacucucugaaagauuauggggugaaaaaauagagacuuuaccgauuaaggaccaucagagccucucugaaggcuauuccugacagccacccuuccccuuuagcucccucaauggaguucuccaaagcgaagcucacucaccugcuugugcagcugaggagcuaaugaugacuggggcuggagcaacaagccggacuggagcuccgaggccauuucuugccccugcauucaccacaagggcaccaguuuggucauaguaagcagcaggugccaagacuggauaaccuggggaaaguaagcagcacacaaguaaaaaccauguugguuaaucuccgcugccaagguuuuaaccaccaugcaagguauuagguggaaaguccuccaauaauuagugaguguuaaaucacguggccauucuaaaugacaugaugaaguuucacaguacuccaggucccaccucccuacaaaugccaccugcccaucagugauagcagccuagguuaccagacuaucauaucaguguaggugcuguagugcuugaguacugaggcugcugaugugccagaauaaaaucuccguauuccaguuacuacaggcgcucuacaggcacucuuagcugugguggugguuuggacaagaauggucucuauaggccauuugaauacuugguccccaguugguagaacuguucagaaagauuacaaaguuuggccuuucugguguuaucacaauaggcugaguuugugguuucaaaagcaucauuccuaguuugccucaggcuuauggaucaagacagaagcucucagcuacugcuccagcaccaugccugcugccaucuucucugccauuaugacuugaacucuaacacugaaacuaaacuguaagccccaaauaaacucacucuucucuaaguugcuuuaaucauggugucuuaucucaggaacagaaaaguaacuaagacagaugacagucuccuaccgggcauugaauucauauuguuuauaguacaaacaagauucaguacuaaccagucuagagucacacacacaugggucuugcaauccacaguaaucaaaggaacuucugaauuacauaaggaaaauguauacugaauaccaacauauuauaaauaaagauaaauucaguuuugggauuacauagauuacaaguuggauguacaacuuggcucugucacuuacacagaugaaaugccuugaaucucugagcauuaauugcccaaucuauaaaaagccuugggagaauuaaagaaaagcugagugagaagggugucacagcacuuaagggacaggagugcucucuucuauuggucaauuuaggacagggaauaccauuccaucaaaggcuggccaagaccaauguacugcuuucuuuacuaaacaaguagcagaaguaugaguacaacaaccacaguauuugcauaccacacaguaauccagugagaagagcuagguuagguucaacugacaaaauuauucacugcuaccaagcaucuccucuuaguaagaauugugugcacaugcacaggagaccuaauacaacccacagauaaguaacaaaauacacaaggcaaguugaggcuucucaguuuauaaauggcuacaucggacaagaaagucucacaaaauuaaguaccuguuucaaugaagaacaugacauuaaucuauguucaaugcucaccaacaaggcaguaaaaagaccaacagacacuggugacacauuuacaacucaguggguaaccaaacaacacuuagaaacccuacaaauacaaaugguggcuacuuaagagaacagcagaaauucuuucucagucaagcggcucaaauacacaggcauucagaacaaagccaaagacuauugugaaagcaggaugagcacucuguccacuuuaaguccugaggcaaagagagaccaaugaagcaaagcucaccuucucacguguacauacacauccgucaaguguucagauaaccgugacgaccaaugacuggcucagaacaaagcucucaucaucgaccucuggucuaagugagggcaaguauguaucaucccugccaguccccaguccgaagccaaaaacacucccucaauucauaccuuuugggccccacaaacuauuaggaacaucaaugcuaaucuuaccuggcauaccugcagccaauccuuguccaaaggcaagagcagaauucacugcugcagcugcuacaaggggaucuguuuguugucccugcugguucugauuuggggucaaaggacguuggcuagcuccuccacgaagaaccugggaauaauaaacagaaaugcuaucucacaggacuuacagaggacacaccacaugcucuacuagagucagucuuuuaaaugacagcuaaauaaauaaauauuaaaggggggggggagcaaagcccuguagaacucaaacucucugccuccuaagugcuggcauuaaaggugugugccaccacugccaggaauaaaauguuuauuuuuuuuuuuaagauuuauuuauuauuauauguaaguacacuguagcugucuuuagacacaccggaggagagcaucagaucucauuuugagugauugugagccaccaugugguugcugggauuugaacucuggaccuucggaagagcagucagugcucuuaccugcugagccaucucuccagcccaaaauguuuauuauaaugguuucaacacaugguguggcuacuaggguaaaaauucaauuuauccaucauuugguaaaauuucauucugguauaagaauuucauucuucguucuaaguacaaccucuagaaacuguagauuaugccagccaguuggugacacacaucuuuaaucucaacacuaaggaggcagagguacacagagaaaccccaucuuaaaggaaggaaggaggggggaaagagggagaagaggggagggaaacaaacaaaagagaagagaaaaaauaacuaauacagcauugcucauuuuaaucaaauagcccuuaccauagaucagacaauaagaacuauaaacaaggcaggcaaaguaugugcacucacucuagucaauaaggcuggagagacagccuagcuuaacaauaagaacucuuaauuaaguacccagguucuguucucagcacccacaugguggcuaacaacugcugcaacuccaguuccaauagagccaaugcccucuucuggccuugcagauaccaggggacacaugcgcauacaugcauacaggcaaaacacucuugcaaauaaaacaaaaguaaauaaauugaaagaaggaagaaaacauagagcaaugucagaguucugucacaugggugacaaaaccuaaaaaggauuaggagggaucagccgagacagggggcagucucagaaccuggacguaucugugcacacuacauagccaucccuaaacucaguguguagcucagggcaauucucaacuauuuaucauccuaacuccacuaggcaugccaccauacucaguuguacauggugcuagggauaaaacccagggcuuuauaugugcuaggaaaacacagaacuaauaccaacugagcaaacucccaaaccaaagcacaaaauucucaaccacauuuucuuuuucuaucuuggauggagcuucaagugaaaauaggccccauagguucauguuugacuacucugacuccaggugguaaaaaaaaaguuuaagaauuaagagguguggucuuguuagaggaaguaggccaguaagggugagcuuggaauuucccaguaugcucguugcuucccacuuuuuugagauguggacuaacucucucccugccuccucucucucagcugcuaccaccuucccucagccaucauaaacuuuaaccccuuggaaccuaagcccucuuaaaucguguguguguguacacaguuucucuguguagcccuggcuauccuggaaccuccucuaacauucuggcagggcauggugacugauaccuuuaaucccugcacucaguaagcaaggacaaacagaucucugaguugagaaaauggccuacacagugaguuucaagauagccaaaaaaugaaaagggggacgaggggcauuuuuggaaaaugucauuaaguguuugcugcccaaggaugugacccagaaccagcacgcuauggucauggacuuaucccagugucagcaacggagagacagaggaauccuggcucacuggcuggauagcccagccuaauuggugagugccagguaugggugagagauauuugucucaacaaacaagguggcuggcuccugaagaaugacacccagaggcuaauaacaacaauaauguauccgcuaaugagcacuggaacaaguaugugaccguguacacaggaacucagcauuuuaugaugaagagcaacaucaucugacagacugacagacaaacacacacauacauacacacacacaggaacccuguguuuaugaagacaucaacaucaguugugagucgcuugcacacagaugcacucacuggucugucacuagcacacaucacaccacgcccacccucacaggcucuccuguuaccugcugcugucccugcugggccugcggagcgcucugcugaguagcagaguuuguagcugcugcagcugcagcugccugcugcuggaagagacuggcaggguagacaccccauggcgugacuccauaauauuggugagggaccacagcugggccuagagggaaccagagaaaagagaaguuuuacaagugugaucuuaggauuauucagaucuuaaaaggugagaccccaaaaaaaauauuaaagaacauaaagauuugugcuaggcaauauuuaugagagaggagagagggacugagcuacugacuguauuugaugcucuucugaagccaggcugcacuacagccagacauauauggguaaagugagaaaacuacugaaaagagaggcugggaggggaacugaaggaauagggcuuaaaaacaggagaaacugcgagaucuguuugucagacaaggccgugcuauguagccuagucugacuucaaacuagagcugcuccuuccuuagccucccaagugcuggauuauagacaugaaacagcauauccagccagaagucauguuuaccccaugagaaagaaaagaugcaugguagacaucagacaaaguuugcugugaaagaggaauacauagaaagugcaugaguuuaaacagaaaggacaagaacaaauuucagcuguguucugccuucaccagucaucugaggacuagcugaggcuaccaagccccugcaucacuaaccccagaagcaaucuaugacccuucacauaacuggaccuccacacacaauuucaaaaaucuuugacuauuuuguccauguuuaaagucagaagguuauucaauacaacaagcacagcacacacucacacauuguuauaucaagucucacauuucaagcugacugcuacugacaaaagcacagcgcaccuuaacccugacucaccagagcuacugaccacagcacagaaacucaacacucugcuccaggucaacaguucaccuucucugcugagaagggacagcucaacguccgccacacaaggcaaagcugcagaucugaacauaauaagguagcuuggagagaagccaguggggucaaagucuagaucaaaauuugaugcugaaguugguaccaaaaaaaacaaaaaaaaagaugugaauccacccucaagacagugucaugacuuaaagaguaaauaguuugaguacauuuuacauauuuaaaagaacuuacacaagaaggaaaaagaagaaacuguucaaagacagcuccuggaaucuggugaaauaugccuucuuucucggucccagcacaaggcuaagcacgugcagcaugacuaacagugagcagccuugcauuuaggcuccaagcuguuccaaauaguacaguugugcuggcagaggagcugcuucucauuaaauaaaaauaaaccagcacacacuggcaagguucuacaccacaaggcagacugcaucacugccuaaucauaagcuccaucuaggugggugcuguuugaugccuauggcuuaccaugaccaagaaugcccacuguguugcugaggaaauguguuacaauacggaccaucuucuuauagugagaauauggacuaaagugccuugaugacuuuucagaaccuuaaacaauucaaaagccuggucuccaaguuaaagaaaaugacagucuccaaacucaccugacaagugcccacagacaguaagguaaaaaagccacaaggggggaggggagaaagaaaccuaaggaaacugucccacugccuggguuucuuguucauacagcagguaugccagguuaaggguguggccuuuuggccuuuaagaagaugggugugauucugcaaggacagcaccuuaaacacuuacacucagccaucaaaucuuugagcugguacuucuacuacuuggaccuuggucauguggucgaaauuaaacaccccagagugcuuagcugaaacuggcuaaucagaaccccugguucaauuucuguguuaacaaaaauccuuccuuccguggucuggguaguuaaugucucuuguuaucuggcagacuauuuaaaucaucuuuagucuaggugauaugcaaaccaccuaucaucucaucaacuacacauucaucauccugaugaucaaaaacucagagaaacuagcacuaagggcagugcauagcacucagguguggcaaauguuagugggagccaggcaaggucacacuacugacagggcugugcugucuagcucccaaaggcaaguaggcugccaugccaucauaaucagggaaaccacuguggagauaaucuacaucacugagaaccacacuccagucacugaaaucuuacacuaaaacugguugaaaagaguguaacuuacacagguguacaccccaacaguuucagagguuguuugcugccuuuguucucauauugaaaugaagccacuuaacauuuauggccccucugagacaacaacugugcuacacagauuuaaaaaagaaagguaccugacuuugggggaaaaaaaaacauucaaaaguucagggaaggaaaagacaacugaauccauucacaagcaaauaaaaguugucaguaacagagacacaagaaaugauccaaaauaaaaucaggucaugccaggcacaaagagugauuacuaucuggaggcagaggcccaagcugguacaguaaggaaccugaaaucagacaggacugacugugguguacugugagagccaaugugacuauuaaagaauaaaagagcagugcauugguaagcucugcacacaagucaucgagagaggaugccagcucagccaaucuuagaauccugacacuagagcuuuguagugcuaaucccaaggaccaaccaucguccccucaggcucugaugagcucuaagugagaauaacagaaccacgccacauuucagagcagggagaagagaaauccaagagagaaguguuaagacuugugcucaaaagcuaugcaauuuagaggacuggagaaagggaaagccacaagcaacgagaagguaaggaaacagugagcuccuauggaaccaaaagaaaagcugagcaaauccccugcacuaucaacaagcaauucuguggacgaaagcuacugugggacagaauaagugaccaccuuauuuuccuaggcagaacaggacaauagcuaagcagagaaauaugacuaacaagggacuggcacuaaaaccaggaggcauuguuggagacauggcuuuggcagaguagaaagaaggcaugcccguuucaaaggacuuuucuagcaggugagcaaaucccucaugcagcacgugucucaccgagugucgcugcugcagccaauccagcuguguagggguccgucccugggggagcagcgcugaugauguauggguuggggacaaacgcagcgggagcuaaaccugcuggaaacauaccugucaguaaaaacaaacgaccaaacugcagcccuacuacacaccucucuagucuggcuagcauuccaggcuauagaugaaggggacaaaagggaagagagaacagacugagaguaaagaggaauuucacaaagauaauauaaccucaguaaaaagucauaguggcauuuauccaagucagugugugucugugugugucuaugucuauguaucuguguguauacacaaggaggacagagaagacagcaggugccuuccucuauggcagugguucucaaacuuccuaagaaccuuuaauucucauguuguggugacucccaaccauaauuauuucaucgcuaucugauacaagagcccaaagguugagacccauagcucuaaggcuuucuaccuuauuuuuaaagacaaguugucuugcuguacaugaggcuugccauuuuaacuacacaacacaggccagcaggcuccuuggauccucuuguucccauuccccaaagcugggaucuacuugccuucaggugagugcugaacacuugaacucgaucuucuugcuugcccaguaaacacucuuaccuaccaagcuucuccccaguccuggugggcucuaugaaaugggggauucacuguguagcuuacgguggccuugaacccuccugccucagccuucaaagugcuggacuacaaugccuacuuuagcccacuaugggcaaccucuccuaucuuuacuaaagcaaugcuugcaacaaaucauguauacagcauuuuuguucugucuccugaaugucaggcaaccccccuaccuccaaacucuaccugccccuguuacagucuuaaauucagcuggacagacucuuagcaauuaacuuuacugucuguguugcuggggauugacuccagggcccuggaguccucugugcauacucugaguuccaucuccaagucuuaaaaucuuaugaauuuucaauuuuacuauuaaaauuauuucaaaacacuuuuauuaaaugaggaauuauuucuacuaaaaacaauguuucaaaggaguuuugguauuaaugaaaauuuacauguacacagcacuggcgggucuuguggcaacuaggguaggauuaaacccucuucucccuugcccaccacacccagggcugccauagccuuucugcucauuucuguuacauuuaaagcaagaauaaaagaaaucucuccucccacuuaguuacaguuagaguauuuuguuuugaagaacccuuaaaaaggucugguggggcugccaggcacagcagucacaucuaugauagcaacacuugggaggcugaggcaggagaaccgacaugagucuuaagucuagcugagacuacaccaugauccugucucagagaucuagaaauagagguccaaauagguugaaaggucaaagugaagauuaaaaugccucccaaacucaugacaagaaggaaggcuuggaagauggaucuuaaaagaaaaaaagcacuaugggcuguucaguaagccgagaagcuaaucuggucuauucacagcugcaacaagcuaaucacaguuguggaaaucuacucauuuauuuggggggacagaaugucacuguauagcccuggcuggcuuggaacucauagagguccuccugccucugucucccaaguucugggauaaaugugugaauuaccacaccagcacuguugccugaaaucuuaccaagugguaucaguagucauuucucuaguaaauuauuuaaauccugauuugggaguaggggggaggaauagaguccagugaaguauuauaaguucaggucuaguacaucaaaaauaaaauauggggcaagaaauaacucaauacaaaaaagaagccacuuacucuguagaaggcauuugucugaauuccaccuacccuugacuuuucuuuuuuggacacagggcaucacuguauaaucuagguucaccccaaaugcguuaucuauuauauagaucagauuggccugggacucaugacauccucuaaacucuuucugccucccaggguuaggauggacuuuaauguuagugaguuacugguuuucccagcauccaccacuccuagguagaaagagacaugggcuuaaggacuuaccgaugugaggcuggugggcugcugcaagugcauacugcugcugcugggcagcugucaacugcugaacagcaagugcauugggucuuuggaauagcuggggcaagagaaagauguuauaguuagagaacugcccugugaaaugauguugcauuagccucuguuacacaugaugcuccacucccuggaagaauaaugcuccaguauccauucucguucacugccucauuuaguucuccucucuccauagacugguccucugucucaccuuuacuaagcuccugauauacacacauauaaaaaauccucaauaguaaccagcaagugucuagcacagagugacuaaagguaagaauacugcgaagugacuuccaugggaccccgagguuagagucuacccaaacagcuucuaagaccgagcaaaugaguucuuaccuagucaugcuuuggagaagaugagaaaaguuugcuuuacucucuagaaaaauuauuuugcauaccuuccuaaauaaaguagcagcucuuccuaaugaauuaagagaaaugccuggcuuugggaguuucagggccuccuaaucuuacucuucuuggacagugaaaugaacagaagugcagcuauugacaaauuuucacugaaccagcaagguucuuaacucuaagccuaacaacuugagucucauuccuaggacuacaagcuguccucugaccuccuacacugguggcaucugcaccugcacacaaaauuuucauucacaggaaagagagaacguauuuuacacuucucacuaaaaugaccccauauacauaccuauuaauauaaaauauucacagucagcaauucaccuguucauuuaauauguauuuacuaugcaaggaacaggaacauuuuaucaugaagugaugaagaaaggugaaacuggcaaccugauuguaaagagccucaaaggcuuccuuccagagacaaauugcugaauagcccuguucccagaacauagcuuccaaccaccuguucuuucuaucggacccaucaacagccaaguucacaucacuaggugauaucuaacagguaguacagaccuugaacuacagcccuauuuaucaagagacauuggaaggugccaugaucucaacucagcaaaauuaccauugaaacuauucuuacuguuaauguauacaauagagauuuaauccuguggccuuacgcccuaccucugucucaaacaauuauggagagaugguucagcugauuagagcacuugcugcuuuugcuccaggaucaaucccaggaccuaugugugcaccagguaaagauguggggugugggguguaguguguguguguguguguguguguguguguguguguguguaugcgcauacaugcaggcaaaacauucauucauacacauaagucuaaaaauauuuugauaguuuauuuuucuuuuauguacauugguguuugccuguauucaugagagucagcuccccuggaacaggaguuacagacagcugugaccugccauguggguguugagaauuuaaccuggauccucugagcagccagugcucuuaacuguugaaccaucucucuaagucccuacaaauauuuuuacauaaaaagcugcauauguugaaucccaguggccacuucaaccugaaucuuacuuuaaaucuuuaaaaaaaaaagaaaaagaucuugccgguccuuaggaaacaauaucauauacagauuuuaaaaaacaaaaacaaaucaaaaaaccccuuuggcuuuccuuuuccaagguuaaaguaaaacuucaccaugaugcugauaaaauaaaaaggcauaaccucauacacaucuaauaacaagcagugaaauacagggacuagaugaauuucucaagcuuuccaaacacuugucuacccuacaaugagagcuagucagucagugugucuuagaagcugcauuuguguaugggugucucuagcaaauggaggcaguccacacaggaguaaagaggcugggaauauagcuuagugaugaaacauucacuuagcauguauugagcccuggguucaaucacaagugccaaaaaaauuuuaaaaagcagauaaauaaaaacuaagauaaaagccacauaaaaaacuaauaaaacuuucugcaacagccacauucucaccaaugcucacauuugcuucuaugccacccucacagcccucuucaacaaacccaucucgaugaaaagucccacuguugggcuuccaggcagguauacaacugggagcuaagggugcaugcagaaugucacugcugagggcaucccaacauacuccaacaacacuccagacucuccucgcuacauccauuauguacucaguauuuauacacuguaaacacacacaaaaacacguaugugugaauaccauaagagcaauccucccuaaaucugcaguccccacccucauguggucacauuucaagguaaggaucauuacuucuaacaggaaccacauacauuagccuugcaacauguagucugugguuaaggacuacuuaauaauuagugauaagaaaaaaaaggagauuuucuuuaugagaguauuuugcaguaaacaauuuaacaaaagcuaauuauacaucuguagccauuagauuugauuauauacuagauuacgucaauuuuguaauguucucuuugauauaauacuaacuagaaagagugccuaaaacaaaguuggguaauuggcaacacuugcuaagaugcuaaguuauacaguuuccaaagauccuuaaaaacuuacacuaaugcccucugguggcaaaccugaguucugcuaccacugucaugaauucauaaaggagccagugaccaacacugggaaaggaacacugugagcacuaggaagugccuguggcaggacagcacagaugagcacugugcuaauuacgauucacucacagggaggacagggaagauccagcaaauauuucaaagucauaugaggauucacaacaaauacuguuuggguaucuaugacaaaaugcuuugauucuucuaugucccucacuacgugaguuuacaaaaggcaauguuucggauccaaaagcucuaaaccacacaacacaacaguaccauucaguggguuuuuugcaaaaaauaguuuacuguuauaaucagaucccauacagcaaaaggauaaaacucuguauggucuccacacacacacacacacagguacguacguaaguaugcagguuuuuggaaguuacaagaaaagaugcuaaguuaucauaaaagaacaguuucuuguuauauacuccaugccucccucuccccccccccaaaaaaaagcuaugggcaaagcugaaugugaggguaagacaaaucuacagaacaaaagucuuugcauuccuaggauaaaggggggggggggagcagccucagagaccaaaagaucucacuauuuucuuuuuguuucaaguuuuacugcuguuuauguagucucagacaagagucaauagucuauauacaugccaaacacccauacauuaaauaaacaaaugcuauauuuaaacaacaaaaaaccuucacuguuccuuagcagauaaaaaaaacuagggagaaucauuguaaguuugagccagccuagucuacaugaguucuagcacagccagagagacagacagacagacagacagacagacugacuuugacugguuucaggguaaauaauuucugagaucucagaucaaaacuaaaacccaauccucuaccaaaugaauguuucuguauaccucgacaaacuaaagcuacacugagguaaccuuuaauccuauaacuagucagucucaagucuuccucagaacaacacauaagacacuagugaauuuuaaaaauggcuuacauuaaagcuaugcaaauaaggaaguacccuggccaguaggccggcauucaggaggcagguagagggaggcacuucucuuugaguuugagaaaagcuugagcuaugcaggaucccaggacagccauggcuauagagagacugaaucucaaaaaaaaaaaaaaaaaaaacuaaaguuaugcaacuuauggccuauuaagaacaacaguuaaucacuaauaaagcaacugagcgagugaaggugugugagacaaggacagacaggggguguggggggugugugcgcaggcgcacacacaugcacuuuggugaugagaagaaagcacuggauccccugcagcuggaguuauacucaguuaccaaucacauguguacacucuauaaucccagcacucaggagacagaaacaguucaaggccuucagcuacacaauuaacaguuucugggucagucccaguagcaugagaccuugucuuaugguauuuuucaacuguuauaaauaaaauguaucaacacucuagcuuaugccgacauaacaguuuuagcuucgguuacaugaaauuuaguaaugauuuccaaaauauucuggugggaauauaaauggaaaauaguaugauacuucauuuaaaacugcucaaauaucguaacagaauggcaugaauuugauaauacaaaaacuuuugggggcuguuuuucaaaauuaagaaggcauaaggaaaaagcaaaaaaaguggaaagaacacuccagaaggacaucaaaaaggauauuguguggagaaaauagucuagagugagucuuagagugaaucaugccccuuuuccaugcagggcaauccugaaggcucacuuugaaugaauguuuuauucaccuggacccaauugggauucuucaaacucuugaaauauucuccaaaaaugauuacuauuagccuuauaucuacaaauuauuuauuacaaagacggaaacaauguacaguuuuuccucuuacacuguagcugcaagcauuccaaaauccuuuucauguucaauaugagcuaauacuucaugcuucauauguauauagaagcaaauagagauuuuacuuuuaaauacauugacguauuuuuuaacguaauguuccuccacacucuuuugcauaccauauauuuagaacacacacaagcacacccucaauacuauggguugguaaagcagcucagaagcagagcacauacugggccugcacagguuccugguucagucccucaccauacaacaaagcagacaagaaagcaagucgcagggaucaccuaacugcccaaaggauuuguagaacucuuauaaaucugagaggucacauucacaaugagcaccagagaccagagaagaaacuaaaaaauccaaagaauaaaggggacuuaaaucaaaaucaccuuuccccuacucacuggacgcuuuguaucagguagcucaauaaagcugacacuuuacaaaaccaacuuccauaaacaucaacagaaaccaucacguggacaggccuggagcugaggcaagaucguuuacucuguaguuguccacaccagcucccccucaccccaccaagaaagaaacacaaaacaaaaauaaagcugccccuacaauuugaagcaaauuaaaaaaggaagaugaccacccuuuguuccucauucacagaacccaaaaucaaaaagcauacugugcagaacaaugcacugugcgcuacaucacccgcuuaaaaacccucaguugcucugugugaugucugagacacaucuggugcaagcaagaccuccauaacugagacucaaagcucaaugcagucuuguacugaugcuagaauuacaguccaggaauacucugauuauagauaauccucucugcccuaucaacccaaacaccccuuaagaugccuugguccucacugagcccgcccacaccugacugauagcacuuacaccaacugauuuaaugugauuccacugcaggcacaacucagguuuccagaaguacuugagucaacaauuaacugauauauuaacaucuagugucuagaccugcuucuacacaaacaccacaaaaaccacaaaaauuaggcauucuuccuaaaaagaaaagauagaaagaagcaggccaguuaaggaaacauagcaagacugaauauguauguauguauguauguauguaugacaaggagacagacagauauauagaucugcuuuuaaaaaaaagucuuaguguaaguaaauaaaaauacacaguaccuauucacuuucauaucuacucaaauuaccagcugguuaaacacacuccagaucauucguauuuuaggcuuuacuacuuauauguucauuauuuacucaugagcauuuuuaauuuucagcuucuuccugaagaaauaaggcuuuuaagaaacagcucacuggcacuucuuccauaaauuuuuccuuccucuggagacagaaaugcuguggauauaagcaugauggucucaucucucuuuguuauuuuagaauguguguggauaggugggcacuccuguuacugagcucagaggagggcauuaaaugcauacacuuuuaaucccagcaugggcagacaaacagaauuuugaggccugccuggucuacacaacaaauuucuggauagccagagcuagauaguggaaaauggugguaguaccaguaggcacuuguaagccacccaacauggauacuggaaacccaacucuggcccucugcaagagcagcaggugcauuuaacaccacugaaccaucucuccagcauuagcccaucucuucucaugaguguuauacuauauaaaugaugaaaugcaucguaaugacugaauaaaacuaggaagaagacaaccaaacagaaaacuuugcucuauucaucaaagauauacuugucuauagaugaaaagguacuaacuauaaguuauugugaguagccaggaagccacgaucuaccugaaucaauucacaaaacugggucccaaaagaauguuuucuggaugugaagggccaugguuuuuggucagauggccacaaagugacccuaaucuaguucaccugauccaggaaagaacucuccuggcuauuacacuguaagagugugguacuagagguuagauaacaaacuuuccaacaacauccaaaaacuuucauggguauuacaguuucaaauuuuaaucugagaaaccuucuaacagaaacagaggaaaggccuccuaaaggcucauuuggcuaaagggaagaagaggauagcccuugcucucacgcagcucccaagcaggcaaaggcauugauaccuuagcauacagaggcaaagaaaagacacuugagcucuuagcucacugagccacuuuauacaauggaguucaagaaaugaagaauuuuugguugcacauaaauaaaggaaaguggugcaacuggcccugagagcgagagcaggaaugaaguuacauauggugagaaacacggugauuugaaugagaugccccacagucucaaacauuagaacacuugguaucuagcugaugguagggaggaguuauauuuacagauuagaagcucaagucacuucugguucacucuguuuuguuugcaguagaagucagcuuccugcuccuauagcuacagcugccugucacuugcaugucucccugcaaugacacacugucuagcucuaaaagcccaaauaaacccuguccucucugaguugcuuugaucaugaugcacuaucauagcaacagaaagaaacuaauauaaaaugcaaaaguaagaaugcacagcaacugacaagugauccuuccuccuuaacuuuagcggcuucucugcaggcaccucugggaaccuggguauggaaagacacuuggacaucuuaggauaaugauugccagauguuaucuggaugcccaagacaggaguuuuuaaaacuauguaucuacucagaaaaaguuaauuugagacuggcaauacaguucaggagcugaacaugucauuggcaugaaugaagguaaaaacaauaguuaagguauaugaaaugugcuggguagauuuaugucaacuuugacacaaaauauagacauccgagaggagggaaccucaauuuagaaaauguuccuggaaggucggguugcaggcaagccuguaaagccuuuuaaguagugauugauggaagagagaccacugugguucacuguggguggggccaucccuuggcuggucauccuggguucuauaagaaagcaggcuuaggaagccauaaggagcaagacaguuaaguagcacucuucuauggccuuugucugcaucagcuccugccuccagguuccugcccuggcuuccucaaugauggacugcaauguggaaguguaagccaaauaacguccgucccccgucccccaacaugcuugugaucacaguguucaucauagcaauacuaagccuaacuaaaacaugggauagucuauacauaguagcaacacccuuaaacugcaaaaaccaagacaucuaugaaaagcuguaacuaaucagguuccaaaauacaaaucuuuuuaaauuagccaaccuaaaagccaucuaugacacuguacuaccuguacaacuaguaucucugauauagacaaaaguccaaauaauuaaccccaaaauuccugguaauaugaaaccacaaacuaauaaaccaaaaagaccacaauuccuucacuaugaaguaaaggacaguuagauaaaagagaauaaaaauuuuaaaaagcugggcagugguggcgcacaccuuuaaucccagcacuugggaggcagaggcaggcggauuucugaguucaaggccagccuggucuacagagugaguuccaggacagccagggcuacacagagaaacccugucucgaaaaaaaaacaaacaaaaacaaacaaacaaacaaaacacaaaaagguuuauuuauuuuauuuauaugaguacacugaagcuguuuucagaaacaucagaaaaagacaucgaaucccauuacagauggcuguuagccaccaugagguugcugggaauugaacucaggaccucaggaagagcagucagugcucuuaaccgcugaaccagucccagauaaacucuccuuaaacaaaaaugguucaauuaaaauagaaaacaaaaacauugagcuaguaaagaccagaaaagagaaaaagaaaagugaccauuuuuguagaacacacagauauuggaagcuacagagagaauaauauucaauuauacuuuccauucuaugggagaaaaagcuugcuauuaauucacacauaggcugggagugugucugcaccuguaaggcaagcacaggcucuacucccagaacugaagaaagcaacaaaacuguacugagagacuauuuaaacgucuauggauaucuauuucucuaccaaucaaaauccacuggggagcagugaggcggcagcagguaaagcacucgucuccacagacaggaagucaggucaaagcaucacaggugcucacacuuucaauuuauaguuguguaccaguccaaaggaguaauagaaaagcauaaccuaccagaccuuuuguggguuaugaagcuacaaaguagucccucugguccucauuuccuuucuaaugaauuaggccuauugugccuucaaaacuggcugccauuguuuuaggguaugguggcucacaccugugaucucaguacuaccaaagaggccaaaagcaaugaccuggagaagcgacuacaugguuaagagcacugacugcucccagguucauuucccagaggcccacuauaacucauacacaucugugagucugggcucaagagaauucaggucucuucuuccuugagcacuucaugcacauggcacacaugcacauucacaaagcacagagguggagacaaggccauccugggcuacacagcagauuccaggccagccuuggguucauaaaagucucaaaaagacuaaaccaacacgucaacaaauuuuucuagaaacuuguaaaacagagaguuaagccuuggggggaugguucaguguuuaagagcacaggaaaaaaauggguagcacuaagagguggggugauaaggaauaacgggagcuuacuggcuggcuggccuaggaaaauggccagccuagacgaagcgcuuucuuucaggcuuggcgagaaacccuguuucaagggaauuagggaacgagcaauagaggaaaaccuccaacaccuuccucugaccccgcaggugcgugcacaggugaaaugcacacccuuugcucucaugaccagccccuccccagguaccaaacaaaucauuguagaccuucuaguguuuugugugcucaguuuaucauuccuauuacuuuauaauaauuagaaugucugugauguguguucuagacuguaucuagaguaauuuaaacaaaaaacaugacugaugggaaaugcguugguaauauacugagguucuggaucucaguauauuuauuggggguauagaagguauacacacuuggagaauagauacauguggcacuguguacacauguaaaaaaaaaugucuuccuuuauuguucucuaucuugcuuuuugauacagggucuaacacugcaucugaagcccacuguuucugcuaggcuaucaggcuggcuaacaagcuccagagugugccuaucucugauccuagggucacaagcauggacagcugcucuuuuacaaggguacuagagauuuggaguuguauuuucuugcuuucgaagcaagcacucuuacccacugagccaucucucuagccccucauuauuuuuuaacacaaaacaaaccagcaacagcauacaauagaaaucuuccaaauguaacuuagcaucugagagaauacucauucacucccccaggguuggggagaaaggagccaagcaagcagaguguauacagaacaggugcucucuuucuagcaacugcagcaaccaacuuucugagaaggugagcuuuuaaaauuuauuccauugcuggaccaaaagcaacuggcuaaaggcuuucuaagcugguaagagccuugcccaccccacccccauaaugugagggcuggaaagaaagggaaagaugacaaagacacacacuguaccuguuguugagaauuguagucaaaaagucccacaguugcugcugcagaguccacagguaccugcgugccugaauaaucaaacugcagaggcuccaugcccacauguuccaugggguccaaggggacacucugggacuccauguuggagaaauccuccacaggcuuggcaccauuggugcuggucagcugggcuaagcccucagaaccauucugguuuggacccagaagauccacuucauuagcagaguucuggcaauuaccagggguacggcuaaacagagaaaguaaagggcauuaaaccuuauauugaucgaggagggacacuacagcaacccccaguucaaguccuugacauaguucauuagcaguccugaaagcuaguucuacaaaauaaccagagaucuuugacaaggcucacaggguuguaguccucuagaaugauucuuccauuguuugcauguguaucaucaucugcuauuaacauacaauacaccuuuacuauggaaucaagacugaauaaacacagaguaaaacuaaaaacaguauugccugcggcagccaugaaaacugaaacaaauguuccccacaaacacagguaaauccacuccaccagaacagcagauccucuuuaaacacagagcaaagcuggaaugguugguuuucugggucaggcauaauggcacacaccuaucaucccagcacucagaacaaguuuccaagucaggcuggaguccgcacaagacuuuguuucaaaauaaagcaaaacaccuacagcugguuccuagggguaauuccaauucccguaaugaugcuaaugaaaagguuuucauuauuauuuacauuuuuuaccaguggugaacacuaccccaccugccaaggaaauggaagaaggaaaucaguugaaaaacaucacaaaugaguaaagcaucauuacugaccacacuccuacuccaagacaaugcucaagcuaagcuaguagauggagauuccauccuccaugucaugacacuccaaagagcacagggaaaccugggccaaaauguuuaagugaguacacuguucugggacuugagauauaccacaaccuaaaguauaauuccauaacccauuacaauuacuguaaaauuccaaacccauuacaggcaagggagaguagccuauggcuacauucaaucccuccaucucuuaaaaaacaaacaaacaaacaaaaaaaaaaaaaaacacagcugguacaaguuaaaggaauugucauguucuaucaucaucaucaucaucaucaucacauacaccaccaccuccugccccagccagauaccucaaagcauugguccaaaugcuugugauuaacagaggugaggcugucugaacacagccaaguaacacagguaaguauuuagugcccguugccucaauugcaaagacucugauuuuauacaguucaauauauauaauuaggcuuauaauucuccugcaaaugauacaaaacuuuuuuauacuaguggguauuacgguauaaaaaugcauguuuuuaucuguuugcaaauaaauacucauuagcuuuagaauggcauuaaauuauuuguauguguauguauaacaccgaacaaaguuuuuuuaaggcucuuugaacuuauaugccauaacuaaagcuugucuacauaaagaagaaugguuaucaacuguggaagacaaauauuuaauacuauggauguucuacuuauuacagggaaaucugagacucagucaugaccagacaugagauaagaggcauccaaggaaaauacgugauuaugaacaagccauuugcuggguauggcaguauacaauugaaauuccagcacucagaggccagggcaggaggauugccaaguucaaagccagccuggguuacauagugagccccucuuacuuugcaccugaacuuuuacuucuuccaacugaaguaacuggugacuggccuaccuacauagaauggagcugcugagcauguaggaaaugggagaaggcguaaaauaucucagcuaauucucccuccaaugugagagagagagagacacauacaucccucaauguccauggcucugguguauagugauguaggaccagcucagagagucccaaagcgccuaugcugaaguucuagaacuacuaaaauguccucuguggaaccacucugcaagcccagcuccauucaaaugcaaauucuguugggcaaaguauaaacauggacagcucuugggaaaucccaccuuaccaguuaguuuacaccucuauggcaucaucuauacuagauuuuuaaaacugaaacaggacaggagggacuaaaauaaaaacaaaaacccacagcccacauccaaaaaaucagaaguguaaaauauacaaaccuaaaaucuuugacgucugcaucaaucccauucugcacuggcaaaccauuggucuuguccaucacaucucccuccuccuucaaaucuccuagcuuaucuccaucaaacguacccuuguucuucuuuucaccuuugucguuuucaucacugucugcaucccuugggcccuguuuaaaaaauagcuucagcuucacuaaucaucaucaacuaauuauggauacccacuguggacaccagacuacacuaaaugcuaacugggacaggacagugcccaugccugacauuacagucuaguuuacaaacaacacagaggcaggaaggaacacugcagaauuuuuugccaaaugggggaagacagacagacagguauguuacagaacugaagacaucuuaucauaccaagugcucccguucugacccacccacuuucccccccaauugaaacuguauacuucuucagccuacuucucuacucucaaaucugucuagcauauuccuaagagggaaaguauuaagccuguuuaaaaaaaaaaaaaaaaaaaaaaaaaagagggagggagggagggagggaggaaggaaggaaggaagaaaggaaggaagcaaggaauccaugacuucccacuauccuauauaagccccuccuuuacuucuaaauauggaacuuaauguaggcugaaaccauuugaaucuaacucgucucuacuugaccuggggauauauaccuugccaaacuguacuacugcccaguuucacucuguugcaccaaguccuugacauuucuguauuuuguuuuguuuuaauuuuuguccaauuguuuuuguuuuguuuucacuuuuugagucagguuuuuacugucccuugcuagauuggaacaaacuacauacagugcucagguuggccuguauuuuuggcaacccucuuaccucagccucuuaaaugccgagauuacaaguguguaccacacacccagccgacacugacauuuuuuaaaagaugcuucaaaacaaauuaaauuuuccuuuuagcaagcauacucuaaaaacuuuuaucuuccauuaccugcauauuuugcuacaaauuaguuguaaugauauaauugggggcauuuuacacaagagaauuuauuucugaaauguuucaaacuuucaaauacagaucuauucccagauauauccagguccugccuuuuaaagaaugugacugugucuccucuuagcagcacccagcauaagcccuggauauauucauuuuuaaugccuugauguccaaaaggaagucaaguaucuguggacucaauauggcagaaagcuuugcagacccuggcacugaagggcacuaaguaacuuuagcuguuauaaacugagagaagcaaccuuguccuucccaccacggacucaggcuuuaauguggaaacaagugcacauggcucaaacuaaagauccugguacaaagcaguggacauaagacaaacauucuucgacaaauuuccaaucaccagcuggacuccgguaggacuuaguggagcagaguagcaggcgguuaguguugugagcagacccacugagaaauggucaggcugcacagagaaaacacaagcucuccauaugguaagaaaucacaaucagaaacuacaauacaggaacccugacaauccuagaccuguaggauacuacuucagagccaguuuuccuuuuaaagcuauucucuguguaaauacacacagaaaaagaaagccuuuguggauaauaugaaaguaggacugcgugugaacuguauacacagcucggccucaaguggcaucaagacaaugaagcccgacaguggccaccugccacaggaugugccuuggagacugcuucucuacaacaugcagcuuagcaacagagaagcccuugaagagagcucugacacccagcacagacaugggaagacaaggcucugaaggccaagagcuuauacaaaaccagaaacaggagcaaccuccacaaugcagagaaaaggauagaaguaagaguuuucauuuuuauagcugcagcuauaaagaugaauacacugucuagcaggcgcucaauaaauaugaccaagugcuguuuuaaugguagagucaaaaaccccugggaaacugaacugccaaaaaaaaaaagaaacuucaucuugucuuuaucaucuuaccccagucuagauggugagaguaugacugcaguagcaaaggaaaccauuaaugucaauggccaagaagaaucacaugaacaaucucuauaagucuauacaucaaggucaugucucaagaaaaucuguccaacuccaacaucucccaaagaguucaaaacugugccuauaaaacugcccaggacagggaaaagcagcagcacaaagguccagcaagcacgggacuggcgagcauggucacuggagggcuccgggucagcauucuccuuguugacuuucacaaggcuucccaugaaccacuucagucuauccggaugcucacuggucugcacuaagaacacagccaauaucaauuucacagccaggggcaagguuuucaaaacacucccugggagguuuucacuaguucuguauguuacauucagauagcuuguuaccugacuaucaaaauaucaaacuuuuggcagagcacuggcaacucuuucuaccuauugauuuuguuggugcaucucaucuugaagaaguuuguggaaaacauuuauaaccucaguauguggguguauauacuuauacacacacacacacacacacacacauauauaugcacauauacauuuuuaaaaaggaaaaagcucauuuaaaacaaguacacaugcagguuguggugguauacaccuuuaaucccagcagagguauacagaguucucugaguuugaggccagccugguuuucagagcaaguuccaggacagccagagcuacauagagaaaucaaguuucgaaaacaaacaaacaaacaaaagauaugcaacaaaaauagcagacaauccagucugccauguacauuaugccaagaucagacugaaaaaucagcugcuauggaaagacagccuuggguucaagaucauaaaaaggguuuuuacuguagucccagcacucggaaagagaagcaauaagccagccaggaauacagugaagggcccuguuucaaagaacaagaaaaaggucucugagccagguggugguggugcauuccuuucaucccagugcccagacagagacaggaggaucucuacaaacagccuggucuauggagugaauuccaagauagccagagcuacacacaguacugggcaggggagucaaacuuguaaccccaggaguuccaggccuauauuagaccuugucuuuucauuuuuuuaaaaggaggggaaggaagaaaacaucuuguuaagagccuaaaauagaaaaguggaauggagagauggcucagcagugaagaacacugguugcuccuacagaagacaaggguucaaucccagcuccuauauggcagaucaagcaguuccuggagagacugacauccucuuaugaacuccaggggcauggcaugcauguacuauacaaacaaaaaugcaggcaaaucacccauacguguaaaagaaaacaauuuugggggaaaaauagauaaggaguauaaaaaguguucaugcuuggcaucuuugugguuuuuaauaguauguaaggugaauguuuauaguuaugaggucuuucaggaaguauuaauauaggugcacugaaucuauucuguguucuauguauaacacuggccauaggauuuugaucauuuauucuaagucuuaguuuucucauuuauaaaacagggauaauuuuguuuaauaguuaugaacagcaaugaaaugcuacauugugaaacuuaagaaccuuauuguauacacauaaaaauacagcaggacagagagaugcacacagcagggucugaaacacuaccaaacacaaguacauaauuguguggucuuucuagagcagccauuuggcugaugagcacaaccucaaacauuagagaccacauagcagagcaaaagccaucccggggaaaacuggagaaaaugcaaacaaagcuugaaugcaagagcccaacuuugccuccaagccuuuuuuucucaucuauaaauuaaucugccauaauuauggguuguuacaacaaucaaaugagucaauucuuaaaguuacaauuucuucaaaagaagaaaaaaacaguaaugcaaauaaacaaaacuaguaaacaaacuugcagaagccuggaaaccacuagaauauccaggcccuaucacauuccucacagcaaacaaaacaucaccgcugcuagccgcaggaagagccaggaaccaagcagacaugguaagaaccacagagcagagucggccugacggcucagccuccucaggacaaccaaccauaaagcaggauaacuccaaacauuucucuuguacaaccaaaaacacuucccauggcaaaagauccguucagugagaucagaggcugucuuccaucugcaucaaacaggcaauucugugugagccuagcugcauaaaaacaaacaagaugaugcugaccacgcuaggucuuguguauacuuguuucacacaacauaccccugaaauuuuuucaaaguauaacaguucacaucucugacaggaauagaaaaaugagaaaaaaaucugcagcugcuagccuuauggaacaaccucaaaagccaacauagcagagcaaaagccaucccaggcaaaacugaaauagaaacaaagcuugaauguaagaccccaacuuugccuccgagccuuuuuucucaucuauaaauuaaucugccauaacuauggguuguuccaacgauuaaaugaggcaauccuuaaaauuacaauaucuucaaaagaaauaaaaaacaaaacaaaaccaaaacuuguuuuuagaagaccuuaguaugaaaagaugcagccauuauacacuucgccuacucugggguacuaucaugcuaugcaccucuaaguaagaguaguacaaggaugucaagggcccagcugaacuggcacucauuucagcaggaaggagcaagagcuaagagaagcauacugugaagcaucgccaacacaggccuggucacaaucacccaguccugcugugcagaaagggaagagcagugggcaccugcagugauauuuaagaguaaaaaaagaaaucuaucuuagaggcaagaagugguguuugauuuuauuagaaaacccucaaaaagaguuugguuuuguuuaauaagccugauauugcagacuccagcaugugguuucaguuguggagauagccauaaucuaaaggcacugcacccuaauaaucuacucuuccaaggagacucuagcagugcagcacacuugugaaucaugggggcagggaaaggcucauguuacaaaugcaaaugcgguagguaagcuuuugccugccuagcacucaggaagcugaggcaacaagauugggaguuugaggccagccacagcuacacagugacaacccugucuuuaaaacaacaaaagcaggauuuaguucagaaaggccuauuaugguauggccuaagaauccuaugccccagaaugaugcuacuguuaucagugcacaacugaguaucaauauacuuuguuacaauauuaugauacuuccuugaauaguaauuauuccuacuauacaauaaaaaaauccaguugggacucacagcccuggcuucucuauguaaugcaauaucccaaguuucacaaaaaucaauuguaauacuagccuuccaagccaaauaguuaugauccaaaugaauagcuacacguauguauccuccaggucagaaagcaggaacuugacacaacauggggagaucuaccaacaacccugcaaagcuagaguaguugucacugguccaauauuugcaguggauaaaccagaaaguagcacucaugacccacuguucuuaauaacuauuugaagacaauuagggaaccaagagcagagcccuuagauaggcaaugucacccaugagcuuucaaaauaugugauuuuguaacuaccucugaaucuaggagauggggagagaaguaucuuauuccagaacaaauaaaauaaaagcuaaaaggggaaaaagacuuaacucuuggacucaaguuuucucacauuauuccaaaaucugguacucuaacagcuggggaagcacaugcuggguuagcuagcugggucaccucacuguaagggugagaacagagucgucugcuggaccucagaguaagucagcuaauuaguuuguggcagguucuguaaagcacuggcuggccuggaacugacagggaucaucugaucucucucucuggcauaaaguaccaggccccaccuccuaaaaguaauccugauuucaaaccaaaacuccugaaguguuuauagcaccaaaaggaacucagggaagcaugggaagggaaggccaagagcuaaauccuauuauucaagcugugucaaggaaaucccaaugacaauauaaaacuacugcuuccucaugagacaccuucacuuaaagaguuaacaucuggacugccagcugucacauccaagaacuucuguguaccugcugugaguucuauauaaucacugugccacaaauauaaucacuggccacucagcuuacuagacuaaagacccagcugcccuacuagacacagauggcucgcuguccuuguucuccaaacuuaacauugaccuucuuuuguuuuuaaaagaaugacugggacagccccccuuucccaauguugcaugcauaucaugggaacuagagugauucagauuucccauaaacacaguuuucucugugugacauccuaacugcaguaaagcaagaccagcagcagagcaagcccagguuaacaucagcagaacacaccaccagugcugaccagcaguuuucugacuggcaggccuucaucagccaaaagcaccugccaacacccuggcuuaacauccaucaguauucuucuaucaaccuacagauggcacagacgucaaacuauugaauaacauuuuauucuccacggauauccucuuaagaaagaagauacugagacuuaaccaucugacuguaggaguccugcuuccuaaagaaacaucuggccugaggcucaauacaaugaagaucuaaaaaucacauuucccaaaacaacuaaguaugggacucuccuugggcagggcuuuaucauaaaaacuguccuaaaagugacaguaauaaucccaauucuucuguuuuaucuccuuuuaauucaaauuacuuuucugccuccuacaaccuucacaguaguccagaugugugccugugccuaaugucaacaaacuagaaacuggucagagaauucacagccauuguuaucaaggcuccuggccaccauaccagcaacucauuaaugaagcacacuaguuuuucucuagcaaauaacuuaaaguggaggcaguauuuauaaggcaguacuuucucuuaagaaaucaaauaaaagugugaagaaggaagaaaauagaauuccacugcucucuugagaagacaggcaaacagcaauccuuuggcuugcucccauuccucauaaccaaaguauaaaucuugucugccccaaagaagccccaugagaagagcacaaaagcaguucccuuuugauuuacaggccauuaugucugaacuaagucaaaagauccagaagcauuccggucagcucugacaaggcuagcccucaagaacaugcuuaauauuaauacacagagagagcaggcuaacaccgacuacuguaaccaaacaguuuucggagacagaaggguagcgccuagguaacaaaugcagcacauaaagaagcgcauguguaggugaaaccaaguguaugaugauaagggggaagaagguaucucaaacauuugccaccggguucuuuuaggccacaacgacauccgggaaaaggacuaaaaggguacagaacaaaccaaguuaggcaugaaaggcaggcagauagcugcaacauacaucagccagagaauacaaaaggagauucaaguagauauauuucccaagauuccuuuaucuauaaagcugauaauauagagaaugugcuucaagaaaggcggugacaaagcuucagaaagaaugcuaagauucagcagcaagaggcaguaggcaaggagacugcuuuggcugccauucagccagaauuuauaugugggguuaguggcaaugaauuaaaaccaaaccagaaaacaaagacaaaacaaaacaaaacaaaacaaaacaaaaaaaaaaaaaaagcaagcuccccaacagcauaggcauaggaaacaaagcugcucaauugcggccaccauaaaauucacaucuagccugcaaaaaccaagacugagccacaugccuuguccucuguaagguucugagguaguggccgggcaaucacuccucuaagacagcaccucaugcagauacccaacuuguccuucucucuugagcuuuguuuuagugaagaaugccuucuuguuaacucauuaacugaggcuuugauuguagugcuucccucaccuggcccuccgccccccugccgcccacagaaacccaagcccugacuuuuccaucuuugaagugcaguuugccuguccugucaugcuuggugagcuccauguaugcuacaaugggaguguucuaaaacacccucuaacacugcgagcaccuaggaaacucaacaggcacauuugcuuugggggaaaggggaagaaagagacaggaacaaguuccucaagccaacuuacaaauccuccuuuucuuagacaggagucgcccggggaugagcucaacacauacuccaccaugcuaacgccuagucccccacucuccgaccguggggacaguacagaauugaccucacuguucacauggaaacucugaccaggucuucucugcaccaugauuggcugggaaacugaaugaucuacaaaaaagauacacaagugugacacagugcagccagaagcccaaacaaauuaugagugaugucucgugauaaaccaaugucugggaaucaggagacccaccauggucagcugagccaaggucuccccuugggucuuucaauaagcacugguauucuacauaggcuaaggacacagaacauaccccuccuauaucuaggagagcaagggaguacagccgaucacauugcuaaguagaaaagucaauggucaccucuuucgaauugcagaaauucuuuuguucuuuuuuuccuuaucuuuuuuuugggggggggacaacaaaucguucugaggacuccaguuugcaccguccugaauacaguuuauccaguguuggguuuucuguuuuccccaucccuagaagcuguggcuucuuucugcuguuggugucucugccucuaccagcucuccccaacccucuucaguggcagucuaucacaagagugucugugccgggugaguucauuugaccucaggcacauuuaaagauaacuacggcauauauagcauaaaacaucaagagaaaaagaaaaaaagaauaaugaaguucaaaguauggguuuggauuuuccaauuccaggcaagcugacagcagcacagagggaaacgcagcuaaaaucaugaucacuucaaaugagucccuucuucuuugacuagcacuugagaaaauauugaagauuugauuuuguguaauuauuuuuaauauacuacaucaucuaagcuccuuaguggcaauuauacuacuauaggacaggacauuugcucggcgugcuucugccacugaucugaaauucaugacuuggccaagugcugaggaagggagcucuaagacaggcauaaaucacaguagagaggcuagagcuagauuaccugauguuccccaggcacugucucgccauugaucacccaggaauauuccuuuugguccaucuuugcuggauucaucuguuucccaaaacuuuuuaccuggcaagagcugcugcaaauuaaaaauaauagaugcuuuuaaagaauucauaaaggaugagaguacagcagucaacacuuucuuuagacaagaguacugaagauguucaaagacccugagggucucaaucaaaguguuuuggcuacacagcuaugaucagaacacuauucuucuuugguaaaggacacagaaaugccuaaagcagggggacacuaaucaucaauaucuaaaauuguucacuuaauuguugugaagauuuuugaggagguaagaguacaaacauggcccuacuacagcuaacugcuugcuccgagggcucuaccugcgagagugccuaccacaguuaacacuguccgcacaagcacugacugagcacaguuacucaagcaggagcacaaacacagcuaggagccccagcuacagaauauuagacaccacuucuauuaacuaacucugcaccacauccaccuuuucuaagauuuuaagagaaaaaaaaaaacauucaucuacuuucagaaggaaaaucaaauuucuugaccucuguuagguuuaauaauacuucaaagaaacaguggcuguaguuacagaggaaaguuccugaagacugccauaauucuugguguguucaucaauuuuaauaaaaugucucccucuuguuuccucuaguuguuuuuuuuuuaauaucuacuauuccucagacaggauuucagaaguuuaagauaauguguaaucacuaauucugagcauaaacgggcauacugaagaucugacuuauguaauaccagaaauggaauucuagcuuucugauaaaacaccagaaagcccaagagaucugcucuccuccuggacagguuuaacuuuccaacuuauuuagcuacuacaucugagcauaauaaagaaaucaaaacugucuaaaccaaaccccagcucuccagccucacuacugccaucucagccuaguguuaccauauccucaaaaagucccaaacuauuccacagcauagguuccuacacaaacccaagaugguugcuaccuuuuucaaauagaucccaacaaaaagacuuuuuggucugacauugaguuaugcaagugcuaagcugccucgaggacaggcaauuaaaucaaagcaucaaccaagugucccuuaauguucuggggucuauuaacuggaguggguugggaagaggagguaaaaagagagggagaaacagguugaccgaauaaagcugagcaaagagacagaaaucccgggacuagauaauucugauuugcccugggaacuacuauuaaacuguccuuggucgucuccucuuucuucugaugccaaacuuguuuuucaguggcaauuccccucagaagcaucaauauccaccaaacagcuucuuggaaauguauucagcggcaucggacauuagcaaaaucauagucaaauuccagaagagauaccgagaauauacaagggucaauuaaacaaacaaaaaaaaaaacaaacaaaaaaaaaaaaaacuucugggugcuagaaaaauggcucagcuguuacaaucacuaggugagcucccagaggaccuggguuugauucccagaaaccacuuggccuuuuauaagugucuauaacuccaguccugggagauccaguguucuccucugaccuccucaggugccaagcugcagacacacaugugggcaaaucacucacacacauaaacaaacuccuauucccacauggcagcucacagcugucugugacuacaaucccauaugcagacaaaauaccaauacacauaaaauaaacuaaaaagaacuucuguuuccacuuuuuuccccuuuucaucuuguaaaccaccuauccaaagacuccauaaaacuuccuuacucacuagcucucucccaacauucuacuuuuaaauaacaacauucucauucuuauuuugaagagggugagaccaaauaguacucccaauuuagaacccucuaugcauacuaaaaggagcaacaauauuaguacaagaguccacaucucuuacugguuaauuuuaugcucugugaaaugguguaaagagcaaaaguaauuaaaaccaguccuaugcuguugugguuuuuuuccccaaccuuuauccuucuucacauaauucaagaauagccuagacaaguaccagauucaacauauaaacagucuugcuauaauuuaucaaguugguaacuaaaaguagcaaucuuugagcucaaggggguaaaggggacuugugggauucugacauuguuuacuacagucuauuagguugucauaacaugcaaaguagcaagugcaggcaagcagaugagagcagcagcaagacacaccuucaaaggggaagcaguagaugucucagagggcacuuauaaaggugcuugccuccaaaccugacuacuugaguucaucccugaaaccuacauauuagaagagagccaaguccacaugcuguccuucucucucucucucucucucucucucucucucucucucucucucacacacacacacacacacacacacacccacauccacaaacacacauaugcacacaaauaaauaaugaaacaaauauuaagaaaguuaagguggagagucaacuuucuauuaguaacaugcaucaagccucaaagaaacacaucaaaaauauguuccuagcucaccaagagucacccaguucuccugcuacuaaaaauagaaaacaaauacuaagauguuagagguaacccccacagugcuagagcuccuuauacagaugagguggaggucagcuaacuguuaucaaugagaacagcagacacuauuugggcaaguucccaagagauaaaacaaggugggagagcagagugcagcaugcugauuggggccaggcaggguacaaagagugaguugcuugggugcucaguaaacaggaaggcaaucccugaaccaagggaucugggcaaagucaaaagcaagcuuaguuaaguucuuuaauaucucagaguucacauagaaccuagccuuucucccuuuacuauaaaaucuacuguuuguacucaaugguggaaagcagcagggcuuuccaaugacuccaaugaccuagucccagcguucuguaaagaggaucuugaugguggggugcuguggggucacaacaucuacagugccacaaacuacuuacuucuauuugccccuacuaccaccacugcccggcucacucacuuuagacagcugcuaugcugugaacuguacuagaaaguggcccaccuggcaagguaucaagagagaucucuacccaacaaugcacuaggaauugaagucuucauucuaagagccugaaggccugaauccugauaucaaccccauggauuugaaagaagacucuucucagauaaaguugagcauacacucagcacugguagaaaucaugcaugaagcucaugcgagaccguaugaaguuguaagacauaacaauggccuucugagcugucuggaucuguuauacaguggauccaaucacgacuauguggaaguguguauuuucaacucuuguguuuucuuuuaagaagaacguccccauggguggugguccacaccuuuaaucucagcaauuggaaggcaagaggcaggguuauacagagaaacccugucuugaaaagacaaaacaccaaagcaacaagaacaacaauacccguacuucucaucccacuuccauuacugugauuuugacuuaggaaaaaguaguuaauuagcucuguccacuucauguucucccauacacuggcuuaaaccccuuccacauucaaaauaaguagccuuuccugaagcugagggacagcaguguuaacacuuucagcuuuauagucagucaacaaaaguaaggauaucuaccuucagagcuagguagcaacuuuauuacaaaacaagauaaagauucaagagacauuuaaacucagcaaauacaccucuggggguaauucuauccacagcaugagguauggcauccccacaagccaaaauauugauugccacaaacaugcaguugacaaacuuucucuucagccagcccuaacuucaaucacuacaaauuuaaauacagccagccuuaauuuauuugagaucgaucucacucacacacacacacacacacacacacacacacacacacacacaccccggugugugugugugaugcagaggcucagggcacuccaagccagcauacuuucuuuucuuugugaggcagguaaagccaggccugcugagaacucacuaaguaacccaagcugauugacaacucuaggcaauccuccugcuucuguuuucaggugcugaaauuacagccaaaaggcaacaaauuacagcucggcuuuccaacaugcacuuuaaaggaaaacuaagcuauaaaggauuaagaucugacaauucuuuaaaaaaaaaaagugauaaggacuacgacuuggucagacuguacuaaccggaugcaccuggaaaagagcacaugcuacacaaacagguccacaccaaugacagucaacuugaacaaauucugaaaucgucaucucagcaacuuccccaucuccaaugcuaauagcaaguagcuucucaaaacugacuucaucuguaaccaagcacagugaccacugagagcaagacaagcgagggucuacaggugaucugacacuugggaacaccuuuuguuguuuccugagucuagcaaaacagacucuucaagaaguuauacucaauagagugugccuacaucuccugaaauuacaagugagagcaggagaacuaucacaaauuuacuacaagccaguucauuguacauuuuacguuccaggcuaaauguaaacuaguaaagaccuugucucaaaaccaaaaacaccagaaacaacuauuuaaaaccaagaaccccacacaauuaucuuauauuccuuauuaaggaaccuuuaacacauaaaaccucucaugugucuaacucucugaaugccacauguggcuuuacaucugucuccuuaucucacguuacaaauagucugucauaaacaacaacugaaauaacccaauaccgcuuagaaugaagagcuacuccuagucugccagagggugggauucccccaauccaaggcagcccauguacucucccagcaaagcuagcacugugccauucagaccacuguaguaaaaaucacuagccaaccaaacuccccaagaaccaugacccuaguucuguggaaccuagagaaguucuaacuaaggauuagcguguaugaccaugccaauacuaauguuugcauagggaaguauucaugaguuucucggcuggccuuaaaagcaagugggcgccgggcagugguggcacacgccuuuaauccuagcacuugggagacagaggcagguggauuucugaguucgaggccagccuggucuacaaagugaguuccaggacagccagggcuauacagagaaacccugucucgagaagaaaaaagaagaaaaaaaaaaaaaaaaagcaagugggcaaggccaugcaguggugucacacaccuuuaucuccagcacuuacaaggcagaugcagacagagccacugcucuacugaguaaguuaguuccaggauaaccaaggcuacaagaaaaaccaugucucaagcccaaccacacccucaccaaaaaacccugugcacuuucuacuaucauaugcucacauguuaccuaacugcuuacacuuguaaaacaugucacagacagcgccccaccucuguacccacuauucucucuucucuucucucccguccauaccauuuccuccagaaauuuggcuuguaaaacacaaucccuugcuuacaaacucacaggcaugaucagguuucaucauguuaucuggcuacucaaauuuccaaauuccuaguuuuaccugaaaugauuaaacguuuaagcaccuaguuagacucaagaaauaaaaauaaauaaauaaauagauucuuuaaaucucagaagcugacauuaagucagaaaaaggucucuuugagacugcaauuugaacuaugauggugacuaugguaauucacaaguuccugaaaacaaaaguauuucuagaaaucuguucucaaaaaucccuccaauuuagcuagugaccgccccccccccaauaccaaacuguuguaaagcaaaugagacaauucaagaaauguccacaaugccaugcccucuacugaugcagucaucccuguuagagauguaagccacugucuaaaaaaagaaacaaacauuuuuugaaaguauaaaaaaauaguaauaauaguaaagccugagucacccauuaacugucaccagaagaguaagaaugaacccagggccaaccgagcgauccccccaccccaaccccucccccccaccaaaauaacucaucugaacaacuaaaguucuucaaucuggcauuguggugcauaugcauguaauccuagcacccggagacuaauuaauguaggauuacuacaagccuagguuacaaauaagauccuuucucaacacacaugcucauucaggagucuuuguccuagccccuccucucuccucucccucccucccucccucaaauguaaugaagacugcuucucuuuauacauuguuccgagcuaggccagugagaugaaucaccagguaaaggcacgugucuaauggccugagaucauccccagaaccuguauuguucucugaccuccacaugccuacccauauacacauaaaauuaauuuuuuaaagauaagaaagauaccaguugcuggaguacuugccaagccugcaaagcccugaauuuaaucaucuuuauuguguguguauaucgggguuggggggggggggggggguaaggggggggcagaagagcucccccagcccuggagucacaggcagcucuggaguaccacuaagcccugagccaucucuccaggcccugaaaugaaugauuuuguguuguucuggguuauaagagcaggauuaaugccuuucaacacuaguuucaccgcuacagugaaacccaccaaucacuagccaagauagucauuuuagucuuucccugcugaaucuaaacauccaauacugauuuuucugucuaugggaaaucuuaaaguuggucagcaaaugcauuuuuauaauccuaacacccaggauacuaaagcuagacugcaaggcuaacauggguucauucaauagcgagaaacccacuuuugguggggucuuuuugguucuugguguuuuuguuuuguuuuauuagagugggggagaagagccaaggguaucucugcauagcccugacugucugggaacugauggccccaaagucagagaucugcaugcacacacuaaguaguaacuaaguaguaguaacuaaggaaauguuuguuugaaauggggucagaggcuggguaccuaaaguguggagccccaggagaaggcucagggcucugagacaccuuucagcuuuaccacugcuuuacuuacucagucugcuuucugugauacagggcagcagcugggaccugugcuuuguaggcaagcccucuaccugagcuacaucccuagcccuccagcaagcuuugggauuugauuuuucugguuguuguuuuuguuguuguuggcaaguuuuggcuuuuguaauuuauuuuucuuuuuuuuuuuuaagauuuauucauuuuaugugagugcuuugcguguaacacgugaguguuuggugccuucggguccgaauccuagaaauggaguuacguguggauggccaccauguggauaccgggaauuaaacccagguccucugcaagaauauaugcucuuaaccacugugccaccucuccuacucuuguacuguaauuacaaacuaagaaucaaaacccaucauaaugaauaagaaugcagccacagaagccaauucaucacuuaagcuguuuuaaaugaaaaucuauucuauagagucaacuaaggcacaaggggcaaaugaaaacaggaugcaaacagauuauguuucauccauccagaagauaguaaggugcccugaagauucacuacaacuacugagaaaccaagaggugugauuuagaggagacuggagauacgaagaacuggugccuguuaggacacccaucagugagagcugcaggcugcuuucugacaaugccuacacuuugacauauaaccaucaggaacaaguucugaaacagacuguaaagacacacugcuuucaugaaacaaguccuucagagacaucgggacagacagcaccuuaauuuccugccacuuuggauaaauuaaccuagaaauaaguaacacaccgaccucucggucucuccgcuaagcacuggaguccacugagcacauucuuuacauguucccacuucaaauuacugggacagggacaaaagaaacuagcuccagaacacuggacaaucaguccagaaaaguggcaggaagaaauacacaaaaaaaaaaaaaaaaaaaaaaaaagcaacuguguugucugucaaguuaccuacugaugaagucgcaugcuuuuuugaugcauaaauguguuccaaucauauucuuguuuaaaugggccuguaucaaaagcaacacaaucucucuugagacccugguauacaaagaccuaccuaggaccccuuaacacaaaguucaggaauagacaguuuggaacauucuacaaccaacaccucuagauccugaaacuccacgcaaauaacuaagaggugaagaauauggcauucacccauccacacugccggguggccucuaguguuucucagcacucaugcaugagcaacggaggucugucccugugcuagaggagggagcgcccuguucaugcauccucguaaaugaugcucuacacagggaauagcaacagaaaagacuuucucuaugugucucuaugugcuaugagaaccaaaucaaaaaucagugaaguaaguuugauguucucugguuccuuacagcaaacuuacuguaaaagagaaaguaggagccacccuuaaucccagcaacuuggaaggcaaaggcaagcagaucucugaguuccagguuagccaggacuacacagugagacccugucucaaaauuuaaaaagagaaaaaaagagagagagagaaagacagcaaacaaagaaacaaugacacacaucauaguuuaaugcauaccugagcaagcaacagaguacaaguaaaccaacucuguaaauaccaugauguccgcuacauacauaaaaucgaugagacaaaaaagcagccucuuaaccuugugcuacaagaaccugaugacaacuguccuggcagcauguaacggaguguagcuacagucccccaggacugaugaggcagaggcauacggaugcagcugugaggccagccaaggcuccacaguagaucucuggcucaaaaacagagugucuccauaucagacucagcuuguagggcagcagcaauguugaucacagguaccugugcuaaagggcuucugcccuaacuaucugcaagagaggcagacuuccaguuuuguuguuauucauccuuuccccacaucuucacaacccugggggcaggaaaggcaucuaagugcugcagcuguuuacugaaccaaacuggaauucuaggugacaaguauagggccuaagaacaggagaaauccccugaaagcugaacucauucuauggcuucuaguaggugagacagcaggagagcuucauggaggagugaacacaaacuacaagcuaaaauuugaaagaauaagacuccacauaaagaacugagagugauguaucuggguuuggacagcuggaacaugaucacaucagucuuugcugcuuaucuguuuuaaaaaaagcauccuaacaucacaggaccaucaugaaaaucaggucuaugaagugauaaacauagccaaaauaaaauguauuuguucaacagauuucuuuuucugugcccaauaaaauagaaugaaugaaucuaugcaguauugacccuuacaaccuuaguuggucuuccuuuccucaucuuuaaaaaagaaggggaggaggaggacggaggacaugcgguuacacaagucagguaaaggaaggguggaucuagggauacaagucagacacagugcacauaccauaaacucagcauuuuccaagcaaaauagaaaagaacacaaguucaaggucagccuagacuacauagugaagacuuauuucaaacaaagcaaaacaaaaggaagagucacagauaaugcuguugaugguaucauuauaaauaugguauuggaggcugccauucacuauuguaaauguuuaguugguuuacucucgaaucaaguauaugaauaugcauucccccccccaaaaaauuacuaagagccugccuuaaugggacacaaauuuaaucccaccauaaaggcagauauauugcugugaguuaaaaggcaagccuaggcuacacugaaagacacugcccuuugagaccuugcuacauuacauuacuagcugucugaacuccuggcugcuggaacuaugcaacacuauucccagccucucucuuuuauuaaagcuaacauuuuagccaaaagagaagccugaaagguagaaauguauuagcagagagagagcgggggccuuacuguacuugucugagcaacaacaugucuucuuuccaacaaucaauuuuguagucaacugaaugaacuguuuuuuuauguacuucuacuuaaaaggaauugccaacuucaauagcugucccuuucagaaaugugauucacaaaccauuuuagcugaucaauacuuuauaauucgaaacugggcaguagugguacacucaggggguggggggcggggguggaucucugcguucaaggcuagacuggucuacaaaguugaguuccagggcaacaagagcuacacagagaaacugccucaaaaggccaaaauggggguggggggcugccacaacaccuuucuauuccaacaggacaaugucaaccauaauggaaaacaacuuaacauauugaaccauucccacuuugcuuccaacccaaccccuguaucccaauggacauuuccaaucagcuguugaaaggugaaggggucaacuuagaagaacccaaggagggcuaggacuguaacucaguuggcaguuacauacauuagcauguaugcagccuagcaucaaacaaacaguauagugguacacaccuaucauucuagcgcucuggagaugaaagcaguaggaucagagguugggacuggaaagggugacucagcaaugaagaacacuuaauguucuggcagaugaccuaccuggguuugguuccuaccaccaacaugauagcuugacacccucaacuuccaugaccuccuuccugcaugcacacagugcauauaagcucaugcaggcauacagcuauacccauaagaacuuguugggcuguucaaggucacacuuuguugaagccagccugaaauacaagaaacccuauuguaggguauccugggaugugggggguugugggguggggggggauguccaauaaaaaguucuagaauaacaaacaccucuuaaauguccuuuggcauauuucucuuuuccucucuccuccaaaaagacuaaccauuuuuuuuucuacauaagaucaaacuccagcaaucucugacaugggagaguccuagaaaccaaacucuuacucaacaucucuuagagauagaaagaagcaaaguccaaagauaaauguuugaagcacagauacaaacacuggcuaagggcccuggacucugugcugguucuaaacgaccacguuuuacuuucucugaguaagcaguuuccuggaucacuaucaaaucacucccuccucuaagucuaugugguaguaccugcuuuuaaucccagcacucaggaagcagaggacacacaggacuacagagugagaccaugucccccaaagcugcuaucucacauucagagauacuauuauuccuuuuuuaauuucugguaucugcaauuaucauuuaaagucuaccucuggugaauagagaaggauuuuaucacuccauacaggagagaauauuuucucaacuucauuuuuuuauguuuauuuuuauuuuaugugcuuuggcauuucugcuugcauguauuccaugugagauuucagauacccuagaacugaguuacaggugguuguaagcaaccaugugagugcugggaacugaaccugugucucuggaacaagaaccagagcucuuaaccaaugaaccaucucuacaguaauuucucaaucauauuuaaaaccuaucaccagcgggcaaugguggcacaugccuuuauuccuaguacuugagaggcagaggcaggcgaauuucugaguucgaggcuagccuggucuacaaggugaguucuaggacagccagggcuauaaagagaaagucugucuugaaaaaccaaaaaaacaaacaaacaaucaccaaggguaauuauuuuucuaaaggaugaagagcuaccuaccuaaaugcauuguuuaauccagaaaugagaugguagccuauacgauuaaacuauucuagauauauaaaauauuauggaaucuuaacucagugugauugucaaugccuaagaguagcuuuuagaaggcaagagaaugaguucaaggucaccuacaugucaaguguaagaccagccugagcuacauaaaacccuauuuacaucaccaacagccuaaaaagaaaacuagucacuuguucuauagauuagaaaacuucagcuagcucaugcucagaagaccaguccuugguuaguggagguaagagaacugcuaucauuuuaaagucagccugggaaacauagugaguuccagaagaaugagacuaucucaggccuacuacaguagcacaggccuuagagcacucagaagggagcagcaggcagaucucuucuuagcuuaagaccagccugguguacagagugagguccaagacagacagggcuacacagagaaacccugucucaaaaacaaaaaaaaaagacucuacccaaaauaaauaaaauuuuaagaccacaaauaaagaacaacaggaaaaacaaagauuaagggaucuuuugaccaaggauucccacaguuucuuuauuuuuucacaaauaccuaggcagucaugucccaacuacucuucuacccagaaagcagagagaccauagggaaaccaagguaggaaguuuaaaaacuaaugucaacaugacaggugaacugagugucaaccugacuggauucagaguagaccaaggaccaaauagagggcauucuggguacauuaaggcacccccagagacuggugucaugaaugaaaagauaacauuuuagagaguagggcggaggcaggcacuggaggcauguuccuguggggucucugucaccauggccucuuccuguaugccacuuucauugucugcuuuuugucugccauagagaagccucucagucaggcaugguggugcacgccuuuaaucccagcacuugggaggcagaggcaggcggguuucugaguucgaggccagccuggucuacagagugaguuccaggacagccagggcuacacagagaaacccugucucgaaaaaccaaaaacaaaacaaacaaaaagaagcuucucuguguauguuuccaaaaucucugaaacagagcuaaaauaaauaauucuggacuaaagagacauuuaugaaggcaaaacacccauacacauaaaauaaaaauaugauugaaugaaugaaugagaauuccuccuuuauuuuauuacugccagcuauuuggucuggguuaccacaagagaaaauaacaguucccauuauuagaaaaauacucugagcccacaccaacacaaaguugcuuaggaagugucuuuaaacuuuugaggacucuuaaauuaaggagccaguaaaacacaugggaacuacuuuaauucacacucugcacaaggagaaagggaccccuucagcuuacaacagcuacacuuaggggcuggagagcugguucagucguuaagagcacuagcugcucuuccagaggacccagcuucaaaucuuagaacccacaugaaaacccaaaacacacuauaauacuauaauaacuccaguucaaggguaucugaccccuuccuccuggccucuacagguaccaagcaguuguguagugcgugcucgcgcacacacauacacacacaggcaaaacauccauacacacauagcaaaaguaacaaaauuuuuuuuucaagcaaaaacagcuucacuucagacaaccagcaaacaucuaagugugguauuuuaaguaauaacuuccugccaggcagucauggugcagaccuuugaucccagaucuugggaggcagaagcagguggaucugucagucugaggacagccuggucuacaaagaguuuaaagacagccagugcuguuaacagagaaacccuuucugagaagaaaacaacaaaaaaaaacuucuuagcaaaauuucuaagaaaaaaaaaaaaaauggaaaucuucugugcuaagaguaauggcaaaggcugggcggugguggugcacaccuuuaaccccagcacuugggaggcagaggcaggcggaucucugcguucaaggccagccuggucuacagagugaguuccaagacagccagagcuacacagagaaacccuguauugaaaagaggaaaaaaaaaaagagugauggcaaaggcuuugaacagaguaaagcagcccuaacacuaauagaagucaguuucuuucaagggaacggauguucauuggcauguaaagauccauacauucagguacuuaaguagccccucccccccaaucucucacacacacucccaccaguuuaaaaguccauccaauccacuugagauaaaguuuguacucccuucaauagaguaucuuuuauugcuaaaugggaagagaaaucaagugauucgaagcucaaguuuuacuauaaaagccuauugcuaugcuucugaugugcuacuacugucuccugcauuacaggggaagcucucccaggcugcauggaaccaaguccucaucugagcagaagcugcagccuggaccuuccucaugacaccgaugugcugcucugcaggccccuccucuuucccuuacuccagauuccaccacccuauuugugcucugcagagguaacuugugugagucaucugagcuugaggagggaguuaagagcuuuccuuguguggacaaucaaacugaguccucagugggugcugauaaguuaauguauaaaaaguaguuaauaucugccuaaaaaacaguuaacaaaugguaguugccacuguugcuuuacgaguguguuguuuaguguucugguauuuugaauuuuaaaaugugccuaacgggcucaagcauaaaugaacccuuggucuccaacuagugacacugcugagagaagagaaaguauguccaugaggcggcucugagagguuaauuaaagccuccucccucccucacuugaaauguguuucuuuacugagauaaaaggugugaucucucagcuuccugcuacccagagcuguggccaugccucucccucuggaaccagaagcucaaauaaacuuuuuguuccuuaaauuacccuuguccauuuuuguuaaaacagaaaacuaacuaauacauucaacuaugacauccaggcugaccuugaacucaggcuccuucugucccagucucccaauccugggauuaaaggugugagcuaacaugcacagcucuagaauuuggacuuuaaacaaagaauagguuagaauaacagguauaguuuauauuccauguuuaauggguaacauaaauguuaauuuucucuugaaaacuuacuucagaaaugaaguaacaaagcccuuuguccuguaacacucgagguuuaauacuagcacacgcugccccaauagucauagguaggcaggguuaacgcaaggacacaaggaucaaaucauuucuuaaaauucagaacccaagaucguaaggcagacacuagacuuagccucucugaccacaagaaaauucagaaaacuucaaagcacaaucuuccaacaaaaugagccagacucucaggacaaagcaguagaagccaggaggacuugguguaagcuccacaaaaggacugaauuacuucuucaucuuccaaacccggcacaauaccaggaccaaauagcauucacuaaaccaaacaaauaugaucuaccagcuggaacacaggaaaagucucaaguagagucauccucccaccuucaaaacacugaagugaaaggagagcuuuuuaaguacagaagaaaaaagacaauccuggucacuguccagaaaggcaaucaaaaguaaauggucucuuaaugaaccaguugucuucggcaauacauuugaacagucuacuguaucugucauugguacaugacuccaggcaacaagcagaaucuucagagguugcuguacuuuagcuucacucuucuucuaaacaauagcaacucaauauauugagaaaaaauuuuuaaaugcuaaaaagaaaccaaacuucuuguuucuagauuugcucugcccaacagaucucuaucuguaaguaagaaaccuaagaaacagccgcauucaaaauggaggcuuuaaagagaacuaguguaaaaacgcaggucagugagaugcucugauuaacagcacaucuaaacuccaacugugaaagcaccuagccacugaacacugagguaaaggugagaauaccugaugacuauaagcuauguuugcacaucucauauuacagcuaacuuauuagcauguuuauuguuaguguucauauuuggugccuugcaguuuaaguaacuggacuagguuacgaaaucaccaguagaguuuuggcacaguucuccaaucuucuauuccuacugugaggauggcaacaaggaaaagcaagcacagauuucuagagacuagauucagacacaacugaugaaagacaaguccaagcuucccuaggacaccccuuucaaccacaccagcucacuuaccucgcccauagcucucccuuccagagcaagugcuugaaaaucaugauucaauucauccauagagcguaccuaguguucagaauagaagggaaagcuuuacgucagcauugugacuauuacauacauauuaugcacaaaugaagucuuuucuauauuuacuuuaagaaagcaacaagcacaguaacaaaacucaagguauuaaauguucacucaccuuuaaccaucaagauucagaaaugaucccuguguuaccccaccuacugccuucauuuucaaggcaugaaauacaccacaugacaagaaugcuagcuacuguucacaugcuuuaauaagcagagaucagcacaauggugcucaguggcaagucucugaucuguaacagggcugcgucuccuuaggcagucaaguaugagggaggcuaguuuaaaccagcagucuuggguaacuccaagagaucaaacuguaaacuguacagaguaucccaacaucuaucuauaaaaggcagucccaggaagcccccaaauaucaaacaggggagaaagaaauagcacauaacacaagaaaccuucuucacagcuuacuaaagcguaucuauauacaaagcuuccauuucaucagcuccaaagucauuaaggcauuucccacauggugcaaggaaagaacugacucccacagguuguucucacacucacacaugcaugaacacagacauaugauaguaauuauaaauguaacuuuaacaguaaggauaagaaaugagacaguauacucaaguagucguuuccaucaagccacaaacccacaggucagaaaacauggcaaguuuuaggucacugugcauuucaaaagauagccuuugccaucugcuaucuucuucaaauaauauaauccaucucugcuuucugaagcuagagucucuaccagcccuagaaaagauacuuuugaaagaaggcauuucugcacaucugaaaacaaggcuccugaggcaggagccuccuaggccuccuaucagccgccaccuuccuggagcuggugcaguuucuaggaagugaauggaaagcuuagcuagggcugagcaggagaaagacagaaccuaaaacccaacuuaguaacguaggcaugcugcuacaccccuuuaucccagcagucaugaggcagaggcgugggaucucuggaguuugcugccagccuggucuacugagcgaguucugggacagccaggcuacagagaaacccagucaaagggaaaaaagaaaaauuuuaaggggcuggugagauggcucaguggguaagagcgcccgacugcucuuccgaagguccggaguucaaaucccagcaaccacaugguggcucacaaccauccguaacgagaucugacgcccucuucuggagugucugaagacagcuacaguguacuuacauauaauaaauaaauaaaucuuuaaaaaaaaaaaaaaagagaaaaacuuuuaagucuuagaauauuaguuugucucaauugucaauauaguguacauaaaaaauaaaguagcacuauugcuuucuaucacauacuuuaaaaucuacacaccgggcagugguggcacacgccuuuaaucccagcacuugggaggcagaggcaggcggauuucugaguucgaggccagccuggucuaaagugaauuccaggacagccagagaaacccugucucgaaaaaaaacaaaaaaaaaaaaaaaagaagaagaagaaagaagaaggaggaagaaggaggagggaggaggaggaagaaggaggagggaggaagaagaaggaagaagaagaagaaguaguaguaguaguaguaguaguaguaguaguaguaguaguaguaguuguuuagucagaacacuagaaaucuuguauguauuuuccaaagaaacuagaaggagaauucgacaggacacacacccuuuuagcuuccugucucguccuucucccucucuccuauuuccgucuggcccaggucuccuuucacaccuucuuuuacuuuaucgcucccucuaggccuccuucuuuccaagugacucacucaccucaccuauacuggaaacuggcauuauccuuucccuaucuacugucuuagccuuauuuccuaaagcuugcuuggcugggauaccacaaacuucauuuaaaauuuuaccuacaguuaaccaaagcuaaaacaaaaagaacuauucucacagauguaugucaauuauucagaagcugucuguguuuacaggacaucuauaugauaugguuacugacaccaggccagcuaucaauccaaacuucuuccuuuaaaaacaaaacuauuaucaaaagaaucaaaagaaaugggaggauaaaaauguaggcuaucgaggcccauuggucgugcaaacuuuauaugccucaguauaggggaacgccagggccaaaaagugggaguggguggguaggggagugggugggggagguuaugggggacuuuugggauagcacuggaaauguaaaugaagaaaauaccuaauuuaaaaaaaaauguaggcuaucgaagaaaugauugaccuaagaaacaaagcuuuucucaccaucaagaggaaaggcugacuguacuuaagagucgguagccaacccuucucaccaagacuggacuuucuuccaaguuacuuugcucucugccucccuuuucuucagaaaucuuugacuggcagauuauguuaacuucuugucugauaauuccucuuuuguaucuacuaaguuucuguaagaucuccugucuuuucacaaaaacaauuuauuuuuuccuuguggcacuugucagucuuaccuuucuccaucugggauucccaguugcuguccuauggcuaccuccucccauccaaacaccaccaccacccuuuuuaaauauuuauuuguaacucauguguaugaaugucugccugcauguacacacgcaugucuugugucccuggaguucugugagcugcuaugugggugcugggaaccucaugaacagcagcauccuaacuguucagucaucucugcaacccagacaaccccuucaucagagcacagagccaacuugggagcccgaccugaccauaugccucuucauuccaccucaggacucuuccagaguccaggacuuccuuuugaaaggcccaauauaugccuuuucuucuaacagaaaagaguagaugcugccccaacuagccccacauuuuaacucauuaaucugguuuuuugucacauaaggucuuacaaaauuaaauuauaacagguagaaagcaagaguacaaaucauaaaauaaaaaagauaaaguaugggcuugugagauggcucagcagguaagagcauggauugcucuucggaaggucccgaguucaaaucccagcaaccacaugguggcucacaaccaucacaaccaagaucugauguccucuucuggugugucugaagacagcuacaguguacucauuuauaauuaaaaaaaaaaaagcuaaaguacuauuuauaauuugugguggaguggggggguucaaaacaggcuuucucuguggaaagcuggguuuagugguacaugucaggaagacaugaauguugagccagccaggguuacauacuuaagacugucucaaaacuuaaaaaaaaaaaaaaaaaaucagcacuggggaggcagaggcaggcggaucucugaguucgaggccagccuggucuacaaagugaguuccaggacagccagggcuauacagaaaaacccugucugggaagaaaaaaaaaaaaaaaaaacucuucccaagauacaagauacaauuugcaaaaaacaugaaacccaagaauaacgaagaccaaaguauggacacuuugccccuucuuagaauugggaacaaaacacccauggaaggaguuacagagacaguuuggagcugagacaaaaagauggaccagcuagagacuaccacaccuggguuccaucccauaaucagccuccaaacgcugacaccauugcauacaccagcaagauuuugcugaaaggacccugauauagcggucucuugugaggcuuugccggugccuggcaaacacagaaguggaugcucacagucagcuauuggauggaacacagggcccccaauggaagagccagagaaaguacccaaggagcuaaaggaggucugcaacccuauagguggaacaacaauaugaacuaaccaguacccccagagcucaugucucuagcuguauauguagcagaagauggccuagucagccaucauugggaagagaggccccuuggucuugcaaacuuuauaugccucaguacaggggaaugccagggccaagaagugggaguagauggguaggggaguggggggggggggaauuuugggauagcacuggaaauguaaaugaagaaaauaccuaauuuuaaaaaaauuuuuuuaaaaauucucaaacaccuacuacuauguguuguggguggcccuggugcuguuuguguuuggauguuaauucugcuuucccaagagggguugucuguaacaaggaaugagucacauacucaggugacuucuugugaaccuucuccuaaugaauaaaggagccaaucacugggcgaguaggugggacuucuggguuggacagaggaagagaggaagugggaaagagauagaagguuuuugauggggacaucaagaggacaacauauagcuacuaguaucucccgguuuagaggauuuagauucaauguggccuacaagauuaggauucuagccuggcgugguggcgcacgccuuuaauuccagcacucgggaggcagaggcaggcggauuucuuaguucaaggccagcuuggucuacaaagugagugccaggacagccagggcuacacagagaaacccugucucgaaaaaaacaaaacaaaacaaaacaaaacaaaaacaaaaaacaaaaaaaaaauuaggauucuaguuguugcacccagcaauuguuucugaacuaaguuugugcguuguuucauuucacggggcggcuugacuggguuccagagagaaaaguauggaagcaaagcauggcuuugccagaagugcaccacaaaaggccaagggaguuugaagcauggggcuggugugguagggacccgccagugccugagcggccagcccacuagugcccugcaguaguguggacgccuuucuuuauuauuucccucuacagcuaugcccuccacuuaaccaccuacaacacuaacacugaucacagcagacagcaacauuugucacuauuucucaucugcauagcuaugaguaaccuguagcuacugcacaaacaugucacuaucaacaagugagacaaaauguccuagagagaugauggcucauugguuaagagcacugacugcucuuucagagguccugaguucaauucccagccaccacaugguggcucacaaccaucuguaaugagaucugaugucuucuucuggcacauagauguacaugcaaagagcaaucauauacaaucaaucaaucaaucaaucaaucaaucaauaaaucuuuaugggggguuagaacccagucaacagugcuggccucacugacuagucuguaaaguauucaagagucugcccuucuuacucuaugcuuauccagaggguaaauuuuagucauccccagaaggaagagggaccagggaguaguauugaccucaauacuucauuuccaucaucaaaauaccauaaguaccuaccaauacugcuugauguuauauagcaguucaugccuagauuaaaauauuccaaccuggaggaagucuucacacagaaaguaagcaacacuuugugucuaaaagucccugaaacuggcgggcuucauuacuucccgcgcccccaagaguaaacaagauugcugagucacucugggacaagccaggcugaaccuacugaggccacaccagcaaagcugccagcaaggggcuagagccaccugcaaaggacacuuuccaccugcugagcugucuacaguguguccagggagcuccagguucccaacuuuuguaagcuauuuaucuaucacccaugcuagcuuuggcaauacagcugccuguauacuucuguuccuucagugacccuucaccaauccauauuccugcuaagaaaccccaguaaaacucauugguucaccaagacggacuuuaguucauacuuugcucuguccuaggcucccugugugggaggauuguguccccagaaaagucuauaacacaacacuggaauaucuuauuuucucaacugugacauuucaguguauacccauucuuuucccuucucaaaucugagcagauacaacaauuuaguaaagcaucuauucagacacuaccccauagccccaaauaaaccacugcuccaccaccaauggcaaucuuuuuuuuuaguugacauugaaauaaaaagaaaagccauguagugguggugcaggccuuugacaccagcacucuagaggaaaagauaggugaucucuguaaguuuaaggacagccuggucuacacagugaguuccaagacagccaggacagagaaacccugccuucaaaaaaaaaaaaaaaaaaaaagagagacagacagacagacaaggggguauucuaaaauccuugaccauuguucuggacauuguucuguauugguucugauucuccccacucucuugucgucuugcuggccuacaguacaagugaaagggguuggggagagauagaacagaauggacuagcgcacacucaacacaacucuacaauuuuuaaaaguuaaugauacacuccuaaauguuucauaaauuguauuuuuuuuuaaccuaaauauagcacagacuacuacuaaccccugcagucacuggaaccacagaauaauaaauacuaguggguuccaugcucagcaccacuuagaaagacaggacuggagaacauucuaauuaaagcucugccggcauuccagcccucagauuaucccucaggcgugacaguuuguccaguccacucuugcauauacaagaaauaaaacucagacaaaaacagucggucacuacucaguaaccuguacuagggauuucuauugagaacaaauuuguucaguuauacacauacuuagaaaaaacucaauuaacuugacacuuuuuaagcaucuuucaagaaagagcaacuuccaagccuaagagauaucguagugguuaggcacacuugcugcucuuccuaggaccagcacccacauggcagcucugguuacaggagaguccguguccacugcuggccucauugagcccuauaugcuuguauacaggcucacaugcagguaagauacccauacacauaagauaauaaaauaauaauuuuaaaaaggaaaaaaaaagcaacuucuugcuucccccaccuguggccagaauagucccaagaauagcuccuccuuaaguaccugaucccauaaaucuagggguggcagacaccuuuaauccaagcagaagcagcuuuggucuacagagugaguuugaggacagccaccgauacacaaauuucacaaauucccgcuagagacagauaugacuggcaacgcuaggagacuggcucccauuuccccuggaaugaucucugaacagcuggccgaauugaaagcugagccaucuauauaaauaucuguaccuucaaaaauuacaguuagaggcuggugagauggcucaguggguaauagcacugacugcucuuccaaagguccuguucccagcaaccaauagucucacaaccagccauaauaagaucugacgcacucuucuggugugucugaagacaguuacaguguacacuuauguauaauaauaaaucuuaaaaaaaaaaauccaguuagucuaaauagcaccaagagagcaaaugggaguggcaaggaagcaggaacuguaccuugaggcagcuucggucaaauggcucuucucuugccucccaagaaaccagugggcuuuacuggcuuuucuaggaaucugacaauaagcuuuauaaauuuuauuaauauccauggcauuugaccugcuaaacugccuuccauuuaaauucuaagaaaauaaucagaauaugggcaaagauuuauugagaaaaauuucaauguucguauaauaauggggaaagcagcagagagcuaaaaaaauagaaguuauuaaauaccacauaucuuuuaaagauggggggggguuagcuuuguuguuuaguacaacagggcaucuuuguguagcuuuagcuguacuggauauggaucucacagagacucugccuccccaguaugugugccaccacagcagaauuuaaaggaucugauacagcuacuuaaaaugucuacauuuuuuuaauggugugaauauuugacaucugugcagugugugugugugugugugugugcgcgugugugugugcgugcuuauggaggccagaagcugucagauucuuuggaacuggaguuauacaguugugaacuguuacaagggugcugggaacugaacacgggugcuuuaugagagcagcaaguacuaauguuuugagccacuacuccagcacccuaaaaacaugucuaaauuuucaaagagaagcauauauacacaaaaagacaaaguaggacaauacaaagugccacccgaacacacaccacaucuaagcaauauacccaaauguuaacuuacaacuucuagaggagggccugguaaaauagcucaaucaguaaaagccugagggccugauucaaugcaggcucagguggaaagagagaucugacuccugaauacuguccucugacuuccugagcccaaacucaacacauauacaucauacagacacacauuaauaaaacaaaacauaaaaauguugcuagaagccuggguagccuaguaacagaauaccaggguagccuaggagcagaauaccuggguagccuaggagcagaauaccuggguagccuaggagcagaauaccuggguagccuaggagcagaauaccaggguagccuaggagcagaauaccuggguagccuagcaugguagcagauacaugcacucccugcucaaaagcaaauguaggcuggagagauggcucaaugguuaagagcacaaacugacugcucuugcaggggacccaaguucaauucccagcacaaauguuaggaggcuuauaagcaccuguggcugcuuauccagcuccaggagaguuuaacaucucuggcuucugucagcaccugcacacacaugcacauacucacacauagaugcacauaucaugagaaaagggagaaggaucacaaguucuagucaguaugggcugucuuuuguagugagaauucugaaauuuuaguuuauuuaaaaaaacaaaagcgcagaaguaccgagugugcuuuugucuuaacccagguguagggauguggggcugcuuccgacuguccacagcagcucacuaugauuugccuaucagaagcaugguuuugccaguugcagauaauuucuucgacugugugauauuuggaauucugggaacuuuucagagguuguuggucauuuagggaggcugugaucaaaaaagaaacuaaagaaaggaaauuagauucaaggacuuuccuaauuccucucuugucucuaccauuguuucuucccugucuaguguuaggggauaaaacagaaaggguaugauaaagggugggggaagaagaacccacaaaguugcaacaucagcuaaaugucucagucauuauucuauguugugaagagacaccaauauuauuuauaguauaguauaguauaguauauaggaaagcauuuaguucgacgcuuccuuacagcuucagaggguuguccaugaucaccguggcccuacaggagcacagaagcaggcacaguacuggagaaaaaagugaaagccucauccugagccacacaggcagccaacaccgggcucggcguauccuuuugaaacuucaaagcccagccccagcaacacaccuccuccaacaaagacacagcucccaccuggccaccaacuagagaugaugaauacaaauauauuggggcuacucucaugcaaaccacuaguuauagaccagcacugaauacacagaaagacucuuuugauaaggaagagggcuggggagauggcucaacaguuaaguguccuuuccuugcucuuuuuuuuuuuuaaagauuuauuuauuuauuauauguaaguacacuguagcugucuucagacacuccagaagagggcgucagaucucauuauggaugguugugagccaccaugugguugcugggauuugaacuucggaccuucggaagagcagucgggugcucuuacccacugagccaucucaccagccccuuuuuuuuuuuuaauucucucuuuuuuuuuuuuuuaauuuuauuuuucaagacauggguuucucuguauagcccugccuggcuauccuggaacucacucuguagaccaggcuggccucaaacccagaaauccaccugccucugacucccaagugcugggauuaaaggcgugugccaccaccgcccuuuccuugcucuuuuuacaaaguccauuuccagcacccacaucuaaguaacacauggcaacucagaagcauccaagcucuaguucugggaagcugaugaucucuggguuuuguuguuguuucuuacuguuuuguuuuguuuuuuaguuuuguuuuguuuuuguuuucccaagacaggauuucacucuguagcccccggcuguccugggacucagagauccaccuaccucugccuuccaagugcugggauuaaaggugugcaccacaacuacgcaguuguauaacucuauuuacuaauaaggaauggagacaaggugagauaacugacaagaaauuaaaaaaaaaaaaauuaggcaugagauggcuguaggcaguuucuacagacaguaaacacuguuugaagcagagacagaucaaucuucaaugccaccaugacagaugcuguaauagcuagaguuuauuacaucuucaacacuguuuauggcucauuucucaaagagauauugugaaugaaauuuucucccuaacuuuuuugaaacaaagcaaaaaacuaaggaaaguuaaacccucccugcucaguuauacaagcaggccagcuucagaaccugauggggcucaccuucaaucccaggaggcagagacaggaaggacucuauauuuaaaacccuccuagucuacugaguuccagaucaguuaaagcuaauagagaggccgggcagugguggagcacgccuuuaaucccagcacuucggaggcagaggcaggcggauuucugaguucgaggccagccugcucuacagagugaguuccaggacagccagggcuauacagagaaacccugucucgaaaaacccaaacaaacaaacaaacaaacaaaauugguaacuaaggcuggagagguagcucagcaguuaggagcacugacuguucuuccagagguccugagcucaauuccaagcaaccacauggugucucacaaccaucuguaaugggaucugaugcccucuucugguguuucugaagacagcuagaguguacucauauacaaaaaauaaacuuaaaaaucuuuaaaaagaaaacaaaaacugcuaacucaggguuggagguaauucugggcaacacauggcaugagccaacccagguaaccaguccucuauagauaccucuaaauugcaauaauauuuuacauaauuccuguccuagaaaaaagacuuauaaaagauaggauuuaaaacaauguuucuuuacugagguaguaaaagcuacaccaucaugcauuuauauacaagaacuggcagccaaacuuaguaacaagaaagcaaugcacuugguauugauuucugagagacuggauuguuuacacuguuaaaaauugguuuugccuuccaaaauuaugguuaugcugugauaauguaaaagaaauucaaaaaguauaguuaaguauauauaaagcuaauggaacauuggcaguuuacaauucaaucacaagagccugaugaaauauuuauuccuauuccaaacagcaauuaaguugguaauugcagaauacagguuuuggccuauugcaaguauaaacuuuuuaggcaaaacugauaaccauuauccaaaagauaaguuguuacaauuugccucuaugcaugcuuuuauauuuuuauaaaucugcgcaugcagcccagagugugcuuacuguacuuacagacagcucaucugaugggaaggcagucuauauaauuggaucgcguuuauucuugagucaacccccaacuccacccaagucagcacacauaacugaauuaugugcuguagcacuguuuuugaaauguugaaaacucaagcuuuuaauuuguauacugauagucaauauagcucaugguuuagaauugcuugaaacuguuccguuuuuagauacugcuaauucucaaauuuuacaauuguuuaugcaaauacaaccaauuuaaaagaacaaacuguuccuuacuuuuuaggacauuuaagagcucauacugaauugccgggacaggccaauggcauaguccugaucugguauuaauauggggaagagggcagguuugugguuuuuccucaggaugcugaaggagcacaguagcugccagagcaauuggugacacguaaugaugcugagacuaaggaugaugcugacugugaaguuuacugagugcccugacaauggugacagggaagcuguacugagccuauguucuugauacaucacuaauacaucugauaugguccagcccagagauucuugugaccaguaauaauacucaacuucuuggaucuccuugaacaagggaguaaacuuauaauaagaccaugacuuucaauggauuugaugaugggauuccuguuuguuuugugaagaauaguaugaaugauggguguauuucuguguuuacucauauuuggaagaaaaacauuucacaaacuguaacucaaagcauagagauggaaaugaaaaaaauacuaugagggaucugccucugacccuaauaagauaugaucuugcaaaucguguagagaauguagaucuagcguuuaacaaaacuauuagauggaaagaauguuauaaucaaccccaauguaguuuaauguuuccuacaauaugcaaacuauugauugggcaggaaaucaaacauuggacaaaagaugucuauagguuuuuggcaauaagaagcaagccaguuccaacugcguauuuggaaguuaucugcagcucucuaugaaguuaccuuaaacaaaauagacaaaauuaggacagaauauggauuucaaacaaguguuagcguguguguuaaggcaccuaaucuuuuauuaauaggccauguuaaaauguuguuucuucuauagcauuuaauguaaguugcauugauuguacacuaucuaauuguauuaguguacugaaaucuagcaggucugguacaguggucuaucaaccagcuuuuguuuuauugccuaugaguaugacaggaccuuauauucugaaaaaaaagcuuacaaauauuggaagaagugagccaggcuuuaaagcagaagcaagaggguuaaggguuugauuauugcugguauugcagccacugcuucugcaacugcuuugaugcaagaaguuaaaacagcuacuuuuguuagucauuuagcagaaaauguuacuaauguucugaauauucaagaagauuuagauagggguuuggaacaaugaacugaugcucuuuaugauacuauuaaaauuauuggagagaagguucaaaguuuaggaguaagaagccaucuggagugucacacuaaauaccaauggauuuguucaccucuaaaacuuacaacgacagccacuauaauucaaagacacuugcaagguauuuggcauaauucuaacaccucucuggauauuauaacuuugcauaaugagauuaugaauuuaaagaauacugcucugcugaguuuugaugcuaagcauacugcugauaaaauuauucaugacuuaaggucaguauuucuaucuuggucaagcuucaagaauggcuuguauaagccgggcgugguggcucacgccuuuaaucccagcacuugggaggcagaggcaggcggauuucugaguucgaggccagccugguccacaaagugaguuccaggacagccagggcuauacagagaaacccugucucgaaaaaccaaaagaagaaaaacaaaaaacaaacaaacaaaaaaaaauggcuuguauagcuugaucauuugagccccucuuguccugagaauacuuuuuccugcccauugugacaaaaauugccuuuaacaacuucagcauguuggcagccaaaguacauggcuugaaacuaaaacaagcuggaagucaauagagguuaagauucugcacagagccuuaccaaccuaugacagaaaugcauugcuuuggcuaaugcauagugaaacccuaucucaaaauaaaaaacccaaagaaaauaaaauuuuuaaaugggaaagggggaucagagcucacuuuauuauuuauuuuuuaugucuacaggcauuugacuauacauaugucuaccccaccacaugcaugcucagcuccccaggaaaccagaaaagaauaugcucuggaauugggauuauagacaauugcaagucacccugugggggcuagauauugaauccaggucccugcaagagcaguguuccuuuuguuuugguuuuugguuuuugguuuuugguuuugguuuugguuuugguuuuucaagacaggguuucucuguauagcccuggcuguccuggaacucacuuuguagaccagguuggccucaaacucagaaauccaccugccucugccucccgauugcugggauuaaaggcgugugaaaccacgcccggcuuaagagcaguguucuucaacacuaagccauaucucaaaccuuaaaacucaguacaacccuuuaagugcugugugauucugccuuuuaaaaaccuuaggucucucaagaccuauaagaugguuccaugauaaaggagcuaguugcaaaacuugacaaccuaaauuccaucccuggcacuuacuggagagagaguucacuacugaaaguugucuucuaccucuacacuugugcugugugcaaugugagucuucugcccuauauacacaaaauaaaucagaagguaauuaaaaaaaugcaaaugcccaguguaacauuggaaaaagugaaacugcaaauucaacaauaacuagaaagagaggguggauuacuaaagacaacagacaacuagcauauccuaugucuagauugugauaguacacaaucacaaacucuacagaacuacaugccagcuggguacaguggugcagcauaguuacagcuauucaagacacuaagagaaaaagaucaccugagcccaaguuuaggcagcccagaugcuaucauuauguuuaccauaaaauaugccacuuagcagggcaugguguaauaccccuuuaaucacagaacuugggagacagaggcaggcagaucucuugauuuccaguucagccagagcuacauaguaauacccugucucaaaaacaagaaguaaaaaugccacuuuaauaaaaaggaagggaggaaaaaugggagcacaccuguaauuccaucuauagaaggcuagguaggacaggauuacaaaaccagguuagucuggaccacauggcaauaccaugucucaaguaaaugggauaaaccagacaugauagugaauaccuuuaaucccauaaagacagagaaaggcagauuucugugaguuuaaagcuacccuggucuauaugguuccaggccagaauguugauauccuaucucaaaaacagagauaaaaagaagaagggggcgggggaagcauacaagagauuaauggacuucauuacuuuccugucuuaaaaaagugagagaaaauucaaaucacaugaagucccauacauuaucuaaaaugaggcauaauuuacugccuugguaaguguuuauuguugugaagaaaacaccaugaccacaacaacccuuauaaaggaaagcauuuaacugaggcuugcucauagcuuagggggucuguuauagcugggagcacagcagcacacagacagauagucuacucugagaguucuacacccugaucaggagggauagggaaggcucuaggcuuggcuugggcuuuugaauaaagccacagcuccuaacccuuucaaacagaucugagcuucuggucacccagguuugacacuauggaccucugggggccauucccauuuaaacugcaaacaaccaauagcugcucacauagauaucuuacuuuguucucacuugcuucaaggauacuguuucacuucccaccuaagacuggccucaaacucacagcaauccuauaccagccuucuuugaauguugagguuauaggaaugcauuuuuaaaauucaaguauuuuaaaaaacaaaacaucauuuuuaaauuacauuaugauuuacuuaauuaugugcauaggaaagaggacucacacaugccacagcacaauuguggaggucagagaaaaauuuuuuuauuuuuuuuaaagauuuguuauuuuaggaauauaaauauacuguagcucaucuucagacacaccagaagagggcaucugaucucauuacagauggucgugagccaccaugugcuugcugggaaucgaacucaggaucucuggaagaguagucagugcucuuaaccgcugagcugugucuccaaccccagagaacaacuuuuaggaauaaauucucuccuacagugugagugcuagggacggaauucagguuggcaagcuugggaacaaauuuuuuuaaaggcacaaaucagagaacacacaacacaauacagccuuuaaaagcauguucacuguuccuuaaaguccaaacugucucaguauucaagacccuacacucaauuucaccuuacaaguuuaucaaguuaaaaugacaccuuaauacucuucaaaauaaaacacuccacucaauacaucucuucaaugugcccugauggcauaaagucuucauuuaucaauuauauacuacuugccaggugcuaggaauaaaagacuucuuuuugaaaguuucccaaaauccugguucuuaucuaaugagugcauaaguauugaggaggcagaaaaugaacaugaagagcaacucagcucuggcgauucccaacccaccacuuguuuacucaaacagcauguaagauccaauggagacacaauguucaaccgccgggcgugguggcgcacgccuuuaaucccagcacucgggaggcagaggcaggcggauuucugaguuugaggccagccuggucuacaaagugaguuccaggacagccagggcaacacagagaaauccugucucgaaaaaaaaaaaaaccaaaacaaaaaaaaaaaguucaaccaaguaccacacugacacaauaguauccaacucuggaaaaaagagggagcuagcaaugccuaucagaaaugaagguacuuuuaacaaaagcuugaaggcucauguguagugagcacuaaaaaccuaguaacguggggcuggugagauggcucaacagauaagagcacccgacuguucuucugaagguccugaguucaauucccagcaaccacaugguggcucacaaccaucccuaacaagaucuggcgcccucuucuggagugucugaagacagcuacaguguacuuacauauaauaaauaaauuaaaaaaaaaaaaaaaaaaaaaaaaaaaccuaguaacgugaaguaaauguuuuuguuuuacuccuagguguagaauauggggcggcuucagagucacugccuaugacugucuccugcgaggggaaugauuuuugcccacugcagauaguuuauguuuagaauucugaggacucgagaggguauaaaucugagagcccugcuccaucugcuauuggaaaauggagauauccugauggggacuggacuugccccuaggaaccuaagguccuaaucagcaggaagcagagucuaaagagguuuaucccuccuuuccccucuaaccuucuuucucuccuacccauuguugaggauuuggaaaggauugagguagaauaaggguuacuuugccaauacucauguauuugaacaguuggccucuaguugguggcaguuugggaaucaaggaaauguguuauuaaaggaagaaugucacugggggcuagcuuugugguuucaaguguaaugccauucccuuugcucccucucucuggcuguggauaugaucucucaacuuucugcuuugauugccauggcugccugccaugaugguggaccacuagcccaaauaaacccuuacuuuuauuaaguugccuugguccugguauuuuaccacagcaacagaaaauaacgaauacacuauucucuaccauaauauaccaaagaaaucccuauacaauuuauguuuguugcugcacuacucacaguagccaagacagaaaagccuagaagucaacugacagaugaguaaagaaggaauauauggcaaaagcuagaugugucuaugcagaacugugaucuuagcaccuacaagaaagaagggccacaguuuaaggucauacuuggugauuauauauguacgugugggggggggguuuaguuuuuuaauugagccaauccuucagggaaagaagaagaauaggaaggugauacauacacuuaacuauaucuuaucgggugaaagacaacauuauauguuuucucucacaugcaacaucuggauuuaacuuucauuuuccaagacaggguuucuguguggcccuagcugaccuggaacuuguucuguagaucagacuggucucaaagacucauuucuuccaccugccucugacucccugggauuaaaaguguaugccaccacugcccagcugauuuuuauguauacauauauguaaaacuuuaaaauagguuuguggaagauuaaagagguucuagagcagggaagauaacggauccuuugucaaagagagcaaacaaaggaggaagaggggcagggcacaaagaacaaaguauaaugauucauauugugugacaauguauaaucccagcacuugggaggcagaggcaggcggauuucugaguucgaggccagccuggucuacagagugaguuccaggacagccagggcuauacagagaaacccugucucgaaaaacaaaaacaaaaauaaaaacaaaacaaaaaaugaagguagugggcuggugagauggcucagcaguuaagagcacugacugaucuuccaaagguccugaguucaaaucccagcaaccacaugguggcucacaaccauccauaaugagauuugacacccucuucuggugugucuaaagacaacuacaguaguacuuacauauaauaaguagaucuuuuuuaaaaaaaugaagguagcuuaaaaagauaaaacuacaaaaaauagaaaugcauuaauucuaugauagccuggguuacaacuagacccugucucaaaauauaaggaauuuauucaacucauucguucauuaaauagcaucauaugaaagcacugcacaaaugguauuuaaaaaugcaugcuuuggccgggccgugguggcucgugcuuuuaaucccagcacuugggagugcugcagaggcaagcagauuucugaguugaaggccagccuugucucaaagugaguuccaggacagccaagacuacacagaaaaacccugucucgaaaacaaaaacaaaaagcauuuuuuggcaauguuauagauucaguacagcuacaguaaagacaaugaaaaaaaaaaaaaaaaaaaacggagaaaugaccugcaccaaaaacaccaagcaggaccuguuaugcuauuuugaaggaaguugaaguuacccuaaauucaagagaaaacaagacgaaacuagccccacuaagaggcacacucuuguaaucaaucccagcacuaacaacuggcacagugugaaaccaucugagguuacaaagccaaccccuaucuuuaaaaauugguaagaacaacagggcuaaaaccccagcucaguuggaagaguacuugguaguaggcaggaaguccugggguuaauccucaguaacacaccaacugguacuggguguggaugucugcuucugagcacuugggagcuuggaacaaaaggacauccagucucaaaaaaaaaaaaaaaaaaaaagggauagagagauagcuuggcaguuaagagcauugacugcucuucaagagugcucuucacagcugggcgugguggugcucgccuuuaaucccagcacuugggaggcagaggcaggcggauuucugaguucgaggccagccuggucuaccgagugaguuccgggacagcaagggcuacagaaaaucccugucucaaaaaaccaaaaaagaaaaaaaaaaaaaaaaaagaguguucuucaagagguucugaguucaauucccagcaaccacaugguggcucacaaccaucuguguaauaggaucugaugccucuucuggugugucugacgacagcuacaauuuauucauauacauaaaauaaucaacaaaagaaaaaaaaacagauaugcacagauuaucuuaaagacuuuaagacaaauucugugacugccccuugcagaguaaucaagggaaagaaauggggaagagaacagaguagagcaaagaggguagggagcucuauuccugguuggagcacauaauacugccucuaaggaccuauguucaagucccagcacccacaucccguaacuccaacuccaggggaucugauaccuuccugaccucuuccuacaugggugcacacacaacaauuaaaaaacaauuaaagaaaaacuauucugcaguauuauuuuaaauaaaaagggaagggggcuagagagauggcucagccuuuaagagcaucacaaccaucugaaaugggaucugaaguccucuucuggugugucugcagcuacagucuacucauguacauaaaauaaauaaauaaaucuuuuuuuuuuuuuuaaagccagaggcugaaguuggcugggcagacuauaauacuuucagcuagcucuuuuauaggaccugcuuugguugccggcacccacauaaggugagugagucaccuaugacuccagcgucaggugaucugauggccucuucuggccuccucaggcaccuucaggcaccacacacacacacacacacacacacacacacacacacacaaaacacacaaauaaaacuguagaaguggcucagcaauuaagagcacuuaaugcucuugcagagggcccagguucuguuccuagcacucacacagcuacucacaccaccugcaguucaaguuccauagaauccaagacuucuggacucaauagguaagcauacacauaugcaggcaaacauuauuacacacauaauaaaucuuuaaaaagggaaaagaagcuggauggugguggugcacgccuuugaucccagcacuugggaagcagaggcaaggcagauuucugaguucgaggccagccuggucuacaaagugaguuccaggacagccagggcagaggggggaaaagaaaaacaacaucagacaagaaugccaguacaagcuagugaucccaacacccaggaaagcacaagcuaaacaggucugcauaucaguucuaggccagacaggcuuacagaugcuguguuuaaaaaacaaaaguaaaaaaauugugugacacuaggaagggauagagagauguucagcucaacuucuuaaaaucaugugucauuuaacauaggcuuguguuuaggaaagcagcugcccugcaauaaauuaguggguccuaugaaaguaugucaacugugagauuuuaccugagagucacauuucuccacccuguuuucucauucauaaaaauuuacauagagggcugggcuauguucaaugauagcacuggccugaauuaugaggcugccagguucuacccauaccaccaccaugaaucaaucacucaacaaauaacccauauaaaguuauuggagguuucaccauguaagaauaaaacagccagccgagaugggggagggagggguggcagcagccuuuaauuaaucccugcacucaggaucagaagcuggcagaucucugugaguuccaggccaaccuggucuacagagcaagucccaggacagccaggauuucacagaaacccugucugggaaaaaaaggaaaaaagaaaaacauaauaauaauaauaaaccugccgucccggagguggggugcacaccuuuaacaccugcacuagggagguagagggaaaccucugaguuuugagagcaaccuggucuacagagugaauuccaggacagccagagcuacacagagaauaauauuguaaaacaaggaggguaggagggaaggggggguguagguaaaggcauuagccuagcagguaugagaugaggaccuguguuugaucccaagaacacagguaaagcuggugcaggguucuaaucccaaucuucuuaggacaagauggaagacuaacaagguugcagaccagcuagccugacauaacaguacaaacaacagauucauaaauggaaaagagaacuaacagccaagaauccucuggcuuuuacacacacacacacacacacacacacacacacacacaccauugcaugacaaguccacauucacacaacacacacauugucuuagauauuuggaaauaauaaauggcaagaagccaaaucaucgauaaucucuaccaccuacauauguaacaaauuucgugauagcuccuccuuguccuuaauccagguacagacagaguuuaaacucucuagcucgcucucucuuuuugaaacagggucucucacuauauagcucuaacuguccuguaacucacuauggagaccaagcuugccugggacucaagagaucugccugucucugccuccuguugggauuaaagaugggcuccaccauguccaacuaaaaagccuauuuucuagggaauaaacuaacaagugaaggaaaugugucugccaauuacucuuggggcacuuuuggauaaccaaauacacacagaccuaccgaacucggcacagacccacugaaguugcuguucaaaauuauuuuguaccuuccucuuuccuucaugaaaccaaguuucuucagaggaaauacauaagcaaauucauuguuugcauuacccaagauuucugacucuaaauaaugucucccuaacauuuacaacagugagaaaacacaaauuugaauuaauaaguucuuuaauggauuaaagaacauuuuguaauuaucggcaggggcugaagagaugguucagcaguuaaaaucacuggcuguucuuccaggagucuaguccaauuccuagcaccuacauggcagcucacaaccaccuguaauuccaguuccaggggacccacuauccucuccuggccuccauggacaccagacacccauaaaguuuucauacauauacacaggcaaauauaacuuuaaaauaaauauaucuuuaaaaagaauuggugauccugacaccaccaacaacuccccuacaaagaaaugggucgaaacccacacuacucagaaagcagcaccacuguuaaacuucauccccagacucuggcugagcccuucucaggcuguacuaagcuuuaaaaaguagucucagagaaccagagacuguauccaauuuaaagaacugaacaggcuacccacagacuagaguagucuggugacuauccagggcuagagcauaagugagagcuacaagugaugagaaugcucccacugugguauggcuaggcaacuggguaggcagcugauaagcccugaauuaacucuuuaauugaacaaacuauguaucaauaaagcggcuauugacaacuuccuuaaggcuccugguuucuacacauuaaaaucauuuuccuggaagcuuauuaauucaaagaaaaguacuucaaagcuggaaauauagcugggcggcaguagcacacuuaaccuaagauagccaaguccugggcucaaacauuaucaccaagaaacaaacacacaaucuacugcaaucugugcacuauuugcacauaucagcagagaacaaaguaccaugacagcuacacacugagcuuauauuauagcuccuuggguuaagaaaaacugaauggaaaacacagcgaaggagaggguuuuuuaaaaaaucaaauccagcacuugggagauugugaguucaaggucagccuggucuacaaugaaaacuuguaucaaaaaaaaaacaaaaacaaaaacaaaaaggaaggaagcaaacuaccccuacacacauacuccuggcauccccuguucucuugacaguguguggcagcaccuuggaguuugcaucaagcuuccuaacacugcuaucuagguagucuuuccauaauauucuugaagcaaaaaggcucuugugcaacugcagcuuccugaaaaggccacaugcaaggaugucugccacacagaagugucaucaaaaacagacgcaucuuuugcuuacaccccccuccaagacaccuacauagcaucccucacucagauuuaaaacaugucuccuaacuacuuauuuuccuuaagacuuggccagcuuugguguuauacaccuuuaauaccaucucugugaguuugaggucacccuggucuacaucuacauagcaaguuccaaaccagccagaguuacaugggagacgcuguguccaaaaaaccaaaucaacaaaauuuaauccauuccauucucuuuuauucguccaggcagauucucaaagcaaacuguaauuaauucugguauguguuguuucugugagguuuuuuuguuuuuguuuuuguuuuuuucgagacuggguuucucuguguagcccuggcuguccuggaacucacucuguagaccaggcuguccuggaacucagaaauccaccugccucugccucucaagugcugggauuaaaagcgugcgccaccaccguccggcacuauuuauuuauuuuuaauucugacacagaaucucguugaauaguccagaccauucggaaacugacaauaaacucugaauuuuauuuuccaucgugacauuucacaaccaucuaucauuuacccuaauaccuuaccaaaagcuuuuugaaacaauguauugccuagaaggcaugcacaucaaguucuauucagcacuugaaugaugucugacuggauacgcacacaugccaggaccacuggaccacuucuucaagugaaaccaugauccuucagaauauauagucaaagaauugaugauuacccuuuuaacaaaauaccuaacuaauguuaaaucuuggcuguacagaacacagagaaaaagaaugaagagugcagagauaauaggauauaaaauaggaaagauggaguauuuagucaagugcuacuaguucaaaugcugaggaacagccuaagcaaucuacuccuggugacaaguuauaaguugucaguuaccuuauaguacuggagaggaaacauacacaguaagauauggucaccagaugagacaaauaccaguacaaugccagugagacauuugauucccugagcucugcuugcaccucugugaugccaaccugccagugaccacaagcaaaauguguaugcuccauagcccuguggccaggacagagaggcuccugucugcccuggguaacccacuauaaaguucagucauggaccuuaacacauuuccccuauuucaucaccuauuuuaucucccagcacuuuacagagaaaauaaauuuaaaauaaauaacaguacaacaaucacauguuaaaguuuuaguuuugcaagaugaagcuuuaaugcuagucagaacuuaaaucacaaagguuacuauuuaaauauaguucauuuacauguaaaacgggugggucuuccagcucuucucuagcacccucacgacauuccuuguuuuaauggcuugcuaugggugcuauaaugugugccacacagcuccuauuucugcaaucagugucuaucuguacucuaauggcuuacuuacuuuuccacccaccaaacccaaguuaacuuuuccuccuuccccagagaccuccacugaguccaaaaaugggggcuuugacauuucaaacuauguauagcaauguuacauauuaaaucaaauuacgcagaaaguuauauaggcuuuuacuguucauaugggggcaugcauuauuaacacauggauucacuaugaagcccaggcuacccuccaacucaccauucuucaguagucuuagccuacugaauacugguauuagaaccuagacucacuaugcucaccuuacuuguggggggaaccuccuauaugucuccuucuuccuaagaauuuaacauaguacagucaggucugaugguccaugaccugaaucccagcacucagaagacaagacguuagagguuugaagucuacaaagcaaguuccaaaccaggcagggcuacauauacagauccuggccuuaaaaagcucagcacuauaaaguggaaaagccaaguacaguauauauaauauuuguuaauaaauuccagcuacuugagaagcuaaagcaauccugagcuuguggcaaaccugagcaauauagcaaaaccaucaucucaaaaauaaauucaguucacuuuaaaaaauuuaaaauaaaaguugggcagugcuggcacaugccuuuaaucccagcacucaggaggcagagacauguggaucuccaaguuugaggccagccugaucuacagagcaaguuucaggacaguugggacuacacagaaaaacuauugucccaaaaaacuuaaagaaaaaaagaaaaaaaaaagugggcugaaucgauggcucaucaguuaagagcuaccuguuguucuuaaagaggacccggguuugguucccaacaccuacauggcagcucacaacuuugugguaacuccaguuccuggggaucugugcccucuucuggccucugugagcacucugaguacuacaugcuugugguucauuuacaugcaggcaaaacacacaaaaacuuuuuaaaaaguaaaguucuuaaggauuuauuuauuuaauuuauaugaguaaacugucacugucuucagacagaccagaagagggcauuggaucccauuacagaugguugugagccaccaugugguugcugagaauugaacucagaaccucugaaagagcagucagugcucuuaaccacugagccaucucuccagcccccaaaaaguaguuuuucacaaaaggaaagaacaugaaccuaaaguaucuuaacacaguaaguauaaaucuuaccauacccugagcaucuaaauaaugaguguuuuaccaaaaguguuugaucuuaaauuuuguuccaucauaacagaacauggaagugccuuugaucccauugcuaaagaaggcagaggcaggcaaaugucuguaaauucaaagacacauuuacacagccagggcugcagaggaagacuaucuccaaaagaaaacaaauaauaaaauaaaagaggaaggcaggcaauccauuaugauaaaaagucaucuaaaaacaaaaauguaaaaauuaaaagacaaggcuggauagaugguucagugguuaagaacacuaacugcucuuccagaggucaaguucaauucccagccaacacaugguggcucacaaagguccccaccaaaaaugaauaacccaauaguacaguggcaagcacaggaguaagaucacuucgugaacugauuacuacuuagaacccucauaaaaacagaaacacuggugugugggacagccaaaacccucuccacuguaaagguuaaaagaugagucccgcugggcaugguggugcacgccuuuaaucccagcacucgggaggcagaggcaggaggauuucugaguucgaggccaaccuggucuacagagugaguuccaggacagccagggcuauacagagaaacccugucucaaaaagacacacacacacaaaaaaaagaugaguuccuuuugcgaauuacaacuguaauucugaaaguaagguacaauguuaaauguugaguguacuucuuuuuagaguuuagcacaaucuugaguuguaaggaccuaauaguuguuuauguuagucucaugagaaaagcaguuauccuuggugaaauacuucuguagacagucucuggcuugucuaacccccguaugaagauuaccauucauaggacagacaagacuacaguacccuaagagucuauaucacuuguauguaucuacuaucaagccuaggaucucuacuuuuccaguaaaguaacucauuccccuaaaaauaugcuacuucacugcaaugauucucugggguucagcaugucuuccugggaaggcaaaagucuacccagagcuuccacaguaaacucaugcuuacuuuaaaacuacaccacugggcauggugguggcacauuccuguaauaccaguacuaaggucugccucauaacuauacuucaguuucuugucucucacaaaagauccuuaguuaucccacagaacugaaaggaucaaauucaggaacuaagcagcucacugccuauacccugucuggcuccugacagaucccacagccucuagucucaccaguuaccauagcugagaaggacagaauccccaccuagccaugugccuuuuguucuagugccccuccugcuaagugcugaguaaacaggaguuagcuaccuuggcuggcuuuaaacaaaacacaaacaaaccugcacagcccuccccagcauucucuccacuccuaguccuaaaccuugcauuuccaagacagcugagcuacaagacucacucaucacuaaacuguuuuguccugaguuaacauaaaaucacagaauacuuccaggggaaaggguacuaaagacaccagaaccuccacccuacgguauaacuuguucuaaaacugagacaaauacuaaaagcaaaccagacauagcugucaucccagcacucaggaauacuucaagucccaagcaagucacggcugaagaguaagaugcugccucaauuacccacaaacaugaaaaaaggggggaggggcgcauuacaacacacuauaacuacuguguaaguaauuauuuguguggauaccccauaacuauagacgaaccacccugaguucucuaccacugugcacugagggacacccccaacacacuauuuaacaccuuagccuggcauucaaggacuuuuccucuacuaccauguuccuuuucuacaaccuuuuuuuguuuguuuguuuuuuguuugaaacaggguuccucuguacagcccuggcuacccuggaacucgcuccauagaccagacuggccucaaacuagggagaucugccugccucuccauccuacccccacccuacccccacccgacccccaguguuggcgugugacacaacauccagcucccaagccuucuccugugcuaaaguguauugccugauacugagaucagaucuaauaacagcuucaggacucuaaaccuuucugaggaugaaguaaaucagagggaguggucuugccuaugaaucucaagcccagguucuaucuucagccaauaaaaaaggggaugacccugcuguaacaguaaacaaagcaguguugugcuguaaguagagaauaaaaacuaaaacuaacugaggaacacaagacacuuccuuuuccuuaucauuagcagacccuacauaugcccuugccaguaaagcaagcaucugugaucuacucaaguagcgugccuguaaucccagcagucaggaggcagaggcagguggagcuauauaaguucaaagccagccugguccacagagagaguuccagaacagcaagggcuacacagagaaaaaucccuguuucaacccccccaaauaaacagaaaacaaacaaacaaacagggucuggacuggcaagauagcuggaugagugaugugcucaccagcaagccugauuagucuguccucugaccuggacauguugugucuacacauguaccuacacauauaaauaaaaauauauauaauaaaaauuauuuuaaaaaaaugaaugggggcuggagagauggcucagugguuaagagcacuaacugcucuuccagagguccugaguucaaaucccacauggugucucacaaccaucuuaaugggaucugaucccuguuacagugcaucugaagauagcuaguguacucacaaacauaaaauaaauaaaaugaaauaggagcugaacagauggaucauuggguaaaguauuggccacgaagccaggaagccuugauccccagcacuaacauaggagcuaaguguaaaggcauguaucuguaaccuagcccggugggaaagcaacccacaugaaccugggacucagugcaggccaaucuagccaagcgcccaacucuaaacucuguaagcaaucuggucucaaaacuuaagcacaaaucuuuaaucccagcacuuuaggaagaggcaagaggaucucuuugugaguuugaggccagccugaucuacagaguuccaggauagccaggcuguuacacagagaaacccucccuugaaaaaacaaaaauaaaaaaaaaaaaaagguagaaaaggucuggcucucgggcaugcacauaccuacaaaugaacacaaacacacacacacagaacaaaacaaauacaccacacaugcauacacacacauaacaaaaaauaacuacuauccuuccuggcaaguucaagaaacauguaaccgaaaaauuagacuugcuuauguuagugcuugcuuauguuuuugaaauaggaaaaaaaaaaaaaaaaaaaaaaaaaaagccaggcgugguggggcaggccuuuaaucccagcacuugggaggcagaggcaaacagauuucugaguucgaggccagccuggucuacagagugaguuccaggacagccaggcuauacagagaaaccuugucucggggaaaaaaaaaaaaaaggaagucagacauggagcucaaauguuuaaucccacuacuggccaaccuuuguggauucaaagccagucugaucuauauugaccuacaugagagacccugucucucaaaaaaaguuaauaaaaaaaauuaauaaaaaaauuaaugauuaucaacucaauucuuagaagagaaagaugguuaaaaccuaaaaggcacaaucagcccucauuuugaaugacaaaucucaagugagcaacugauuucuuaauucccuccacuuucaaccauaacaccauuuuauuucaguaauuuuaauuuucaauuuacaacaucugucaaguguaguucuuccugggaauuuagacauucucacauuguuuccaaauaauaggaucuuaaagauaaaagccaccuaaaggggacagaaaagcuuugcuuuacauuguccuguaaacccaaacaauucuuaaaagcuugucaauggugaaaaauauucuguuagaagauauuccuagaaauaccuugugaacauuaaaacacucuugagauuucuuuagugaauuuacuauauaacaccagaaugguaaauaagucaguggcaauuacaacaaccaaccauucuuuaaaacaaaugacucuuguuuacgacaaacuaaaaaagcaauggcagaguuucaagacagucacugaagcagacagccuaagcagacagugauuacaaagcugaaauagggaacuuuuuuuaccugguguucugcaugaauguuauccccuguaggccaucgauguuugcuaguauuauagccgccuccaccacuuccuccucccccaagcugcucaccaugcugccucugaaagaaguaguccaccauagcgucguccugggaacggccugcaacuccuauggauccugggacagggcuggaguguguuccagcugcaagagccugauuugcagcuggcuguggcugcgcuugcgacccuguuccagaugucaaaacaacaggcauguugggauuagcugguucuugagggugauguuucaggugggggcugaaagaguccugccaaagcacugcuuuucucuucaagacacaugcaacgcucauuccaccaacaccugagaacaaacaguuaacagauguuuaaugcuugcauuuaaaaaaaaaaaaaaaaaacaacuccauauacuccaguacaaaaugcuacacaauucccucucuucugcaagucaauacugucucuaccaagaaguuaagugucuuguaacaauuuccugagcugagccuccucugaagcugcugggccuguguguacagagauaaaggucaacagcggcagguagugcagcaagugcugagacgagggcccacuacuguaagcagagcuuuacuaacaaauagucauagaaagacaauuccauuuuauuuauggaccacauaaauaaagaaguaaacaaacaagcaaaauagcaauauggaaucaaaauuuaaucaacagcuucccuauucuuucuccuuaagucaacuguacuuaaaaauacacagguuuuuuuuuuuuuuuaaccugaggugagauuucauguaacccaggcugacuuugaaauuaaaagguagccaaagcuggccaagaacuacugauccuacucccaccuccugggugcugggauuacagaaauacaucaacaggacugugacaagaaauuuuugaaagcauccuuaaguuuauaggguagagauauauagcucaauggaggacuggccuaccccgaacaggcccuagauucaauccccggacuccacuccagccucagcagacucaaucccacggacccucuccaccaaguucccuaauuagcuuuaaaagaauuuacaacuguaacaaacaugccaauaaccaaacaaaggccuacagcuuagacucuguaacuuaaaagaacccuuuaaaauaucuaacguauuugugggacaauaccaagaucagcuguguuuauauaacaugggaaaaaaaaaaucacaacuuuuaccaauaccuuacaaauacaaugcuaucauuucgaguuauugauuaacuagaaaaaggacaagacaaacccaacucacuucguugguacuaaaccucucuguaaacccaggucugucucaccagucauagggcagcaaaugcauggcagacauuaucucaucacagaaacacugaagcauuacuggccuuguuuugacaaguaaaccauuacagaaguuaggaggagcccauggccauccagcuagcaacagagaucuccagcuauuuugaaaccaauccugguucccucuagaacccuagcaacaauaucacuaucuuuuucacuuguuuuguuuuuggucucaucauguaguccuggcuggucuacaacuugcuauguagagcaggcuggccuugaauucagagaucugcccgucugaaguaugggauuaaagauguaagcuaccaccccugugaguaucuguaguacauuaaacucuggaaauccaacaaagaaaucaaaugcuauuaggaaacauugcuacuuaaguuccauaaaaccaaauaauuauauuuguaugaacaaaguaaacugguuaccaauuaggguagucugugugcaaccaccagagaacuuccaagguuagcaacacuguucaaaacaaaggagaaaccuguucucucauuuuugaaauauuuagucuuauuuuguauguguuuuaccugugugugugugugugugugugugagagagagagagagagagagagagagagagagaaagagagagagagaaagagagagagagagagauguuuaugugucugagaaggucagaggcacaauacucuccucuaaaacuagagucaggaauuacugggaaccauaugagugcugggaaccaaacacauggccuggcaaaagcaccaagucagaagugcgaaagcacugagcaccgcuccagccuccaaccaucuucucucuagguaaguaaccuccuggaaaaguaauccuagggucucaacuaauucagguuaugaagcuaguagacaucgcauggaaucugcaaucuguucaaaaccuaguuugagggguuggagagauggcucagugguuaagagcaccuacugcucuuccgaagguccugaguucaaaucccagcaaccacagaguggcuaacaaccauccguaaugagaucugaugcccucuucuggugugucugaagacagcuacaguguacuuagauauaauaauaaaucuuuaaaaaaaaaaaaaaacuaguuuguaaaccuguuuuaguccugugagacuaaaacaggagagcugauaauauucuaaggucaggggaguuauacugucaguuuaaggcaaacauggagaaccguaaaauucucucaaaaaaaaaaaaaaagacaaaaaaaaaaaucaaaccugcuuuggaaaugccuaauguaaaucacaacuuccaauacccuucuaccuaccuaccuaccuaccuaccuacacacacacacauacacacacacaaaccaauuaaaccuuacacuggaauaguucuagccuucuaggcucucaugaauaaaaugcugucuaggcucaaguacaaacccagaaaaguacagcuguuucauuaucagccucugcaaaguacacagcagccucccuagcccuccucacuugguucuuuaaggaccucaguccauucauauuucauaguacauuugcuucuacaagagaaucuccaucuugcugugcauggugguacaugccuuuaaucccagcacucgggaggcagaggcaggcggauuucugaguuugaggccagccuggucuaccaagugaguuccaggacagccagggcuacaaagagaaacccugucucaaaagagagagagagagagagagagagagagagagagagagagagacugacucuccaucucuuuacuucaggccaacugaugcaacaaaacucuaguuuugccaucaaacuaacaaucucucugucagauucuaaaggaaguuuuucccccaugccuugguuuuugauagcuuuuaaucacuaaguugaaagguauauagaaaguuuuaaauuuucucaaaucacuacgcuuaagguuccacaccagucaaggcaacagagccucaaucaucaagaggauucauaaaauaguaaauguaguauuuucuaacauaaaagaacugcgaaaaguuaccuaugaauuuucaaauuaagaaaaaguuagccgugguggcgcacgccuuuaaucccagcacuugggaggcagaggcaguugaacucauuucugaguuccaggacagccaggacuacacagagaaacccuguguguguguugggggggggggggaguuuagcuggccaguggcugugcagucaggagucugaggcugagccagaugaaccucgaguucgaggucagccuggucuacagagugaguuccaagauagccagagcuacacagagaaacccugucucaaaaacuaauaaauaaauaagcaaaugauaagagauugucccugaaagcaaucucauucuaaaauauaacuggggaagggucacuuacaaaaauauuagaacaaaacaauuggccucuuuaaggcugucuggaagcccugagacuuccugguuuacccaaugaggcaaggcaguuucucaaacacgggagagccuggcaagagggacaacugaaaagugagcaaacaccucagcacuaacaugugucugagagaauucuguaacaucuuggcacugacagaacaaaaacuaauaaucugucaccuaaguaccagaaaacaagaaacugaugguaccuuuuagggucucucaacacucacuaagaaauuaugugcaguauuuaaaauuugauuuuuuuaagcaaaugaccuaucguuuagaaacaaauauuuuaagcaaugcaaugaaguagcaagccuagucuaguacuuccuagcuuucacacugucaagaucacaguggaguuuguuuuuacuuuuucuuuuuaauaucacuaauaguacuuuucuuuaaacaaaacagcaugguuuaaucuaucuccauucacuaagaugcucagggcugauagguguuuauuuuuacuacacugaacaaaccuucuguggacauaaauuuaucuuaaagcaguucacagacucaaacuaaacaaaucccaacuucaaaaagcuguggccuuagacaagaugaacucaagcguggaaagacaaaauacuagaaguucagaauccaguauuuccaaaccuucagauaaagauccgcagccccuaguguuuuacaaaguuacaaugagcaaagggucaaaaugguuuacuaaaaacccugaaggaagcugcuuaucuuaaaaggagagccacauuaguaacuuuuacaccaaagcaaacagcucaagcuacaauccuaccuucagaaguaacuggcuuuaaaaacugaacgcccaaaagcccucauaaaucaucuuaauaaucccaguaauuaauggggugagcaaaaugaucaaguguaacgaagcguuaucguaauuugcacaaugaaaacgaacaauccuucaaaguuaugguggggauaaagccuucucuggucaucuaugugggaguuccucgcgaugugggaggggagcucuugggaagaggggugagcuucacuggagaaaaguuacuggaguguuccucccuuaacgugggagugguacugacgagucaaacaaaugacccauguuuacccaccgcguucgugaggaccgaaacuguagcacuguguagcuaucuacauguuuguccuacuaccugcugaaagccccuuggagagggaagcacaccaacacagggaggaucagagaggaagaacacccccuccucaagggggaggaaaacacacacaagcucucacagaaacaaaaggccacaaggaacccaggcgcuuaaaaagcgauccgaaacuuccugauggucaccucuccauauuucaaggcuugcaagaucgcccacucccccaccaccauggggggcucgcccgaggaccguggcccaccgcccgcuuucuaaagccuuguauuguuccucccucggcgcugccacggaagcuccagccaaguccaaggagcccgcgggaccacagaaucuccacuccgcggccacaagagaggaccuggggcugcucagauccauccaaaaaauaaauaaauaaaugcaggggaggaaggaaaaaaaaaaaaaaagaagccgagccgaacggcaacaccaaccucuagggacucccggcagggccgaacggaggcacggagccgccggcagccgcgggcgagccgggccccggccgcggcccgcuccccacccccuccucgcggauaacaauagggccucgcugccgccucccaaacacguacgagcggagcgagcgcggugccuccgccaggcccggcggcgucucuaagcccuuucucgccccgccaaccgcugccaaacgccaauacgagaggcgcaucggcucgcuggggguucggagcacgguuuggggccaccggggcgcggauacucacgggcggagcgguaggaugaagauggauuccggccccccgaucuucgcucgccggcgcucucgcucccccuuaccuuucacuccgacaacauggcggcccacuggggacugggcugacgcggugcaucaugggagcggcgccggcgccg

SEQ ID NO: 2153 - RNA, 4432 nt, Mus musculus
uaagaaagcaggcugagcaaacuacugggaccaagccaagaagcagcaguccccgugacuucugaaucagccagugccagagcuuccugcccugccugccuuggaugauggaaaaacuguaagaugaaacaaaucccuuccugcucagcugcuuuugguguuguucacaacagcaacagaaacccuaagacauaacuugguaccaggucaguagugcugggagugcuaaggaggauugugguagcaccugaaguuugggcuggaaaagccaccguaugcucagagcuuagugggcuucugugggagcuuuaagauaauguugcuagcaguacagacaaaaaagcacuauuuguuaagcgucugagggaagcaagggcucuacuggggccauuuaagugauauuuguauuaaccgcugaagugaaaccuuugcuuugcugguacaauugauacuggucagcuggggcugugauuaagaaaagaucagcagcggggcggugguggcgcacgccuuuaaucccagcacuugggaggcagaggcagguggaucucugaguucgaggccagccuggucuacagagugaguuccaggacagccagggcuacacagagaaacccugucuugaaaaaccaaaacaaacaaaaaacaaaaaacaaaaaaaaagaagaagagaccggcaucagugaagcaaaucuuccgagagcauuuccucagggucaguacacagacgcuguagcccaggagucaaggggcucgucaugcugcaacaaaccuugguaacguguaagacacucuugccuguuaagaggucauggaacgacucugaaccuuggcacugugagaggauaggaggggccgcugauggggugcagccucaguggguagaaggccuaagaugcaaugaagcaugagagaaguugaagcuugguaauaacauggcagggucagaaucccugaagaauacuccggagagguuacugguaaagguggagaccaauacaguccuuaaugcugcuucaaggauauugaagaauauuuacacuagacuaggaggacaagggaguaggcucagauaagaauauuuacacuggacuagcacaaggcccaagaugaauacaguugaggaauauauuguauuccuuuuaucuuggucauccugauaaaccccuagacacagugacuaugggacuuucuguauugcuuguuuguuccuugacgacuucauccucgaccuagaacugauccuacucuucgcauauaccuagaaugguauaaaugcagacugacaacaaguaaacccgccucagcacuggcuggagucauguuacaauggugucuaagcguccuuucuuucuuuaauucucccucccucccucccucucuccccguugacugcuggcuaagcuggcuuggccccagcuaugcagugcagccagccgaagacuaggagauaacuaagcgggcugugggggacuguggggggcuuguccaagcccucggggggggacccaaaagaccccggugaauccagaacucucacugcugggcuuugguuuugcuuugagucacugugcccuacucugccuucuuggacuaagaaaggauuuaacuuaguuugcucuuacaggagccagcugagagacuuucagaguuuuagggacuauggauauuuuagaggcuugaacuuuuaaagagacuggauauuuuaaagaaacugaacuuuuaaaguauuuguaaagacuacagggcuuuaaacauugaaauguuuuauauuaugagguuaauauuaauaagagaucuuggagaugaacaggguuaaauuaagcugacaaggggcugacugcuggcuaguuuuuaaugucaacaugauacaagcuaguuacuuuagaaggaaccuugguugagaaaaugcccccaccugauuggccugugggcgggacaccccuggcugcuauaaacaaucagauugaacaaggcaagccagcaagcagcacuccuccugccuccagguuccugcuguucaauucccucaacaauggaguaggcuaagugucuguuuuaaagaugagguagccccuuuccuucccaagcugcuuguggucauugugcuugaucacagcaauaaauaaauaaauagaaaaggaaagagacaagugaagagggcagacacugugccaaugcagcucaaggacagagcggaucugacugucugucuuuccaaagacaaacuagggauaaggaagcgcaaaggcaucacaacccagaaacccauucuuccaaccucacgguagucaccacuccccagcccuaacccccaugccuuacuccuccauccgggcauucaugugcacccaggugagagaggaccucacuuggagcgcagagacagcuacagugcugacuuccuucugcucagauauuaaucuuuccacucaggaaacagaagaugggguaagggguguuuuaacuguucccaaccccaaaucauaaaaaucucaaggaguaccaugccaaaggagaggggugaagccuacaaggucagcaguuagucugcucaacugcaagcucagagcaaggaaagggccaaggagcucuagaaauugcuaugaacccacaaagacuacaggcuagaaaauaguacaccucuaucuggguaucuacagggacaguggauggcaacaaauuguucuauguagcaaucuauauaccuucccaaguuuuccuauucaaaggaccugcacccccagguguaguaagaacccaguauucaagaagggcuucucaaagacucaaguguccuuguuugugccaccuccccaccucaaacacccccauaugaguguaaucuagcuuuuacgguucugaaccuucacacagcccuacugcacucccccccccccccacacgaccuaacuguaugcagacagauccuggccucuugauuccagcuucuacugaccacuucucuucagucugaaaaacacuaccagcuauuagcucagcugcuuccauaacuuccccugaagcuacagugguggugcaugagcaagacgauuauuuaaagcacaguccuggguaugaaugauuguuccguggguaaagucacuugccacuaagccugacaaccuccagguuucauucucagagcccacaggguagaagaaaucaaguaugcuguccucuggccuucauaugcacgcugaagcacacauauaacgugucuccucucugguccccaggucuucaucacugugcgccuacuuccagcuccuacauacacuagccucgccucacagcaccuucacacacaagcaaggugugagacucagccucaagugcuccaggcugcaccagccuucaacugccaccaucugcacacuggcugguaguggaauuggucugaaucagagcuggugggauccugucuggcucagaacgaguccauaacaaagauucucauuaucgaacuuuguccucagugagggcaagugggucaucaccgccagacaauagcaaccccuccgcugagaaggcugagggagcucagagcaccaaggugaggaguacuggcuagaggccuuggagcuaccugggacaaauagcuguggugcgugugccuucccuaccuguggaucucuugggugacuccaccaucaacucccacucacugccugggucucugcucccuuucuccugucuaacucuccccagccuugauucugcaguggaggcagugagggccucccgcacggccagcacuguuucccacugcuccugccaccugggccgguggcagggaccaggccuuagccaugugcaugcugcccaccgccuacacacagcgagcaggcuucagcauugugaccagugaacaagaggaagaaugaaggaaggccugggcugaauaacacacagcucagguuugcuggauugucugguaccacuuaugaggaauaagcagauuuaccucccuggaaaggaacagcaggaaaguguaauggaaugaguggaaagaggcaaggagcuccaggaagcaggcugccucuggacugaugagcugaccucagagaccagggagggauuuaccuuacaaacaagugcagcacacgccuacaauuccagcccuuagacagcuaaggcacaaagagccugauuuuaaggccagcaacaaaguaaccccuccaaacacaggcggauguggcuuaguggcagaaugcuagccuagcaugcaccaggcccaccccagaacauuugaacacaggaaauaagcuucuuaaggaccaacaacuucaguggguaaagggcaccugucaucaaaccuaaccaccucagugcgauggagacgugcacccuaacauccacacucaacaaaauguuacaaaacauguagcacauagguaugcuuucagacaaaacacccauacccauaaga

SEQ ID NO: 2154 - RNA, 33787 nt, Mus musculus
gcggcgacgcuuccugcgggcgcggccgcugugggcgcggagccgcgagcgagcgaacgaacgagcgaggcggagccggcggccgaggagccgagcgcaggucccgcgcagcccgcgccgcgaacaaaggccgccaugaagcccgggccgccgcgccgcgggaccgcacaggggcagcgcguggacaccgccacccaugcgcccggggcccgcgggcuguugcugccaccgcugcugcugcugcugcuggccggccgcgccgcgggggugagugaugggccccaagaggguccccagcguguaccccgcgugucuuugcguguccccucgucgcgcgugccgcgcugggugugucccggucucaugggguccccuccccgccgggaagcgugugcguccgguauccgcuggggucgccuucuccccacccccacuccaucccaagcugccugcagggccuugggggcauuggaggaggagggggugggucgaugaaggugacccgcgagggugaaugagggugacccugugugugugugucugcuucuaagaagggugcgugggcaccugugggugugggcacgggagaggcucuguccauauggcuggauggcauccgcaucccgcuccacacuagggugacccauucugcacgcuguguuccaccauggccaaggcugugugacugugggugagggggugugugcuuugacccauggaccugugugaaagcacacguaugugugugcagguguguagcgaugguggaccuggcucagcucccaccccagaagacaugggugugugugccaucagagguggguaccaggugaccccugacugucccuuugagaaaccgaaguagcuaagggauugaacuugguucugguuucacuagcagaacgggaggaagagggucgguccugcagguggaugagccgggucccugcucugaggaacccagcucccaagugaguucugaguugacaggugucuaaaugugggcugagugagcuggggaguucuagguccuacccccauguggcugacuccaggagcaauggcugucccuacccacucagaugaccaccagagcccaggcuggccggcacgccccuucucuccuaagcaagguggccagauuguagggaggcaggcaagacucugagcugcccugacaacuguuagcuuuggggaggggaccccaagauaguaccugguggucgguucaugccuugcccuuuuuuucuuuucuuuucuuuucuuuucuuuucuuuucuuuucuucuucuucucucucucucucuucuucuucuucuucuucuucuucuucuucuucuucuucuucuucuucuucuucuucuucuccuucuucuucuucuucuucuucuucuucuucuucuucuucuucuucuucuucuucuucuucuucuucuucuucuucuucuucuucuucuucuucuuuuuccuuuuuuuccugauggggugaggggagagguuccugagcaaaaggcagcacuacccacacuggcagugggaacugcuuuucagcagcauuauagaaaauuacccuugacaucaaagaucugguuucaaaguccagugaagaccaccacccaaucacagugaggucuugagccagccuggccacuccucugagucccagcuuuccucucugcaaagacggacuaagggugcccuccggggaggcagaguggacacagaggcaccuuugaaggcauuuugguguugaguacaaagggcucaggacaaauggcuucacuggagcuacugucccuaggaaggaauaauacacauucuacccguagugaaaggauucagggagauuuuugaggacucagcacauaguagggcuucaaccagguaggugugagggcaaaguggagcuggcaugauugagacugaugcugaguggcaugcccagauggugaccuggcugagcgaggggagagauugugguagggaugggucucaagagguauucucucugcaagcaugcuguccucccagggaggggcugggacuguagaggaaggacucucugcacuguuaccuggccuggaaagcuaaggguuaaaggaugcuucucagugagggcugaggcuagaucagaagcccagguaguaguuccaggaauggucucuggugacagcaagggacugacagugguuggcucagcaggggaaaaacaggaugacccugggucuucuuguuagucugggagagcacgggaucaggggaagggaacuccagggaggagaaggcugguuugauccaggcuguggcugucaaguuggggguguguucugaccuacagauucgaggcuuugguccugagagacugacugucuagggcucugagguccucagaccaccucagcuuuucugguuaggugacucccagagugacauggaauguggggacacuagaaaguauagccuuuggagaauguccuuuaaagguccagaucugggagugaccauagaugacacucaguauugcugucaggggugguuauucaacugauuuguggcugugugacuuuguggaagugacuuaacugucccaugccguggcuuccucucucucuaagacggagcaaagagugaaaguguagccauagcacuuggugcacguagauuccuuuguggaggaggugggggcagagucucauguagcucaggcuagccacgaacuugcuacauagacaaggaugaacuugaacuccuacccuccuacugcccaagugccaggauuacagacgcgagucacugcguccuguuuuuuuuuuuuuuuuuuuuuuugucagaguuacuguccuguuuugaggugugaaguggcaggugaggcuuauuccuggcauccaggaacccucuccuuuugcccuuccagacuggugaccucacucuagaaaugaaaagcuggggacuguuccaggcagggcaccacaguaagcaauaggauucagaggcuccauagcugcugggcaccaagagcagauauuugcugugggauuugggcaaugcugucaucugucucaagacucucucuaugcauuauacagcgccaggcucagccccucccucccaggagcuggaguaugcugccuuuccuuggugauagcccuucuuggaggaagccaauggaggcuuccuggaagaagaggccuucugagcuaaacugacaggguucacaacagcagccagucuaaccguccacacucucucuccgucaacacaggguugaauuuucagggcuguuagguuggaccugaagccuccugcuuucuggaagcagaauuggccucuaaaagccggccagcuguggaugggcucacgggagggacuaccugcuucuuuggggagaaggaaggcuccuggaaacugcccccaccccaccuuuccaagcugugcagggagagggcugcuacuuagacccucgggccagcugcagacuggugccacaguuccaggcugagcacugggcaguucugacacccuguccccagcauucuguguggcugacuguaggaugugugcaggguagucuuagaaagaaccagaauccuuguuucacagaugaggaaaugagccacagagacacucggugacucgcucagcgucacguagcccgaaguuagcuguuuugaguuggggccaggcuggcugcaggccugggcuucaguucuagucucuguccucauauuccaugagcuuacauacuucacuucuccucucuggggucuccuuaucccccaaguuauguauucauuaauuaggguuuucccuccccccaaaaaacagggcuucucuguguagcguugacugucccagaacuuacucuuaaucucuuagucucaaacucagaaauuugccugccucugccucccaauugcugggauuaaaggcauguuccaccaccaccccacuuauuaaaauaauuuucgagacuaagucucacuguauagcccaggcuagcccuugaacuuguguuguuuuuuuuuuuuuucccugccucgaccuccugauuguugggaugauaggcaagugccacacugcuccucuuggcuaccacuuaguagcugcacagucuuaccguggaugcugucccuguucucauuucauucugcugugcgcuugggggacauaacaagcagcuaacaggagaaaagcuuuccuagggugccuccucugccaauucucaggucccugucaccugcaaaggagugacucuaagguucucagggacaggcuggaggaguuuuauaagggagguauacaaagccaaggcacugagugguggcccacgcuuuucaucccagcacucaggaggcaaagguagguggagcucugaguucgaggccagccuggucuccaaaggacagccagagcgucacagagagcccuccuuccccccaaaaagaaagaugugcagaguuugaggaccuuguguuaggucacaugagcacaggacaggaaguauuuagaaucucaggaugaugcugaggauccauagcccuuggguaugagccacgagccaugccuccucugcacaggugaccagaccugccuuugcaccccuccuccaccaucuaucccuagaaaaccaucaggagcccagauccuugccucaaccuucccuucugagcaccagcucucugauccucacuuucucucuguccuggcagcagagagggagugacucacaagguccaagacaggaugaggggagggagucacaggacuuucuugacagaccuugagcuucuggggcacccgaggccacucugggcauuggggacugagcauagaaauacagaaaaugcagcugggcuagguagggacucugcuccugcgugcagggaucaguuggugagguggguggggaccuucccuauucaggguauuggccguggacugggaggcgccagggggcugcuuagggcuggccuguggugacacugucaccaccaagucuggccaugaccaugagguuguggcucugggcuucagcccagcuuugugcagcccuguaauuuugugucugggggcaggaugaccaagcgggacacugccugggggcagaccccugauuuccaccaccccuccuggcucccacacuaaccagagcaagcgcugggcuggugaucaccuggaccggucagaucccugucccacaaaauguccugggaacauuagccuuauugacggccccccuccuucccgucacccucccguuugccuuggcuccuagccuuccaagauuccgggaggccgggcagccuucacuuccggccccucacuccagagcaggccccuagccagagggguggccguuccccucccccauucccacagaccaggucuggucugaguaucaaacaggaagagggugauuacagaggggagucugagcagccguggcuuggggggggugggcuagcugugggagaguggggacccucacaaaugaucuagcaccuuucccaccugguggcugaggguggcaggcuggggacaucuugcuggccuuacauaccaggcagaaaaaaucucuuaauccccacugcugagcagucagagcuugucuucccacccagaccuuggugcuaugucuuuuuuuuggggggggggggaguggggggaacugaaucugaaggugacuccgaaacagaagaucagaaacgucugugccaaauggugaggguugacauccuccuguuucuaguuucuugcugugugaucugggcacauuagcccaaccucucugagucuguuuauugcagggagugggguggguguggggggagacuuagcggaguuaggauauggagugaacagagaguggcugccccuguaaauguuagacuagcuucuugcuauuaacugcccaggcuuuugauuuuuuuuuuuuucucucuugcccucuuggucuuauuaugagagcugcugucuggaaacagggccagaauuucccuccacagugugggagccaggucugaauggccugaagcagagcccugggcucugaguaggagaacuuggguugggacucccaguugcagcuggcuggauuuaggccagauuaggcaaaguauuuucuaggcuccauggugcugaguuucugggaauucuguucccagcagugcaggcuggaggcagguagaccuaucuacugcucagaccccaugguccugggacucccagaagaucagauucccugugugcaaaucccugggcagggugacguuuguggaagcugagcagccacggcccacauacccacgauccucuaacccagagcacuugguuguguucuguuaguucccuaggccuggcuaauguuuaggaaccugggagugggaggguccuguagagauggucacccucagccagccccucucaguggaugaccugggccuugcccaaacauggugauacauucugcacuuauagguggcuggcucacugaaccuucagccucucuaggagacuggcaucauugucuuauuuacaaggcucugggauggacagauacccaccagugcccacacaugccaagaggacauagagucugugcccagcugcccccguccuacucuggagcucugccccgaguggcugauguugugucacaccuucaagggugaguggacugugccugagcagcuagagcauccugcacccucuccuugccugguggauccccuacccccaccauccccaccuuagcuccuagccaggcuggaagagucauauagaagcaggaccagugacaucugggagucuaauugcagcuggcugauugccaguuccauccccguggccagcaccagaaugggcggagggaggaggaggagccugugaugguuuuuuggugucucccuccuuccagcuucaggccugggggacagcugaggaauccuggggaguaggaagagcugcuggccucugcucuggguaccuggugguacccaugacaggcacacuucuccaggguguggcagguguggguguccaucugcccuuuucuccugaaugcugucauuugucuuaccuggggugcagagcuugcaucugaaccccacccacauccugccuucgagggguggaggcagaaggcagggaugacaguugcagggacaguggucacuagguaccucuggguccucagcacagccugugggaugucacgucacccuaucuuacccuaucugggcagcaagaggucugccaagguaaacauagugcucugcauucuucugggugcuugcccgaggcacugggccaccaaguagagcacacaguggugagggcuuggguacagcuccuggauucuggugauggacugcucagcuggugcagcagucuuuauugggcgccuacuguaugcaugaccuauaccgggggcuuauaguauuagucuaaacagccuaucuuccauggcugugaauggcuacaagaggaugugaaauuuguggagaaggggcuggaucccacuuccguccacucagggcgaguccaacgcauccacagaaagggucuccucuucuguggagaagggacugguagcuccugguucauuaggcuuugggaggcaaagcuggcucagcagucacuaguuacaaggguggcagguuuuauuuuuaguaucaaguuccucuaagauugccugggcuccgaggugauuccuccagcaacucauccagagaaagagaaccggaacugccugugaaauggagccauuggaugagggugaccugggccggccaguccucacagccgaugauggucugaccucaagugucccacacccuucacguguccuguucaugguuccucuugggccugggugggagucccuuugcuuucuggucauucugagugccauuucucuccagaccuuggggacauggucacucacauccaggccacccagggucaugaaggacacuggguguggagucauaucacuggguccucgucuucagcugccugcugaaacccaccagacccacagccccugugugaggugcauaugucucccccacaccccacuucauguuugccucuagaccuuaugaagcuccaguaauggagaaggaaggagucaaggaggugaaggguugguuugacccuggaggcugaggagaggccucgaaaaggaagucuucuugauuccagcccucggagggugacuaagggucagcauggucaaaggcuuagaagcaggaagggucauggucuauuggaagaacaagcuguggagaggaacaguaggcuugccagccagaggagaaagcaccuuguauggaaggcagucaagccucucuuugggauggaggcuuuuucucugucccuguccuguugcuaaaguguguggccacuuccagguuucugacuuugugcuucagcacauucugggguuaaacagugggccccacccaacuuauccccaacccuaaugcagaagacgccacacuccacacagcucucauugcgaagugagaccucuguuuugcccugcagcggagaguguggccuguaagggguugggggugugugugaguggguggguagguggauaccaaaccugguguaucaaaaccacaugcagcccugugagaaagacacagguauuaucuucauuucugaaauaggauagcaacacagagagauuaaauacuuugcgcaaagucacagagcuaguuagagcugagcugggauucgaacccaugcagugugcugcuaggguucuaucgauuacacaaacugccagcagcagagaaguugugggauccgguguugcaucaagacugaaguaaaggccaaggucuugccaggucccugaacuuguaugacugcugggugcugacucagaccaggggcuucuugacuucaacgaggacagagcuuugucauuguugucccugaugaagcuaacccaggcuuguggggaggaaacugguggagccagaguaacagcaaguugauuacuaaacugagauuaagaaccuucuagagucccagggugcaugcauccacccgccccccccccccaccaccagguucugccuuuuaccggucuccauuuuuguccugagugcaggcgugguucuacuguuugucuccagaagccucccccuggcugccccucagaugcucucagaagccuucccuuggcugcccccaaaugcucucgugucccucgguaucuaugccacauccacucucauugcucuccagugcauggcuucagaccgguuccucugccccacgcauccugcacacuaccccaaccaagaccccuugagcagcccauugacugaccuuuuucacaccuauguagaauccuccagugaacuucuacucaugcuccaaagcccagcucagauggcccuucucccuagcugcuaaacacagagggagcucuccuuccgugcuaucucuccuagcuucccaggcccugcucuuuucccaacauuaagauucuuugccaagaagguccugcuucauugcaucuucuugucuggcuccccacaggguuacauuguuaccuccccucuagggagcccugucuuggauacaauguugcagcugcuaccucccucccccaccccccuuaccuaugacaucaucucccggcccaacucacacaucucuuucguuuuccccggucugacuuugcuguaugguuucuuuuccccauuuucacacauccucauuuugauuuauuucugguucuucucacucuaacaccuugucuuuucuccuuggcccuccccuguaugacgaccccccccccuccaagcugggaagaagaggaaagcaagcgcagcuggggagauguagccauggagggauguguguguguguguguguguguguguguguguggugauguagcggugcuuugacuccuugaaaguggacccuggagguuggguuaccuggagguguccccuucagccacccuuaaccccuccuccaccuugcuccuccucccucuuccuuccuaguguuuuguuauuguuguuuuguuuuauuuugguuuuguuuuguuuuucuccuacuccaauuccccgaggcugucucuuccucccucacuggcugauggggaccucucccaucccugacuguuauucuguggggacuugaagacuuguuccuuggagggacagcguuugguuagaacugggcuagacaccccuuugcgaguccucaccuccuggccaagagcucaucucucccuuuaacaagccccaaggaaucugaggccaaagcugcuucgaggacaguagacacuggucgugcuggucaggguccugugccugauggcccugggaagcuugcuuuaucuugcugucacaugaaguaggggaauaaucuuagaccuggccgggagguuacggccccugggugacccuuuaccauguaugguuacuaacgucauguuucuguccgagcuauaagcuauggugagugacuaggucaucugcaggcagguguacauggauguugccaggcaucuaagcugaugauugggagccuggaggugcagagacugccccagcugcuaaggcucacccccaagccgguggcugcacauagauuuuggugaaggaagcugggagaugcuguggcaaucuugugagggucagaugugcacacagaggcugggcacucgauaauugaaguucuagcugugcaaacgugaagaccuagaguccaaggaaaagcuggguaagcauggcggccccuguaucauccaucccagcacucaugaggccgacccgaggggucccugggacaagccaucuaaccaugcucccggaaacugagaucuggguucgguaagacucugcuucaaccaugaaagcaggaagacauccggcaugaacuuuaggcucccacaugcacucauacucacgcaugcacucaaacucacgcaugcacacacgugaagacacagauggauggacaugaacuccuagacaaguggcagggacccucuucccaugguacuaagaccccuugugcccauaggagcagauucagacucauagcauccacacccacaguugauccccucccaugcacaccacagugccccuaggagcuuccaggagcccucuggccacauguguaugugcugugcaggcacaaggcuggagcugugcucacgggaacaggccugucccuaauccaggucuuaaucccaggguccagagcucuggcugggggcagcuggucaucuggccuccuuagggagauuaaggcaagggcauaggagacacugggagcucugucucccgcccaacccccagaggcacuucauucucaucugccaaaaagcuacucuugggccccucagagaacugguucuauaugccacucaucaauucugggugcugacagggugagagugaaaacaagagcugugaguuccccaagaaagggacaacuacuagugagagaccgggaggugacuaaggacauuguggguuacuagcagaauggugcaggagguggcacugagcaggccacgucauggugcgcggcugcuggcugagcaugguccccuggugggccacugggcuaugguccccacacaacccaagaccuaagaccgugcaggcugagccuugccuguuucuucccagcucagcucuguccagguuuggacggguagcaguguguguugaggaugauggaaggagguggcuuaggugacaaggcugugacuugggccuuugcuaaguuggcaggucaucuuguaccugugccucuaaauccccucuguaaacaggacagucccaguuccacugaggaaaacauuaggguucaugcggccagcuuacagugauggccucaagcuguggcuagcaugaugguagugggaggagucucagccaccacggaggugacaucccauccccaucccaggcucagugaggaagacugcccuagcaacaacccacuggcugacauccagguugguggccaucauuucagcucagguccucugucacuaacacugucuucuuccaagcuggauccugggcaagaccaucugguacucauucauuuguaaccucauucauucauucauucauucauucccucucuuauucauucauuccccccauucauuccaacucucacucaucuccuuccucaucaguucccucccucauuuaauuauucucuuauuuauucauuccuucugcacucuuagucccgccccccauucauucuuuccugaggcugggcuggagacagccacugcucuguguuggccuugccccaugcagcucccuguagggaagagggccaggcugguguuaugggaguucuuccagccuugccuggaaagggucugggagcagucuuaguagaagggaugugguaguuuugucuuugggcugcagaguagguggaggccagagcacucaagguccuugaaggcaggguaagacucugagcccagugcgggagccugugcugaaggcuaaggggagggcagggcauauaugcccaagcaucuugggaugcugaugagggcagagauagcauaugggccuuuucaugcuccccccacccagucacuaaggggacacugagaaccugccagacaaaggcgggcagcuggggccugggccaggccucaggacagauggggccuccgucugggagcagagagcggaaacugcccggggcuuggcagcugcugcuggcuugguagagguucggcuugggagccaaauggagguggguagggcugagggacagauccuggagcccacagggcugucuguccuugaggcuacacuggacagccacaagguaggggacagauggacuuguguccagccucugggacccccucugggccuguaucuucuuguuagggcagcuagcagggccggggggggggcaucuggaugugagcugcaccugcgcccuucaguagcccuuugagaguugguggccuacagacacagggaggcuuggcuggguccugcuuaccugagggcuccacaacagggguuuguccuucugccaccauguggcuucuccuggaugcugggugcccaaaaugggagcacugggauguggcaagggagcaugauaaauucucuggggauucugaauuugaguccggccucugcugugugaccaacauuccucucuaccucugagccucaauuguacgcuucugccuuucucauacaauuguacugagaggagacucaugugcccuaaagugcagaugucucccuuaccguuggcuuuacucccaacagcucaaccaaccacagcgugacaauacuaaguggaaaauuccagaaucaaaacaguucaucaaguucaaauugugcgucuuucugaauccugagcugucacgcugaguucuuccuggaagcacggggcucaugcugugugugcaugcaaggcacucaggaacaucucuguuaccagaugggcugucacugugucacugugcccagucuucaggugaccuuugcuaugcuugcuagaggucccagcaucaggaguggagacgcacacaaggugccagguguaagacauggaaggacaggacugcugggccccauguggcugcaaggcauugugggaaucucacaguagcucugggugagucugccugagguucuguaugcucuccaguggucacaggagaaggguggaggcuggcguaaugcagagcugcagccaucaccuaguuuaggacuucaaacaaacaaacgaacgaacaaacaaaaaacaaacaagguuucugguaguccaggcuggccucaagcuugcuugcucugagccaaagaugaccuugaauuucugagccaccugcuuccaccuccaaagugugauguugcggggugagaaguggggguaggguugggggggccuacagaugugaaccaucaugcuggguuauuucagaauuuuuuaaaaaaagauuuauuuauuuauuauauauaaauacacuguagcugucuaaagacacaccaggagagggcaucagaucucauuacagaugguugugagccaccaugugguuacugggauuugaacucaggaccucuggaagagcagucagugcuccagaauauuuuguuuguuuguuuuguuuuguuuuucgagacaggguuucucuguguagcccuggcuguccuggaacucacucuguagaccaggcuggccucaaacucagaaauccgccugccucugccucccaaaugcuaggauuagaggcgugugccaccacauccaccgccuuuggaacuuuuuuuuuuaaucauucugaaaggagagccugugccaaugucauuguucccugugugcccagugagccagggcuagcagucagcaggcuggacacuucccuccagggggccgcacagugugagguuugcaggacagauuuugucccuuagcacaaggcuuggcaagagguuuacucacggggcagugucugccaucguugcagcuuucuccgaugaguaauauuccucuauguggauggauccugcuuuauguauccucgcagcgggugauacauucuaagaacaaggaucacaugaaccucggcacagugacacagugacuguucaucugguaauagagaugcucuccuagugacuuguaugcacaccgagcagggacccugugcauccagucaggguggauucgcuuuugccucuucuggacagucucgcuuuucuguucuuuauugcauuuucuuucuuuauuuuuguuuauguugggcacgguggaggaggucagagggcaaacuggugggaaucuguucuugacuuccaccaugugaccucugggaauugaacucaggucuucagccuuggcagcaagugccuuuaugagcugagcccucuugccugcccugcuuuuguguuucaaaaaaugaaagacaauagaguuacugggucauauagauauucuguuucaaaaaggcugcuuuuugaaaguggccuugcuguuuugcuguaccucuggagggggucugaggucgcuucuccuagcaucuuccuaagugggcuguucucuggcuucugagcacuguggucccugcaccucuuaggugucgcgcccgcucucgaccagcaagaacgacgcgaccaccaguccuucuaacagcaguccugauucuucuuguuuauaucucccccgaacccugggccucucacuccuuuuauacucucucucauccacgcaccgcaggccacgcccccucgccagucacgaggcuucagcuaaucagggcagcaggggcaaaucuccaccaaauuggauucaccuguauccugguacaccugcacagcacucaagauguuugugucuuauaugaggaagucaggugcaagucauaugacuuagcugcagucccuggcgccuuugggacugccgccacacccgcuccccacacuuaggugucuaugggguggcacaguggacaagauacaaagcuuggugacgauggacaagaacuugucccuugaggggcugcuucaaaagccuagcacauguaggugcucaguugaaggagccaggccgucuggggagcugggacugcagagccauaucuugagagcaagaggggagagugggggguggggggagaucuggccaugggccaccugcggugaccaggacccugugcuuccauucucaaggcccccugcccugugucagggucugcagaugggaagcugaggcucagguggacagcucacugagaagggaggcucuuacuguacccuccgggucaggucuccugacccuuugaggucaauguuauuaagcauacauaagcaaaccaaaggaaacuguggcucagagaggucggcuuucuaccuaggucuguccagcugcagaaagccagugcugggguuuggccccugcuuggucuagcuugggucccugauccuuuuggaugaucuagguggcuuccaggaaucaggauggagguggcuggggacaaguauguugcuuccuaggcaggcacugagcgcucugccuugucagaccucccuuggugucuucugugaauccuucuggaugugucauguucuaccuggacauggggaugguggcuccugaggccucugcugcucagagcauccagaguccccugaaauaaagcagcucuccugugggaagacagacuggggaaggaugggaccugaggcccuagcaugugaacgcacauuagguaaauaaccuagcaggccaauguacaguagggagcucgugggguuccgcugauguugguuuuguaucuuaguccuauugcugggagacccaaggccaguugcuuuaccucucugagcucugguucccgugaguagaauuagccccugccagcgagguuugugaagagaauccagacugugugcauccaaagauccaggcccauggugagugcucccuguugggagcacuaacuguucuucacagugagggauggaaugucucagauagccuucugaaaaaugcccaggggauacaccauaauacagcuuggggccugugugcacucuuggaggcucagggauucagucagggguucaaguccuacugggacacacugguggucagaagucuuagcgucuguauccguaagugagaagagccuggaacccaacauggucaaggaaaccuagcagagcucacugaggcccgaggccaggagcuggggugucacgugggaggaggacucugcagaggcuggaggacccaggccuccaugggugcuccuccauugcacaacucauggcugggcaucaaggagcagugugucaggguggucccaaaggugacccagaugagagcagguggcuggcacagugggaguugucucagccugggcugaggagugcccuagcuuaccagggcuggucauugucuuucaucuaaacacaggagacauaaugugugcuguggagccgcugccuguaucucauaccuggauggguggcacacagucuggauucucuucacaaaucucgauggcaggggcuaauuccacucacaggaaccagcgcucagagggugccuguuugcaggaccaucaugaugagggugauggccagggugggagagguggcagccagguuggccagcagguggggggagguccuuaggaagcacgcacagggucaaaaacggagagccagugcuuaaagcccuugccaagugcuaguaaccagagaccagcucagagagccagccugccucuucggcucucugaaaugugacuugaggaugucacuuuuguagugggcucugcugggcuggcuccacgccauguauguuuaauagugucccuuuggaacuugauggugaggguauuaacugccgacaguccuaggcccagccuccauuaugaugccccagagaggucauacugcuuuuguuuugucuggaagggcagacugacagaguugguguccagccagggccauucaggcauugagggacagaaguacccggcagucacuuuagcgacccagcugucccucucuggcagucaaugggcaacuuuucccuuauucuggaauauucuuucaaaacaacuuuuuuuuuuuuuaaaaaaaaaucuucugagauacauucaggccuuuuagggaccaaauuaggcagcaugggugugugagaauacauuauugacagcuauauacuaguccauguacaguaacuuauuuaguaguuccuuauuguugggaagaacauuguuuccaguuccccuucuuauucagagcacugcccuggggcucuguucuugaggccccacugauguuucuuuugcacuuggaggaggaggaggaggaggaggaggaagaugaggaggaggaggaagaggaggaggaagaugaggaggaggaggaggaggaggaagaggaggaggaagaugaggaggagucuuguuuggaaguggggaggagcucacaugaccugugcacuguuggccugggguaggcauuaguaccacuguacagauagagauuugggggucagcagcaagcuggggaaggugauaaagggagguuuugcugacacccccaccccacccccauccuccggcacacagcuggggaggggugcagccgcucucuugauuuccuuugcagagaaguugggcuggcugggaugugcuaggugggggugaaggguggggagugggguuuguggggguuagguggguuuuggggguaggguagggguggggaauggggguggggaugaggguuggggagggguagguggggguacauuuucugaacucagcgcugcucuguggggggugggguggggugggauagagggggagcuggggaggaggacuggggagggguaggacugagguuauccaugcugucauugucacccuggccauccuucugcccagagccuggccacagcccacauuccugcagagaggcucugggucucccugguggagcuggugacacguguucucacagggcugagagccuuuggggauggagcccacagggacccuggggcuaaucuggacugcucuccuccuuuccugcccaucucugcaucuguugggacagggacuugaacaccgugcucucucaggccuaguuuagacuugaaauugagaucuggugugggacugcaugcugugggggcaucagccagagacgagccaggagccaccauccgccugguggcucacacuccuuacacugccuuacuggauucccacaacagcucugcgaagcagacguuauuauugccacuauuuagccaaauauaggcucagagagguuauauagcuugcccagagauacccagcaaauagauagagcuugacuugaacucaccgagacuuuccgagccuaauggugggcucucagcccaggucacauugucucuggucaccaggacaguggagcccuaaucuggcgacuugggggaaggaagcuggggcagaauuaauuacacuugauuuuguucuagccuuugcagcaugauuagcagggcucugggcuccucgcccccggcggcugaccuaauuuauguguccgaaugcuucugcacccagucuuccugcuccagccucucucuucaguccucuguguggcuuaggcaauguuauccaaccucucugggcaucagcaggcauuuccucugcaucugucuccuccaggagaaggcuguggcuucucuucuauaauuguggagagauuaacguuaacugguaaucaaucgcuacucgccgcucccacccccaccccucccguuccugcuuugcacagcguggcuacuccucccagugccgcaagaucccugcucuuaccaucucauuucacggaugaggaagugagggaccggacugcacugcccugucucucuacaagguguggaaggagguggcgagcuucucuugggacuuggucgguggcuuagaaaggacucugaguaaggaaugugucuaaaagauagcugucaguggcugcucuggaccguggggacaugucuaacuugaggccucaucuagcuugguccugggcagggaaucuggggagaugggguagccggcaggaggaagccuucugcccagguacugggaagcccagugacacccacagcuccaugacacuggggagagaggucuguggaugggugggugggugggugguuaggggagcuugcuuaccauagggcccacaucccuggacaggaaucugggugucauugagggcugaggcugugggucaguuccacaugaaugugauaaggagagguggaacauuguagcugaucaugggcaugugagauugugcugucccgggggggggggggggcgguggugugcaucucugugagucuggagguaccugcuccaggaaugaggggccugugucaauggggggcggggcagggugugcugugaagcagauucagucaaugaggucaagcuuggugaguagguaggugcugaaugcugaggugggugucaggcaggccacauauguaggaacccuggauccugacugaacaugggguuggguggccuggagcacucagagagacggacucuggaugaggguggugcucacaccuugguguuggccagccuugcugucuggcucuguagacugaagauaaugacccucccucccaggggauaaugaugagggugguggugauggugguggugguggcgguggugaccugauacccagguccccaauggcaggaaggaggacauucugcucgauggauguuugccuugaguuggccauggcagaaaacacgucacggauacuucuuucccucguggugagugcuggaccaggggugcugcccugaugugcgagugugaagggaucaacuucgaguugugauguaugaguggagcaggcaauggaacaagagugccacguggccuaggggauguguaggugcacacggcagauccaucuguccauggaggugagccuuggcacauguggccccgaguccgcugagguuuguguggagcaguucaugaguuuccuaagguaugugcacagcugggacaagacugggcuggcacacaccaugguaagcuguacugggcaugugcaucagggucugucaaugccgcuuuuaacugcguccauuggguugugugucugcuaagguguuagugugaaggagcaugugugugugugugugugugugugugugugugugugugugcacagguguauauauggguauauuuguguauauguguguguauguguguguaugugugcugggauguguauacauguauguuuauguauguguauacuuggguguguguucaaaggacuguguauuugugucuugggggguggguaugugugugucaugggggugugcugagauaguuuguguaggugcacauuaggcuguaucuccucucagucccuugcuggggcaugggugucugcagguugcucagucacaggagguuguagaccacuucaguggagagccacagagagggucagacaaagaggccaacggggcacuaggacucuauucuuuaagggggugacaaagacagcugugcucaucaagugugaagucaggcaaaugcagaugccauucaggggugagguacugucuccccccaccauuugugacauuuaaggcuuucuucacugccgccuugaaggcuguccccugggagccgagcuaccagcaucccuaguguucugcaagccuccuccucagacccacagggugaccucagggugacugggcuaugggcuacccuucugcucuguccaggcaucucuggaggaaggaugugugguggaggcaugguggggaaauugcuaagguugccucuccccagcagccucugaugagugagacuaaauugggauguaagccccaucucaaauguucucaccuccccuucuccccagcccugccugcucuggcuuuaccccucuccaucccuccuguccucugauccuuccccaucucccucucucacacacucuccagcucuguggggaacugcagcuccugguccuuagcauggagaauaugguugccaugacaaccguugucaugucaauggcuacugagccaggaugaauaguaucuaggugagugcuaccugaguggaggcugauggguucaugagaggcuauaugcuccuuucugagcucagagcugcauggaacuccccccacccuucucucacacgcccccaaaagcaugccagucugcugccuucaauggcugccucuaggugagcguguguuggugcaugccugugucucuagcugugucaauugcagggucuuuguagcuuuggagcuguuucuggguuuauacaagcccuuuuugggccacugaggagucuugaguucccauuuugguuccuguguucacucuuuuuuuucccccaaaacagaguuucucucuguaucccuggcuguccuggaacucacucuguagaccuggcuggccucgaacucagaaauccaccugccccuguuucccaaaugcugggauuaaaggcgugcgccaccacuguccagcuccuguguucacucuucuuuugguucccuggaaugacagaucucuuagaauguuccuuugaagcagaagaggaagauagaggucccugcuuaguccccauccugcugugugacaucgggcuacuggcuggacaacaagagggacagaugcccaaaguccccacaggauucuagcuuauagaagaugugacucuugcagcccaggaccugggaagugugggcugggcagagaugggaguuggugggggaugucuacaaagggggaagacccagugauuagucaugggggcaauuacacuaauuguuccaccccgugacucacugguauaaaguaaauacugauuaauucauuacuuccagacgugcgugcguguguguguguguguguguguguguguguuguaugagggguaucucuuggcucccugcccuggcuggcuuggcuggggcucuggagcaggugcugggggcuaggggcaggaagccaggacuaagagccucucuuuggcucugcaugaauucuagaagggucugugaauggcaggggugugagaugcugaauguaaaucuagugcugcaccagucuaguuucuccucuguucguacgccuuccaagguuccccacugccagcuggggcagaugcccaagacacccacccacuggcgaggcacugggcccucugugagcagccuggugacuuuguagccacaccucuggccauuccagauccuaauuccaaaucguucauccuaagccuccucggugcaaggaaccuugcuagacagggagggcagccgccaccguagaacaucuuaguggaugguggaugggagcagccccuaaacauuggcacuucaaagcaaacugcucacgagcuucaggcaucaugacuugggagcauaggaugcuuuuuuaaaaaaaaaguaacacuggagguggcuugggaagaaagugguaggcagagcgaccaggggucguggagggugcugggugaaccugcaggguaggcaaggccagcccaagagaggcagcugcauugaccaaccccaggguguaucggguuucccuugucuagggugccuuucucuuuggauuuugguuguaagacacaaaugcccuaggcuucaaauccuaauaccaggagcuuccccucaaagccugaggguggggaccacagccaggguaagucagguggcuagucaaggcuacucggcagucuuugggagucuacaucccagccuuuaagggucguagggcuggcuccaaguguggacuuuccaggggggcugcacaguuagagcugagaacaccagcuccaggcuucccggguucugacggagaaggguucuuaggcccggggagcuagaugcuuggagaagccagcuggaagcagaaguacuauggggcuugugccaaugcugggugugcauauacugugggguaggccaggcgggagcuaacuuucuguuaugggaagagcucgggcuggcucagcaaggacaguccccuucgccuuucccuucccuuccuuauucugcuauuucucuccuggguucucagccucccuaguacccaugucugucuucuagaauuaucucucugccuuugccaauuuuuggugucauuuggauuucaaaucucauuucacuccuagcccucugggcacuggagccucaguuuucucaucugugaguugggcuggugacugccgccuaaagucauuuaccuugagaccccagugggauccugucugugaguacugaucacacggaggugaugguggaccuguguugaaucugcagugcaccagggcaaucucaggauagugagggagccauuuuuauuuguuuaccaagugcacaaauguucaaacucauccagggugcaaauaaccuuucuugguuucaaacucagcacugcaugcucugagccuauucuccuguguggggguucucauggcuggggcuggggggucggcagcugguggucucuaguggcagcuugcagguaagggagagcuuuucuaccauggccuuggguaggugggaaguggccauccaccaacacccagcucucuuguagcacauauuggccacucugcccacgagugcgccuguugucucuugggccuguaugggccaauaccuuggguaccuagcccugugugugucugcaccccucccaggcucaacgcuggcgcaaugagaacuucgagaggccgguggaucuugagggcucaggggaugacgacucguuuccugaugaugaacuagacgaccucuacucggggucaggcucuggcuguaaguaguccccaggucucccugcccaucucugauaucuagcaccaacccaggagccuuuaaggucacuugaaugagucuugccacuguauggagaucaagaccucaaggaggaggggggcagagcagcuuucugauagggagaagacuagggaagccuucagagcccaggacucuugucccugugucugcaugugcaguauggaccuguguccagccccguggcuccugccucgugguuucugccccguggcuccugccccgaggcuccugcuccauggcuccugccccguggcuccuucccuguggcuccugccccguggcuccugccccguggcuuguugaauaaacauaagccacucaguguucccagcucggcacccauuacguuugaaaggccgugggauguccucaucagggaugcccuuuuuggucccaucuggagcaggugacccuuuggguccaucaauaguggggaagcugagguugagguagggcuacaaugggcuucaggggccugggauuggguugcuggcucugucuuuagucgacugugggccaggcagggugacaguagauguagcaacuccagcagggccuugugaccaggcagcugaaugacuucugacccccuugccacucccauauuccuaucuacugaggaguuaaccuuccucccaaaggcucugggaggugggcacaggcagucaguguggucaugaagcugcuaacugagggagcgcgcugagauggacccagccuggggauggaugugugaccacuguuccaggcuccugcuccuuccugagccgccugacuuagcucugccgcuagucucccuccaacucugcuuuaagccucucccucaggaaacuggugcccuccucuaaaaugucacuguucucaggaggcagaggcagaggcaggcggauuucugaguucaaggccagccuggucgacaaagugaguuccaggacagccagggcuacacagagaaaccuugucuugaaaaaacaaacaaacaaaaacccccaaaacaaacaaaaaccaaccaaccaaacaaaaaugucacuguuuccuucucucgacccucccuggccauggccucuccucacaucuccuaacucccucaucucguccccuccaagccccucaucuuaccccuucuugaguugugcccguggccugggaagggcucugcaagaaggccucauccccucuggugaucugcucacguguggaagguggaguggcucagggucucugcugccaugacuuugugugaggcauguccuugggucuggcccuucucacggggccaggccucguuccccuguaacccugaauggauggauuccagacagaggcuucggucagcaguugcuaggccucagguuggcagagucaggacaggcugccuggaaauuguggcccccucgaggauuuuggcuaggcacgggcuagcaucugcucaaaccucuuccuuucugucuuguuuuccuggggaaauugcuuguguguguggggggggguguccugcugggaaggcaaugccugccuggggaccugggggugaggaacacccacuccccagagcuuuccuuuccccaccuccccagacuucgagcaggaguccggccuugagacggccaugcgguucaucccugauauggcccuggcugcgcccacugcaccugccaugcuacccacaaccguuauccagcccguggacaccccauuugaggaacuccuuucugagcaccccagcccugaaccagucaccagucccccgcuggugacagaggugacagaggucguagaagaguccagccagaaagcuaccaccaucucuaccaccacaucuaccaccgcggccaccaccacaggggccccaacuauggccacagcaccugccacagcagccaccacugccccuagcacucccgaggcgcccccugccacggcuaccguggcugacguaaggaccaccggcauacaggggaugcugccucuuccccugaccacagcugccacagccaagaucacuaccccagcagcacccucaccacccacuacuguggcuaccuuggacacagaggccccgacaccuaggcuggucaacacagcuaccucgaggccacgagcccuuccucggccagucaccacccaggagccugauguugcugagaggaguacccugccguuggggaccacggcuccuggacccacggagauggcucaggugaggacagugggugagggguuagcgugggcagagauggguugggcagggaccaggagguaccaggggugaaguaggcaaggugggccuagugugugugcugagugggagccucuggaugggguugggggaggucagagagccaggccagcugaguaaaggcuguuauugagccaaggcaccaauuagguggauuuguggggcgcaauuggggaguggugggugugccuaacugggaauucauguccugagcaacauuaaaagauugucagccaacuaggugugguagcacacaauuuuaaucccagcacuuuaaaggcagaggcgggcagaucucuaugaguuugaggacagccugaucuacagcaugaguuccaggauggccagagcuagacccugucucaggaaaacaaagaaaagaaagaguaaauaaguggcuguccgccuggauuuaagccaccugccauccuuuuucucuuucgucuuaagacauuaguaggugguuggugcuuucugugucuucauuucuuuaccugugaagggaagaccagagaagguacacacacugguaaucuuaucacuggggaaacugaggcaggaggauugcugcaaguucaguucagccugggcuaugcaguaagacuguuucaaagagagaggcagagacagagagacagggagagaggccugguguggucuguacauggucuuuccugaccauuuaguucuuagaauucuggaacaguccacaagccagcugcuccgugguugucaucgucauggccugagggugacuaagugggugcuguggggagacaccuggcugcagccauuguagggcauucucccugaauacuucuccagccccgccccuccccauucugcugacugaucaccucuuuuuucaugugaggcagaggaagccauguuucuagguuccuuggguaguaguugaaucaggauucaaacacuggcuggcuggggccccuugagcuuaggcuccuaagggugggggccccugaagcuuggggguuucugaaguuagggggcccuugagcuggagccaggguuaagcuagguagggcacggggauugaaggagagaccgugaugaggguggagggacuccaggggacugcagccuggccugugccuugcaccaugaaugugcacaggaaagccagggugguggcacaugcuugagauuccagcaccuuccagguagaggcaggaggauuagaaguuuaaaguuguccucccuuauguagucaguucuaggucagccugggcuacaugagacccuggcuggaaaaacuauuuuucgagcaccaaacugaaaggggacacaaugacuaucaagacccucaaagcagcgggccuucaaccucgcagggaccuuagagccuaggaguggacuuuggaguccugcagacccucucuggccccagccagucccauaaggcuugugcccaggcccuucccucagagagggagccuugcgggaaggaggaacaauggcaggguguggcccagaagcagaaacagaagcaggugucgaagguuuggggccuggccuugccauacucaggcccacccuugccucucugucaugaagcagcuguguacaccaccucucagcagcucccauggccucacuuaagucccucagcucagcugcucuccccucugcaguggggagccauaaguguauggucacuggguugguuuggggauaucagcucacagaccggucuccaggugaagggacauacucguguaguauacaugaggacagagccaggccuagcaggccccagacaaaccccugcuccuggacaggaaucgaccaagauuguucuaaggcagcuggagaggaagucauggggacaggauggggacaggaugucgucaggaugagaauagcaauacaagguccaguaauuggaagugcagacuggaaucagagaggucuagacuuuaguucugcuucuaccauguauuagcuggguguccucgagaaagucacauaaccucucugggcuuguuuacagcucuguaaauuggggauacuaaccccuucuuugcagagacugugcuggccccaccugguguaggcuuguguguauggcguaccuaaccccaagucauacuaccguuuuugcagaccccaacuccagagucccuucugaccaccauccaggaugagccagaggugccaguaaguggggggcccagcggggacuuugagcuucaagaagagaccacgcagccggacacggccaaugaggugguggcuguggaaggagccgcggccaagccgucaccuccacuggggacacugcccaagggugcccgcccaggcccuggccuccacgacaaugccaucgauucgggcagcucggccgcccagcucccucagaagagcauacuggagcggaaggaggugcucguaggugagggcaggcuccaggccuggggcaaggcagggugugaggugccuccccugcuccccgcucuucauuuuguguucuucucucucuagaacuuucuuuaugcccucugaccccuccauacuuaggagccuugcuuucuugggggucaccccaguugacccugugggaccuuucuuccuaggugcuaaucuccgaccugucuucuggccugaccuuuaacccagccuuuacccaagaccuugaaggcuuuacccuggugggacuugggauccaacuggcucuccuaucgagguucccaucuccucuuggagacagcgggugguggucuggcagugugggggaggggccuucccuuccuaauaguuuugaggaagugaggcaccugauguuugauacugacaaggaccaggucaccugccucuauccuagggaugcaaagucauugcugagccauuggaaaggacuuggggacuguaggugauaccagcgcuguccuuacugguauucugucucugacuccaggcccaggaggaugccuagccugcuaacacccaaccuuuuaauuaauuaauuaauuaauuaauauuuauauacauauauauguguauguuuaguuuuuuauaugcuucuguucauuucuuucuuuuuuuaauuagguauuuucuucauuuacauuucaaaugcuaucccaaacguccccccagauccucccccugccacuccccuauccacccacucccacuucuuggcccuggcauuccccuguacugaggcauauaaaguuugcaagaccaaugggccucucuuuccaaugauggcagacuaggccaucuucugcuacauaugcagcuagagacacgagcuccagggguacugguuaguucacauuguuguuccaccuauaggguugcagaccccuuuagcuccuuggcaccccaaccuuuuaagcugccucugggucuugaccucugucucuuucuccacagccgugaucgugggugggguggugggcgcccucuucgcugccuuccuggucacgcugcucaucuaccgcaugaagaagaaggacgaaggcagcuacaccuuggaagaacccaagcaggcaagcgucacguaccagaaaccugacaagcaggaggaguucuacgcuuagcagagccacagugccuccugcagccuccacuccgccucgcccagucccuggccccagcagcagcccaggccugauccugggccugggccugggccugggauggagccuggcccugcuucuuucugcucaggcugcuagcguaacacagacuguccuaaggagcagaggugcugccaucugccccagacuguguccuuaugaccccuucuuuggucccauucccuccagcccggggcuucaggaccuugugucccauggacaagaggaaggaagcccuggguugcugguugaaacaggggcaggggcaggguuaagauggcccacagugcuugcugauguccucuucuugcuccagaggccaccaugcuggcuucuagaaccaauaauacaugguacaucuagcccuccaauucaaaaucacccagaugcuguggccucgagcugcugucccaaggccucucucuugacaggagggugcccuuugucaccagccugagcucaugauggggucaccgcccccucccccugccaaaugcacagguccccaggcugcaccucuuccugcauugccucccagggaaagggcuuccuucaguguacagggcagccagugguaagugaggccagucuagcaucccuccugagaggggaugccacauagccuccgucaaccacuacuagaauccuaaaaugcauucacacaggagacaaaaacauacccaguccugaccacccagccagcgagacaucacacagaugcaccaccuucacgcagugcucagccauccugaugcuucugcuacaucguaggccacugucauugucaccaguggcgaccacaccaccuuccucccaaucuauucucuuuacacacauugguccugcaucuggcuccucuaaccauccaggucacugaggaaggcaggaccgaguuguaggcaucagcccauauugggucccccagagucacucuauuccacuugguccccaccaugacaccuauaccagccacacugaugcugaucccagcugacgucagucacaagcccacacaguuaaugcaggcucucccucccccacuguggcucauagagaaguuuggggcuagccuccaccagccaaguuugaagcaagaagggagcuagggccucccaggaccaaggcgcuguguggguugucccuggucuccauguaucuccuuucugcucugagccaggagcugucucugccucccaggacacgugucuccaaagugccugugagggugggcuccgcccaggcccucuguguccccugcccugcccuggccuggugaggccaaccucaggccuaccuacccuggguccuuucuguggacacaacugaccaggcaacuuggcaguucuggcuauauccagaugaacccauagcccaccaggcucaucccaaugcuauaggcucugagaaucauugauggggacaagggugucacaggccucaagucuaccauccugucucuguuauccuuagaaguggggcuauuucagagguauuuaaaauguggggggucaccauucucuuugugaaagggccaugccgaaggagcucucagcaccaaagggacacagcuuggguagugacuggccggcaccccuccaccaucucucacaugucccagguucagucaggugaccacaugguuucuuucuguuucauuuuaaagaaucccugacagcagaguugggcagacugaagaaccacaucuggguaauggacaggaucuaggcaguuggcacagcuugucuuucugggguggggguggagggggugucccccugucaggcucuguucugucuuccagaccuccaugacucccuugaugggacuuuagaguuuuguaagccagucggccuggucuuuaagugggggggaaggaaugagaggcguccuaaacccaugagauguggaggagggagcuuggccaagaucuucccugcagcaggggcuggguagggcguagaggagagccagugucccagacccucccacuccucccugguaagcugcagucuuggggacuagagcuuuggaaagagaggcucagcagcugggcgaggcaaccuccagguacucagcccaaggggacaccacgaccagggcaggaggccccagcuucuguguugggcuaggguucacuucucacaucucaggguggcucuggcccuggggcuauggguuuggcauccugauaccagcauccuuaaugugucagcaucugagagaagaggcagugggucuuaaguaugggguccgggcuccaaggccaacgccuaggcuucauggccauggcguuugaccugaagguuaauggugugagcagcccagauaaacugggcuagccuggugaggccaggacgauuuaagagaacucaguuccaagggugaacugaauucuuccuagugcaaugugggugcgggguucccacccugccccagaaacagugcgguacauacagagccuguccaaaggaguccagagacaccucagugcuccugggaagguauucaggacaccggcuugccuggagacacaaugcauucugaaucagagguggugauguguccuggacuucucugggcccugguuucccuagagaguaagacaugcuggggccagagcacugaagagcuaagcuucaucucucuugggggccagacuagggacucuauguguaagguugauucuccuugauugccagaggcaugugggugacagccaggacuggcugagcagaucugcagcaagagcuuaggaugcuggggccagacccccugggcuuggcuuagcuacucaucaggccuccuggcuggggcucgagcuucagagagcagagccaacgcugcucucagggcaguuguggcucccugggcuguccuggcuuucuccugggaugugccucccagccuuggugucuguaaauagaagcccacacuguacagaucuacagagaggcccaaacugggcucuggugucaccaucugaggggcugauggccuggcuucccccaggugcccugugggugcuuggguaugccuggccccggcguggugaaugcauguaaauacuucguagacaguguggcuccagagagcccccugagacagugucccccccaccuuacugguucauccucucuccuguacagagcccucccagccccugggccaccaggaucagggguuaccucccuuccccagaccuuuccuacccguucucucccuauaaccuguuuauuaaccaacccuguccugaguucauggccaaaacuuaaauaagagaaggaggagagggucagauggauaaagauaaagauaccaaggccugguccauccuuaccaugggcgcucguacaccccuggcuugggaaggacagggcuugcuuuguuuuguuuucuguuaguuuuuguuuuuuaacauuucccugugcugugcccauuuauaagaggaaauaaaauuaagcugaaagaugucgu

SEQ ID NO: 2155 - RNA, 33787 nt, Mus musculus
acgacaucuuucagcuuaauuuuauuuccucuuauaaaugggcacagcacagggaaauguuaaaaaacaaaaacuaacagaaaacaaaacaaagcaagcccuguccuucccaagccagggguguacgagcgcccaugguaaggauggaccaggccuugguaucuuuaucuuuauccaucugacccucuccuccuucucuuauuuaaguuuuggccaugaacucaggacaggguugguuaauaaacagguuauagggagagaacggguaggaaaggucuggggaagggagguaaccccugauccugguggcccaggggcugggagggcucuguacaggagagaggaugaaccaguaaggugggggggacacugucucagggggcucucuggagccacacugucuacgaaguauuuacaugcauucaccacgccggggccaggcauacccaagcacccacagggcaccugggggaagccaggccaucagccccucagauggugacaccagagcccaguuugggccucucuguagaucuguacagugugggcuucuauuuacagacaccaaggcugggaggcacaucccaggagaaagccaggacagcccagggagccacaacugcccugagagcagcguuggcucugcucucugaagcucgagccccagccaggaggccugaugaguagcuaagccaagcccagggggucuggccccagcauccuaagcucuugcugcagaucugcucagccaguccuggcugucacccacaugccucuggcaaucaaggagaaucaaccuuacacauagagucccuagucuggcccccaagagagaugaagcuuagcucuucagugcucuggccccagcaugucuuacucucuagggaaaccagggcccagagaaguccaggacacaucaccaccucugauucagaaugcauugugucuccaggcaagccgguguccugaauaccuucccaggagcacugaggugucucuggacuccuuuggacaggcucuguauguaccgcacuguuucuggggcagggugggaaccccgcacccacauugcacuaggaagaauucaguucacccuuggaacugaguucucuuaaaucguccuggccucaccaggcuagcccaguuuaucugggcugcucacaccauuaaccuucaggucaaacgccauggccaugaagccuaggcguuggccuuggagcccggaccccauacuuaagacccacugccucuucucucagaugcugacacauuaaggaugcugguaucaggaugccaaacccauagccccagggccagagccacccugagaugugagaagugaacccuagcccaacacagaagcuggggccuccugcccuggucgugguguccccuugggcugaguaccuggagguugccucgcccagcugcugagccucucuuuccaaagcucuaguccccaagacugcagcuuaccagggaggagugggagggucugggacacuggcucuccucuacgcccuacccagccccugcugcagggaagaucuuggccaagcucccuccuccacaucucauggguuuaggacgccucucauuccuucccccccacuuaaagaccaggccgacuggcuuacaaaacucuaaagucccaucaagggagucauggaggucuggaagacagaacagagccugacagggggacacccccuccacccccaccccagaaagacaagcugugccaacugccuagauccuguccauuacccagaugugguucuucagucugcccaacucugcugucagggauucuuuaaaaugaaacagaaagaaaccauguggucaccugacugaaccugggacaugugagagaugguggaggggugccggccagucacuacccaagcugugucccuuuggugcugagagcuccuucggcauggcccuuucacaaagagaauggugaccccccacauuuuaaauaccucugaaauagccccacuucuaaggauaacagagacaggaugguagacuugaggccugugacacccuuguccccaucaaugauucucagagccuauagcauugggaugagccuggugggcuauggguucaucuggauauagccagaacugccaaguugccuggucaguuguguccacagaaaggacccaggguagguaggccugagguuggccucaccaggccagggcagggcaggggacacagagggccugggcggagcccacccucacaggcacuuuggagacacguguccugggaggcagagacagcuccuggcucagagcagaaaggagauacauggagaccagggacaacccacacagcgccuugguccugggaggcccuagcucccuucuugcuucaaacuuggcugguggaggcuagccccaaacuucucuaugagccacagugggggagggagagccugcauuaacugugugggcuugugacugacgucagcugggaucagcaucaguguggcugguauaggugucaugguggggaccaaguggaauagagugacucugggggacccaauaugggcugaugccuacaacucgguccugccuuccucagugaccuggaugguuagaggagccagaugcaggaccaauguguguaaagagaauagauugggaggaaggugguguggucgccacuggugacaaugacaguggccuacgauguagcagaagcaucaggauggcugagcacugcgugaagguggugcaucugugugaugucucgcuggcuggguggucaggacuggguauguuuuugucuccugugugaaugcauuuuaggauucuaguagugguugacggaggcuauguggcauccccucucaggagggaugcuagacuggccucacuuaccacuggcugcccuguacacugaaggaagcccuuucccugggaggcaaugcaggaagaggugcagccuggggaccugugcauuuggcagggggagggggcggugaccccaucaugagcucaggcuggugacaaagggcacccuccugucaagagagaggccuugggacagcagcucgaggccacagcaucugggugauuuugaauuggagggcuagauguaccauguauuauugguucuagaagccagcaugguggccucuggagcaagaagaggacaucagcaagcacugugggccaucuuaacccugccccugccccuguuucaaccagcaacccagggcuuccuuccucuuguccaugggacacaagguccugaagccccgggcuggagggaaugggaccaaagaaggggucauaaggacacagucuggggcagauggcagcaccucugcuccuuaggacagucuguguuacgcuagcagccugagcagaaagaagcagggccaggcuccaucccaggcccaggcccaggcccaggaucaggccugggcugcugcuggggccagggacugggcgaggcggaguggaggcugcaggaggcacuguggcucugcuaagcguagaacuccuccugcuugucagguuucugguacgugacgcuugccugcuuggguucuuccaagguguagcugccuucguccuucuucuucaugcgguagaugagcagcgugaccaggaaggcagcgaagagggcgcccaccaccccacccacgaucacggcuguggagaaagagacagaggucaagacccagaggcagcuuaaaagguuggggugccaaggagcuaaaggggucugcaacccuauagguggaacaacaaugugaacuaaccaguaccccuggagcucgugucucuagcugcauauguagcagaagauggccuagucugccaucauuggaaagagaggcccauuggucuugcaaacuuuauaugccucaguacaggggaaugccagggccaagaagugggaguggguggauaggggaguggcagggggaggaucuggggggacguuugggauagcauuugaaauguaaaugaagaaaauaccuaauuaaaaaaagaaagaaaugaacagaagcauauaaaaaacuaaacauacacauauauauguauauaaauauuaauuaauuaauuaauuaauuaaaagguuggguguuagcaggcuaggcauccuccugggccuggagucagagacagaauaccaguaaggacagcgcugguaucaccuacaguccccaaguccuuuccaauggcucagcaaugacuuugcaucccuaggauagaggcaggugaccugguccuugucaguaucaaacaucaggugccucacuuccucaaaacuauuaggaagggaaggccccucccccacacugccagaccaccacccgcugucuccaagaggagaugggaaccucgauaggagagccaguuggaucccaagucccaccaggguaaagccuucaaggucuuggguaaaggcuggguuaaaggucaggccagaagacaggucggagauuagcaccuaggaagaaaggucccacagggucaacuggggugacccccaagaaagcaaggcuccuaaguauggaggggucagagggcauaaagaaaguucuagagagagaagaacacaaaaugaagagcggggagcaggggaggcaccucacacccugccuugccccaggccuggagccugcccucaccuacgagcaccuccuuccgcuccaguaugcucuucugagggagcugggcggccgagcugcccgaaucgauggcauugucguggaggccagggccugggcgggcacccuugggcaguguccccaguggaggugacggcuuggccgcggcuccuuccacagccaccaccucauuggccguguccggcugcguggucucuucuugaagcucaaaguccccgcugggccccccacuuacuggcaccucuggcucauccuggaugguggucagaagggacucuggaguuggggucugcaaaaacgguaguaugacuugggguuagguacgccauacacacaagccuacaccagguggggccagcacagucucugcaaagaagggguuaguauccccaauuuacagagcuguaaacaagcccagagagguuaugugacuuucucgaggacacccagcuaauacaugguagaagcagaacuaaagucuagaccucucugauuccagucugcacuuccaauuacuggaccuuguauugcuauucucauccugacgacauccuguccccauccuguccccaugacuuccucuccagcugccuuagaacaaucuuggucgauuccuguccaggagcagggguuugucuggggccugcuaggccuggcucuguccucauguauacuacacgaguaugucccuucaccuggagaccggucugugagcugauauccccaaaccaacccagugaccauacacuuauggcuccccacugcagaggggagagcagcugagcugagggacuuaagugaggccaugggagcugcugagaggugguguacacagcugcuucaugacagagaggcaagggugggccugaguauggcaaggccaggccccaaaccuucgacaccugcuucuguuucugcuucugggccacacccugccauuguuccuccuucccgcaaggcucccucucugagggaagggccugggcacaagccuuaugggacuggcuggggccagagagggucugcaggacuccaaaguccacuccuaggcucuaaggucccugcgagguugaaggcccgcugcuuugagggucuugauagucauuguguccccuuucaguuuggugcucgaaaaauaguuuuuccagccagggucucauguagcccaggcugaccuagaacugacuacauaagggaggacaacuuuaaacuucuaauccuccugccucuaccuggaaggugcuggaaucucaagcaugugccaccacccuggcuuuccugugcacauucauggugcaaggcacaggccaggcugcaguccccuggagucccuccacccucaucacggucucuccuucaauccccgugcccuaccuagcuuaacccuggcuccagcucaagggcccccuaacuucagaaacccccaagcuucaggggcccccacccuuaggagccuaagcucaaggggccccagccagccaguguuugaauccugauucaacuacuacccaaggaaccuagaaacauggcuuccucugccucacaugaaaaaagaggugaucagucagcagaauggggaggggcggggcuggagaaguauucagggagaaugcccuacaauggcugcagccaggugucuccccacagcacccacuuagucacccucaggccaugacgaugacaaccacggagcagcuggcuuguggacuguuccagaauucuaagaacuaaauggucaggaaagaccauguacagaccacaccaggccucucucccugucucucugucucugccucucucuuugaaacagucuuacugcauagcccaggcugaacugaacuugcagcaauccuccugccucaguuuccccagugauaagauuaccaguguguguaccuucucuggucuucccuucacagguaaagaaaugaagacacagaaagcaccaaccaccuacuaaugucuuaagacgaaagagaaaaaggauggcagguggcuuaaauccaggcggacagccacuuauuuacucuuucuuuucuuuguuuuccugagacagggucuagcucuggccauccuggaacucaugcuguagaucaggcuguccucaaacucauagagaucugcccgccucugccuuuaaagugcugggauuaaaauugugugcuaccacaccuaguuggcugacaaucuuuuaauguugcucaggacaugaauucccaguuaggcacacccaccacuccccaauugcgccccacaaauccaccuaauuggugccuuggcucaauaacagccuuuacucagcuggccuggcucucugaccucccccaaccccauccagaggcucccacucagcacacacacuaggcccaccuugccuacuucaccccugguaccuccuggucccugcccaacccaucucugcccacgcuaaccccucacccacuguccucaccugagccaucuccguggguccaggagccgugguccccaacggcaggguacuccucucagcaacaucaggcuccuggguggugacuggccgaggaagggcucguggccucgagguagcuguguugaccagccuaggugucggggccucuguguccaagguagccacaguaguggguggugagggugcugcugggguagugaucuuggcuguggcagcuguggucaggggaagaggcagcauccccuguaugccggugguccuuacgucagccacgguagccguggcagggggcgccucgggagugcuaggggcagugguggcugcuguggcaggugcuguggccauaguuggggccccuguggugguggccgcggugguagauguggugguagagauggugguagcuuucuggcuggacucuucuacgaccucugucaccucugucaccagcgggggacuggugacugguucagggcuggggugcucagaaaggaguuccucaaaugggguguccacgggcuggauaacgguuguggguagcauggcaggugcagugggcgcagccagggccauaucagggaugaaccgcauggccgucucaaggccggacuccugcucgaagucuggggagguggggaaaggaaagcucuggggaguggguguuccucacccccagguccccaggcaggcauugccuucccagcaggacacccccccccacacacacaagcaauuuccccaggaaaacaagacagaaaggaagagguuugagcagaugcuagcccgugccuagccaaaauccucgagggggccacaauuuccaggcagccuguccugacucugccaaccugaggccuagcaacugcugaccgaagccucugucuggaauccauccauucaggguuacaggggaacgaggccuggccccgugagaagggccagacccaaggacaugccucacacaaagucauggcagcagagacccugagccacuccaccuuccacacgugagcagaucaccagaggggaugaggccuucuugcagagcccuucccaggccacgggcacaacucaagaagggguaagaugaggggcuuggaggggacgagaugagggaguuaggagaugugaggagaggccauggccagggagggucgagagaaggaaacagugacauuuuuguuugguugguugguuuuuguuuguuuuggggguuuuuguuuguuuguuuuuucaagacaagguuucucuguguagcccuggcuguccuggaacucacuuugucgaccaggcuggccuugaacucagaaauccgccugccucugccucugccuccugagaacagugacauuuuagaggagggcaccaguuuccugagggagaggcuuaaagcagaguuggagggagacuagcggcagagcuaagucaggcggcucaggaaggagcaggagccuggaacaguggucacacauccauccccaggcuggguccaucucagcgcgcucccucaguuagcagcuucaugaccacacugacugccugugcccaccucccagagccuuugggaggaagguuaacuccucaguagauaggaauaugggaguggcaagggggucagaagucauucagcugccuggucacaaggcccugcuggaguugcuacaucuacugucacccugccuggcccacagucgacuaaagacagagccagcaacccaaucccaggccccugaagcccauuguagcccuaccucaaccucagcuuccccacuauugauggacccaaagggucaccugcuccagaugggaccaaaaagggcaucccugaugaggacaucccacggccuuucaaacguaaugggugccgagcugggaacacugaguggcuuauguuuauucaacaagccacggggcaggagccacggggcaggagccacagggaaggagccacggggcaggagccauggagcaggagccucggggcaggagccacggggcagaaaccacgaggcaggagccacggggcuggacacagguccauacugcacaugcagacacagggacaagaguccugggcucugaaggcuucccuagucuucucccuaucagaaagcugcucugccccccuccuccuugaggucuugaucuccauacaguggcaagacucauucaagugaccuuaaaggcuccuggguuggugcuagauaucagagaugggcagggagaccuggggacuacuuacagccagagccugaccccgaguagaggucgucuaguucaucaucaggaaacgagucgucauccccugagcccucaagauccaccggccucucgaaguucucauugcgccagcguugagccugggaggggugcagacacacacagggcuagguacccaagguauuggcccauacaggcccaagagacaacaggcgcacucgugggcagaguggccaauaugugcuacaagagagcuggguguugguggauggccacuucccaccuacccaaggccaugguagaaaagcucucccuuaccugcaagcugccacuagagaccaccagcugccgaccccccagccccagccaugagaacccccacacaggagaauaggcucagagcaugcagugcugaguuugaaaccaagaaagguuauuugcacccuggaugaguuugaacauuugugcacuugguaaacaaauaaaaauggcucccucacuauccugagauugcccuggugcacugcagauucaacacagguccaccaucaccuccgugugaucaguacucacagacaggaucccacuggggucucaagguaaaugacuuuaggcggcagucaccagcccaacucacagaugagaaaacugaggcuccagugcccagagggcuaggagugaaaugagauuugaaauccaaaugacaccaaaaauuggcaaaggcagagagauaauucuagaagacagacauggguacuagggaggcugagaacccaggagagaaauagcagaauaaggaagggaagggaaaggcgaaggggacuguccuugcugagccagcccgagcucuucccauaacagaaaguuagcucccgccuggccuaccccacaguauaugcacacccagcauuggcacaagccccauaguacuucugcuuccagcuggcuucuccaagcaucuagcuccccgggccuaagaacccuucuccgucagaacccgggaagccuggagcugguguucucagcucuaacugugcagccccccuggaaaguccacacuuggagccagcccuacgacccuuaaaggcugggauguagacucccaaagacugccgaguagccuugacuagccaccugacuuacccuggcugugguccccacccucaggcuuugaggggaagcuccugguauuaggauuugaagccuagggcauuugugucuuacaaccaaaauccaaagagaaaggcacccuagacaagggaaacccgauacacccugggguuggucaaugcagcugccucucuugggcuggccuugccuacccugcagguucacccagcacccuccacgaccccuggucgcucugccuaccacuuucuucccaagccaccuccaguguuacuuuuuuuuuaaaaaagcauccuaugcucccaagucaugaugccugaagcucgugagcaguuugcuuugaagugccaauguuuaggggcugcucccauccaccauccacuaagauguucuacgguggcggcugcccucccugucuagcaagguuccuugcaccgaggaggcuuaggaugaacgauuuggaauuaggaucuggaauggccagagguguggcuacaaagucaccaggcugcucacagagggcccagugccucgccagugggugggugucuugggcaucugccccagcuggcaguggggaaccuuggaaggcguacgaacagaggagaaacuagacuggugcagcacuagauuuacauucagcaucucacaccccugccauucacagacccuucuagaauucaugcagagccaaagagaggcucuuaguccuggcuuccugccccuagcccccagcaccugcuccagagccccagccaagccagccagggcagggagccaagagauaccccucauacaacacacacacacacacacacacacacacacgcacgcacgucuggaaguaaugaauuaaucaguauuuacuuuauaccagugagucacgggguggaacaauuaguguaauugcccccaugacuaaucacugggucuucccccuuuguagacaucccccaccaacucccaucucugcccagcccacacuucccagguccugggcugcaagagucacaucuucuauaagcuagaauccuguggggacuuugggcaucugucccucuuguuguccagccaguagcccgaugucacacagcaggauggggacuaagcagggaccucuaucuuccucuucugcuucaaaggaacauucuaagagaucugucauuccagggaaccaaaagaagagugaacacaggagcuggacagugguggcgcacgccuuuaaucccagcauuugggaaacaggggcagguggauuucugaguucgaggccagccaggucuacagagugaguuccaggacagccagggauacagagagaaacucuguuuugggggaaaaaaaagagugaacacaggaaccaaaaugggaacucaagacuccucaguggcccaaaaagggcuuguauaaacccagaaacagcuccaaagcuacaaagacccugcaauugacacagcuagagacacaggcaugcaccaacacacgcucaccuagaggcagccauugaaggcagcagacuggcaugcuuuugggggcgugugagagaaggguggggggaguuccaugcagcucugagcucagaaaggagcauauagccucucaugaacccaucagccuccacucagguagcacucaccuagauacuauucauccuggcucaguagccauugacaugacaacgguugucauggcaaccauauucuccaugcuaaggaccaggagcugcaguuccccacagagcuggagagugugugagagagggagauggggaaggaucagaggacaggagggauggagagggguaaagccagagcaggcagggcuggggagaaggggaggugagaacauuugagauggggcuuacaucccaauuuagucucacucaucagaggcugcuggggagaggcaaccuuagcaauuuccccaccaugccuccaccacacauccuuccuccagagaugccuggacagagcagaaggguagcccauagcccagucacccugaggucacccugugggucugaggaggaggcuugcagaacacuagggaugcugguagcucggcucccaggggacagccuucaaggcggcagugaagaaagccuuaaaugucacaaaugguggggggagacaguaccucaccccugaauggcaucugcauuugccugacuucacacuugaugagcacagcugucuuugucacccccuuaaagaauagaguccuagugccccguuggccucuuugucugacccucucuguggcucuccacugaaguggucuacaaccuccugugacugagcaaccugcagacacccaugccccagcaagggacugagaggagauacagccuaaugugcaccuacacaaacuaucucagcacacccccaugacacacacauacccaccccccaagacacaaauacacaguccuuugaacacacacccaaguauacacauacauaaacauacauguauacacaucccagcacacauacacacacauacacacacauauacacaaauauacccauauauacaccugugcacacacacacacacacacacacacacacacacacacacaugcuccuucacacuaacaccuuagcagacacacaacccaauggacgcaguuaaaagcggcauugacagacccugaugcacaugcccaguacagcuuaccauggugugugccagcccagucuugucccagcugugcacauaccuuaggaaacucaugaacugcuccacacaaaccucagcggacucggggccacaugugccaaggcucaccuccauggacagauggaucugccgugugcaccuacacauccccuaggccacguggcacucuuguuccauugccugcuccacucauacaucacaacucgaaguugaucccuucacacucgcacaucagggcagcaccccugguccagcacucaccacgagggaaagaaguauccgugacguguuuucugccauggccaacucaaggcaaacauccaucgagcagaauguccuccuuccugccauuggggaccuggguaucaggucaccaccgccaccaccaccaccaucaccaccacccucaucauuauccccugggagggagggucauuaucuucagucuacagagccagacagcaaggcuggccaacaccaaggugugagcaccacccucauccagaguccgucucucugagugcuccaggccacccaaccccauguucagucaggauccaggguuccuacauauguggccugccugacacccaccucagcauucagcaccuaccuacucaccaagcuugaccucauugacugaaucugcuucacagcacacccugccccgccccccauugacacaggccccucauuccuggagcagguaccuccagacucacagagaugcacaccaccgcccccccccccccccgggacagcacaaucucacaugcccaugaucagcuacaauguuccaccucuccuuaucacauucauguggaacugacccacagccucagcccucaaugacacccagauuccuguccagggaugugggcccuaugguaagcaagcuccccuaaccacccacccacccacccauccacagaccucucuccccagugucauggagcugugggugucacugggcuucccaguaccugggcagaaggcuuccuccugccggcuaccccaucuccccagauucccugcccaggaccaagcuagaugaggccucaaguuagacauguccccacgguccagagcagccacugacagcuaucuuuuagacacauuccuuacucagaguccuuucuaagccaccgaccaagucccaagagaagcucgccaccuccuuccacaccuuguagagagacagggcagugcaguccggucccucacuuccucauccgugaaaugagaugguaagagcagggaucuugcggcacugggaggaguagccacgcugugcaaagcaggaacgggaggggugggggugggagcggcgaguagcgauugauuaccaguuaacguuaaucucuccacaauuauagaagagaagccacagccuucuccuggaggagacagaugcagaggaaaugccugcugaugcccagagagguuggauaacauugccuaagccacacagaggacugaagagagaggcuggagcaggaagacugggugcagaagcauucggacacauaaauuaggucagccgccgggggcgaggagcccagagcccugcuaaucaugcugcaaaggcuagaacaaaaucaaguguaauuaauucugccccagcuuccuucccccaagucgccagauuagggcuccacuguccuggugaccagagacaaugugaccugggcugagagcccaccauuaggcucggaaagucucggugaguucaagucaagcucuaucuauuugcuggguaucucugggcaagcuauauaaccucucugagccuauauuuggcuaaauaguggcaauaauaacgucugcuucgcagagcuguugugggaauccaguaaggcaguguaaggagugugagccaccaggcggaugguggcuccuggcucgucucuggcugaugcccccacagcaugcagucccacaccagaucucaauuucaagucuaaacuaggccugagagagcacgguguucaagucccugucccaacagaugcagagaugggcaggaaaggaggagagcaguccagauuagccccagggucccugugggcuccauccccaaaggcucucagcccugugagaacacgugucaccagcuccaccagggagacccagagccucucugcaggaaugugggcuguggccaggcucugggcagaaggauggccagggugacaaugacagcauggauaaccucaguccuaccccuccccaguccuccuccccagcucccccucuaucccaccccaccccaccccccacagagcagcgcugaguucagaaaauguacccccaccuaccccuccccaacccucauccccacccccauuccccaccccuacccuacccccaaaacccaccuaacccccacaaaccccacuccccacccuucacccccaccuagcacaucccagccagcccaacuucucugcaaaggaaaucaagagagcggcugcaccccuccccagcugugugccggaggauggggguggggugggggugucagcaaaaccucccuuuaucaccuuccccagcuugcugcugacccccaaaucucuaucuguacagugguacuaaugccuaccccaggccaacagugcacaggucaugugagcuccuccccacuuccaaacaagacuccuccucaucuuccuccuccucuuccuccuccuccuccuccuccucaucuuccuccuccucuuccuccuccuccucaucuuccuccuccuccuccuccuccuccuccaagugcaaaagaaacaucaguggggccucaagaacagagccccagggcagugcucugaauaagaaggggaacuggaaacaauguucuucccaacaauaaggaacuacuaaauaaguuacuguacauggacuaguauauagcugucaauaauguauucucacacacccaugcugccuaauuuggucccuaaaaggccugaauguaucucagaagauuuuuuuuuaaaaaaaaaaaaaguuguuuugaaagaauauuccagaauaagggaaaaguugcccauugacugccagagagggacagcugggucgcuaaagugacugccggguacuucugucccucaaugccugaauggcccuggcuggacaccaacucugucagucugcccuuccagacaaaacaaaagcaguaugaccucucuggggcaucauaauggaggcugggccuaggacugucggcaguuaauacccucaccaucaaguuccaaagggacacuauuaaacauacauggcguggagccagcccagcagagcccacuacaaaagugacauccucaagucacauuucagagagccgaagaggcaggcuggcucucugagcuggucucugguuacuagcacuuggcaagggcuuuaagcacuggcucuccguuuuugacccugugcgugcuuccuaaggaccuccccccaccugcuggccaaccuggcugccaccucucccacccuggccaucacccucaucaugaugguccugcaaacaggcacccucugagcgcugguuccugugaguggaauuagccccugccaucgagauuugugaagagaauccagacugugugccacccauccagguaugagauacaggcagcggcuccacagcacacauuaugucuccuguguuuagaugaaagacaaugaccagcccugguaagcuagggcacuccucagcccaggcugagacaacucccacugugccagccaccugcucucaucugggucaccuuugggaccacccugacacacugcuccuugaugcccagccaugaguugugcaauggaggagcacccauggaggccuggguccuccagccucugcagaguccuccucccacgugacaccccagcuccuggccucgggccucagugagcucugcuagguuuccuugaccauguuggguuccaggcucuucucacuuacggauacagacgcuaagacuucugaccaccagugugucccaguaggacuugaaccccugacugaaucccugagccuccaagagugcacacaggccccaagcuguauuaugguguauccccugggcauuuuucagaaggcuaucugagacauuccaucccucacugugaagaacaguuagugcucccaacagggagcacucaccaugggccuggaucuuuggaugcacacagucuggauucucuucacaaaccucgcuggcaggggcuaauucuacucacgggaaccagagcucagagagguaaagcaacuggccuugggucucccagcaauaggacuaagauacaaaaccaacaucagcggaaccccacgagcucccuacuguacauuggccugcuagguuauuuaccuaaugugcguucacaugcuagggccucaggucccauccuuccccagucugucuucccacaggagagcugcuuuauuucaggggacucuggaugcucugagcagcagaggccucaggagccaccauccccauguccagguagaacaugacacauccagaaggauucacagaagacaccaagggaggucugacaaggcagagcgcucagugccugccuaggaagcaacauacuuguccccagccaccuccauccugauuccuggaagccaccuagaucauccaaaaggaucagggacccaagcuagaccaagcaggggccaaaccccagcacuggcuuucugcagcuggacagaccuagguagaaagccgaccucucugagccacaguuuccuuugguuugcuuauguaugcuuaauaacauugaccucaaagggucaggagaccugacccggaggguacaguaagagccucccuucucagugagcuguccaccugagccucagcuucccaucugcagacccugacacagggcagggggccuugagaauggaagcacaggguccuggucaccgcagguggcccauggccagaucuccccccaccccccacucuccccucuugcucucaagauauggcucugcagucccagcuccccagacggccuggcuccuucaacugagcaccuacaugugcuaggcuuuugaagcagccccucaagggacaaguucuuguccaucgucaccaagcuuuguaucuuguccacugugccaccccauagacaccuaaguguggggagcggguguggcggcagucccaaaggcgccagggacugcagcuaagucauaugacuugcaccugacuuccucauauaagacacaaacaucuugagugcugugcagguguaccaggauacaggugaauccaauuugguggagauuugccccugcugcccugauuagcugaagccucgugacuggcgagggggcguggccugcggugcguggaugagagagaguauaaaaggagugagaggcccaggguucgggggagauauaaacaagaagaaucaggacugcuguuagaaggacugguggucgcgucguucuugcuggucgagagcgggcgcgacaccuaagaggugcagggaccacagugcucagaagccagagaacagcccacuuaggaagaugcuaggagaagcgaccucagacccccuccagagguacagcaaaacagcaaggccacuuucaaaaagcagccuuuuugaaacagaauaucuauaugacccaguaacucuauugucuuucauuuuuugaaacacaaaagcagggcaggcaagagggcucagcucauaaaggcacuugcugccaaggcugaagaccugaguucaauucccagaggucacaugguggaagucaagaacagauucccaccaguuugcccucugaccuccuccaccgugcccaacauaaacaaaaauaaagaaagaaaaugcaauaaagaacagaaaagcgagacuguccagaagaggcaaaagcgaauccacccugacuggaugcacagggucccugcucggugugcauacaagucacuaggagagcaucucuauuaccagaugaacagucacugugucacugugccgagguucaugugauccuuguucuuagaauguaucacccgcugcgaggauacauaaagcaggauccauccacauagaggaauauuacucaucggagaaagcugcaacgauggcagacacugccccgugaguaaaccucuugccaagccuugugcuaagggacaaaaucuguccugcaaaccucacacugugcggcccccuggagggaaguguccagccugcugacugcuagcccuggcucacugggcacacagggaacaaugacauuggcacaggcucuccuuucagaaugauuaaaaaaaaaaguuccaaaggcgguggaugugguggcacacgccucuaauccuagcauuugggaggcagaggcaggcggauuucugaguuugaggccagccuggucuacagagugaguuccaggacagccagggcuacacagagaaacccugucucgaaaaacaaaacaaaacaaacaaacaaaauauucuggagcacugacugcucuuccagagguccugaguucaaaucccaguaaccacaugguggcucacaaccaucuguaaugagaucugaugcccucuccuggugugucuuuagacagcuacaguguauuuauauauaauaaauaaauaaaucuuuuuuuaaaaaauucugaaauaacccagcaugaugguucacaucuguaggcccccccaacccuacccccacuucucaccccgcaacaucacacuuuggagguggaagcagguggcucagaaauucaaggucaucuuuggcucagagcaagcaagcuugaggccagccuggacuaccagaaaccuuguuuguuuuuuguuuguucguucguuuguuuguuugaaguccuaaacuaggugauggcugcagcucugcauuacgccagccuccacccuucuccugugaccacuggagagcauacagaaccucaggcagacucacccagagcuacugugagauucccacaaugccuugcagccacauggggcccagcaguccuguccuuccaugucuuacaccuggcaccuugugugcgucuccacuccugaugcugggaccucuagcaagcauagcaaaggucaccugaagacugggcacagugacacagugacagcccaucugguaacagagauguuccugagugccuugcaugcacacacagcaugagccccgugcuuccaggaagaacucagcgugacagcucaggauucagaaagacgcacaauuugaacuugaugaacuguuuugauucuggaauuuuccacuuaguauugucacgcugugguugguugagcuguugggaguaaagccaacgguaagggagacaucugcacuuuagggcacaugagucuccucucaguacaauuguaugagaaaggcagaagcguacaauugaggcucagagguagagaggaauguuggucacacagcagaggccggacucaaauucagaauccccagagaauuuaucaugcucccuugccacaucccagugcucccauuuugggcacccagcauccaggagaagccacaugguggcagaaggacaaaccccuguuguggagcccucagguaagcaggacccagccaagccucccugugucuguaggccaccaacucucaaagggcuacugaagggcgcaggugcagcucacauccagaugccccccccccggcccugcuagcugcccuaacaagaagauacaggcccagagggggucccagaggcuggacacaaguccaucuguccccuaccuuguggcuguccaguguagccucaaggacagacagcccugugggcuccaggaucugucccucagcccuacccaccuccauuuggcucccaagccgaaccucuaccaagccagcagcagcugccaagccccgggcaguuuccgcucucugcucccagacggaggccccaucuguccugaggccuggcccaggccccagcugcccgccuuugucuggcagguucucaguguccccuuagugacuggguggggggagcaugaaaaggcccauaugcuaucucugcccucaucagcaucccaagaugcuugggcauauaugcccugcccuccccuuagccuucagcacaggcucccgcacugggcucagagucuuacccugccuucaaggaccuugagugcucuggccuccaccuacucugcagcccaaagacaaaacuaccacaucccuucuacuaagacugcucccagacccuuuccaggcaaggcuggaagaacucccauaacaccagccuggcccucuucccuacagggagcugcauggggcaaggccaacacagagcaguggcugucuccagcccagccucaggaaagaaugaauggggggcgggacuaagagugcagaaggaaugaauaaauaagagaauaauuaaaugagggagggaacugaugaggaaggagaugagugagaguuggaaugaauggggggaaugaaugaauaagagagggaaugaaugaaugaaugaaugaaugagguuacaaaugaaugaguaccagauggucuugcccaggauccagcuuggaagaagacaguguuagugacagaggaccugagcugaaaugauggccaccaaccuggaugucagccaguggguuguugcuagggcagucuuccucacugagccugggauggggaugggaugucaccuccgugguggcugagacuccucccacuaccaucaugcuagccacagcuugaggccaucacuguaagcuggccgcaugaacccuaauguuuuccucaguggaacugggacuguccuguuuacagaggggauuuagaggcacagguacaagaugaccugccaacuuagcaaaggcccaagucacagccuugucaccuaagccaccuccuuccaucauccucaacacacacugcuacccguccaaaccuggacagagcugagcugggaagaaacaggcaaggcucagccugcacggucuuaggucuuggguuguguggggaccauagcccaguggcccaccaggggaccaugcucagccagcagccgcgcaccaugacguggccugcucagugccaccuccugcaccauucugcuaguaacccacaauguccuuagucaccucccggucucucacuaguaguugucccuuucuuggggaacucacagcucuuguuuucacucucacccugucagcacccagaauugaugaguggcauauagaaccaguucucugaggggcccaagaguagcuuuuuggcagaugagaaugaagugccucuggggguugggcgggagacagagcucccagugucuccuaugcccuugccuuaaucucccuaaggaggccagaugaccagcugcccccagccagagcucuggacccugggauuaagaccuggauuagggacaggccuguucccgugagcacagcuccagccuugugccugcacagcacauacacauguggccagagggcuccuggaagcuccuaggggcacuguggugugcaugggaggggaucaacuguggguguggaugcuaugagucugaaucugcuccuaugggcacaaggggucuuaguaccaugggaagagggucccugccacuugucuaggaguucauguccauccaucugugucuucacgugugugcaugcgugaguuugagugcaugcgugaguaugagugcaugugggagccuaaaguucaugccggaugucuuccugcuuucaugguugaagcagagucuuaccgaacccagaucucaguuuccgggagcaugguuagauggcuugucccagggaccccucgggucggccucaugagugcugggauggaugauacaggggccgccaugcuuacccagcuuuuccuuggacucuaggucuucacguuugcacagcuagaacuucaauuaucgagugcccagccucugugugcacaucugacccucacaagauugccacagcaucucccagcuuccuucaccaaaaucuaugugcagccaccggcuugggggugagccuuagcagcuggggcagucucugcaccuccaggcucccaaucaucagcuuagaugccuggcaacauccauguacaccugccugcagaugaccuagucacucaccauagcuuauagcucggacagaaacaugacguuaguaaccauacaugguaaagggucacccaggggccguaaccucccggccaggucuaagauuauuccccuacuucaugugacagcaagauaaagcaagcuucccagggccaucaggcacaggacccugaccagcacgaccagugucuacuguccucgaagcagcuuuggccucagauuccuuggggcuuguuaaagggagagaugagcucuuggccaggaggugaggacucgcaaaggggugucuagcccaguucuaaccaaacgcugucccuccaaggaacaagucuucaaguccccacagaauaacagucagggaugggagagguccccaucagccagugagggaggaagagacagccucggggaauuggaguaggagaaaaacaaaacaaaaccaaaauaaaacaaaacaacaauaacaaaacacuaggaaggaagagggaggaggagcaagguggaggagggguuaaggguggcugaaggggacaccuccagguaacccaaccuccaggguccacuuucaaggagucaaagcaccgcuacaucaccacacacacacacacacacacacacacacacacaucccuccauggcuacaucuccccagcugcgcuugcuuuccucuucuucccagcuuggaggggggggggucgucauacaggggagggccaaggagaaaagacaagguguuagagugagaagaaccagaaauaaaucaaaaugaggaugugugaaaauggggaaaagaaaccauacagcaaagucagaccggggaaaacgaaagagaugugugaguugggccgggagaugaugucauagguaaggggggugggggagggagguagcagcugcaacauuguauccaagacagggcucccuagaggggagguaacaauguaacccuguggggagccagacaagaagaugcaaugaagcaggaccuucuuggcaaagaaucuuaauguugggaaaagagcagggccugggaagcuaggagagauagcacggaaggagagcucccucuguguuuagcagcuagggagaagggccaucugagcugggcuuuggagcaugaguagaaguucacuggaggauucuacauaggugugaaaaaggucagucaaugggcugcucaaggggucuugguugggguagugugcaggaugcguggggcagaggaaccggucugaagccaugcacuggagagcaaugagaguggauguggcauagauaccgagggacacgagagcauuugggggcagccaagggaaggcuucugagagcaucugaggggcagccagggggaggcuucuggagacaaacaguagaaccacgccugcacucaggacaaaaauggagaccgguaaaaggcagaaccuggugguggggggggggggcggguggaugcaugcacccugggacucuagaagguucuuaaucucaguuuaguaaucaacuugcuguuacucuggcuccaccaguuuccuccccacaagccuggguuagcuucaucagggacaacaaugacaaagcucuguccucguugaagucaagaagccccuggucugagucagcacccagcagucauacaaguucagggaccuggcaagaccuuggccuuuacuucagucuugaugcaacaccggaucccacaacuucucugcugcuggcaguuuguguaaucgauagaacccuagcagcacacugcauggguucgaaucccagcucagcucuaacuagcucugugacuuugcgcaaaguauuuaaucucucuguguugcuauccuauuucagaaaugaagauaauaccugugucuuucucacagggcugcaugugguuuugauacaccagguuugguauccaccuacccacccacucacacacacccccaaccccuuacaggccacacucuccgcugcagggcaaaacagaggucucacuucgcaaugagagcuguguggaguguggcgucuucugcauuaggguuggggauaaguuggguggggcccacuguuuaaccccagaaugugcugaagcacaaagucagaaaccuggaaguggccacacacuuuagcaacaggacagggacagagaaaaagccuccaucccaaagagaggcuugacugccuuccauacaaggugcuuucuccucuggcuggcaagccuacuguuccucuccacagcuuguucuuccaauagaccaugacccuuccugcuucuaagccuuugaccaugcugacccuuagucacccuccgagggcuggaaucaagaagacuuccuuuucgaggccucuccucagccuccagggucaaaccaacccuucaccuccuugacuccuuccuucuccauuacuggagcuucauaaggucuagaggcaaacaugaaguggggugugggggagacauaugcaccucacacaggggcugugggucugguggguuucagcaggcagcugaagacgaggacccagugauaugacuccacacccaguguccuucaugacccuggguggccuggaugugagugaccauguccccaaggucuggagagaaauggcacucagaaugaccagaaagcaaagggacucccacccaggcccaagaggaaccaugaacaggacacgugaagggugugggacacuugaggucagaccaucaucggcugugaggacuggccggcccaggucacccucauccaauggcuccauuucacaggcaguuccgguucucuuucucuggaugaguugcuggaggaaucaccucggagcccaggcaaucuuagaggaacuugauacuaaaaauaaaaccugccacccuuguaacuagugacugcugagccagcuuugccucccaaagccuaaugaaccaggagcuaccagucccuucuccacagaagaggagacccuuucuguggaugcguuggacucgcccugaguggacggaagugggauccagccccuucuccacaaauuucacauccucuuguagccauucacagccauggaagauaggcuguuuagacuaauacuauaagcccccgguauaggucaugcauacaguaggcgcccaauaaagacugcugcaccagcugagcaguccaucaccagaauccaggagcuguacccaagcccucaccacugugugcucuacuugguggcccagugccucgggcaagcacccagaagaaugcagagcacuauguuuaccuuggcagaccucuugcugcccagauaggguaagauagggugacgugacaucccacaggcugugcugaggacccagagguaccuagugaccacugucccugcaacugucaucccugccuucugccuccaccccucgaaggcaggaugugggugggguucagaugcaagcucugcaccccagguaagacaaaugacagcauucaggagaaaagggcagauggacacccacaccugccacacccuggagaagugugccugucauggguaccaccagguacccagagcagaggccagcagcucuuccuacuccccaggauuccucagcugucccccaggccugaagcuggaaggagggagacaccaaaaaaccaucacaggcuccuccuccucccuccgcccauucuggugcuggccacggggauggaacuggcaaucagccagcugcaauuagacucccagaugucacugguccugcuucuauaugacucuuccagccuggcuaggagcuaagguggggaugguggggguaggggauccaccaggcaaggagagggugcaggaugcucuagcugcucaggcacaguccacucacccuugaaggugugacacaacaucagccacucggggcagagcuccagaguaggacgggggcagcugggcacagacucuauguccucuuggcaugugugggcacugguggguaucuguccaucccagagccuuguaaauaagacaaugaugccagucuccuagagaggcugaagguucagugagccagccaccuauaagugcagaauguaucaccauguuugggcaaggcccaggucauccacugagaggggcuggcugagggugaccaucucuacaggacccucccacucccagguuccuaaacauuagccaggccuagggaacuaacagaacacaaccaagugcucuggguuagaggaucguggguaugugggccguggcugcucagcuuccacaaacgucacccugcccagggauuugcacacagggaaucugaucuucugggagucccaggaccauggggucugagcaguagauaggucuaccugccuccagccugcacugcugggaacagaauucccagaaacucagcaccauggagccuagaaaauacuuugccuaaucuggccuaaauccagccagcugcaacugggagucccaacccaaguucuccuacucagagcccagggcucugcuucaggccauucagaccuggcucccacacuguggagggaaauucuggcccuguuuccagacagcagcucucauaauaagaccaagagggcaagagagaaaaaaaaaaaaaucaaaagccugggcaguuaauagcaagaagcuagucuaacauuuacaggggcagccacucucuguucacuccauauccuaacuccgcuaagucuccccccacacccaccccacucccugcaauaaacagacucagagagguugggcuaaugugcccagaucacacagcaagaaacuagaaacaggaggaugucaacccucaccauuuggcacagacguuucugaucuucuguuucggagucaccuucagauucaguuccccccacuccccccccccccaaaaaaaagacauagcaccaaggucugggugggaagacaagcucugacugcucagcaguggggauuaagagauuuuuucugccugguauguaaggccagcaagauguccccagccugccacccucagccaccaggugggaaaggugcuagaucauuugugaggguccccacucucccacagcuagcccaccccccccaagccacggcugcucagacuccccucuguaaucacccucuuccuguuugauacucagaccagaccuggucugugggaaugggggaggggaacggccaccccucuggcuaggggccugcucuggagugaggggccggaagugaaggcugcccggccucccggaaucuuggaaggcuaggagccaaggcaaacgggagggugacgggaaggaggggggccgucaauaaggcuaauguucccaggacauuuugugggacagggaucugaccgguccaggugaucaccagcccagcgcuugcucugguuagugugggagccaggaggggugguggaaaucaggggucugcccccaggcagugucccgcuuggucauccugcccccagacacaaaauuacagggcugcacaaagcugggcugaagcccagagccacaaccucauggucauggccagacuugguggugacagugucaccacaggccagcccuaagcagcccccuggcgccucccaguccacggccaauacccugaauagggaagguccccacccaccucaccaacugaucccugcacgcaggagcagagucccuaccuagcccagcugcauuuucuguauuucuaugcucaguccccaaugcccagaguggccucgggugccccagaagcucaaggucugucaagaaaguccugugacucccuccccucauccugucuuggaccuugugagucacucccucucugcugccaggacagagagaaagugaggaucagagagcuggugcucagaagggaagguugaggcaaggaucugggcuccugaugguuuucuagggauagaugguggaggaggggugcaaaggcaggucuggucaccugugcagaggaggcauggcucguggcucauacccaagggcuauggauccucagcaucauccugagauucuaaauacuuccuguccugugcucaugugaccuaacacaagguccucaaacucugcacaucuuucuuuuuggggggaaggagggcucucugugacgcucuggcuguccuuuggagaccaggcuggccucgaacucagagcuccaccuaccuuugccuccugagugcugggaugaaaagcgugggccaccacucagugccuuggcuuuguauaccucccuuauaaaacuccuccagccugucccugagaaccuuagagucacuccuuugcaggugacagggaccugagaauuggcagaggaggcacccuaggaaagcuuuucuccuguuagcugcuuguuaugucccccaagcgcacagcagaaugaaaugagaacagggacagcauccacgguaagacugugcagcuacuaagugguagccaagaggagcaguguggcacuugccuaucaucccaacaaucaggaggucgaggcagggaaaaaaaaaaaaaacaacacaaguucaagggcuagccugggcuauacagugagacuuagucucgaaaauuauuuuaauaagugggguggugguggaacaugccuuuaaucccagcaauugggaggcagaggcaggcaaauuucugaguuugagacuaagagauuaagaguaaguucugggacagucaacgcuacacagagaagcccuguuuuuuggggggagggaaaacccuaauuaaugaauacauaacuugggggauaaggagaccccagagaggagaagugaaguauguaagcucauggaauaugaggacagagacuagaacugaagcccaggccugcagccagccuggccccaacucaaaacagcuaacuucgggcuacgugacgcugagcgagucaccgagugucucuguggcucauuuccucaucugugaaacaaggauucugguucuuucuaagacuacccugcacacauccuacagucagccacacagaaugcuggggacagggugucagaacugcccagugcucagccuggaacuguggcaccagucugcagcuggcccgagggucuaaguagcagcccucucccugcacagcuuggaaagguggggugggggcaguuuccaggagccuuccuucuccccaaagaagcagguagucccucccgugagcccauccacagcuggccggcuuuuagaggccaauucugcuuccagaaagcaggaggcuucagguccaaccuaacagcccugaaaauucaacccuguguugacggagagagaguguggacgguuagacuggcugcuguugugaacccugucaguuuagcucagaaggccucuucuuccaggaagccuccauuggcuuccuccaagaagggcuaucaccaaggaaaggcagcauacuccagcuccugggagggaggggcugagccuggcgcuguauaaugcauagagagagucuugagacagaugacagcauugcccaaaucccacagcaaauaucugcucuuggugcccagcagcuauggagccucugaauccuauugcuuacuguggugcccugccuggaacaguccccagcuuuucauuucuagagugaggucaccagucuggaagggcaaaaggagaggguuccuggaugccaggaauaagccucaccugccacuucacaccucaaaacaggacaguaacucugacaaaaaaaaaaaaaaaaaaaaaaacaggacgcagugacucgcgucuguaauccuggcacuugggcaguaggaggguaggaguucaaguucauccuugucuauguagcaaguucguggcuagccugagcuacaugagacucugcccccaccuccuccacaaaggaaucuacgugcaccaagugcuauggcuacacuuucacucuuugcuccgucuuagagagagaggaagccacggcaugggacaguuaagucacuuccacaaagucacacagccacaaaucaguugaauaaccaccccugacagcaauacugagugucaucuauggucacucccagaucuggaccuuuaaaggacauucuccaaaggcuauacuuucuaguguccccacauuccaugucacucugggagucaccuaaccagaaaagcugagguggucugaggaccucagagcccuagacagucagucucucaggaccaaagccucgaaucuguaggucagaacacacccccaacuugacagccacagccuggaucaaaccagccuucuccucccuggaguucccuuccccugaucccgugcucucccagacuaacaagaagacccagggucauccuguuuuuccccugcugagccaaccacugucagucccuugcugucaccagagaccauuccuggaacuacuaccugggcuucugaucuagccucagcccucacugagaagcauccuuuaacccuuagcuuuccaggccagguaacagugcagagaguccuuccucuacagucccagccccucccugggaggacagcaugcuugcagagagaauaccucuugagacccaucccuaccacaaucucuccccucgcucagccaggucaccaucugggcaugccacucagcaucagucucaaucaugccagcuccacuuugcccucacaccuaccugguugaagcccuacuaugugcugaguccucaaaaaucucccugaauccuuucacuacggguagaauguguauuauuccuuccuagggacaguagcuccagugaagccauuuguccugagcccuuuguacucaacaccaaaaugccuucaaaggugccucuguguccacucugccuccccggagggcacccuuaguccgucuuugcagagaggaaagcugggacucagaggaguggccaggcuggcucaagaccucacugugauugggugguggucuucacuggacuuugaaaccagaucuuugaugucaaggguaauuuucuauaaugcugcugaaaagcaguucccacugccaguguggguagugcugccuuuugcucaggaaccucuccccucaccccaucaggaaaaaaaggaaaaagaagaagaagaagaagaagaagaagaagaagaagaagaagaagaagaagaagaagaagaagaagaagaagaagaagaagaagaagaagaagaaggagaagaagaagaagaagaagaagaagaagaagaagaagaagaagaagaagaagaagaagaagagagagagagagaagaagaagaaaagaaaagaaaagaaaagaaaagaaaagaaaagaaaaaaagggcaaggcaugaaccgaccaccagguacuaucuugggguccccuccccaaagcuaacaguugucagggcagcucagagucuugccugccucccuacaaucuggccaccuugcuuaggagagaaggggcgugccggccagccugggcucugguggucaucugaguggguagggacagccauugcuccuggagucagccacauggggguaggaccuagaacuccccagcucacucagcccacauuuagacaccugucaacucagaacucacuugggagcuggguuccucagagcagggacccggcucauccaccugcaggaccgacccucuuccucccguucugcuagugaaaccagaaccaaguucaaucccuuagcuacuucgguuucucaaagggacagucaggggucaccugguacccaccucugauggcacacacacccaugucuucuggggugggagcugagccagguccaccaucgcuacacaccugcacacacauacgugugcuuucacacagguccaugggucaaagcacacacccccucacccacagucacacagccuuggccaugguggaacacagcgugcagaaugggucacccuaguguggagcgggaugcggaugccauccagccauauggacagagccucucccgugcccacacccacaggugcccacgcacccuucuuagaagcagacacacacacacagggucacccucauucacccucgcgggucaccuucaucgacccacccccuccuccuccaaugcccccaaggcccugcaggcagcuugggauggaguggggguggggagaaggcgaccccagcggauaccggacgcacacgcuucccggcggggaggggaccccaugagaccgggacacacccagcgcggcacgcgcgacgaggggacacgcaaagacacgcgggguacacgcuggggacccucuuggggcccaucacucacccccgcggcgcggccggccagcagcagcagcagcagcgguggcagcaacagcccgcgggccccgggcgcauggguggcgguguccacgcgcugccccugugcggucccgcggcgcggcggcccgggcuucauggcggccuuuguucgcggcgcgggcugcgcgggaccugcgcucggcuccucggccgccggcuccgccucgcucguucguucgcucgcucgcggcuccgcgcccacagcggccgcgcccgcaggaagcgucgccgc

SEQ ID NO: 2156 - RNA, 24568 nt, Mus musculus
augaucucagccugccacucaccuuucuaggcagcagauccccuuguccugggcagagccacacacuccagaagagguuaaccacuugucccuuucugccagacucuauggcucauguugcugagggcaaagagugacuucugcacuuggcagcaguuucauagccucugcuuucagggugggcaggcagugacuauggacaacaaacucugaggcagggaaggcacagcauuccuccacacgcaugacuguacucuucauccuccacucgggaaguuaaggguuuauuagggagccuagaguuggucccccacccuccugguaggaagagacaauaugggugaggcagucugggaaggcugggguucucauggaggggccagcagacagccagucuugccucuccugcuuuccuccugguccucuggagcaaucacauggugagaaucugcuucgaagacacaaaaggcuucauggaggcuuccaaagccugcugguagcccugcaguggaaccucagaacaggauggggcugugagccggccuuggcggaugagguugcagagagugagaaucagcuccuugaacucaucugcaggaggugcaagucagacaaggaacaacaggugaggucuagugggauggcugagugcuaacucgagacagagucauccagaguaauccuagggaccguaggugggcagugacuacacccuucucagugaugguuagagaggcucauccacaggacaggacaggacuggugaagagcuggcccuaagugguggcuaggacagcauuacugagcuaaggaagccagaggaggccaggaaggcagaguaccuggcacagugcuggaugacaacagaccacaggaggaaaagcucucucugacagcccugggcuuccacuagauuccucaacugaggcacccacuaucccuuccucggucugccucuuccuaagggccaaagauagaguaggaaucgaagugaaggccucagcugugaaguguauuucuuuuuuuuuuaaagauuuucacacacacacacacacacacacacacacacacacacacaguagcugucuucagacacaucagaagagggcaucagaucccauuacagaugguuguaagccaccaugugguugcugggauuugaacucaggaccucuggaagagcagacggugcucuuaaccucugagccaucucucuaguccugauaaguguuuuucauagaaauaaacccaaccuucagauuuaauccuacuuccugauuagaacucuaugcuggcaggcauaguggcgcacaccuuuacuccuagcucuugggaggcauauacagguagauuucugaguuccaaguuagccuggucuacacagugaauucuaggacacacacacacacaccauaaaacaaaacaaaacaaacaaacaaaaccccacugccaugcuggcuucccaguugucuucaaggcaggagugugaacuuguuaggucuuuuguaauccaguuagaaccugcucucucaguccaagaccagacuugauccuccaggugucagaaucugcccuguguagugguggguuccacucucuuuaaaaguuuaguuuggguguaggacuucuaaguguauauauguguaggugagaccacauauugauugaggugucuucccucaaucauguuucuuauuuauagacaagauuuuaccauguaguccugaguggccuggaacucuauagaucauggagcucugccugccucugccuaucaagugcugcaguuaaaggugcacaccaccauucucaggaccccuuuauuuuuugagauagucucucacugaacaugaugcucuuuuauuuggcuauaggcugggcuacucuaccuuuccuccucuccucucuguaguccugggguacaggcuuuuuauguggauacuggggaucugaacucagguucuaagcuugcuuggcaagcauuaaccaaguuccccccagcccuuccccucacucuccugaagagcuuuucuucuuagaacaccagugcaugucaccacuucccuucagccacuccaugucagucuucacucucauccuuggcuccucaucuggggagcugggcuguagcagucagagaccuaugcugacguuagcagcuccauuccagagaugggagaguguugagugauugacuuagaggcccugagccucaauuuucuccucuugucaaauggcucaaaguguuaaaaccaacaaugcuuaaaacaaggcagagauucagugacuuacacaguucccagcuaggccaggcccaccuagaucuaucuggugagauuuugguuuuuguuuuguuuuucuuucuuuuuuugaaacagcaucuaguuauauaacuaaggaugguccugaacucauaacccucccaccuaagccucuugagagcugggauuacaaguguauaccacugcacccaguaagcuccucagaacaagggcugguccaucucacuagacucugccaaggaccagcuggcuccuucuagaagcaaugugcuggccugacugguaaacuaugguaacuaaugguccugaaucccguuaagguugaggaccuagucacuuugcaggcuuuagaguagcuggucacucugcagccauaccaggcucuacacuccucugccucuugguaucaaggccauccgucacucaccuggacugugguucuucuuccacugggacaaccaaaagccccgaaguuugagguccuuaaaaaugagcagacucuguggacacaggaagaugcacugaggcucugaguacuagaacuuaaagcaucacuucagguauagauccucgaauuuagacaacugcaguuagcgcaagaccagcuaagccuuggucugcagguaucccugacuuaccacagaggcuguuacaggcuguuuggccauucccccauaggucaccaugguuccuccgggccuguagaguucagagaaugaagagugggugcaggcaaaggccuaucauggccuaaggaacuugcuaaggcauuuaaaggaaccaauccuggcucucaaaaucacuggggaggcuuaaaaaauauauagcuucccaguuuuaaccucugacuuaaagaauuagaggcagggaccauaugucacacauaucgggcauagaggcauaucccaaccugccuagcuguaauguaauuuccuacaaugaacuggugaggauagcaugagcuagauuuagccuucgcugcugucccuguuccuugacuuucaguuuguugacaaaggaugaccugaggcauuuuuuggagaaacugaggaaaacagaaaaggacauaauggagucaacugcuguauuacuaccuaccuauugaucacagugcuaggagaauccuaggucuucacauguuaaacaugugcucuacgcuguauccccagucucccaauguucucucugugccucugucuccauguaugugugugucugacuacaucugucuguaucuguguagccuaugguugccucagacuugggaucuaucucagucuggccuugaacucacacuacuccuuuuccuuagccuccugagggcuaagauuacaggggugccucacaagcauggcuucauuuggccuaaguuuaccucagaugguucucacucaagaaauaaguuccuaauggaagcaagcccucucuccuuguaccagacacagcgcuaagcaugucaccuguacugucuccgugacuuaucagaguaacaucaagaaagacugaugucuggucuagaggacagagcugaagcucaucaugucugcaucgccucacugucccuuauacuacccagcagaggcagaaccauauuccuuaugcccauuucagagcugaggagacuaaggcuuggaucuucauguuuugccuaacacuucacaggucuacagcuagaaguagcagagcugggguuugaacccagucuuucuaaugucagugcccacauugugauuacuucuuccuuugacaauugcauggaggaugcagucagucucacaggcugcucgcugccugaacagggguguucuguaguuaugagaacucgugguuaaccguugcugucuggucaacuauaccuaaaugaagugaucacguucucugggcuucauuuuuuaaagcgaagauggggggggggggggcauagcucagugauggaacaugugcuuuagcaugcccaaggcccuggguucaauccccagaaccaaagggaaaagcaaaauaggaauuuggaauaguaagcucugccuauggcuguagauggcacgacagccacugcagaggcugacucucaacauagcuguguagcugucccagucuaagcucuaccucagcagcuuaggcaucucuucagcuuguagcuugugguguugggcaagucacugugcaggggccccacuuugcugagaaguauuucuuagguguccuccgguuggagaacagcacacagcgaguggagcuucucugcagugguggggaccaagagaaugccugucucuggucccucagcacggcucuuuuuuuuuuuuuuuuuuuuaaaagaucgauguauguauguauguauguauguauguauguauguauaugaguacacugcagcugucuucagacacuccagaagagggcaucagauucaguuacagaugguugugagccaccauuugguugcugggaauugaacucaggaccucuggaagagcaaccagugcucuuaaccacugagccaucucuccagccccaccucagcacuuuuauauguuucaaaauaucuugugagaaauaucuuaagaagcaguaagugaugacuccuggguuucuauggggagaaaaggcuggcuaggcuuaucacagagacgaggcuuuagagcacaggccagagagcaagauguccuugugcgccacugucaguauccuucuacccuggcuuauacucacacuuguaacuagacagcccuccugauggagaccugcagguugagggacuuacgcuaggugccggagcagcucuguagaacucuucccaccaacacaguugagagccaaucggggcagcggcagguccugaaaguaaggaggcuacggugagggggcuacugggugcucaugggguuagaagcugcuacgagcagcaugguaaggccaagugcugagucagaagagaaggaaauggagugugcaugacuuuuugggcuuguuuuuguuaugucugagaagggcuuuagcagcuucauccucucguccaucccaggacuuugggaagcacagacaagcagcaucucuguucagugucaagguacagagaaguuuacacacgauaggcuuuccuccacuucagcaaugcugucuagggcaaaugugcucaacacuggguaugugguucuuccauaugcuguagugcaaaaggccucagauugggucugcugggguggaugcucuaaagagguaccggcuucgaguucagagugauggggccagccucaccacuuugugaugaugugguucuaaggcuggugucucaucuaugcagcaucuaugucagcuacuuuguagaguuuuucugagggaugucaaguaaaugugaggcagaggcuuaggagcuucucuuccucucuccaugccauaguuuccucagacccucauccagcucggacucacaccugccauguggguugauggaccacaccacaaauguuuaaaaccucggcuuuccuaaagucugucuacuucugccuccuuccaugucugcacacuuacagcaugcuauccccaggcuaagguuggaugggcuuuguccuuuccagaagagaagcgguuugcagagcagagcagggaaggcauauuuuguaauuaccaggagauggcaugggauuaagggggaaguguucuuagcggggugccucagcuuuuauuuuacuuugugcacgugaaugugauugcuuugccugcaugucugucucuguaccgugugugccugggaccuguggagauccuuuggaacagcaguugcagaugguugugagccaccauauggaugcugggacugcaagagcaguaaguacucuuaaccgcuuaugcaccucuccagacccaggcuagguaccuugaagaugguuuuugucucgggcauccuuagcucuuccucugugaggacauaaucagcuccuagauccuucagucugucaguuagcuucuugaugucgggucuggaaaccaaacacaaucaggucacacuggcuaacuagccucccucaagcucccagaaccccuuugccacagcccugagaacacauuccuguuuugagaacagggauagagagagauuaagccagaccucaagcaggagcuguccacauaauucagucaugcucuaccagcucuugccuccuuuccuccccggacagagccaggcugggagauagucugacaaccuaugagugcacacacccuagagccaucugugcccggggaagagccauccuacuuccuccuucuacucagacaccacuuucuuuccucuugcucuccagggcacuugaggguaucaugcaaacacacucuggggcagagcgguccuggacucucugguccaggcacgcagaaucacuuuuucaucaccacugcagaggcaggggcaggaguaaguacaacccucguaagaaaggucucaagugacugccacacgggagcacacugagguuuaaagggacuggaggggacaauggaaagaagguaagucuguuacugacuugccgugucuuccugagcaagcugcuuccucucuuggaaacuugagcuuccucaucuguaaaagagagaccacaagccugccccaccuccuucacagcugugcuugguguacacaugcaaccgacagggcuagaguucauacaacaguacaaaccagggacccuaagacaagucuccaacacuccugacuguucaguaaggaccaucacugccucuuuuugucaucucugugucagacuuucacagggacuucuuuugcccugcggaaugcuugcaagucagcagccagccacucaugcuuacacaugugcgccaucugguggagauguaggagugcgcagggacaugaggauuaggccucccaguaccugucucggacaacguugauggucuuuaggcgaagggcugaggcgaucugaaugacugcuuggcccacuccacuguuggaugcauucuggaugacagaguccccuguggaagacacuaggucaagcccugcaaacuuggguugagggcucccagccugggauccuaguguggaugcaggaccuagcaacggcauuuccuuauacggugaacuaucacucaguuaucaacacacuuuccacaccuauaaugcgucacgggauuuggacacucuguccauguuucagauacugcuuuguaacugaccuucaucuucccaauuuuuauguccucuguccauccauccauccauccaucuauccauccauccauccaggagcacauuauuucuuucuacuauauaggcucagggauugaauucaaguugucaagucucaguggcaagcaccuuugcacgcugagucaucucacugacccaugcugaggccgagucucugguuugaaaugguuuucugguucucuuccuuuuuaaguucagcucaaguguggcuuccuucaugaagcucuccaagguuccuucuuguuuguucccagaggacucugguaucucaucaaugcucaggcuguaaccauguucuacacuaagcuguguucauauuuaucaauaccuucaguccugagggaggaccaucccuuacucccuuguguauuauuuaaugacggugcauuugaaauggaugagagccauaugagagaaaugggaagcuccugggcccuacagaauguuugcuuuugcuuuguggugcuggggauagaaccuagggacuugagcaugccaggcaaguacucugucacugagcuauauccucaccccuacaaugggagagcaauguggugcccuagggaagugugggcucuggcacacaguggagcugggugugcauccugcuuuaccaaugacuguaacuaaacagcuacaucauguccucuuaaaacuucaauuuuaaaaaacaggaggccugccggacaguggugguacauaccuuuuaccccagcacuugggaggcagaggcaggcagauuucugaguuugaggccagcuuggucuacagagugaguuccaggacagccagggcuacacagagaaaacccugucucaaaaaaaaacaaacaaaaaaaaccccaaaaaaaccaggaagccugggagcaccuuucagagcaucucccauugaaaccaaauuaguaggaagaugcucuguugacugggaaagugucugguuuugaaagucagcagcagucagugcagaaugagcuauagcuaguggcagacuccuaggucaaagaugcucauuuaccuuggcuccaaccuaucacucacuaguucauucucaaccaacuguguagguagacggcagcauugaucuguuucaguuagaguuaaggaguacaggaauacaggauaauaacaaagauagugaaggcgaguauugggcugccaaaguuggcuuccaugaucuguguucaucuaugcauauauucuauugaacagugugacauuuauucuugcuuuagaucaggucaugaguuugucuggccucaucagcccugaggcagcaaaguggagaagugggcugcuuauacuuacaguggguagcauccgaaggccuggcucuguuaagcacagaguugcccuaaucaggagugaccucaggaccaggacaagacaugaggcgcuggcuauagcaggacuccagcagaggucucucaucauaccuggcuuucucuaccaaaggcaccuaggacucccaucaugguccagggucuuggucaguggcuaucuaauuuuaucauaguccagcaguucuugccucaauuuccucaacaguagguaauuuuuccagcccuguguggcucagucaggcaguagagagagagagauuucacacagugggagggcuaggcuggcacaggucugugguagaccuacugcucggcauaccccaggcccugauucuauucccagaacuguaaacaagacagacaaagcucucagaagcaacagaaacaaacuggccagucuucugucuucuggaguuaauucuguagugugucauaugaagaacaugagggcaucccuagcaagacugaggccaggcucugccuuaaugggcaaagccuuaguggguucugccucccccccgucuugucuugcugacucauucccuugcuccugauucuagggaccacuucccuaaugaaaugcuugccccagcgccugcuuggccucugcuuucagaggaauucaguaacacucuggcugcuuacuugcugagggauuucauguaacagcucaccucucugggucuguucccucgcugaugaaaaggaagacugaacauucuguagucagccucuggcaucccugcucuccauauggaugagcaguuaggugagucaggggaggugaagccugggucagaacuuguuggccugggcuuggguacuuaaucccuaacaagggcccuuucugcaucccucugaagaugugacccuugcagagaggaugccugcaaaggcgcucaugcuaguggaagugcugagcagaacuauuaccacugaguucagcacuuuauugaaaacaguggcuauguuugucucccauggcuuuguguccccaaagcuuagcauagcucaacacauuuuugcugugugacaacauucuagcccuagcucugggaaaugugaccagcacuucuuacaguguguccucugaggguuuucuaggaacccaucgaacaucuuuuuacuuaagagcaguaagagccacucaguuagagccugucacugcccccagggacccucucuccaccaugugugccagcaaguccccaaguccuuugagccaggauuuuggugcaccccagugggaagacccuggcuugcucccccagcuuguagguuccuaccuggcugcagcuguucaaaguccaccaacauccuguaggcugugcagggguugacaccuaggguggcagcgcucuggagaggaauguccuuagggauuccaaucagugcuuccucacugaacaccgccucaguccgccagguuccugaaucaggaugagcaggguagugagagaggagcccugcacacccaggccccucuccuugauacaaggacaucgaggagagcagacuugggaggaaagaacaaagcucaugguguucaaguccucgugaacaguuacauguacggugauguaaaauaauaaagcaauuuaaauuagguuuugaaagucauagccugggggggaggguaugggggacuuuugggauagcauuggaaauguaaaugaggaaaauaccuaacuaacccccccccccccaaaaagaaagucauagcccaaagaauccugacagaguauagugggaaacacggagacaagacuccacugggcucucccucccuuuguguuugagucugaguaaacuuugucucccaagauucagauccucauacacugaacuggguggauacugucugccaucuacugggccaguguuagggaaucagggcggggggagguaaccucaagucucaaacauuaaaguuaccauaggcaauccuuaccuacaugccauuacuugguaaacaugaacaaacaaggcagaguggggucucaagcugcuccugacgcuggagaguaaacuaaugacagugaauguaacacagugucccuucauggccaaaaguagaguaaaggcuaaaagguaaaccugagaaagucaauuuggacagcuaucugcuaucucaaacuggauagccuuuaccacccugaaguuaaaaacuaaaagcaaugggcuagaaagauagcuccaugguuaagagcacuggcugcuccucaagauguucugaguucacuucccagcacacacaugauggcucacaacuuuauaacuccaguuccaggguaucagacauccucuuugggccuugucaugguuugaauaugcuuggccaagggagugguacuauuuagaggugugaucuuguuggaguaggugugucacuauaggugugggcuuuaagacccuagccuaacugccuggaagucagucuucugcuagcagccuuuagaugaagauguagaacucuuagcucugccuguaccaugccugccuggaugcugccauguucuugccuugaugaaauugaacugcaccucugaaccuguaauccagccccaauuaaguguuguucuuuauaagauuugccuuggucauagugucugugcacagcaguaaagcccuaacuaagacagaccuccgagggcacugcaugcuugugguguggacagaagaacuguaaggcugaagcagguucaaccuucccccacucccuuagaaaaucucauaauugagaaaagcaggcauuauaaccaguuucuggccagggucuaccuguccugaagcaaguaaccaugauacccccugagcauaaaaccuagaguucuccaugcuaaugaggugucuagauaggccugaauguuuagccaaugagcuucucuuccuggacauccccuccugcaaaagguauuuaaucccugguuaaccuugauuaagguguaugcauucacaucugccauaacaaagcagcuuggacaagcaaggacugucucucucacagaggauugccauggggggaggccuuuguuuuacagagacuugggcucaaccaccccuuuccagccuggugaguaggggaagggcaaaccguuggaccacucgaggucccuagcagugucuggguacacaggagauugagaaccacaacauccgucccagaucucaaugcuuguugccuggaagaacacaggcuggaaccccuagcguggacugcacccugcuuuccuuggguggcaugcuccggcaucccagcugugaggcagacagccugacaaguacacaaaugcuggcaaaauacuuaaauauauuaacacaaacuuuaaaaaaaaaucuuuuaagaggcaggguaugguggugcauacacuuuuaaucccaucacucaaaagcuagaggcagguggauucaauuugaggccagccuaguguacccugucucuggaggcaggggcagggggugggggugggaaaaccaacaaaaacaaaauguggguuauuucuucagcaguuuccacacucaccuuaauaaaggcucaacagacgaggcugagaggcgcuaguccucugcucuggcugugugguguuccuacuaucuuucuaccucuucuuuauuaaagcucucuuauccuuuccuuuggucucuacuucauccucugggggagugucucuaaccuuaggcuaccucacucauuuugggaacacuauccucuuguggcucccaugaagauccaucuggauaauagaugugccuugaaaauguaagagcuaagaagcagaacacucuaaugacuccuuuccauauauacacgaaaugcuauccuagcuuggcucuuuaggacugcaccccauguggccccacuccaccucuggaaccuucuuucucauuauguaaccucuccauaggcaaauccuuggcugaggccacacacuggauuuuccacuccccaaacuuccccugguguuugcucaucuuaccucuuccacaggaaaugccuuuuggcucauuuccgccuaacaacuucuccuaccacggacuuguucuaagacucucuuccacagucucacuuggaguuuccucacaaacaucucugucagaacagccacgauuacuucugcuuccuguggcuucgggguacucccuuuuuugagguaccuccuuccugacacuuuagucagauuugagccuucuggaaagugggaccaaccuuacucguaaucugcaucuaaccuuacagcaaggauauaaggaaucauauacucaaagcuccaaucgacagcgagccaaggagauauccacauagguaugucccuccagagcacaacaaacaggauucaacgccacaugcuggagguagccuauuaacuaacaacgaaucccacacugcucagcugcaccgagccagugggaaugcaucugcagucuaggaucuggaagaauaaauggcugcucacaccuggggacacuuacccaaacccgcauuugcugggaucacccaaucuccuggcuucaaugcagacacacugcugcccaccgcuaucaccugcccaacgccuucguucccuccaacagcaggcagcuugggaaggaggccauaguucccugggagagaagaagucagagugcaaaugugugguuuggauaaaagugucaucugcagacuccuguauuugaacacuugauccugagcuggugacacuuucuggggaggucuaggggguguagucuugcugagaaaguguguugaugaggguagaauucagucuucaaagcacugugcuauuuccaaugcuugcucuaugcuuugaguucaagacaugagcucccaguucccugcuucugugccugcugccugcacccugccauugcagacucuaacuagcccucugguaccauacguugaaacaaaacuuucuucuauaacuuguuuugguuaugauguuuuaucaugguaacagaaaguaacaacagucacacugucagguucggcugagacucuggagggcauagacuuuguguucgcucacauuugagcuuaucgggacccugcucucaugagcuguccacuuaaccaagcucuggccuucugcuuccuuaacuauguaggagcuaaaacucuuugggcacaggauuaccacaaggacacacucaaguaagaaaggagucuagcaugucacaggcucuucagaagggugggccucccaccacuacacuucaccuaacucacagagcgucaugcuuaguuagagguuggccagagaggagccgagcgagacugugcaugcugcuccucuagaggacagccacugcuaauccugagcacuucagacucuaccugagccaauuagcauaagcuccagagagcaagguuaccuuggaucauauuuaugucagauggauugauaggggcugccagcauccucacguggacgucagauccuuccacagcagugagcuccagguucuucagccuaagcucagaaagacacugucaguagcuaagacuucugcucaaacugucuccccagaguaggucagcaacaugccucaauugccgugugccuaggaaucugguucugauggaaaggaggugcuuugaggaccagcacagagugcaggcucacaccaacugcaauggaucaaucuugguauccucuuagugucaggaacagaagcacuagugagccucugcuggccuggccuuagguucuccacaaccugcuugguucuaaaaaucauguggugcacuauuuuuuuuuuuuuuuuuuuuuuuuuguuuuuugagacaggguuucucuguguagcccuggcuguccuggaauucacucuguagaccagguuggccucgaacucagaaauccgccugccucugccuccaagugcugggauuaaaggcaugugccaccacugccuggccgcacucacuauuaauacagccgcugcugaugcgugaaccagcaucaccaggugaggggaccccaagugguucuuucaaagaagcauaccugagaaacucugggucagcccuguccgcuguccauguguuguuuuguuggcuccaacacacaugggcaaaggugauauuucccuuacugcagagugaggugauagaaagagaaccucuguaucugugaagugucucugcugaccgugacucacaccccagggagauggcccuucugggcuggggucuuagaaaggaggugcagguggcgucuuagucaggguuucuuuuuuuuuuuuuuuccauuuuuuauuagguauuuagcucauuuacauuuccagugcuauuuagucaggguuucuauuccugcacaaacaucaugacuaagaagcaaguuggggaggaaaggguuuauucagcuuacacuuccauacuguuguucaucaccaaggaaaucaggacuggaacucaagcaggucagaaagcaggagcugaugcagaggccauggagggauauucuuuacuggcuugcuuccccuggcuugcucagccugcucucuuauagaacccaagacuaccagcccagagauggcaccacccacaaggggaccuuccccccuugaucacuaauugagaaaaugccuuacagcuggaucucguggaggcauuuccucaacugaagcuccuuucucugugauaacuccagcugugucaaguugacacaaaacuagccaguauagguggagaccuugaugucaggcucuggcauauuucuucucugagcuagccuacuugggcugaagguuggacuaucuaccuucuagcagcucucagaguucuguguggaacacaaggaccagacuuccgguccucagcacucaugucacagguaguuaggccaguuccuguaacuccagcacuggagguaaagcagagaaagacagauccaccgucagucagguuagugaaaauguaagcgccaaguucugugagaagccuugccuugaaaaugaagaaacaacugaggaagacgucucaaugacaaccacuagccucuaauacaugccugcaugggcgagcucacccacacauguaugcaagcacauacauggagaccccacacauguaaaagacuugccaggggacuuugagggaacuguuguuauuuuaaaguuuuauuuuguuggguugggucuagugguauaccccuauuccuguacaugggaggcugaugcaaagaauggugaguuugaggcuagccugugcucuguacugagaccuuguuucaaaaaaacugaagagcuuuuuuuuguuguuguuguuguuuuuguuuucugagacaggauuucucuguguagcccuggcuguccuggaacucacucuguagaccaggcuggccucgaacucagaaauccgccugccucugccucccaagugcugggauuaaagcuuuuuauccuaaaauuauuuagaauaagagggugcugguuccucucaaacuagaguuacagucuugcaagccaccacguagauccucugcaagagcagccagugcucaaaauaaauguucuuuguugucuuacuuuuaaagucaugcguguuuaucuguguagcucaguacaggggucugugaaggccagaggcguucgagcccuuggagguggaguggcaggaggggauaugcugcuugauaggaguacuagaaacaaaccuugguccucugugagagaaaucugcacuuuuagccacagagccaugccaucucugcagaggcuguggagggcugcuuacuggcuugcucagcuugcuuucuuauagcacccagggaucacuuucucagguggcaccacccauaggcugggccugcccaucaaucacuaauuaagaaaaagcccuaaaggcuugccugccuauagcuugagcuuauggaggcaacuucucaauugaggcuaucgccucucugcugacuacagccugugucaacaugacaugcaacgaggcagaacaccugcugacuagacagcuccgaucacugcagugagugccugugacugacuuuucaaugacugaaaacuccuuuccuuuccugaaacuuaaugcuucaggucugcaaugcuucucugcacaaauguaucuacaaaguaauaauuuuccucuuuuacuuagcagaaucauauauaauugccagccagaggcuccuagcauguugucacaguauccucacacuaagcugagguaauucaccugcuuccgccauaaucucaccuuuuuaauuagaccuaaggcaugaucuuaggcuaaaagugugauuuuuuuuucaaguaaugucuuauacuaagaguagcaacagaggcauauucuacaagucugcucucaccaggcucagugcugagagcuuuccacgcaaggcuucugugaaggauguguuaacaguccaugucuacuaggaagcacaguuccuggagauucugaaguguacacuggcgagucaaagcugacacugauuuacauggcugcacaccaacaucuaggugaguuuggaaguccugacagccuacaagaaccucagagaacuuggggaacauaaacacgaaagcuaggaacgcuggacucagagaaaagccaggucucacugugauuaagaaucagcuuaaaaaaaaaccacagaaacgagugggacaccagggacaaguauagacaaaaaggcuuugcaaaagaaucguagugcuaaggaaguauguguguguguguguguguguguguguguacagcuggaggagggaggagguccucccuauaauaauaacugcugcuuucugaguguucaccagccaggcuuccugccaagugcuuuacaggcaggccagcuuccacccuauuucaauagcuugcagacuauuguucugcuuuuauagcugacgaacaaaagcacagaagagguaaauaacucgcccaggcugcuaacagugguaggugguugaucugaucugaaccuggccuucagaugguaaaagaagccaccugguaagccuccaacccaagcugugaaaugagcccugaccugaccuggccuugcugcacuggcugaggggagagaggagggugcuggcacugccagggucuccccaguggaccuccuugggaggccauacgugguacuuccugagagucuagucuguaucccaaagcaaaguccagccuggagcaagcagguuugcagacuagcugccucugaguuauccccauggcuucuccugcauccugacagauaaccagacuugucuuguaagcugacaaagcccaggagcucaagcugcuuagauacagcuuuucuuuuuuccugcacuuuuuucuacacacuccucccuuagcaaggauuucacugccacaguuucuccgugaaaugaaaaauucaaucuagccuucaagacccagcucaaaauguacuucugcagcucuuccuggagcuguccacuggaaauggucacuuucuuacuucugcuaggcagcaggggugacuauaccacuuaagaucauugcauggguuaugaaguccuuccauagguguuuuuuuguuuuguuuuuccagacaguguuuuucuauguguaguccuguuggcccuggaacuugcccuguagacuaggcuggccucaaacucacagagauccaccugcuucuggcuccuaaauuuugggauuaaaggugugcguaaccaccgccuggcuccauguauguuucuuaauugaucaaggcauagguucaagaucucuuuucuggaguucuugggaucugauguccuccagaguuaucuauauuccggagggcugggcagcccuguggucggguacuccugcaucaagaggcaugaauauucacaccagaagaacagacagugacaaucugcuuuccuuccaaacccucaguuuucagagcuucuugggaacuauggaaagaguuuggggauccuucagacucggaagccagaauccuuuuuaguuaucaucugguauguguguguguguacgcgggcacgcuggggcgggaugggaggugcuuaguuucuccuuggugauuaucaaguaucgagguccaaacucaucuccagugagagauguggccuaagagugaugacucccagacuuaguuugggcuccuggcugagcaaacagagaagaaggauggagggacugacagugggcagaaaggugcuguauuugaagucugauggaggugacuugggggaugggcagcagacuaugcucuggcuagacauaaagagcugccagcccacuguguauuaaaccuuaccucuggccaccaggcuggacaacaaaaggacagcuagcugagucuucccaagcuugucaaucugcaucuacagguuccuuaucuccccagugcucaugcuucgggcaucacaucaugcuaauuuuaaaaaggaagaaagcugagguucagagaaacuaaguuagcuggcuuaaacaaaagcagcaagacuugcucuuaaacuagacuuggggauucuccuaggagacaucagcuuuccuuaggauucaguacaucugaggagcacucccugccaguucccuuccuaagggucagcaaacacaccaugaaggcuuugagaaguccugcaguagaggcacccaggaggcuugguccagcuccccugacuggaacacgauuuucacagaccuacucucaagaguagauaggacauugaacugaaaacuaucccuggucucaucuggcuccuggaaggccugucagagauuuacagaagagggcagaaaguagguagagacaggcagggcagaaauuagagucugggaaguggaagccgaguacaccagugggugguggugggaggcaggcccaauacuugcuuuccuccuggggugagcuguguugguccagcuguaucucaucaggaaagaccagccccagccugcccucauggaaugccaucaauaccacagacacugugccugcagacaguucuaacagcgucgucaaggauaccgcugcugagacaagaaggaauacaggaauacagggaagggucugaauuccaggagcuggcccucccuuuggugccacgauagcaauccucacuccacuuguuuuuuuguuuguuuguuuuuuuuaauucaccgaagggaacgauggcuguguugcagaacucaacugaggcccccaaacacaaccuggcuguguugcaagucaccucucagcacuguucgggucuuuccccugugagucugaugacggcgccaggcaaugucgagggcugccacugucucagcugacagaucccaggcuggauaaggucacaauggcuccuuugaggcucaggcuguacaccugugaugccauaucaaguacaagagaaacaaaagcaggcagaagaaagagccuuuugagaggggaaagaaagaucccaguccccgggggacugcucaguucuaucugcuggguaagguagacacuggccagcucugcugagcgcucuuuccugccucccauguuuaaucagcagccauuuguucuuucaucuuucacuccaucauugcaaauaauuuuagucagacccgacugagagagcacauaaccgaacagaccuccccaucugcucagcacaugaggcaggaaugugugcccucauauagcacugggcaaaggugacugacagcuccugugguguugcucaggucuguauguaguccucaugauuagcagguugccuucugugauuuaaugaagugcuuaggaugcugagacuuuacuaauuaacaagcagaacacaaguugcaaaugggaggaagaugguuccucaguuccugaccacagcaggguguguaaguggccuaagcugguggagagcuaaccgagucuuggacucuuagggaccagagcucuuugucacucaccagccuugcugggccucuucuggcuuuccuggugauccugcccaucuucuugggacucauauuuugguccgucgaacaaggacauacaggaauacagggaugggucugaauuccugcggccccuuggccccccuucuuuuuugagggucuuaguauguuguccagccuaaucuuuaacuccugggcucaaacaagucuccugcuucagcaucccaagaaacuggagagaacuuaguucaaugcuugcuacuugguagguauacaauaaaugagaguuauuuccauacuaucacuaaagagagcagcauucugagggaacacauuguaggaugggggaggggcaggagggucuagggaggaggaaagaaaaggacaucuggauuuccagaccucugugguacagaaucuagaagucugcacagagaacaguggcucuggccaccucugaaauguccagaauccuguaagacucugcagccugauuucauacuuuccccccaccucccagagcacuggcccacaguacacaacacaccugucugggaacuacuguuuggauuuuggauaguuucaugaucuucuggucaccaggcccagugaugcccagacauuaagaugggaaaggaacauuugauucuuugguggcugugggcacuguaaaccuuacacaggacuacaaagggaaucucgaucggucacuggccucagcccacaugcaaaguugucugaaucugagucagaagggaaggucaggccagaccagggacaaucccuacugccuggccaucuaucuguaggcauugcuccucaacaauggcuaggcaucagucaccgggaggccugaaaagcguaaauaaauggccacccuaggccgagauagacccacugagcacuuuagaggcagagcccagaaguaguuuccaaauguagcacaggugacagacugagcugugaauccaggcugaagagaaugcucugaacuuggggaaauaacuagaagucuacauagaagacaaaagcugcuggcuuuuuuccuggaggcaucuguagacagacugggcuguucccagcuucccuggcacucuaacaggaaaccaaucaggaggccacugcacacagcuguuuaaccacccaagccuuccuuaucaccuugggagaaugcaauaaaaggugaccuucuuaacgaaaugagcuuuggguucggcuaacaugacaggagcaggugcuuugcagcaggcuggcgagggacacaaaugaugagccuuugggagcaccaccucacugcucucaguuugaguucauuucugaaaauggaggccugcucauaaggacuuuaucaccucacugcagcaaaaucuccagggaagugucuauccugacaugauugauucccuaugagcaaaauacaacuuauggcugaugggucagcucagcagucggagguacugaugcccagaccugauaccugagcuccaucaccuguucgcuaaagacggcaggagagaacugacuccugagagcuagcgcgcucucucucucucucucucucucucucucucucucccucccucccucccucccucccucucuuaaaaucaaauaugagauguuugaucuuagacaaauuagucaaccucugaaccucuaugucuauaauauccucuuauaaaauucuguuggaucuuaauucauaauuuccgcaugugagcuaccaacuaauuacacauaucuuaccagucaaaagagcuguuaagguugucuggaguagggcuaaggugaaagcaccaaucugggaauuagggaaucuagagucagcucuuugcccuaacuuggcuuagcugaggguuuggcaaggucacuucguucucugggccacaucacaaauauaccauacagggauaagaaugaacaaaugucacuccaccaaaaagccccggaaguuuccccuguggugccuuuauaacuccuugauucacagcagacagaauuacuguaaugguucauguaccggcuaggugcuuugacagucagagaggagcuucggauaaacucaggggcaugggcccucuggccacacccacucuagaacaauguaaaagaauaucaacaauaauucaaauuccuugagaaccuggggggggggggaagagaggccacaaauuccagaucagccugggcaacacaggaacaccuugucugaggggagagaaaggaaggggagcaggaacaguggggaacacaccugcaaucucagcacuuggaaguuaagagcccagccucuguuuaaaaagggggaugggguggguagguuuggaguugcaagccuuuaaucccagcauuuaggaggcagaggcaggccauccagggcuacaaagacccaaucucaaacaaacaaacauacauacauauaaccaaaggagcucccucccccauuagaagcaggcaacuucagccccagugcugggggcuggggguggcagagguagaaggaucacuagaaacuccaggucagccaaggcuacucaacauguucuaggcuagcugggaccauacagggagaccuuaagaagggaagaaauaauaauaauaagaugcauguugguaagcccaacuuguccacuuuuuguuuguuuuugaggcagggucucaauauguaguucaggcuagcauuacauucacaaucuuccucccuuagcaagugcugggacuacaggcacacaccaugcgcauccccuaaacuguauuugaagauuuuuuuuuaaauuuuuauguauuuuuacugugaguguguauuuugagacaaaggcucauuaugcaacccauguuggucucaaacucauaacccuuuuaccucagcauccugggauuaugaaacaacuccuuuuugcuuguuuguuuugagacagggucucucucuauaguccuggcuauccuggaacugacuauguagacuagacuggccuugaacucacagagaucugcgggccucugccucacuagugcugggauuaacggcacaugccaucaagcuggguuuaaacaacucgucauaauuaggccaagaugcacacauggcuugguggaagggaacucgcaugagaaacaggugaauuccggcaccuauuccaaucacuaauuagccguaucauuuuagacaagccccucggccucugugaaaggcaaacaauaaucuccuauuuaaaaacagguguagaaucuagguaggcugucagaccguauguucaaauuucuauucucacuggcugggugacuuggggcaaauguuaauuuuaacuuucuuaugccucgcuuuucucaucugaaaaaaaaaugcaauaaauacccccagacuguugcugugacaaauagucggaagcauccacugagacaaaggagugacugccacaaucuucaaaccaauaugggucaguaaacucuggcaccggugccucgcggguccuuggccgccggaaagcaccggugucgggucagcaagcacgcccuggggucucggcaucuguaggacagcagaacccucuuccucggacccuguccucuccuggcaguccgccgcccgccucaaaacccuccaggaaccccagcucccuccccgguggcggcgccgacucuuacuggacgaccuuggcuggauccccaugguugccauagaccagcgcccgcacccgugacggcucagagagagcggaguaggaggaugugguccggccguggcgguaccaagccucgaggagacccgcaagcugaggugcccgggcucgcgccccugucacucgcuggcugaccaacaugcugcuuccagcacuggcagaauccggcgcucu

SEQ ID NO: 2157 - RNA, 4918 nt, Mus musculus
agucaaaagaaccaccacagguucuagcugacaagacauucuccuuaacaaaguuccauagccaagggaccagaugggcacggaccagaaucuauaaaauggccaagacaggucuuucuucuuuuaaguucauuuguucaggaauuagucacagcaaugaaaaauuaccaacaugaaguaaaucaucugauuggaaaaaaaaacccaaaacaaaaacuaaugauacauagcuaaauucaagacucaauggagaccaaagccagggccuuaggcuugcuagacaaguacucuaccacugaguuaaacccccaacccaagcccagggucuugaaccacacugcagauaccagaccaucucuaaaggaauauucauauacuggggugagaaaacaggaacaaucauuacaaaaaauaaaaccuacuccugaagagguagauuuuuaaaguguuauuuuguaauuguucugauagccuaucugccaaguugcuuucaucacucuaaaugguuuauaaacucugcaggcuggugguauugugggucaguggugcaaggcccuagggccguguagcccuggcuguugggggaacucugcagaccacuaggcuguuccugaauguagagacucaccugccucugcuuccugaguaccaggauuaaaggcaaguccacacaaggucuugaaacauuauuauagagcuaagucugcuaagcugcuucccugagcucuuaccauauccuuagccuaggaacgggauaccuagaaaacaauacaaacuauuucguuugaggaucaaacuauacuaauuauaaccucccugucauaacuaaaugguuauuuuaaagaaaaaaaaaguugcuuuccuuaaagaaguuugaggcaguugggguccacaauuacaccucucuuucaauuuucugucucucaaaaguuuuacacuaaaguucaugaagcucaaacacaaacuaaaaacaggugcacaguacucauuauuacuaauucagaacacaucucuugggacacagaguaacaugcaucaccauguccauuaugcacacucaucaaaacaaggauauacucaacaagcagagcuacccaaauccacacuaaagccacacaaaaccagcucuaaacaacacagggagcagguugucaggugcuuaauaaagcucacuccucugggaccaucuuggcuguuuacauguugcuccuaacuacccuggguagcaagcagucuauucuauucuuuuccacuucaacuuuguuaaagaugccaaugccaugcuauuucuuggagacagauuucccccaacuggccauuucauuauuuuuugcaaaacugucaaguucuuuuugcucuacugucucacugcaccacaugauacaugcccugagucuugcccaccuugccaggcugcuuucaaagcucccucagugccccuucucucucugggucuuggaguuucuccuggcacuagcuguuaagucuuuggcuauuuccucuagccuggggcuuucgccucagcucagaaaagcuauccaggggcuugccuuagaauauggcuauguaaauccagagcacaauccagcccuuuccgugaaggauauucuaagaucagaggcugcuaggaugacaagacacugaaaugugugcugacacugacacgcauccuacuccagguagcuaggacagccugagaguuaaccacuccccauucucuaccaaggccagcauuauaaaaaguacauccugucucacgaugcgcuuuaguuuauuagaagccucuagaaaagacuacagggugaacagacuagggaacccagauuaccccugugggcaggaaaggagaaacagacugucacugcaaugcuauggcuggcgugugaaugaaaauaauacgcagcuucuagagcuuucgaaaauucauccuguaaucuuggccugucaaccacaggccucaguuuucauauuagcacaaaccggggauaccauuaguuuauaguguuuugauauaguuagcugaaauagaaacuauacagcuggggagacaggacaauggcuaaaggucaagccuggcagccugagcugaauccugggaaaccacaagguagaaggagagaacagacuccagcaaauuuccuugugauuucuacacucgugccauagcaugccaccacccccauaaauggauuaaaacaaaauacaaugaagcuguuaauauuuucuaguuuuuaagaguucaguguuagcucacacuuguaaguaccacucccuauauuuucucagauaugugugacacauuuuccuuuugaggaugaaaaauacaauugucuguguaaaguuaccuacaagcaccucaaaucuccacgaacccaaaccacacguaucacccagucaccacucugugcuuuagggaaagacaccucauguagcucaccucaaaaagaaaaggaagaacaagacauuaaacaaaguuuuaaaugucuugacuaaauaauuacauguaauguuuauucauaacacaaaccagggucuagcacccaagaggagagaacgugaaccaggauaauuuauguuagaaauauuuagauauaauuuauagccuuguuuauugguauugauuucccauguuuugagaagaaguaacauaauaaaauggaccgcauuuguaauaguuauacaacuauuaaaacaaugacagaguauuacuucauccacggucccaucuuuuccuuuuuuuuuaaagacaaggccucacagcuccaggcuguccucaaacuuuccgaggagccaaagaugacucuguuguauuccugauucugcagcuuccgccuuccaagugcugcgacuacagagaaagccaccauaccuggcuagcuuuguugauuuuuugagacaggauuuauuuuuucuuuuccuuuuuccucuuuccuuucccucccucccugagacagggacccauucuuuacauugcccagauuggccuucaauuccuggcucaaaagauccccaaaguaucacuucaagcagcaaagauguuauaacaguaccauggcucaguaacagugggguggccacgaugcaugcacucuuagccacugcugccuuucuuguaacugguaugguuauuuuuguuuuugagacagggugucacuaugugcuccuagguggccuggaacacagagauuuguuugguucugucucuugggauuaaaagugucuaccaccaugcauuaagaacuuugugugucauuucuugugggauuaaugaauuuugcuccaugaaaugugucuuaagacacagugccagaaagguuuucaugcaugacauccaauacagagcuauuuauaacagcuaguauuaggggcaaccuagggagaauagcuaggcaaaguacaacucugcuagacaacgaauuuuaggcaaccaacagugaagauuucaauauaacaacaaaaacaucacacaagccaaaguagaaaaaguggcacacaacacauggggauguaccucaguugcuuagcaggcauaaagcucuggguuaaacccagcacuggguaaaauggaaaagguggaccacauucuagaauucuagcacuugggagagguaggaauaucagaaggccaagucauacuuggcuacacaguagguuugaggcuagcccugacaaccagacagguugcaauaugcaguccagacagggucuugcuguaauagguaguagucccgacaggucuugaacacacaaucauucugacucagccugguaaaugauaggacuaccacaguauaccaucagaaagucucuaaagacuuuugacaucucuuuucuggcuuuuacauuaaauuaccuacaagcuauacauauuguuuaagucaaaaguuacuuugugaaggacucaauucuccuaggcuaaauggaaaaaaacaccccauagugcuuaaaaacaguauacuaaagucuaaaaguuuaaacaagggaggggauggagcuagagaaguggcucagugauuaccaacacugcugcuuuucgggaccaccuagguucagucuccagcaaccacaacugucuagaacacugucuaggagaucagacagccucuuccaacaccagacacccaugugguacagacauacacguagggaaaacacccguauacauacaauuagauaaagcacacaaccuauugguuuggaaaucaaggguuaccagaaaacauaagaaugcauauuuauuuuuaugcccaaauccugaaaauaugcaauuuuuacauaaagaauauuucccagugcuacauaugcauaaaauagugaaaaccaaauauaaucuaagugucuucuaaccuaccuuuaauugcauauauuaaauagaauuuauauguagcauuucuauauaaucacuacagaaucaagacuguagagguaagagguauggcucagugguagagugacuugccuaccaugcauacagccugagguuggaucccuagcacaacacaauucaucauacaaggcagguuguuggaguuagagaauauucacaaagccagacagaccagacuuuuaggcaaacaggcaauaaugugccaccugaucccaaguugguugaaaaagggggagaaaaaagaagaaagcgaagcaaggaauauauguauacuauauagcugggcaugguagcauugcacacaccuuuaaucccagcacucagaaagccaaggcagguggaggaucugugaauucgaggccagcuuggucuacacaguaagacccugccucaaaaacaaagaaaacaaacaaaaggaagaaagaaauguauguguggaagcuguagagaugccaggucacgucacaugccccaacugcaggcagggucauuucuggacgaccuugccuccuccuuucuuuguuagaaaaa

SEQ ID NO: 2158 - RNA, 1098 nt, Mus musculus
cagccggcccggggcgcagcgggggugcagggguccgggccgggucugcagggccucgggccggggucgcuccgugcuaggcccgggacgggcgccgcugccgcuucucuccgggacaccggggaccgagaccggacgcccggaccccgcugcccgcggccucccggcgccgggaccagggcacaaggccuccuggagcggcuccagcgugcggccccgaccccggggcggugcuguucuggcccggacgcggcccacggaggccucgggcggaggaggcuggaaaagaggccaggcggcgggaaagggggaugauucauccccgggagcccgaaucggaaacaccgcaaucugggaacagccuugccugggccggcgagcgauccaggaggagaguccguccggcgaggaccugcguccagcacuggcaguccccugccuccagccccggcucuagcccggccguggggggagggggaggccucuucuggaggaguggagaagaauccuggacaaaguccgccguugccuccucugcucugacuggcuggucucggccagagcgguuuuucccagagucuagcucaagucucuccugcugcagcuccagugccggcugaggaagucugcaaggagggggcgagcaaggagaagccggagucagagacaccuccgccggcccucgcugcgguauguaaagcgcaguaagggggagguggggcgcgcgcgcgcgagccccgcagccccgggcgauccgaguacccccuccccugguuacuucggggcggccacgugcgggggguggggucgagcucgggagguacuuaccccggccgcgaucgcaaggggggcccgcgcgggugggcgggcgggcgggcgagcagagcgcgcgcaggcugcaggagccccgcagccccggcugcacccgagccccgcagcccccucccugcgcaccgcccgcgggcccggccaacgcuggcucccagcuccgcugcggaaaacccgagcgggggcggcucccugccuugcggccccgggaaaauccggggguggccgccagggaucuccaagcggccggccgaggcggccccgcgcauc

SEQ ID NO: 2159 - RNA, 5198 nt, Mus musculus
agcuuccuaccggaagugcugaagggagaguuuggcgguuucucuggcucugcgcuggcggcauuugggggugcggauugcgggugugcacgcguggauuuaauuccagcuuuacaaggaucuguagcgcggacggagacguguugcuaguguaagugcacacgugucccggcugcccgcgugggaggaccgggacagucacucuaacuucauauuucccgccuggcucauuugcagaggcguucucauaaaggcagaaccaguucuaguuacaucgcucgugugcccuggggccuuucccugagucugcauggccuccgcauagagugaaggguggacaagguccuuaggucucccucggaucuuuucuuuuguuuuuucuuugagacagucucacugugaugcccuaauuggccgggauuugcuauauagaccagucuagcccgaagcugcagccguccuucuaacucuguccccaaguauugagauuacagauguuccccccaacacagccgguuuuuauuucuuuauguuuggaaacgaggccucucaguguagcccaguguaguuaccauuuuugaauaugaaugucgguuucuuucgagccagguagugggugggggagacgagggcugugggguuaaacacccuuggucuuauuuuaaacgagacaguagguuucggaacaagagguuacauagcugccucgagauuacauagaaaaacguuuauaagguucagaacuugauacuagauggcuauuccguaucuccggagcuagaaccccucuuauucccgagucacccguucuuggaaccggcuguauaagcagaugugcaaaguuaagacugaaugagcuuugguuucaaggccacugccgcagcaaacaggguauggacaagugugacuuuuccagguggauccugugcuucuccgguuggaagaucuguuugcaguucuguugucuugaaccuaauuagaggcaucauggaggcgccuccagucaccaugaugcccgucacugggggcaccauuaacaugauggaguaccuccugcaggguaagucagccaaggagcuuguguuaccaaguuuucaguuuuuucuggcuagagcaaguugagaugacuuauaggcaacuguaggguuccuguaacuguguuuaaaagagggugggugggaagauggcucaauggccagaaacucacucuguagacccuucuggcugcaggggccugggauuauagauauuuaccacuauuguccuauugucuguucucucucucucucucccucucucccucucucucucccucccucccuugcucuuucuuucuuucuuucuuucuuuccucuauuuuuguuugucuccguauaguucucgcugucuauagaccaggcuggccucgaacucagaauucagagguccaucugcucugucucccaagugcuugggauuaaaggcacaagccaccacugcaugacuuucauuuuuuuuuuuuuuucaucuugaaaaauuaaaacucaggcccgaggagaaggcccagccguuaaaagcacuggcugcuucuugguucaauucccagcaccuacauggcagcucacaacuguguguaacuccaguugcagagaauuugaugcccuagucuggucuccauggauucaggcauacagguaguucacagaugagcuugcaggcaaaacacuccuucuuacacauaaaauuuaaaaacaaaaaacaagaacaaaacaaaacaaaccaaaaaaaccucauaccgagucucccucucaccucuccacuguguuuccuaccuuagcugcuuagaugccccacaugagugagguccccaacuggcuuauuucuccuagcauuauauccuugauaaagucauguccuaugacagaauuuauauuguuuuuguuguuuggaagcaguacuaaggagcccaggcugauuaauuuuuuucaaguaugauuaaaaugauucuuuuagauuuuuaaaucuuauuuuaucuguaugagugucuugccugcaugugugggagucagaggucagacaaguauguccaguucccugaaaaggagucguggacgauuaugagccaccgugugggugcugguggacaccgaacccagguccagcacucuuagcugcugagccuccucucaaacccccaggcugaccucuaacuggcuggguguccaggagcaguguuaaccucugaucuucgggccugagccuaacugugugcaugcgcugugcaugcugacugggcugugucuguuguugaguuagcauuguuauuucauaguucauucauuucgguacgugucuuagcuuuuuguugcuccacggccuccauuuuaaauguguauaugagcacaucacagugcccucaccucuccuaguacaguugggcugggcaucuggucuccuucucauuuuugguuacaaagaaaacagcugauacaggucaggggacauguggugguuuuaucuuuauauuuauuuuuggagcuucaguuuuuuuaauuguuuuuuuuuuuuuuuaagauuuuuuuguuuuguuuuuguuuuuguuuuucgguuuuucgagacaggguuucucugugcaguccuggcuguccugaaacucacucuguaaaccaggcuggccucuaacuccaacucggaaauccaccugccucugucucccaagugcugggauuaaaggcaugcaccaccccugcccagcuuuuuuuaagauuuuaaaauaccauuuuuaguucucugugcauguguuucaggggaugguacaugcaugcgaggcaggaggugcugggauccuuggaguuggaguuacagguugugagccacuugauguggaugggauugaacucuggccucugcaagagcaguacaaacucuuuaccucugagugguuuucccagccccagucuugcagcgacucuauugccucagacuccugagugccugcaugccuggcucaguuaaauaacuguuuaaucuuauuuaaucuuuguuguuguuuaauuuuauuauuuuauagugcuaggaauugaaccccgagccuucugugucaguccucagccguuaagcuccaucccucagccuugguccucuuggugccuugaucaaaccccagcaaggccuugcaucuggagcacauggucucucacagaucuacacccagccacaaugauuuauuuauagccaaugcaauuuuuccauuuguagaacaaauucagauuuucuuuuucauauaauuauacuucagaacaagaagccgggcauggugauaacaccccuuucaucccauuaaggcaggcaggugcuggagcaguagcugagagcuacagccugagccacugacagaaagaugggggcccgcuuuugaaaacucccacugacacaccuccuccaacaaggacguuccuccuaguccuucccuaaacaauaggaaguagagacuagacauucaaauccaggagcugugggggcuacugucaugcaaaccacuacccggcauuugcugcuaagucagacaaccuggguucaaucugggacccacagggaauccguucuagcggguuauccuccaaccaacauuuaugugccauuguauucucgaguuugccgagacaagaaugacuaaauauaaaacguuuugaauagacaaauaaauagaaucccauggauuguucuuagaaaacguugcauagaacuauuuauuugguguguguaucuuucgcugguuucaugacccuaaaugaaaugaaagccgggacucacugugcuugugccucuucaggaaguguuuuggaccacaguuuggaaagccucauccaucgccuccgagguuugugugacaacauggagccugagaccuuccuugaucacgagauggucuuccugcuuaagggccagcaggccagcccguucguccuaagggcccggcgcuccauggacagggcaggggcacccuggcaucugcgauaccugggacagcccgaaaugggagacaagaaccgccacgcccuggugcgcaacuguguggacaucgccacgucugagaaccucacggacuuccugauggagaugggcuuccgcauggaccaugaguuugucgccaaaggacaccuguuucggaagggcaucaugaagguugugguguacaagauuuuccgaauccuggucccagggaacacggacagcaccgaggcccugucccucuccuaucuuguggaauuaaguguugucgccccggcugggcaggacauggucucugaugacaugaggaacuuugcagagcagcucaaaccucugguucaccuggaaaaaauagaccccaaaaggcugaugugaugaagaaaguuugucggccuuuuaggccuguccccaccugggaggugagagacuucgaaaguagcccagguacugcugccagccgggcccacuuccuuccagaagaugauggcgagaccugguuccuuucaacuguuuccuucacuugguaaugucucuuuuuucuugcaacaggguuuuaccauggaauucacuacauaaacuagcuacccuggaacucaggacccuguacuucccgccuaagugccugcaagguccuuauuaaaccugacuguucaucuucuugauaggcuuuuccaaugaaagacccaggauaauauggagauuuguucaaguccucccuccacucaaaaagagggaacuggaauaaauuagcuuuucagaggaaaggucaaaaaacaacucauaauauuuugcuuuuuuuuucuuuuuucucuucuuuucuuuucuuuuuuguuuuuuuuuuuuguuuuuuguuuguuuguuuguuuguuuguuuguuuuguuuuucaauacaagacaggguuucucuguguugcuuuggcugcccuggaacucacuuuguagaccaggcuggccucaaacucagaaauccaccugccucugccucccgaguacuggaauuaaaggcgugcgauaacacgcaagcccggcuguuuguuuuuuuuuuuuuguuuuuuuuuuguuuuuuuuagagaaacauuuuuuauuccuuuauuuauuuguuguuuucuucauauguuuuaaauuguguuguuuugccauugauauacaagguuuacaaugguggugugagccagcauugugugguaauaaagacugaaaagacucag

SEQ ID NO: 2160 - RNA, 3188 nt, Mus musculus
ucuuucucaguagccuaggcuagcuuuuaauuugcucuguagcuaaggcuagccucagacucaagauccacuugccucagcuuccugcaaccuuggauuauagguguguaccaccauccccagcagaccccaaaauauucuucugccaucaagcacuuguuggaagcuaacuucgaucaccuagaggggacaaaaccaucagccaagguauucccucugcuccagugcaguucuaaaaggacuuagcuaaaacauucagaaacugacacucuuggggaggaaggaaaguggggaggggagggaggaaaggaaggggcggucagcagagucuguggaaaacuagaggaauguagagaaguucuccaacuguucucagcuuccaagaagguacuuuaguggguggggagugcucuuaaaugugcugccgcugcuguaauagucuggaagagaaguuucugcuccgacauuggaaaucgcuuuggaggaccccgaauuucuucuuugugaugccaaucacaacugcaauguucaguccugaguugaguaacaauccuacaucagccuccuccacuugcaggcaaaucccaagaguggcaacuuugucccagaauuuaguacucuaucuccagggcuugguacucauuggcucggcagccucuggugagugagcgaacagguguuaaagaugucaccucuccagcucugccuccaaccacugguccuccaggggauucaaaggugugaauuuguccagcaugacuuaaucuccuaucugccugcccuagggcucugaggacucucugaaagcaagcugcaggagauuccuucugcuccuucuucuacuccagauaaaauguugcagugugcaaacaauuacaacuacaaaacaauuacaaaaauuguaaagucaaacaaauagauaacuauuaguaccuaguaucgggcuaugcugcuuguggaucaagagccguugauuacaauacugcggaccagaacagccaagaguuccaguggccaggaguucaaggccguguuuagcuacaaugaaaguucaaggccuccacaggcaaaugagaacaccacccucuucucaaauaaaacaaaauaaaaauaauaaagagaaagaaggaaaaagggggggggggggaggaaaucuagucauagcucugucuuucacaaacuccaagcaguuugguugugcccagguccugaauuguuggcugcaguaauuuaaaacaaauucauuacauacacccuggagcugagacuuugaaaguuuucaggucugugugcuaauugaauacaacaugcuuuuuaaaaaaaaaaaaucaaaaugaagcucggccauugauggcacguaucuuuaaucccagugcuagggaggcaaagacagguggaucuaucuuugugaguucaaggccagucuggucuacauggagaauucuaggacagccagggcuacaucgugagauccuugggcucaaaaaugaaggaaaaaagauucagauugagagcuauugaaacaucugugugcacagaugacugaugccaaaccugccccagguuugagccuuggguccugaaugguggaaagagagcaucaacugcuucaaacugucccucugaccgccacacccacaaaaaaaaaaaaaaaaaaaaaaaauugggcccggcguaguggcacacgccuuuaaucccagcacgugggaggcagaggcaggcggguuucugaguuggaggccagccuggucuacacagagaaacccugucucgaaaaaccaaaaaaaaaaaaaaauugaaaaaaagaaaucagccagucugggaacaaaagcaauacaaaugguacaaagaacgucuggcacaguggccacacacgccuaugagccugcacccaagcggcagcagcaggacugaagaaagcuugagggcacccuacacggcuaucucagaggcgaaguguucacaggucucucaccggaaggcuucuaggaggacacacacauuucaguguaugcuggcaguguucaggguaaaugggaagcgggcagagagagaggucuuagcuuagucacuaugugguuuuccugcugcacuuucuaauuccugguaccaaguaacuugaucaagguugacaccuuuaaaugagcaggaacaacuuuggggaugccucuaguucuuuucuucuguuuuauuuauuuauuuagugugugucuuguauaugcacuuguguuggagugugcagaggggaguagcuaucccauuguagcccucuugccuuauuuugagacagagguuuugucuuguuuuguuuugagacaguuucuguguagcccuggcuauccuggaauuuccacugaagaucaggccggccucgaacuccuauuugccugccucagucucaagugcagggaucaaagaugugugcuaccaugucugcguaggacaaaggaggguguuacaucugcuagaucuggagugguaggcaguuguacaggugccgggaauugaacucggguacuuugcaagggcagcaaacgcuuuuagcccugagucguuguucucucaaguucuuccuuuuuauguccuccuccuauuuuuaacuuuuuuuuuuuuuugauaguccugacgccucaguucuagacaagaaacauaaugauguggugaggggugaccccucagguggcuaucaccccuaucccacccucaccccaguccacaggauguccacaaauggggaaaaacccaggaaggcagcaugccaaggccuccaucaaccaugucccacaagaacccuggcuccacggucucaucgaugucauuucaccucaauggguugcagcuucaagguggccucccacuacccagcucagggccaccucggucagaaaacaccacugccauuucccaguccccagugccagacaugcuaaauggguggcggggcugagcacccaagcaaugcuggacuugguuuuguagugccagggauggagccugggaccucacacacaggaggcaaacagaauuacugagccucaagcucaucccaguugacuuccaaugccagcgauucccagucuugcaaucacugggcacaggcaaaggcagggccgaggccauggggucaagucugugacguaaucccagcuucuggcuuacacuaggaugugaacucuggccuucaggaa

SEQ ID NO: 2161 - RNA, 3649 nt, Mus musculus
aaaaaaaaaaaaaauugaaaaaaagaaaucagccagucugggaacaaaagcaauacaaaugguacaaagaacgucuggcacaguggccacacacgccuaugagccugcacccaagcggcagcagcaggacugaagaaagcuugagggcacccuacacggcuaucucagaggcgaaguguucacaggucucucaccggaaggcuucuaggaggacacacacauuucaguguaugcuggcaguguucaggguaaaugggaagcgggcagagagagaggucuuagcuuagucacuaugugguuuuccugcugcacuuucuaauuccugguaccaaguaacuugaucaagguugacaccuuuaaaugagcaggaacaacuuuggggaugccucuaguucuuuucuucuguuuuauuuauuuauuuagugugugucuuguauaugcacuuguguuggagugugcagaggggaguagcuaucccauuguagcccucuugccuuauuuugagacagagguuuugucuuguuuuguuuugagacaguuucuguguagcccuggcuauccuggaauuuccacugaagaucaggccggccucgaacuccuauuugccugccucagucucaagugcagggaucaaagaugugugcuaccaugucugcguaggacaaaggaggguguuacaucugcuagaucuggagugguaggcaguuguacaggugccgggaauugaacucggguacuuugcaagggcagcaaacgcuuuuagcccugagucguuguucucucaaguucuuccuuuuuauguccuccuccuauuuuuaacuuuuuuuuuuuuuugauaguccugacgccucaguucuagacaagaaacauaaugauguggugaggggugaccccucagguggcuaucaccccuaucccacccucaccccaguccacaggauguccacaaauggggaaaaacccaggaaggcagcaugccaaggccuccaucaaccaugucccacaagaacccuggcuccacggucucaucgaugucauuucaccucaauggguugcagcuucaagguggccucccacuacccagcucagggccaccucggucagaaaacaccacugccauuucccaguccccagugccagacaugcuaaauggguggcggggcugagcacccaagcaaugcuggacuugguuuuguagugccagggauggagccugggaccucacacacaggaggcaaacagaauuacugagccucaagcucaucccaguugacuuccaaugccagcgauucccagucuugcaaucacugggcacaggcaaaggcagggccgaggccauggggucaagucugugacguaaucccagcuucuggcuuacacuaggaugugaacucuggccuucaggaaauggacaaacaucccauuagcaaagacuacaaaacaaaccucagcacuuuuauuucuauuacuguuuacaagguccaagauuucugcacuuuaacacuggaugcccuuccccacccacccaggggacacugucggcaucaucguguccccucuagaacuuccccccaugcuggggcccccuccucucuugcccaccuucacugcagggagagcuuucaagccuggaggggguacuaguggcuucccgugccugcacgggcgucaaguguggcacacuggccaggcuccuguggugccuggccugauggagaugagcuggagauggcagcagggugucuugguuuccucagacagcucuggacuggucugagaggaggcacccaucuacugcugcugguggaaggggaagggacaucagaauucacaguuguuugcucugcaaagugcuugucggugguggcugcuucugccaagucauccauuuaaauccgggagaggggacagaugggacacugggauggggguggugucccuuggaaggcagccaggaaaggcugacuguggaauaaggguccccaggggccuucaaggucuugcgagaaaaaucagucugcugcugaugguuuggccagagagcccagaggaaagcgucaaaucuuaagaaauguaagccaauccccccagucuccaaugugagguccaaggaguggagccaugcggcccagggaaagagaaccuugguauaugcaucuuacuggguggagccuggugucaccuaagaaaggcucagguuuuuuuguuuuuguuuguuuguuuuuggcaagcauucuuggcagaacccaagggauaaggaggucaggaugccagccuccguguggcaauaccaucuagagggacagauugacucuggcuccacagugagguccucaagacccaaauacagaguucaccaacagccacuccuuacucuucagacagcagggagaccaccacgggcuccaacucuccagagacaguguguucuuuggauauguuuggccccucucccaggccccacaccaccaggcaugggagaaaaggguaugagggcaaaggagacagaagaacugaaccccuacucagguaaccaaagaacaggcugcccagcagaacaggcucuaggggaacugggcacacagaccagcugugaguccaacuuucacauugaugggugggaggcagguuggggggcugaugaaacuggagaaugaggaaggagggaaggcgggaaggcaaacuuccuggagugcuagucccuggagguccuuacuccucucccacacaggcagccaggggcuucccaguccaggaaggcagcuuuuguggugccuggggcccagccuuagcucuguagccuuccucugcuuuuaggagcaggggaagaaaaggggauguggcccuuggccuuuccgaaucuucuuccagcuccagguacagagcucagaccccaaagucagugcgacgguccuguucaguccagugaggaaaaggaaaauguggcuugcccugauggcugccuggggccacagacaugcccauccccagcaugugguggauagacaugagacagaaaggguccuucccagaucugucuccagacacagaaguccuugcacagaggacgguggaccagggucagcugcuccuggugcugguccugcguacgggguagucaggucauguagcgggugauggcgcgcagggcauagagcagggccgcuugcaugcgggcuucaaggagcagcaaguucacaugaaccuggggaugggagaggacgaggcuggcugacaacucaucuuccagucgaccgguucccugccacucacuccaccagcgccucccaccaagaugcccuggccuuucugcuaaaacucagcacaaucucguagagaugauugcuuugccucccaagucugaaaagaagagcuuccagcuaacugguucuaaggcuggaucaaaugucuccauccauagugucauuuugucccuugucauuauaaaggggagacacucagagguaacuugcccaaagucacacugcuccuacgugaggauuaagacccacaccuagggccaggugguggugguggcucaugcuagcacccagggggcagaggcgggcagauaucugugaguuugaggccagccuggucuacagagugaguuccaggacaaaucaagguuacacagaaaaaagucuca

SEQ ID NO: 2162 - RNA, 3649 nt, Mus musculus
ugagacuuuuuucuguguaaccuugauuuguccuggaacucacucuguagaccaggcuggccucaaacucacagauaucugcccgccucugcccccugggugcuagcaugagccaccaccaccaccuggcccuaggugugggucuuaauccucacguaggagcagugugacuuugggcaaguuaccucugagugucuccccuuuauaaugacaagggacaaaaugacacuauggauggagacauuugauccagccuuagaaccaguuagcuggaagcucuucuuuucagacuugggaggcaaagcaaucaucucuacgagauugugcugaguuuuagcagaaaggccagggcaucuuggugggaggcgcugguggagugaguggcagggaaccggucgacuggaagaugaguugucagccagccucguccucucccauccccagguucaugugaacuugcugcuccuugaagcccgcaugcaagcggcccugcucuaugcccugcgcgccaucacccgcuacaugaccugacuaccccguacgcaggaccagcaccaggagcagcugacccugguccaccguccucugugcaaggacuucugugucuggagacagaucugggaaggacccuuucugucucaugucuauccaccacaugcuggggaugggcaugucuguggccccaggcagccaucagggcaagccacauuuuccuuuuccucacuggacugaacaggaccgucgcacugacuuuggggucugagcucuguaccuggagcuggaagaagauucggaaaggccaagggccacauccccuuuucuuccccugcuccuaaaagcagaggaaggcuacagagcuaaggcugggccccaggcaccacaaaagcugccuuccuggacugggaagccccuggcugccugugugggagaggaguaaggaccuccagggacuagcacuccaggaaguuugccuucccgccuucccuccuuccucauucuccaguuucaucagccccccaaccugccucccacccaucaaugugaaaguuggacucacagcuggucugugugcccaguuccccuagagccuguucugcugggcagccuguucuuugguuaccugaguagggguucaguucuucugucuccuuugcccucauacccuuuucucccaugccuggugguguggggccugggagaggggccaaacauauccaaagaacacacugucucuggagaguuggagcccgugguggucucccugcugucugaagaguaaggaguggcuguuggugaacucuguauuugggucuugaggaccucacuguggagccagagucaaucugucccucuagaugguauugccacacggaggcuggcauccugaccuccuuaucccuuggguucugccaagaaugcuugccaaaaacaaacaaacaaaaacaaaaaaaccugagccuuucuuaggugacaccaggcuccacccaguaagaugcauauaccaagguucucuuucccugggccgcauggcuccacuccuuggaccucacauuggagacuggggggauuggcuuacauuucuuaagauuugacgcuuuccucugggcucucuggccaaaccaucagcagcagacugauuuuucucgcaagaccuugaaggccccuggggacccuuauuccacagucagccuuuccuggcugccuuccaagggacaccacccccaucccagugucccaucuguccccucucccggauuuaaauggaugacuuggcagaagcagccaccaccgacaagcacuuugcagagcaaacaacugugaauucugaugucccuuccccuuccaccagcagcaguagaugggugccuccucucagaccaguccagagcugucugaggaaaccaagacacccugcugccaucuccagcucaucuccaucaggccaggcaccacaggagccuggccagugugccacacuugacgcccgugcaggcacgggaagccacuaguacccccuccaggcuugaaagcucucccugcagugaaggugggcaagagaggagggggccccagcauggggggaaguucuagaggggacacgaugaugccgacaguguccccuggguggguggggaagggcauccaguguuaaagugcagaaaucuuggaccuuguaaacaguaauagaaauaaaagugcugagguuuguuuuguagucuuugcuaaugggauguuuguccauuuccugaaggccagaguucacauccuaguguaagccagaagcugggauuacgucacagacuugaccccauggccucggcccugccuuugccugugcccagugauugcaagacugggaaucgcuggcauuggaagucaacugggaugagcuugaggcucaguaauucuguuugccuccugugugugaggucccaggcuccaucccuggcacuacaaaaccaaguccagcauugcuugggugcucagccccgccacccauuuagcaugucuggcacuggggacugggaaauggcagugguguuuucugaccgagguggcccugagcuggguagugggaggccaccuugaagcugcaacccauugaggugaaaugacaucgaugagaccguggagccaggguucuugugggacaugguugauggaggccuuggcaugcugccuuccuggguuuuuccccauuuguggacauccuguggacuggggugagggugggauaggggugauagccaccugaggggucaccccucaccacaucauuauguuucuugucuagaacugaggcgucaggacuaucaaaaaaaaaaaaaaguuaaaaauaggaggaggacauaaaaaggaagaacuugagagaacaacgacucagggcuaaaagcguuugcugcccuugcaaaguacccgaguucaauucccggcaccuguacaacugccuaccacuccagaucuagcagauguaacacccuccuuuguccuacgcagacaugguagcacacaucuuugaucccugcacuugagacugaggcaggcaaauaggaguucgaggccggccugaucuucaguggaaauuccaggauagccagggcuacacagaaacugucucaaaacaaaacaagacaaaaccucugucucaaaauaaggcaagagggcuacaaugggauagcuacuccccucugcacacuccaacacaagugcauauacaagacacacacuaaauaaauaaauaaaacagaagaaaagaacuagaggcauccccaaaguuguuccugcucauuuaaaggugucaaccuugaucaaguuacuugguaccaggaauuagaaagugcagcaggaaaaccacauagugacuaagcuaagaccucucucucugcccgcuucccauuuacccugaacacugccagcauacacugaaauguguguguccuccuagaagccuuccggugagagaccugugaacacuucgccucugagauagccguguagggugcccucaagcuuucuucaguccugcugcugccgcuugggugcaggcucauaggcguguguggccacugugccagacguucuuuguaccauuuguauugcuuuuguucccagacuggcugauuucuuuuuuucaauuuuuuuuuuuuuu

SEQ ID NO: 2163 - RNA, 917 nt, Mus musculus
uaaccaguccagagaaauguacaacccagggccugaguagugcaagucucccggagugggggaagucuaaccuugagcagcuacuaucuagaucaugagaacuggagacacguggaggaucuagaaauggcugacaggaucugaggccucagggaauggacacagccuuacaaaaacuaaagagaggagagggaaguuggggagaaaagaugggggugacaggugagugagccgggcucagaggcucugcauguucuggcuaguuguaaacacugcucggagcaccugggggagucucgcacaaccaggggugcagaggggaugacugcgggggaaaugcggggaagaugacagcaaacgauaaauuaggagacuacccuugggcugaguccugcagaaccgguguaaaaggcuuaaggcuggcugggaggccagcagugcgauacuagcagucucgacuacgaggcgacccgauggcuucaucagccuuggaauucugccagaagaugggcgccccaagggaccagguaaagauggguggagcgacagagagcguagaaaggacagggaggacgacugggggcuggacuugggaccaggugggccucaccggaaguaccgauccucuucagccuuuucucguuuuccgaaggcuccaccagcuucucggauggagccagcgcccguauccaugcuauccgacugcaaagagagucguggacgugaaaagaaaaggcacaacaagggagagagaaccugcgccccgcgaugggcgcugggccgugccgccaccuaccgaguccgagacgaagccucggguuugcaggaccuucauaccccagacaccgaaccgagcccgaacugccaacgccgagccugccauugucuucggcguugcucagcucgcguugcgggcg

SEQ ID NO: 2164 - RNA, 18218 nt, Mus musculus
caaaggcuuggguauaaaaauuuauuauacguaaaagaauauuaccacuaauaaaugcagacaagcaaggacacaacgggacuggcuggaagaugaauucuuuggaaagugaacagguuuaaguggcugggagccucgugccaaacaccacagggcaugagggcaacaagugacugccgugugaauccacaauaccucuccuauuggagcaagggccucaaggauggcuucccaagguggcccaggcugaucuggagucggggcaacaccacuguaagcaagacauuuaauuggaaaaauuccacaaacuauacaugacccuugagccacacaauucaaauauaaaacauuaaguuagaggcgugggaaaagaaggcggcauggguccgaagcuccuucaauccugguggauccguggggaaaggacggggauggugaaaccaagccccuccucucaauguacaaaggauuacucugauugauauuaaauuguauugacaacaaaauagacuaaaaagcaaucgcuacucucuggugggguggagguggagagagaaugaguccgugaagcaggaggagcagcggggaggcucugguccugcugcucacucccgcugcuccaucuugacuuucgguggccgcaggaagguccgauucuucuucuccuucuuccccuuuguauuugccuggaaauuucgccaacuguccacucgaccaucccgacuuuccugaaagaaaggucauuaagagucauuaaggaucaagguaaggucauuaaugagcaaagggaccgagccuguccugccaccaacguccucccauaccaauccugaugagcccucugggacaguccaagagcagagagagccgagccgagccuucucccuucucuaaggacccagggaaguuucccagcauccucucaaagcaucuuggaagaggaugagaugggugaagacaacacugugaagcucugggcaguguucugggcaucgcuuuccgugcugcugaacugcaccuccagaacuagcuucacgccggccgccuuuuguugaauguuuuuaagacagcauuucacuauguagcccuaacuggagcuuacuauguaaaccaagcuggcccugaacucugagauuugccuccggcugccuuccaacugcugggacaaaacaugugccccaccaugccuggucccuagcuugucucuucuaaccuuuacagaaagcuggcuacagugugccuuggacaggacugugcagcaaugaggagcugacuaguucugaaccacagagcuggcugggagcacagccauuuuuucuucaccuuguuccuguugccccucugacaacugaggggauguccccaaaccagcucuucucuggccacaaagaacuaccucauuaucacaugggcuacucacuuucccuuuccaaaaggcugggcagaaacagagccaaaaauuacaguuaaccaagcucuacccuaaauucuaacuccuauaaaagaccagaugcaauccacgacuggguuggacacuugaagagcaaugaacccaguucagaagcuacaaggugggcuggugugguggcucauaccuauaaucccagcacgggaguggcugagggaagcagaccaucagggguucaaggacagacuaagcugcguagugacuucaagauaccuugggcuauaaggugagacugucuuaaaaccaaaaaacaaaaugucagaaggcucugcagaaacugggucagaugagccugaccccaguggucugugugucuuuaacucuguggccucagccccagugugugggaggcugacgggggaagaugaggggguccauguucaagccagacugaaaacuuagcuccacucucaccucccgccugcuuucacaaacugaucucaaagcuaagcggggugcuucauguuacccugaagucaccuguguuaggcccauuagguagcugugucugucagugcccaugucggggaaagcuauaaaggcgaagcagccgacugcuucuccagugcccacuuucacccacacaccuacuucccugccugccccaggcaucaagcuuccuuagucuagaaugacccaccucagcuccucgccucagacacucaccucaaaguuuuucugccacucucuuucucgcuuggcuuuuuccugggcuucgaucuccucuucucucugucgcuuccugggagggaaagcagagcagucuuuauuuagggcucacaggagcugaggcccagccaggggaggccucauccuaaaacacgccgaugacaaaacccaacccuaaaaugacauuucacacaagcccaacuagcaaaaucuaauuacucaacaacagaaaacgcacaagccaaaucgaccccagugcuuuuucuucccccucucuccccugcucccccgcccccucucccccucucuccccugcuccccccgcccccccgcccccucuccccccucuccccugcuccccccgccccucuccccccucucuccccugcucccccgcccccucucccccucucuccccugcuccccccgcccccucucccccucucuccccugcuccccccgcccccuucuuucuuguuucucuguguaacagucauggcugccccaggagacaggccugccucugccaggauugaaggccugcaccaccaggcugggcuuccuuuuuuguuguucucugaaacagugucucaaguaauucaagcuggcccugaacuugcuuaauggcaagccaaaaauagucugaacuccuuuuuuuuuccugccuucaccucccaagugcugggauugugggcauguuccaucauaccuggcaaccuccacucugugacaaucaaaggaaaucacacuugagcagaguaacacguucaaguucuuccauuacaauccuaccuacucaacacaacugcagcuacauggccuagaaaagauucuggccuccagagccucaacaacucuacugcacuccagagaggaaggaaacacacugcacuccucaauaaaaaaccgauucccuacagacagggggagucaggguuucccaaaagucuacaaugucugacuggcucagacagccuggccucacguaugccaggcaagagcugcaccacugagcugugccccggccucuccagcuuagucucauaagugcccuacagacucaucgggaaauccgcagagacccaagcgagcugaucugugcaucuaaaugggacuaagacggucauggagauaggcaccucucaugcauuucuuuggcuucucucucuuuccuuuuaaucuccagcucagcaaacagcuucauggucuguuuguagacugccuguuugaacuguaagaaaauuaaggacaaaagaaaagucaacauuucacaucaacauugacaugaagcaauuacauuuagagcccuaaagacuacaacugggcauuuaacugucugcagggagaagcaauaacaacacugucuccucagggagaaaagacggcugcccaggaggccuuuccucucccagccugcagaugcucuguuaggacauggaugcacuuaugccaccacuugggauuuuaaagggugcucucuucucuaaaacuccaagacuaacuucuacucuucuuucuuuuccuucguucguucguuuguuuguuuguuucgguauuuuucaagauaggguuucucuguguagcccuggcuguccuggaacucacucuguaaaccaggcuggccucgaacucagaaaucugccugccucugccuccccaagugcugggauuaaaggcgugcgccaccacugcccagcucuacucuuuuuauaguauuuuauaauuuugauucaguggacagaaugaugaagcugaauccuacacagugaacacaugccccaaaucacaauccuaucuaaagggacaaagacgcuaaucaccugcuccuagcuagguauggcaaugugacucuagaguuuagucauuguacuuauaaaggacaucuaggguacucugagaaggaguggcaucucucuauuucccccuguagucucguuuagucacaugagcaagaugaugagacacccuagacuaggaaggugggagccacagccaagaccuugaaggacacauggugcagagcuuccaccagcagccaccgccuaggccuacugcacaggacaaacauguucuaccuugauugagccaguugucucucuguagccaguucaccuuacacaauauaccuuaagcaaugcaucgaaaggagcauauaacacaacauucaauagaaaccauaaagaccaagaacucuauugagcuucauagaauggaggauaaaacccaaggccucucaagugaaaccucuaccacauuuaucucccaguccacccagggcuuuuaagaaaggaugcuacaguuguuauuacuacaggguugcuauugaagagaagcaguaaagacaaguggccagaucccaccacagccguuacaucccagguccccgucggcauuuuacgucuuugccuucaguaaguuuagugagguuuugcuuaugucuuauuuguuuguugugggcuauuuuuuggagacagagucuaacuauguagcccaaccugggcucaaacucaggguaauccccugccucagccucccaauugcuagaucauaggcauacacucaugaaggccucuuuuuuuaauguauucauuuucuacacgaauaugugggugcauuauguauguguugcccacaaagguaagaaggcacugcaucccauggaauuguagcuauagacugcugggaaccaucaguggugcugggaaccaaagcagaaagugcacuuuacugcugaaccaucucuccauccccuuacacuucauuuuuuuuuuuuuuuuuuuuuuuugguuuuuuugagacaggguuucucuguauagcucuggcuauccuagaacucacuuuguagaccaggcuggccucgaacucagaaauccgccugccucugccucccgagugcuggcacuucauuuuuuuaaaaacauuauauauauacacacacacacacauauguauguauguggcugcaugagggugucaaaucccuuggagcuagagacacagacaguugugagccacuguguggaugcuggaauuuggggaucuaaacucugacccucagacuuacguggcaagcauuugacccaucaagucaauuccccagcagaauauauuuuaguaucuuuaaaagcacuaaauugugaguuaaagagaugguucaauaguuaagagcacuggcugcucuuccaggacauagguucaguucccagcacccacacaguggcuaacaacuaucuguaacuccauucccuggagagcgaauacccuccucuggccuuugaagguaccaagcauauaugcaggcaaacaccuaugcacagaguuuaaaaauuaaaaauauauaaaagccauuuucccagaacccaaccucuaaguuccuauguacaagugugugugugugugugugugcauauauauauauauauauauauauaugggugugugugucucuguguguauguauguauauauguauguauaugugucugaguagcugcuggcuaguuuaaugccaucuugacacaaacuagaauuucuaaaaggacagaacaucuguugaaaauuugcuuccauaaaaccuaacuguacagcauuuucuuucuuucuuucuuuuuugauucuucagcugacagcaagaggauuuaucauauaugaguuacacuuggccacgagaccagaacuaguccagagugccaaagguucagggcagagggccagcgggacuguuuugguccuaggaaaggcagucauuuucccaggugaucguggugaggugacguugcgggucuccugagacuuauuaccgacagcagcacacaguccgacagcuuguuccggugucccggccuugagcaucccucacuucugcuccugcaggcgucauggggcacaggcugguuuacuuggcccucugccucaucuuucuucucuugcaccucagccugugcauucucuucuuccaacaccgcucucauggcgcaggagucucaaggaagauggcgauaagcagcagcauuuucucaguguuuaacggagaugccccaagcccacgguggguggugccauccuugggcugguggucuuggguuguauaacaaagucggcugagcacuccuccauggccucugcugaucaguuccugcccucacugguuuugauguagcuccagcuguacuagaguucauuauauaguccaggcuggccucaaaacucacagagaucuaucugccucuaccucccaaguguugggauuaaagguaugaaccaccauaccuuguuuucccaaguuuuuuuauuauuuaauuaauuaacuuauguguauguguguguguuuaaaugucagcagagaagcuaucagaucuccuggaacuggagguuuuuuuuuuuuuaaaagauuuauuuauuugcucgcuucagcagcacauauacuaaaauuggaaugauacagggaagauuaguauggucccugcgcaaggacauacaaauucgugaagcguuaaaaaagaaaaaaaaaagauguauuuauuuauuauauguaaguacgcuguagcugucuucagacacuccagaagagggcaucagaucucauuacagaugguugugagccaccaugugguugcugggauuggaacuugggaccuuuggaagagcaaucagugcucuuaacugcugagccaucucuccaaacuggaguuauuuaacaaggcauugugagccgccgugugugugcuaggaacugaacccauacacaccauacguguaacacauacccagauggaaaacaaacauaugcacacacaggauggauuaaaaggucaaucaauguccuuguacacgcuuucgggaagccuuucucuuuaacccaccgucacccaggauacagugcuucccacgauaacucaccaguucgggaucaucuuccuccacauuuguaggcuuuccuuccuucuucaguuguuuuuuucgcucuuuaaccuaaaaacaauuuuuuucaucaaaagaugagcccucguccuuugagaauagccacugagcuguauauacacccacuuuccauaaagagaggauaacacacuccuccauaggcauagagaggguaagaggaaggcaagagccuccuccugcaccauuaguaacaacaacaacaauuucugauaacacuguaaaaagcaacuaagacuuggagccuuggguccuuccucuagcuccaucuaaaguccauuccagccugcacccaccagggaaagugcaaccagcagagagguccccaacuuauaauggcugagccacagacauggccauuuagcuuucuuaaccuguggucagagcuauagcaaagaaagcacauuugccaagcuuuggaaggaucuacuaaaugggugguauuuuagguauaaauaguauuucuaaaaguacauucucgauaguuuccacugugaaauucccggaaaccguaauuuucacacggcauugauggauaugaucaggagacagacacuacucccaccagugaccuaugagaggcagccagguucagaaacacuuuacugccaccuuguggccaggaacucuaaggaacuacagaggauugaagaaccuguccugugcucuccugaccuguacuacgugaccagcaggacccgguuccagcgccuuccuuuuccuacuuucccuccucgaccuuaucuaaaauggguccaucuuuauugucauugccuacaaaguucugauucagacuccaaagcucuucaaaacaaagguggacuccuaacugacucuccacugaagacauaugucacucuugacagagucuugagauucuuacuccacuggggggaaaaaacagagagagagagagagagagagagagagagagagagagagagagagagagagagagacuuucuaacugggcccaguggugugugccuacaauccuagcaacuacacauagagaaagaucaggaaugccaggccaagugcccuuaacauggcuuagcagcuacuucugcaaaaauccagguucaguucccagcaccuacacaguggcucagaaccauccuauaaacuaccagaaacucaugccacccucuucuaaccucccugcauaccaggcaugcccauggugcaauacauacaugcagauaaaacauucacacacaucaacaaaucuggcacuuaaaaagaauuuacagucagucucagguacauugcgaauugaaggccagacugaacuacauaagacccucuuucaaaauaauccuacaaaaaagaaaaaaaaaacaaaggucuuucuaccuggaugcuauggcauacaacccauaaucccaugacucaggagguaaaguggaagaauuaagaagucaaaaucagcccaggcuauccuguccugcaaccccagucagacccauuuuaaacaaacaaacaaaagcuguuauuuaguuuguucaacugagccuucagauugcugucauuaaccuggauguucacucagagcuccgugacagccucucucauuucuaaauccuucaacaaaccagggagucaacagggucugaacagcuccacuuccccacucucugaggcaggauggcaccucugcuggggacuaaaggugucuaucaacaaacaccacacagaacuggcagggaagugggagugguaguguccuagccacaucuuacccugagcucaccucucaggaaaggaugcuagauuugggcacucuuccugagcagcacagcuaaccgauagagagaaugaccagugguuugcacugcuagguugcauacacccuucuacauggugccccaggcuugcugucacuuccuauaaacacagcagcacuagagauacuuacaguguguuccacguauucuuuuccugccugaauuacauccagggcccucuucuuuuguuccugauccaguagcaacuuguaagcuuuguccacagcuaaugcaaaacauugaaguuaacuguuucugcaaaugccucucaaagucugagcuaugcucaggcaguguaaauggacuugcacugucuaaaaauucccuacuuugguaaguuauuuaauguuguuaaacccauuuuuaaaaaaaagcauacaaccauagcaaugaccuugaaagucuuagaaaaaauuauuaaauauacacucaaagcuaaauauaccacaucuagauuuaauacauugauaaaguuucccacuuauguuuagcaaagaaaaaaggaaccuuugcaauaaagguauacugguagacacaaaaguuaacaaagcaagauuaaugugcacuuucuuugcagugcugaggacugagcccaggccucuaucaagcaugcuaggcaagcacugagcuacacacucagcccccagggagacauucugcuuaaauggcugcuuuacugaaauccacagccuuuccacaaucaguuauuacuuagcaucgacaacauauaucacucaaauauagguaaaugcacaaauaccuucaaaagccuucugugcucugucagcaucguccugguuuuugucaggaugcaccaggauggacaacugcagggaagagaagucaggcgcaucagaggcucacaggcggggccugagcuccucgugcacaucaguaaguaagugaggagaaucugagcuuuguguaagaaagcuccagaugacucuuucagacguuuauaagacugacuccugacuugcucgcuaccacugaugggagagaaacuacauggcgcaaaaagaaccauuuugggagauggaaaccuacuguuaacccacaguccugauuugugauucuaaccuugucacaugcuagcuuugcagcccugagcaacucagucagcccaucuucaccuccuuccugcacuaucccuggaaagacacagaguaccuacaucuaaauagauuguugugugagcaaaaugaccaaugcaaguaauuagcauaaacugaauauggagagccaaaccucaaugcagaggaggaugggcagugguuaacauagucaaaguaucaaaacaucuucugacagccucuguguaugacaccucauuuaacuguuuggacacauuuaccagaugaaguaaaauagacacagaaaagcccaaagcacuuguucaaguccacagagcuccuaaauaagagaauagauuaaaacuaaagucauauguccucuaaacuaugaagccaucuaaugaaucacuaagaggucauaacucaaguuuguugacucaggaaaaguuuaauuaaggacuaaaaaacuguuugcugagcugggagugguggugcaagccuuuaacccagcacucgggaggcagaggcaggcggauuucugaguucgaggccagccuggucuacagagcgaguuucaggacagccaggacuacacagagaaacccugucuggaaaaaacaaaacaaaacaaccccucccccccaaaaaaacccaaaaacuguuuguaauauugggaauaacuguuaauggacuguauuggaaaacaagacuuugggaagaggggaugggaugugaaguuuaagcacagaucagagcucaagaagaauaaagcuguaaaguuauauaaugggaaaugacugagcaggcaaaaacaaaaaacaucuuagcuuaauauagcaugugggagcuuagagguagcuaugagucagcaauguggaaaucugccucacuagggggagcacuggguguuaguacaaccaguaaaacugcuguucagaacuggagugugagggucagcacuggccaggucucacucacacgugagaagcaugaugaugcaaagaagacaggaaggaagaagacauuggcaggaaucagggaucagagagcuacuuuccugaagaaaguucaaaaagcacuuguuucauuaaggcagguaacuuacuuuuuauaaaguucuuacauuuauugggguggaggguaugaagacacgccauggcaaguguguggagaucagaggacaauuugcgugaccaugugggucacugggaucacacucaggugcucaggcuuagcagcaggcacuucuaccugcugagucaucuuacgaaccuaagcgagguauuucuugagugcuuauaaccauuuguaagagguacaguuacugaguggauuaggcguaugguuugugccugucauucuugcuauuuaaaggcuacaguaggacaaucauacaaaccagguguuagaggacagucagacaacaugagauccuaccucaaauaaaaauaaguuuguaguuacucuauuuggauauaaaaaucauuauauccacagaaaaacuucuacacgccuucuguguccacuuugguccuggacaguauaauuaauuccauuaaguaaacccaagcgaagugcuuugacuuuugcuuuuauuuaacauuuauaucacuauauguaugcguuacuguaagauuguaacaacaacuguuaaucuagccuuaauuugaaaaggaaugcaggguuaauuucagcccaaaaguaucuaguccucaaaagucauguagcugaguugacagagugcuguguacacaugaaaaccuggguucaguccccagcaccccauaaagccaguguggcuugugccuauaaucccagaacucaggcggugaaagcaggaggaccccagguucaagaucacccuuaauuacacagugaaaaugcuaggcaagcccaagcugcaugaaaccccaucuggaagaaacaaacaggaaggaagcgcaaacucuaaugcgagcaacaguaccauaccugacgaaaccucuuuuuuauuucuucaucugucacuucaggaucuaucugaagaaccuggaagaaccaagaucaaaacuguaaagcuggacauggcugcccauaugucaucucaauccuaggaaaacagaggcagaaacaugguaagugcagggccaaccuugguuacaagcagcacaguugcaacaaaaacagaaaacugcagggaguaguccuggaagucugccacguaaggucagaaagucaagaccauccguggcuauguaacaaauucaaugccaaucuugagacaugagacaucaucuuaaaaccaaccaaccaaccaauccaggaggggugagaaucuguauaugugagugugcguguguuuaaguauguagccaccuccuuacaugccgucugucuccacuuugguccugggcaguauaauuaauuccauuaaguaaaaccaagugaagugcuauucacucaaucucauaguccagaacacagagcacagagcucaccaggacaaggaagggagugaacacccaaguaguacuuagucaagugcuagagcccaugcugggggagaaugguguccacacagaacagcagcuugacauggagugcugagaaaggaugaggagggcaagcuccgaguaggcugccaagcacgcccugucagaacugaugaguaggguaaagauaugaacauaggcucagcacacugguucacaccuauaauccuaguguuuaggaaguugagacaaaaguuauaggcugaccuaagcuaaaaagagagacucugauuauaaaaaugaaaacggccuggagagauggcuuagaggcuaagaucaugcacugcucuagaacgaggagagcucagcucccagccaccuguaguccagcuccaggaaaugcaacagaucuggccccccaugcacaccuucucacccacucacagguauagagacccacacagacguguucacauaguuuaaauaaaaauaguggcuggagcaauggcucagugauuaagaauacuuguugcgggcuggugagauggcucaguggguaagagcacccgacugcucuuccaaagguccagaguucaaaucccagcaaccacaugguggcucacaaccauccguaacaagaucugacucccucuucuggugugucugaagacagcuacaguguacuuacauauaauaauaaauaaaaaaucuuuaaaaaaaaaaaaaaaaaaaaaaaaaaagaauacuuguugcucuugcagaggacccaaauuugguuaccagcucccaucuuggauggcucacaacuaccuguaacuccagggaauccaacaugucuggucuccaugugcaccuggacugaugaacacaaaucuacacauauucacauaauuuuaaaaguauauguauguauauguguguguauauaaaaauaaaccuuagccaggcagaguggcacaaccccuuuagucccggaacuuaagagguagaggcaggagaaucaccgugaauuugaggucagccuggucuacaaagcaagauccaggacagucggggcuacacagagaaacccuaucuugacaaacaaacaaaacaaacaaacaaaccaaaaaaaaaaaaaaaaucaagggccaaucuaguaugcacaaugguaaaaugcuuaaguaauauuugaagcccuuucagucugauucccaguaucaaagauuagagagagugaggggggggaaggaaggggagagguacggcucaaugguuaagagcccccacugcauacagaggggggggcucagugguugugguuaagagcccccacuggagaguuagcgcccacacagugggucacaccccuggaucuccagcucugacaccucuuauagauucuaggcauguacaugguauacauauacaaaugcagacaaggcauacacauacauuaacauuuuaaaaauaauaauaaucaguguauuuagaggguuaaaggaauagaccuaaauagagccacugaggguagcaccagaaucugucugccacccuguguugaagaaaaaaaggaggacacacugccaacccacugcgauuugagguaaaugacuuuuggcuuucuaucacaugagaaagaacagugauuaguguugagaagaaaugcucagcggcaggcgcaguggguggugcacgcugugcucccagugcucaggacuaggaagugggaggacuaggcugagccacucugggcuacauuagagauauguucaaaaacucaaagggcauucgcuucucuaaaaucuccugaucuuaguucuguuuuuacugaauaucugguuuucuuauuuuccuguaacaaaaaaguuuuagcaaaguuuuuacuuuguuuuguuuuauuuuuuugaagcaaggucuugcuggagcccuaggcuggcccaagccuuucuauguagaccaggcugaccucaaacuuguagggauaucccugccucugccucccaaaugcacagagaauuucuuaucugggacuaccauuuuuuaaggucaaaaaccauaaguuuaucagaccaacuauagcaaaauaaacaaacaaauccuugucuacuugggcuacuaaagguuggagaacauuuaacuagaccaaguuuaucucauuuggugcuuuaacaagcugccucaacaagucuacucacaauaaaagcauucaaccucaaagacaaccugccugucacaaaaacaucaccacccuuuuuucauucccaaccaauagaacuuugggguguacgcuguuacauaagucugcucccaagccagguacuaugauuuacaccuauaaccccagcacuuagagccugaggcaggagaaccauagagucaaaccucaaggcuaaccuggguuauagagccagccccaggccacagugagcuacaguaacauccuguuucaaaaacagcuggcgcucuuuagcucgacauucuuacucucaucucuagcucccuucuccccucccuuccccccuucucuccacauaaccauggcgggccucucucucuuuuuccuucccucuuucucugugcuuuucuacaauaaagcucuaaaaucauuuaaaaaaaaauacaccagcuggccagggcuggagagauggcucagcgguuaggagcacugacugcucuuccagagguccugaguucaauucccaacaaccacacgguggcucacaaccauguguaaugggaucugaugccuucuucuggugugucuaaaagcagcuacaguguacucauauaaauauaauaaauacaccuaagacaacaaaaaaacccagguaugcugguucauuuccacaaucucagcauuugggagguugaagcaggagaaucuggaguucaaagccaaccuugaauacaugagacugucucaaaacaaacaaacaaacaaacaacccuacuuacguauacguauggaaagcuguccaccauagaagcuacagcaacaauaacgaacucguacauaacugucauaugcaaagcucucccaccaaacucuacaguaacaaucuacucaccucaaauggguucagauuaaaguaagaggaaccaggacgagucaaucuuucaauuugauuuuuggauguuagaacugaaucucucuucucuauuuguuucaccuaaaaguaaaagaauugguaaucccauuaguaagaauaagcuaaauauaucuacuuuaacacaacgcuaaaaugcucagcagacaacgauuuauaucucccauguccaagacacuuugguaacuggagaacaaccacagcggcguagcuauuuuacaaugauauuucagaucuccacguaaaugcuaagcauggccgcgugcgccuggaaacccagagcugggcagggaggagacagggaggcccccagagcucacacccugcacagcccggcuaaacugcugagcuccagguucagugacaggucuugucuaaaagaauaauauggacagugaaaaacauaugacaaugaccucugugcccauuuguguauacauguacgcuacaugcaaucuguaaaauucacauuuacuauguaaacacuucucuccaggaguauuagccacuccacauuuuuuuuaauuauuuuguuuuaugaauaugaaugcucuaucugcaugaauacccacaugccggaagagagcaucagaucucauuacagaugaucgugagcuaccaugcaguuauugggaauugaacucaugaccucugcaagagcagccagugcucuuaaccgcugugccaucucuccagcccccauuaucccauuauagggaaauuauggcuuacagaaagugagguuuccaauuaccuaacuuguuagaaauuuacccuaugucugacucacaaucagaggucgagaggauucccagauacuaaacacaacuaccaccagagaccuauauagcugcauguggguacaauuaaucuaucuuuuuuuuucuuuucauuuugaaaggcaaaaugcacacugaaccaugaccuaugagcaacauucaacaccauuaugaaggacuuacgagguggcucaguugguggaguucuugccuagcaugcacaagauccuggguuugacccuuggcaaaagaaaacggcugggugugguggcucauuccuguacacgagcacuuaggaggcugaagcaggagagugagcccuaguuccaagcagccuacacugcgaagugaguaaagccaccuaagcuucauuggguacuugucuuaaaaacaaaaggacaagcagggugauggcggcaaccaucuuugacagacacgggugggugaucucugugaguucaaggcaagccuggucuacaaagcaccaggacagcuaggguuguacagggaaacucuugucucaaaaagccaaaacuaaauuuaaaaaaauauaauaaaaacacaagagggcuaaaucagaguccgugcugauugucaauguugcaccgggaagcacaggccuuucuucucuguuuccugccugaggaugucaacugcccugccuccauuuuccaccaagauggaccaaaauuucuccaacugugagcaaugcaaaauaugcuaacaaugugaaggaaaaaaauauuuccuaacauaaaaaaaaaauuuuuuuuuuguuuuuguuuuuugagacaggguuucucuguguagcccuggcuguccuggaacucauucuauagaccagccuggcccugaacucagaaauccgccugccucugccucccaagugcugaauuaaaggcaugaaccaccaucgcccggcuuacaaguauucuuauaagcacaagagauaauggcucuggucccagcacuuuggaggcugaagcaagaggguccaaccugggcuaccagaaaguacuuaauucgaaaacgacugcuuuauaauuuucaagcugcuuuuuuauacacgaaacccuuuaaucgucgugaaaacucuuacaauguuaacuugccagugugggaacugaugucuugaaauuucaacagcaguuaggcuaauugccuugcgagaacgcaauaugugggccucugacgccagauagcuaacuuuaacucaguuuauucauucauuuaaucaacggauauaugcgaaacauccaccacgcauuaggcacuggcgaugcaaaugucaacaaggcucagagcaaguucacuccuguccuaccugacaccaagaacguaugcacccucuuaagagguucgucauguuaaagauggaggguucacauacgcauucuugucccgaugaacagugcucagcacugauaagaccgcagaaaucgccacucgcacaauucauggcagaggagugggacaagggccuccuuccuguuuacaaauaaaagugggugcgccgcagcucggccuccgccagccggagacuccaccgccagcaggcugcaccgcgcgaccagcagcucgccgggccccucuccgggucuggguccacaggcccagccgccccgccgcguuccggggaccucaguagccacaguggcggucgcgcaugcacuccgcagccgauccgcaguccccaggccagacggcgcgggccaacggucccaggaggcgccucgccggccccagccgcggcggacgaagccggagcacggucguccuaaggccaccauccuuacuccgggcucaccucacuguagaaggucauaaaugccuccucugugcugccuccgccacccgaagcaccacucucucccgaagccgccauuuucccggcuaaccaccacgugaccguucugcgcaagcgcagccucacguaaccaccca

SEQ ID NO: 2165 - RNA, 1288 nt, Mus musculus
uaguuuagaaaaucaauuuuuugaagcugaaagcacuugagauacaguaaauucaggaaaagcugauuuuucccuuccugccuaaaagcauccuaugaccgucucucucgugagucccugcugguggcaggaugagaacagucuucuuuccagacguggauagcugacaccaaagagacgaacgcagaucaaccuguguuccgcuggucucucccuacugagauaauagucacugucuagucacugucccacagggcccucuuccuuacuucccuuguuuuguccuaauccuagaguugguuauuaguuguacugaauuuaucaacuggaucgggagguucuuaaccuaugcucucaauacuugggagauggaggcaggaugauugugaaucugaggccagccugggcuacuuagugacuuggucugaaaagcagaugaaugaaugaaugaaugaaugaaugaaggcugagaaugcagcucaguuagcacagagugcucaaguaguauauacaaagcccuggauucaauugccagcaccaaauacaaguugguaugaugauucacacugucacucaaagucauuccuggcuacaaauagugaguuugaggcuagccugggauacaugagaucuugucucauuaaaaaaaugaggcuagccugggauacaugagauccugucucauuaaaaaaugaggcuagccugggauacaugagauccugucucauuuaaaaaaaaauccaucaacuauauuaacuuuugggcuuuaugauuucucccaugaauguguaaaaaauuugaauaauuuuuuucuuuuugcuugagacaggaucucauauagcucaggcuggcucugaacuccugaaccuccugucuccaucucuuaaauguugauauccaggugucaccacauccuacuguuuccuauucuuuaauuuaauuuauuucccauacuuuaauuuuguauaauuuuugggcuugccucaggaccuaggaagggagaaggaaguuuuuucugucuugcccaggauacaaaucuggugcaagaaugagauguuugaauuuuuuaaauguaaaugagugcucuaucugcauggacaccuacaugccagaagagggaauuagagcacauuacagaugguugagaggggccaugugguaacugggauugaacucaggaccucuggaagaacaauccaugcucuuaacugcugagccaucucucuagcaccagagacauugagcuuuuaagggacaauaagugccaugguuuggaugugcaaagucc

SEQ ID NO: 2166 - RNA, 7675 nt, Mus musculus
aaguuccgcccagcagcccagccucccggacgacugccccgcccccuuccugccggacuagcggggcgggagggcagguccgcgguugugugguugcuuggagaggaucaugccucuguccgugcaccaccauguggccuuagacguggucguaggccuggugaguaucuugucuuuccugcuggaucuggucgcugaccugugggccguuguccaguacgugcuccuuggccguuaucugugggccgcgcugguacugguccugcugggccaagcuucggugcugcugcagcucuucagcuggcucuggcugacagcugaucccaccgagcugcaccauucgcagcucucgcguccuuuccuggcucugcugcaccugcugcagcucggcuaccuguauaggugagugcccggcccuuugaaaaaguggguugacagccaucagaaccaguucagucuucuuuccuugggcggagaugaaaacacagggccaggaacagaggaagggaacaucagggucuuggagucagagaugccccucaccuuucuuguucauuucugucuucugcgaacguuugcuuccccgucaaggacugaagaggguccggcuugacucauccguguccccggagucagccaggaguagacauagacugguucuuggaaaauauauguggauggugugugcuuuucucaacugggaaggacccagggucagucuaaagugaggacagugagacagacaaucccuggcgcaagugcuggccugagaacuuuuucuuccccgccucucccccgcccccaaacugugacuagucccuuggguuguuagauaggagaaagcgaaaucaagggcucagaaucuugugaugaaggcagggcuucauggugugggugaggcugggcuaggguggccggauccggaaucuuguggaagucucagaucuugggaaagcuguauauagucuccagcuugcggggagggaccucuugaauguuugcauuuugccugaacaauuguaucaucuugaguacagcucagaugacugcgaaggagaguuauuacaggcaggccccaagagaagaagguguuggaucccuuggaguuacaggcgaggcaccucauguggugcugggagccaaacucugguccuccacaagagcaguggaugcgauuaacagcuaagcccucucucaggccccuccuguuuacuucuuaauuccaucucccaucucugaaauggggcucuugugaguagguaggacaggguugugaugcgccugggaucguaccugaccagcaagaguagaaguugaguuugccccacuuuacggacgaggaagcaaguuccaugagguuaguuagguggcuugcuccagguuccguagcuuuuaagugacaagcuaggauugaagucugccucugugcacucagcuguaggagauggacgacgucacagaagguugaccuggcccuccgggcaccuguguguccugccuagguguuugcacggaaugcaucaagggcuguccaugugcuaccaggagaugccauccgagugugaccuggccuacgcagacuuucucucccuggacaucagcaugcugaagcuuuucgagagcuuccuggaggcgacgccacagcucacacuggugcuggcaauuguauugcagaauggccaggcggaauacuaccagugugagugcugggcccagggcugucacuuuugccgacucuucucuccucugcagguguucucacucuuagggggaaaaaaaaaaaaaaaagagggugccugagugauaggcagcuggucuggauucaagcugcaugagcuuggaacagugacucaaaccaucauucguugguucucauccgagcacugggcggaauaaaugugucuauccuugggaguuaggggaagaugaaauguggggaauugcaugcauauaaaguacagggucuugugugcauguguauauguacaaguuugugugcauuuucagguacaugcagaaaccagaggucagugucagguguauuucucaauugcuuuccauuucuuauuuuauuuauuaaggaggaauuuucuuuuuucuuuucuuuucuuuucuuuucuuuucuuuucuuuucuuuuuucuuuucuuuucuuucuuucuuucuuuguuuguuucucuuucucucuuucuuucuuucuuuuuuauuuuuugagacaggguuucuuuguauagcucuggcuguccuggaacucacucuguagcccaggcuggccucaaacucagaaaucugccugccucugccucccaagugcugggauuaaaggcgugugccaccacgccuggcaggacagcuguuucuaaacauuuaugcuuagaccaggggucucugucauccccaugggacugaggcaauggcguccuugacaugguugugcaugcgucgguaauacacauccacucaagacaucauuugauccccacagagugccuucauauacucauuucuucuuugucacucugcuggggacgcagcugugaacaagaucuacagauccuccacccagccaguagccuuaaaacaaauaguuacacuagguguaccaauugaccagaagaggcagguggcagggcccccuaaacccucagaggaaucuuacagugagaagccuugggagagacuuccucaaggccacgggcccagccugagccuaagcaacggucugccucacaccuuauugaaagcccaggccaccccuuucuguugcccaucacuucauuccucauucugcaguggcucuccaaggaaccugucuugucaucacuugccgucauguuaugucacauaagagggaggugugcagaaagguggcugcccuuucucagcacuugcuaggaacuugacauuuguuugagaucagagucagguugagauggucuacacuguugaggagacaggcuuuucucuacuuuugauggagcagacauuuauguaccaugcuuugggccaccuggagaauccagauaagcagaauaaguuuucuacccuccaggagcucgaggguagaauaaaggucaggccaucauggugcaggccuugaaucucaacacuugggaggcagaggcagaugaaucucugauuucuaggcuagacuggucuaaugagugaguuucaggacagccagggcuacacagagaaaccuugucuuggggaugggggugggggguggggaucaucaaacuaaaaaaggagguaauuggguuaaugggguagguagguuguuacagaggccucugacagcagaguggaaucuagguggguggguagccccagaauuuauuugggcugggguuuguaggguaaggaguuggcaaauaguuaagagauggggauaaauagagcuuugauaucaggcuacaagugggcuccgaggacgcaguagguuaucaguaaacuccugcugaguggauaccuuagaggagaugagaggagacacuuuguuagguaugccaauguuacucucuucuuggaggccccggugcccuaggcagugcagagcugggacacgaacccuaucaucaacaccuagaucuuggaaagucaagauaauggccuaggcuggacauggaggcaagugaagaggggugggcuggccaucacucccaguccugaggaaagcuagaauuggaggccuguuacuacgcucugagacaugucacacauccucucauacuuaagaauaucacugggacagcauuugacagcagagcacugaccccucgaaauguucucccucuucaacuguuuuuuuuucucuuuuuucuuuguguuuccuuuucucucucucuuuuuuuuucuuuguguuuccucuuuucucuccaacugucuauugagcaagcuggggcuuuuaagaccugcuucuggguuucuaugaggguuccugcgagucuggggguugacaggcaggcugcacccaggcugacuuuucucuucuugcucaugguaggguuuggcaucagcucauccuuucuuggcaucucgugggcacugcuggauuaccaucggucucugcguaccugucuucccuccaagccacgccugggccggaguuccucugcuaucuacuuccuguggaaccugcugcugcuggggcccagaaucugugccaucgccuuguucucagcugucuuccccuacuauguggcccugcauuucuucagccuguggcugguacuuuuguucuggaucuggcuucaaggcacaaauuuuaugccugacuccaaaggugaguggcuguaccgggugacaauggcccucauccucuauuucuccugguucaacgugucugggggccgcacucgaggccgggccgucauccaccugaucuucaucuucagugacaguguucugcuggucaccaccuccugggugacacacggcaccuggcugcccagugggaucucauugcugaugugggugacaauaggaggagccugcuucuuccugggacuggcuuugcgugugaucuacuaccucuggcugcacccuagcugcagcugggacccugaccucguggaugggacccuaggacuccuuucuccccaucguccuccuaagcugauuuauaacaggcgugccacccuguuagcagagaacuucuucgccaaggccaaagcucgggcuguccugacagaggaggugcagcugaauggaguccucugaggcagggucugauucagccagugaggaagauaaugcgaguggggccuugcaagggacaaggcgggccagucaugugcaagccauuuuuuuucuucugaagccgauggaacugcugucagcaaacacucgguuguuuguuguucucaccucucaggugauugguggcguccuggcuccugguucccuagcccgcucuagaugacacaagauucugggagaacucuucccuaccccaucccauccauucacuucaaccaacaaaugcuaaaggcacuuuauguucugggaacaccauccuggcuucugaacugccugccacucuagcuucuuucccugcccaccuggacagauccuggguagacuccuaaacagugaggccagguaugucccuccaguguccugaugcucaggccaccuuuauaccaagugccuuauggaccuguggucuaggccaugugaugcccaguaaguauuuucauucuccuaccucagucuauguggaagaacauauaugcauguguuuaacaguauuaaagccucaugagauucuccagaccaguauguaccacuaaguguagucuaucacccuuuacagacacguagaaggcgccuggaaccccuuaaaacugacacagaccccuggcauacaaaugugggcauagguuugacuuaauuuugcuucccaagacgcaggggcuagugagcccgagccgguugaucauucggcuagcagaacucaugggcagaugcuaguguauucuuuuagcagcuccguacugagccuaaagaggacuugaggauggggauggcagguuugaggggcuggauggaagguaaaggauuggggguucuuuuugggugagaggugcaguggcuucugggauguggucaauagcuccguggagguggcguguucugcucucggagguuuguggucuuguugggaaaagggaacaggagagaggcuccaggggcagaagaaaagguuccaggucccagugcugggacccagauaguucuagcagucauucauuuauuuguguggacgugaaauaaccugugacccaaacaagcaccaaguacugaaagaaaaccagauggagaggugagagggaggauguauguuguggguggaaguugcagcuuuauaaaaaaccauuggggaggaccccucugagaaacugaggcauagacuguaagcuacuucagcagugacugcagcauggagucugcgugguuuguuggagaaggaaucugcgaaugcuguucccuguggcacagcaaccccacuguaagaggacuguggggugcgguuggcucacagccaaggaggcugcagagaugcaggugggggccuggaagaggcucugggagaagguacuucuuauacuaaaagguacaggcugacuauggacagaaaggaccuaauuuccagaccugaauuuuacagaccaggaaaaggagccaaagugguuguugauguuaaaagggucugaaaaacagucaccaccuccguguucacucucauggaaaaacggauguaaucacaccagaaggugucauccucuaaacagaugcccccacagguacacaccugaaaucacuguuacucucauuuaugaaaaugguaagauagggaugagccagugugacacaccuaccagucugggcaaggacaucaggaguucagacuccucagugacaaugucagaggccagcuugggcuacaugagacccugucuccaacaaaaugaaauuauuuuauuuauuuauuuauuuggcuuuuugagacgggguuucucuguguagcccuggcuguccuggaacucacucuguagaccaggcuauccucaaacucagaaaucugccugccucugccucccaagugcugggauuaaaggcaugcgccaccacgccuggcacauuuuuuuuuuaaauuaaaaaaagaaagacguuacuacccugcucuuguuuugugacacacaaucuggucugagaggacccugagcacaucuuccuuccuucaacacuaccgugcuaaguucuuaaaaucugggacuuaaaaccagguuagugacauuacccguaguuaggauguuugguuuguuggggauugguucuaaugcucugucuuaauucggcucccagaaucacacgggaaucugcucugcuaaaggaagccugucacuaguuggcugugauugggaaauaaaguugcccagggcuggcugggcaggaaagaggcgggacuuuuagguugugagggcaaggaaccccggggaguuggaagcagagggauuucacugcgcaguugggucuggggcagcagagaugaaaugaugacuuagcaagucgacucagggagguuagggggguagaauguaugcuagucgcacggaggguuagacacguccagccacugagcuagucagagcauaucaaaguuagauggugugugucucucauucacaaaucccgggaacacuuggccagccgggagucaggggucuaagcacuacaggguuuggaaaccagccaacacuagaaucugcacuugugacugagcagggguacggacaacagcuaacagucuacuugagcugcacugcggcucagaagaucacuucccggagaaaauucaccuuggaguccgacauaucucaccuuuggaagcuagaaacaacuucuaauuuccuucacuggaacaauggguaaaaagcccucuuguaagcuagugggggccaaucagaccaaauguggcagaauguagaacaccugguuggugggacgggaagucaggauuuauuggguugcggcuuaauuaaugcucagcacagacugacuccuccuugguaacguucagcacacucgacagcucugaaauccauuccauuucuauaccuuaaaaagcaguguauuuuagaaacaauucaaauaaacauuucucucgcaaac

SEQ ID NO: 2167 - RNA, 31011 nt, Mus musculus
cgaugggcggggggucagugcgcacgcagucgcggucccuuccccgcccuuucucuucccgguuuuccucucagcugcugggcccggucaguggcagcuuccgguaggagcgccgcgaagcgcgacccggucucugcucacugucauguccuacggucccuuagacauguaucggaaccccgggccgucggggccucagccccgggacuucaacagcaucauccagacaugcaguggcaacauccagcggaucagccaagccagugagcgaggggacccagccgggagcugggggcggccugagggacagacgguggugaagcugccaagucggggagcccggucugggucgcagcucaggccacaccuugaggccgucgcgagccuccacucugggcgcggcgagcugccuuucccugggucggccaggcucgggcccuuuagguccacaccccugucuuaggcgguuagaguucacgguguugggggucaacagagccgacagccccgauggugggagggagugugugucaucuccaggacugugagcagcagucuugacuuggcgcaguggucagccgaguuuuuccugucgucgccgucccccucuccccacccaccuuguuuuccucaguuccgaucagggggugcuuacuugguugcgacuuuagguucacauucagcucagcgguuggguccucagacaucagcaacuuucaauuaagggaaguggagaaugcgugcguucgagugacuuaauacacuguguuuccuguaauuaaccuggacgucagucagugccuggcauuuaagggacgggaggacugcugcuuuauggcacagaaugcaccgggaacauuuuagguuagguugucuuuguagcgaacguuuuucccauuucaagcaugaagauguccucuucugccuccguugagagcuacucuuggccacaauuacacaccaaguaagagauggcaggguugggccaagucaguuuguaacugcuuaccuuaaaacucccuucuguagcuagagucaaguacaggcuguuuuugaguuucagaaucaucccagagcccuguaaacagaacaacagaagcaauuuuacuuuaaaaauggugacaaccaucuguguuguuuauuauucuguuuuuuuuuuuuuuuuuuuuuuuugugagcuuagcuauacuguuaauaaguagagucaguucugaauugcaguuauguccuaagcuuuaaagcauaagcuaccacugugcuuuuauuuucuuuuugagacaguuuuuuuguagcucugacuauccuggaacucacucuguguaccaggcuggcuucaaaauuagagauccaccugccucugccucccaagugcugggauuaacaauguacgccaccacacccagcuugucacuuugcuuuuauaucuaaauguauacuguaggauuugagagguagaaaguuucaggcaggaaggguuaggccuggguguauggagguaguacgaauacucagcuuguuaacccagauaugaaaaacacaauaauaauugaugacuagacaguaugguacuuugugucccaguuuccuuuuguuaaggagcuauaauacaggauaaaucagaaaauucuuuucaaggggcuggcaagaugguucagguaaagugcuugcugugcaggccugaccaucugauuugagccccagaacccagaugaacguggaaggagcaaauuaacuccacagagcuguacucugaccuccacacucagccacacucguucccuggcacacacaaugugucuguuuacauuaguucuauguauguuccacauaucauacacacaaaaauaauaaagaaaauuuugugccagguguugggggcggggucaugccuucaauuccaguacuugagaggcagaggcagguagaucucagaguuugagaggcuagccaguuuacagaguuucaggacagccaggggcuacacagagaaaccuuguuuugaaccaccagaaagaagaaaagaaagagaggaaagaaagaaagagaauuuguggguuuuuuuuuuuuuucucauugagacuaaccuaauuuaaaugacuguauguggaauauuucauauuugaguauuaaguuguauaguaagcauaggaacugauacagauucuuuuaacugcaaaucuguguuuacuuaaaucaaaauuagaguugaaacuggccauagucguacacgauagcauuugagaggcugaggcaggaggauuaucaugauuuagaagcaaaucuagacugccuaguguguucaaggugauccagggccacauugugagucuguuuucaaagggaaaaagggagaaagggaaggaggaacagagaaggaguuuaaaaccagagccugggugugaugagucaggucuguaacccuagcucucaggaggccaaggcaagacagucuccagguucaaagccagccugagcugugagucuuaaagcaaaacaacaacaaaaaaggugucgguguggucuaggagcaguuucuuuggugauagcuacugauuuagccguugauuaggcauuggggucaagggguuccuuagagucaauaguuaauaauguuacuagcuacuguuuaaguacaucgugugccaggccguaugaaaaguacuuuacauguaauauucuaaucuguaacaauccuguggaguaauuacaaacauucccagucuaugagcuaggaaacagacugagaaaggcuaaaggguugccuagcugaguguguggguuuuuuucucgcgauaagaugaacaucuucccuguuagauuguuagcuugcuugagguaggaaauacgauucauucauccuuauuuuucugucauuuaucuuagucccaagcauaugaugaguucuuccguucagcgugcgacaagcauucuuugagcacugauguucacuggugaugagcagagaacacacugcugccuggcauuguguggaucuuugcauguauuucccaauaauaucaaguaauagcaggugguacgaaggaaagggaacaggcuaaguccauggagggaagcgagaagggacgaauuauuauccucaggugaggaaggccucucuggggagaugauuuauuuuuuccaagacaggguucucuguaguccuggcuguccuggaacuugcucuauagaccaggcuguccucgaacucaaagauccaccugccucugccuccugaaugcugggauucaagccugcaccaccacugccuggguaggaugauguuggaaugagcagauuucagaauggagggagcauggugaguaguggagaaaggcagugugugcugagggcaaaugcaaggacuuucaugugacaaagaauagcaaggaggaagguguggcugcguuaaagguagggagcaaauggggaaagacaucagagagguagccaggggucagggcacauggaagcuuacuaauuguagccaguuaauuugagugaaugaggucucugucauuuuauuuguuuggcuugguuuauuuuauuuuauuuuauuuuauuuugagauagggugucucuguagcccuggcuguccuggaacuugcucuguagaccaggcuagcuucagacucugccucuuaagugcuuuuuuguuuuugagacaggaucucgcuguguaguucuggcugacuugaaccugacuaugagaccaggcuggucuggaacucacagagauucaccugccuuggccuccagaguggugggacuaaagggguguggcacuacaccaggcucugcauuauuuacugaaaaacuaagaaaccuuugaguuuuuaacuguuuguaaacuaaguuuggguuuucccucagcuuccugcuaguuuugugauguuuuggugaauuuugcuuuacgccuccugcuguuuccuggucuauggucauaauuauuucauaggguucugagaacuaacugagauaacuuaugugaaguguuaaaagagugugcgcuucaagauggguuccuguaauccucaccuuuggaaagugcaggcaggagguuggaauucaaggccagccucagcuacauagcaaguuugagaccagcuuggcuaugggagacccugucuuaaaaagacagugccuacuaccuauugagugaauacauaaaacauguuaucugucauuugguucuuuuuucuuaaacauaaccaguuuuuuucucacaguuuaauaucuacuuauauucuauaucccuuaauuaagacaagcuuuuugaccuugucccuagagcaguacugguuuggugggaugaaggaccaugcauuauacauuucucuuuagacagugccuggcacagcaguggaugcuuuggcauucaguauguacuuaauugauuuuaucauugcuaaguacauucuucuuggucuugaguuugauaauaauagcuguccuuaguugagugcuuuuauguggcagacggcuuucuaaacuuagcccaaaucaucucauuucauucucacaucaaccaaccgaagcuucccuuguuacugucauuccuuagguguggaaccaggacagaagacggucaucauuuacuuuagaucacuccgcugggaagugcuggaagcaacagucaggcauaggcaggccugcugaucaugugcuccacacccgugauucugucccuugagaggcagagucaggggaaucacauggaguucaagggcagccugggcaaaacggcaaguucugggauacucuagccuacauagagaguuccaggcuaugcagggcuacauauggagagagaaccugucuuaaaaacaagaacacagucucaauucagaacccguguucuuaacagccacaugugcugucacucuugugcaaagugggagauuacgccuuugguuguuaguauacagauuuacuauccuguuuagugacugaauuuuugggguguguguguguguguguguguguguguguaauaaaaggucucauguaaccuuuaacuccugaccuucuugucucugacucucaagugcugaagauauguacuauaucacuccugacaaacccauuuucaaaaguuaaaucccagccuucaagagacugaggcaagaggaucaggaguuugagucuagcccaucaggaaauggaaauaacuuguucaauuuauagagacucuaucuuuauaaugggggcuggggauguagcucagucucaauaaauauguguaucugugaugccuauaguagguaguuuuuacaauuucuauguaauaucauuguuuaagccuaauuuuguguauagaacauugaauugacuucauuuucaaaaucagugcaaagaccuuguuuggucuagauaguuuuuuuaggucuguggauuuccuuuaucuuaucuuuuuauuuauuuauuuauuuauuuauuuguugguuugguuuuuuugagagagguuuucacuauguguucuugguuggcugaaaacuauagaguuuuggcugccucugccucuugagugcugggauuaaaccacaugcuaucacacauggccuuguuuuauguuuuagugcaaguaaugcuuuuuauauuaaauauguuuguuuaugaguguuugccuguguguauguauguguucugcaugcaugccugguacccucauaggucagaagauggacuguuguuaguaggugguuguuagcagacaugugugcuuggaaucaaauccaggucccuugcaagaacagcauguuuugaguguauugaauuagagcauuagauugucucaaagagaauuauuguccaaucugugugacggaaaguuacuuucaaugugauuaaauagguuuggaccguaguuugugggggagauuuagauuuugcugauaucuauuaaaagcagguaagaaguugaaguuagaauuauucuugguguugauguuagugauaguguacaauaaucgacuuacuucauggucuuuuuaaaaagagcuuuagccaggacacaccuuuaaaggaggaggucagugauaggagaggcuaagggcuaguggguucgcuuuugguuugguuugguuugguuugguuuuucccaaucucuguagauaucugagauugccuagaacagauccuucuugccuuuauguacuaagugcugggaugacaggcuugugccaccaugcuagaccuaggcauagguacaaaauugacaaaauugcuuacacauaacagaagggguugucuucuaauauuaggagauacucaauugucuuuauguaagauauuuuaaaauuuauuuuaugugcauggacauuuaccuguauguauauguaccauaccugaagagaccaaagaaggucggguguuggguccccuggaacuggaguuaaagacaguuguguguugucauggaggugcugggaauugaacuugaguccucugaagagcagcagaugcuauacucuacugagccaccucuucaguccauacguagaguauuuuaccaaggguagggauguaguucagugguagagcacgugcuuagcaugugugagauccuugguucgcuccccagaugaucugcacaugcagucauaguacagagcauuguaaguguccaucuuacacuuuaugugcuggggauugagcccaggacuuuaccuauaucguaggcaagcaccaccacugggacagaucccuaacaguaacaugucagucaaaaggggcugaggagguggcucauuugaggaucugcauuugaucuucagaaccuggaugugguacuuaaaguaccaggagacugagacaauugaauccuuggagaucaaaggcaaaccauaguguauggcacuugaaggaugacacccaggguugucaacugacccacacacucccacacauucuccucaccccaaaauaaaacuuucauuugcuagaauucuuggaagaggagugugcugguuuauagacuuggcucagggguuaagaggaucuggguucaauucccagaacccagaugguggcucacaaggacccaugacuccaguuccuagggauugauguucuucucaucuccucaggcaccaaguacacaaguggugcacagacauacaugcaggcaaaauauucauacacauaaaauuagaaaaauaaguaaauaaaaggaguauucacguuaaucaaguggacagaagguccuuuuagacuuaacucauuuuaauaaaaauauuuuccaaauuaucauuuugauauuuuaagcacacucaagugaaaauaaaugucuggguaaauguuccuguuuugugcuuuguguuuugggaaggcuuccuuucuuggguguaagcugugugggccaguggucccuaggcauuagucacaguuccucaugcugagcuuacagaaugcagucggcaagaagcucugccucggugucaaguaaaugaaagacccugucauccuuuugguuuggauuuuaaggcaucugaaaagucuggauggaaacuuguaggaagauaucuuagcgaucaguauuauagagaagaggggcuggggcgauggcucagugguuaagagcaguggcucuuccacagguccugaguucaauucccggcauccacaugguggcucacaaccaucuauaacuguggucccaugggauccaauuugcaaauauacaugcaggcauagagauugaauuccuuggaaaagauggaugagcauaaucaucauggcucuaggaauucuagacuugauuucaaauaaagcaaacaaaucaaaaucucuucuugcucaucagcaccaacuagggucacgugggcaucaugaaaacugcguccugagccgcucaucgaugcuaagacccugacugagcucaguaaauguuaaccauacaaggagcauguggacaagugguccaaaggggagagagagagagagagagagagagagagagaaggagggagggaagggugggaagggcgagccaagaaggcucuucauucauucuggugcuuaguaagcaaaugacuccaaaguucccaacuugacuuccccaaacuccuuagcuaggaaguccacaugauuucaacaaaggaaaccaaacagaugagggaaaaguccucccucacuugcaaauacccagaagagagcugauuauugagcuuccuagaguauuuaaugcuuugaugguaaugaacagcuagcuacauaccuugguacacuuuuagauauucucaguuuaccuuuugcuccucccccaaaacaguuggaacucacucuguagaccagacuggccucaaacucagaguccaccugccggugccucuugagugcugggaucaaggugugugccaccacugccuggcaucagcuuacuuucagaacaguuucauucuguagucuagguuggccuugagguucagauuucccauauccuccugagugcuggcuggcagucaaguguacgcugcgugcauggcugccugucuuuuuauucguuuagguuuauuuauuuauuuauuuguucuuuugagacagucuugcuuguguagcccuggaacuuacuauguagacuguucugccuuugaacgcacacagaucagccugccuuugucucccaaguguugggauuaaggaaggcaugugccacucugcccaguuuacacauugcauuuauaagauuaagaaagccauacaugccgggaguggugacgcaggccuuuaaucccagcacuugggaggcagaggcaggcgaauuucugaguuugaggccagccuggucuacaaagugaguuccaggacagccagggcuacacagagaaacccugucucgaaaaaacaacaaaaacaacaacaacaaaaaagaaagucucagguagaguaucucugaggcacucauuuggguuacagaaaaacuacauuauuacccacuaugcauacuuccgggacuagaguguuucauugugacugacuuugggagucaacagugugggaggacuuggaaaucauuuaguccucaguagaagcagugucuaaugaggggguagggcauguaacucagcuggcacaguacuugcgugacacacacaaaucuuuagguuuuaucucuagcaccacaaaaucauccuaucucuagcaugauaaccccugcccgagaucacccaagaacuccagaaguggaggcaggaagaucagaaauucaaagccauccucaguuauguagggaggccaaccuuggcuaaguggaacccugccucaacaaacuacaagauuugaugagaaaaauugaaaauuccacacauguaguaagucuucaauaaacauuuaguuaaaucaggauauaaucugcaaguagugaaaaaggcccagcaaaauaaaauagcgcgcccaauucuguacaccugguaaugggugcguauggcugagaugugaaggcucguauuccuaguuuaccuugauucacaucuuuugccuugccaugcaugccaugaaguugaagggagaggcugacuuacucaauauccuugcacgcucugaguaccuggcacugugcuggacuccagugaggacagaggcauagucccagaaaugggagggcaccgggaagggagcagguuagagccaggauaucagucuaucugcaguuagguuaagguacugucagauaaacagguuggggcaaaguggaacccuggggaaucagaccagcccugugugacugcauucuauuuccuuuaagacucagcccuuggagagcaacauuaugugacucaaagcauauagucuucggaaccagcccuguguuugaauucuaguuauggcaugcuguucauaacucaacaguagcuugccauuuaauuaaaaucucauuauaauugcacaagguccucuauaaccuggcuucccacuaccucuuuggccaguacuuaucucuugcucacucagcuuuagcaguaccacaccauuggcuccccuuuugaggacuuugcccuaguuaauuacucucuuugcccggacuacccccucuuuauaagugccuugcccugccuggcauuuucuuuaggucuguccauuguuuccuuauguggccacucaugugagugaguacccucugccuacuccuucaccuccacuuccguuuauucccuuugguaggauuguuaucaccuuguguuuuuguuauccacccuccagaucguaagcuuccggaagcaagugccaccuaguguauaggacaauguggaguaagcacuguucucugagugaacaagucaggccugucacucuugggcugcuucugcucacaugaugcaggcgcaugcugaagccuuacagcgcugcuuaaggucaaauagaagccugccaguaaccacagugucugcauaguaagugcucagugcuccugucugcaccgccccucguuuugaaacaagguuucaugugacuaagguuggaagucuuucucucaugugaguuucuggguucaaacucaggugucagacuuuacagcggaugucuuuauccgcuaagcuguccaacuggaaccagaaggauagauuuuuaaacuccaaacuuguaguaaguggacauccuuguugcuuagcucuggaagcacugcauauguguucccuguaugauggugacaguuagacaacagcacuggcuugucacuugcuugacuaagccuguucuucuguagugugguggcaggaacgacacuuugacauuauccagagggaacaggaaaggugcuugccacagaggagcuaccuuugucuaugcaguguuaucuguugaaauucugcugcaacuuaaaaauggguuuccuuuguuuucacccugccccacaagauaagugagaguggagaaggaaggaaaggcugcgccaucagcuguaaacaccagccuggcagugauggugcaggccuuuaaucccagcacucgggaggaaggagcagguggaucuaugaguuuaagaucagccuggucuacagagugaguucuaggacagccagggcuacacagagaaacccuuccuugaaaacaaaacaaaacaaacaacuaacaaaacuaguaguaaacaccacuucaugcagacaaacuaagaauauucuauuaaugaguucuguucuuuagguaucgugaguuugcuugugugacgucuuggguucaauuuauaggagacagacagauaauucacaggcauacauacgcauacauacacauauacaacuaucugccaguuuaguguaucuuuccccuccuucucugacaacuugggggaaaaaaauagaaagccaggcaagaagaaaucaagggcucugucucuguguugcagaaacuagugccagaacagggauaggaagguuccaggcagagcaguacuaacguguucccuauugaucggccuagaccucuucaggcaaggagauuagaugucagagauucgaacaugaacauuccuaggcuaccagauaucuagggaaaagaaagggcugaguaaaacuguguguuuggcugugaugccaugugggaaaagaacacuuuccauuggagucuguaugccuggggaugaguuuuuacuguguuacuuuuuaugugugcauagauaagauacauguaucuauuuucuaacuuucauuguugugaaaguuagagaguguguauacaauuuaauggaguacuugauauagaagugcuuagucaguguccaucuguuacugacaaugaaccugcauuguuuuucuaaaaagccuuugcuguagaaugguggauuuuuguauugguggauaagucuuguuuuugagacagaauuuccugcauuccagacuagcuuuaaauuugcuauauauccaaagauaacuuuugaacuuaaaggcauacaucauguuuuuuucauguagugcuggagauucaacccagggcuucaugcaugcuaggcaagcucccuaccaauuaaacuacguuuguagcccccauggguuaaaauuguugaaaguucauauagugacucaaaaccuguaaugucaagaaaaaugggaguaaaaaagagaaucaggaauucucccacuagaccauuuauucucucccuuaugauuccuuugggucacugagaauaauucuuuucuuauuuauggcugauaauccaacuagacuaaacuaucuggagucuaacucauagaauguggggcaggaagauaggagauugaagcuagccuagucuacagucucugucucacaaaaacaagucagaagauauugucgaagauuguuguagcuuugagacuacaaaggugaugagugcuuccuugccuuuuuuuuuaaaaaagauuuauuuauuauuauauguaaguacacuguagcugucuucagacacaccagaagagggcaucagaucucauuacgggugguugugagccaccauguguuugcuggaauuugaacucaggacuuuuggaagagcucuuaaccauugagccaucucuccagcccacuuccuugccuuuuuuaugcuacuacgauggaacccuugaccuugggcaucacacuaccaguuuccugccuucucaguccuaaugggggugaaauguuuagugucaugggacauuuagaagaauuauucaguucuuuggagaagauaaauagaacuaccuucugaaccuugcaaaagcacuguggaggaauguguuuguaaagauuuuggcuuuaacaugguuccuguuacuugcauguuaggauauggggugaccagugcucugcagaauagggugcucaugaugaaugugggguuuuuguuguuguuguuguuguuuuguuuuuuuaaauaaaucuuuccucuuuuuuuuucuagcugcucagauaaagaauuugaugagccaacuuggaacuaagcaggacucaagcaaacuccaggaaaauuugugaguagcuuccccaaaagguugaguuuugugagagccccaaaagggccuaggccuuccucagggaggugaggucagagugggaggugaggguuggguggugauagcuggaccuggaagaggagagcaaaguauuucaguggauccagauuucugcugccuugaacuguuucuuuucuuggucugguuuguggaauaguuuaagagagguagagaaggaacucccuccgcucucagcugccucagggagcugugucaguauaacccugcguggcugaccuucccacugacacgugacuccugaugauuuagucuacuuggauuuccaacuuuaacuaagagacaguuauucucagugacacaaaggagccauagggagagaauaaauggucuggugggagaaccaaaccuuuuuguugguguuguucuuuuuaaaucauauuuuucuugacuuuauuuuuguuuuaaaaguucuauucuugcugagugugguggcacacaccuuuagucccagcacuggggaggcagaggcaggcagauuucugaguuggaugccauccuggucuacaaagcaaguuccaggacagccagaaguacacagagaacccaacaaaacaaaacagaauguucuauucuuagggguggagagauaguucagugguuaagaguacugguugcgggcuggugagaugguucagcagguaagagcacugacugcucuuccgaagguccugaguucaauucccagcaaccacaugguggcucacaaccauccauaaugagcucugacacccucuucuggugugucugaagacagcuacaguguacuuaauaaaucuuuaaaaaaaaaaaaaaaaaaaaaaaaaaaagcacugguugcuuuuccagaaggcugagguucaauuccuagcaccaacuuggugguucaugacuguugauagcucuauuucuguggggucuagcucucuuuucuggccucugugggcacuucacauauauagugcacagacauauguugcaggcaaaucacccauacacauaaaauaauaaaguaaaaauuuuauucuuuggugcuggaaaaauggcucagcaaguaaagaaaaguguuuggaacccacaugguauaaggagaauucaaaauucugggaaguuguucuguaaugucagcguaucucaugugcauccuggcacaccuguguccaaauccaucaugguacaccuacacacacacacacacacacacacacacacacacacacacacacuaaacaaauaaauguaauuuucucuuuaaaguucuguuuuuuaucuccggcugggcucaaacucacagagauccucuugcccaugcugggacuaaaggcgugcagccccguagcccagcucuguccuuuacuguaaaguugguugagcagcacuguuugcuuccucgagauguugagagaugagugaguaaguguuagcgcagggagcuauacuaaggagaggugacaugucuccauaucuuagugcuucuagaaugcucuggcuccugauuggcucccucuuguuaucucucuacuuuucuaaucuuagaagccugcuugcagugaaaaaucacuguggaguccugggcacuaaggcugcugcagcagucgaucauaggccagauaguuuauagacaaccauaguuuuauuuuucauaguccccgagggugagaugcugaaugaaggucaaggcucuggcagauagcgugucagaugagggcccucuuuuccauggagaauguuugggguuuguuuuccuuuugaaaugguuucacuauaaagcccuggcugcccugaaacuuacuauguagaccaucuagccuggaacuccaagccaucuacccacccaaggauagggaugaaaggcguuugccaucacacuaggcagauggugccuuccuacucgguccuuacuugguggaaugguuccuugaaaggcccaucacaggcuaaucauuuucuuucuuuuuuaaagauuuauuucuauaugaguacacuguaccugucuucaaacacaccagaagagggcaucagaguccauuacagaugguuuuaagccaccaugugguugcugggacuugaacucagaauauuuggaagagcagucagugcuuuuaacuucugagucaucucuccaguccacuaaucauuuucuaauccuaccuccuaauaacaucacuugggggcuuaggaguucagugggaauucagaccacagcauguggcuucucugucaccccauaaaaccuuuguagaaauggccggagaggagaggucgccaugaugggaagaaccuguguuuauuuauuuuuauuuccauugcaucguauuuauauccauguucuuccucuugaauuuguuuguuuguuuguuuuuguuuuuuguuuuuagacauuuacuguaggaaggcagagagagggagagaguagggaaguaggcuggccauggccacauggagagagacggaaagggaagauggagagaagagggguaaggggguaagaauaagaggaggagcucccuugaauuucuuuuuccuuccauccguucaucccauuuuguuuuagagacuggccucaaauguuccuccuauaucagccucagagaagcuaggacugugauggaggucacagcgcccaucaccuagcuucuuugugguuuuugguuguuaguguuuauggugcuacagacugaguccauuaucuugcagaagagguaagugcucaaaacagcauaggguccagaugccaggcacaaugaugaaggcggguaggggcaaaggaaaaauccacacaaggaaccaacuuuugguugggaagagcuugggaaugggucuuuggaacuuuuuccuagguauguaggaagcuaugcuuuuaauacguguuucaucuaacggcccuagucaguggacuaauaagugcugaccauacagagcuccugggaggucaguaagaacuuuagagugaguucaguguguugaagucauuagguuuggguguagguaguaauuacuccucuguuucuauagaauacagacauucauuuuuuccuaaauaguugaaacuccuggucugugcuugcuucagcagguaucauugagugagcaucuuucugcucaguggaacugcuucaguaauggagaaggccuugcccugggcuugugagcauagcacugaaggaagcucuuguucuaauggcucuucauuccuuguacuaggagucccugagcacaaaguaacaauaagagagcucucaagaagccacagcauccugacccugucuuuucucucuuaggcaacaguuacagcacuccacaaaucagcuggccaaggaaacaaaugaguugcugaaggaauuaggguccuugccccuacccuugucugcaucagagcagguugguauuuucuguuuuguuuauuaauagaggaagauuuuguucugauggaaugguaguauagagaacaaaaguagggcuuugguucucgauaaacauucucuaaaccuuaauuuccuuacuaccuuccccaguuucauuucuguugcuaugauaaaauaccaaaacaaaaagcauccuagaggaaaauucacaauuccagauuauagucucuuauugugggaaaaucaagguagcaggaacuuggagcaccucgucacaucucguccacacucaagaggagagaaaugagugcgugugugcuuguucuauugucacgugcugugcuuagcuccauuuuucuacuuuuuuaaaaaaguuuuuuauuaucuuuauguaugugagcacacuguugcucucuucagacacaccagaagagggcaucagaucccauuacagaugguugugagccaccaugugguugcugggaauugaacucaggaccucugguagagcaaucaaugcucuuaaccgaugagccaucucucuccacccccauuuuucuccucucacacagcucaugaucuccuaccuagggaauggugcugcgugcagugggcuggauucucccacacuagucaguuuaguuaagacaaucuccuauagacacguugacaagccaauucaauguaaacaaucacucauugagauucuuuucccaaauaauuauagguuguguaaagaugaccaugaagcuacccacacagagaggcagcaugacuacuguggcaaugaugucuucccagguguagcaaagugccuggcauccaucauguccugagugugucauggcugcugcuauuacuaauaacauaguacaguguauuuagccaaggaggaaucucaguguuugcaucucuggacuuuggcaucagcuggacuugcaggcugagucuuuaguuuguuuuaugccucauaucuauaaauuuugacuaaauagcuuucacaucuugcagucacuuuuguaucucaggucacucauagguguuaggauaaaggaaugcucagggaagacuucuuuuccagcuggagauguucugucauugagugcuuaccuggcuuguguacagcaucacugacaauagccauuuuagugcauguguccucugguuaucucuguguggcugauugguccuuacucaugcugaggcuucagugaugggccuguucuccuuccauccauuucuuccaccuugcuuccaaaucaucccuuucuccuagcugugcacugaaggagaacacauuugccaaucguuucuaugguauugacaaaggagucuaauugccugaugcaggcaaagucuuguaagugcuugagaaugaaauacuagccccagcaaaguauaaauagaagguuaggucugcuaccaaaaccuucaucuaauguguuuuaaagccaaagacguaguuuuggauuacgcaugcuauuguucccuccauuagccucggucauuaagaacacaaacuagaguugcaaacacgcucuccuccgugaaaugcaguucucucucucccguugugcugacuucccuuugccuucccguauccaaccuggcucauccccauuacucaucuuuucaccagugcccuguauguuaggccaguggcucucagccugugggagucaaaugacccuuucacaggggucacauaucaaauauucugaauaucagauauuuacauuacaauucacagcuagcaaaaucacaauuaugaaguagcaaugaaaauaauuuuaugauugggggggucaccauaacauaagguacuguguuaaaggaagcauuaggaagucugaaaacuacuguguuagaccauaugcccugcuuucuguuucccaugcauauaugcuguuagcagaucucucagcuguugacuacuguggccuuuuuuugugcccccuucuuuugagacaguauuucacugauggugcccaagaugggcuucagccuucuucacugauucuuucucaaaguuggcaaccccagaguucugcuaucgaucuucugauuuccuuuccucagcuuuuuuuccccaggaguuuugcuuaucugauggcaucagugucaucuauauaaugauggcgcgcagauaguucccaaacuugagcucuaaagcccucaguuauuucauugugcuuccugcuaugaaauaacugaguuauaaucaguuauuaccaguccuuguucaacucuucucucaaacuuaucugugguacugggaauggaauccagagccuugcauaugccagauaccugaucuacuacugaauuauaacuccaguccuugcuauaucuccucuugaauauacucucucccuauaaaguauagcaauaauggucuuauucugaguuucucauucaaaucugugaaauaaguugauuggguauauuuaucaucacagaaauaauuugcaaauaagggcugggaauauacagcacuuagcugguaugugcagggucuuugguuccaucccuagcauagggaagaaaaaaaaauguaccuuuugaucaaaaaaaauuugaaggaaaguguaaauuacuaauuacaaugagacucacuuuaacuuuaguuaugguaauuuaaaacugacaauaauggaaggauuuuuuucauaaaauguaguaaaaacaaguucauaaaaaugaaugcacuaauuaaaauuccuaauuuuaaagaauauaguaaugcagaaauaugauauauuuuuaaaauggcauuuugggacggagggaaacucagugugguuccuugguauguguuugacccaaucaguaauuuuuauuuauuuaugugugugcugguugguuggucaguuggucucucuguguaguccuggcuguccuagaacucuccauguagacaagacuggcuucaaacucacagagcuccaccugccucggccucccuaguuccuguugggaucaaaggccugugcuaccuaccaugcccagcuucagcaauguuagauggcaagguuaggagugauguuuguuccuuccuacaacaguucugccuuugcaccaagugcuaggauuacagcccacagaguuuucuuuggggggguuguuuguuugagacaaaguuucacuuuguggcucuggcaagugcugggaucgaaggugugagucauuguguccagccuguuaaaaucuuuucuuuuuuuuuuuuuuuuuuugguuuuuggaaacaguguuuuucuguguagcccuggcuguccuggaacucacucuguagaccaggcuggccucaaacucaaaaauccucuuggcucugucuccugagugcugggaucaaaggcgugcgccaccaugccuggcuuguuaaaaucuuuuuaaugcaaagauuaaaaucccagaaauaagaaaauuuuccucaccaaaauuggcuuucaguauugccaucacuuucccagguuugaagccuaagucauucugacuuuacccucuuccucuaucucuagucacuaagucguaauguuucuuaaacuccuuuuugugacccaguuacuaccauuauguccuucuacccauuaaaccuagauuguugcaguaauuuuuaaauuuuccuuccagcuagcaagccucacagccuaauuucuccacauuaguagguuguccuugcuaggcaguguccccaacucuguugguccacuccucagaggugacccugagugcacuaguuugacccugcuucccuguuuuucuguuuuagcucucuuaugaauacaccuuuggguccaaccaaacugccucuuuuuuuuuuuaagauuuauuaauuuuauguaugugucuacacugucacuuucuucagaagaggucaucagaccucauuacaaugguugugagccaccacaugguugcugggauuugaacucaggaccucuggaagagcagucagugcucuuaauugcugagccaucucuccagccccuccuuuuuuuuccuuuuuuuuuuaaaauaaguuaugauauaggaaaauaaacuauuuuaaaaauacaguauuggcugggcaguggagguacaugccuugggaggcauagguggguggauuucuaugaguuuaaugacagccugguuuacagauggaguuccaggacaaccagggcugcacagaaaaacccugucuugcaaaaucauuaaaaaaagaagagucagaggaggaggaagaggaagaggaagaggaaaaagaagaagaagaagaagaagaagaagaagaagaagaagaagaagaagaagaagaagaagaagaagaagaagaagaagaagagcaggagaggaagaagacauuauuuaagucagaucuguagcucagagcaaguucucaguuuauaguuuugagagagauuaguauagugaagauagccuguaaguaaauaaaguugugguuuuuuuuuuuuaaguucuugaaaauuuuaaaacucaaaaagaaaagcuguaaagaauaaugguaauuuugaggaaaacuaauuacuuaguauaggaaaauggcuccaauacccucccuuaaaaaaaaauuagaugcacugagcucaaaauucuuuacuaugcauuuagauucuccagggaccaaauauuccaaauugcgauuccuuuugaguauugagguaaaugcauguagccccaaguuuaucagcgugcucugaccugggccguagggcuagcugggacuguaauucaggaaggaaacaaacagcauuuaaggaaaagccgauuuuguaauaacuuuuguacuuugaaaucucuaaagugugcaauugugcuuuuaaucaguauuaaaccaaauaguucugaguucacuugagaguucaaguucuuguuuacuuuguucagcgccagcagaagcuucagaaggagcggcucaugaaugacuucucgucggccuuaaacaauuuccagguugugcagagaaagguaucugagaaggaaaaggagagcaucgcgagagcgagagccggaucucgucuuucuguaaguuccuucccaagagaaggccuuuagcagcccagagggugcagcccagcacgccuccugucuccaccagauaccgugcuuuguguucucgguccaacugaaaggcagauucaccuucuccuauuucguauuuguuucuuacucaagacagauugccagagugucacuuauagauguggucggagcggaggcugucacuccuuaguacuguagccaaggcagcucuuauuuuguguaucucuggcauguuuuuggauaacagcagcuacaaccaucuguuuucuaggcagaagacaggcagagagaagagcagcucgucucauuugacagguaaaaggucacucauccaacaugcuggauaguuacugugaguccacgccuuugugucuauuuuucuuuucuucucucucucucucucucucucucucgcucucucucucacacacucuuucuuucuuucuuucuucuuuucuuuuuuguauguuuguggagguuuuacuugcauguaauucuguguaccauguguaugccuggugcccacaaaggccagaagagagcuuuagaucccuugaaacuggaguuucagauagcugugagcuaccauguaagugcugggaaucaaaccuggguccucuguaagagcaaccagugaucuugacuguugaacugucuagucucuuugugacuauuuuuacuuaaaaauuaaaaaaaaaaagucagggcuaguuguaguggcacaugccuuuaaucccagcacuugauaagcagaggcgaguggaucucugaauucaaagccagcuugguuuacauagugaguucuaggacagccagagccacauaguaagaaccuaucucaaaaagaaaaaaggaaaaggaaaaaaaaagaaaaaggauccgggcggugguggcucacgccuguaaucccagcacucgggaggcagaggcaggcggauuucugaguucgaggccagccuggucuacaaagugaguuccaggauagccaggucuacucagaaacccugucucgaaaaaccaaaaaaaaaaaaaaaaaaaagaaagaaagaaaaagaaaagaaagaaaaaggaaaaggaaaggaaagaaagcauaaguaaauaagaucaggauuugagccaggcauguagugcauaccuguaacccuaccacuuuaggggaugaggcaagaagaucaagagaauaggaggcagccaggcuacauagcuugucugucaaauaaguaaauaaauagaguugaagagaugacuuagugguuaagaacacuggcugcuuugcagaggaacaggcucaguucccaguuccugugguggcucauagcugucugcaguccagucccagaggauccacugcugucuucuggcuaccacgugccaugcccagcuccauuuauuuuuuuuuuaaagauuuauuuauuuuguauauaugaguacauuguagcugucuucagacacaccagaagagggcaucggguccuauuacagaugguugugagccaccaugugguugcugggaauugaacucaggaccucuggaagagcagucagugcucuuaaccauugagccaucucuccagccccccaauuuuuuuuuaauuuaauaaauaguacuauuuuuuuuguaaguguacucacagcuaucugaaacaacaguuucaagggauccaaagcucucuucuggccuuggugggcaccaggcauacacaugguacacagaauuaccugaaaaaaaaaaucaaguugcaaauauuuuauuagcuuuuaguuugguuuucucucucuuuuuuuuuuuaaagguugauuuauuuauuauauguaaguacacuguagcugucuucagacacaccagaagacgacaucagaucagauuacagaugguugugagccaccaugugguugcugggauuugaacucaggaccuuuggaagagcagucagugcucuuaaccgcugagccaucucuccagcccccaguuugguuuucucuuaaguggagucuuuuccaagaaaaguccuggagccagauguguuucugacagauaagcugguaaaacccuguuugguggcuuaguguauuuuccucccuucacugagugccucugguuccagccccacuuauacuuugagagucuccuggaaagcugagucuguguaauacauggagucaaaccucugaaaccucuggauacuuccuuugucuagcaaauccuagcaagacugaaacaaacaaacaaacaaacaagccuagguggaaaaggcagaggucuguucuccacaauucugccucaucucaguuuugccuguggcugaaguuuucuuuucuuaucacaucuuugccucuggaugagaauacggcccacggggauuuuguacugauagcagaagaguugggucuugaguagcaucugccuagguucugcuguuagcagagauguaguuaugucuccucauaccuuagagagaaggagucagcuggagugcuugucucccuguagccaugaagaguggaaccaaaugcagagccaggaggaagaggcggccaucacugagcaagaccuggaacucaucaaagagagggaaacggcgauucggcagcuggaggugagaggcaggcuauggcuuuuauuuggcucaagugucugcauauauuagggaaaaaauauuuuuuugccagauuuauaugaaaagggcuguguuaagucuuuguguguuuguguuuuuuuuuaauuuauuuauuauaucguaaguccacuguagcugacuucagacacaccagaagagggcaucaaaucucauuaagaaugguugugagccaccaugugguugcuggaauuugaacucaggaccuccggaagcgcagucagugcucuuaaccgcugagccaucucuccagccccuuuguguguuuuauauuaucuauaaauuuaguuguggcaaaauugaacuucugcuauguucuguuggccuggccgcucaaaagcucccagauucuugcucaaaccccauuuacuguauggucucugggagagacucaugcauggaaaacagcaaagcaagcgauacucuguugauuccuagaacucucaucucaguagcuaucuccaggguaagcaggguucuguguggagagcucuuuuucauagucugcauagcccagccgaaaggcaggcuccggcucugcuuuuguacauucuaaaguccaguuccaaguauagcccuugccccgucauugggucagacuuggaaacacuuuugaugugggguugagggaaaguucuguaagcuguccuuggcuccuugagcuccaucauaaccaaggcaacugaguuuaaaaaaaaaaaaaaagcauuuaaaaaauguuaucaaaaguaugaucauaugguguggugguuuggaugaguauuacugcaguuguagauuauuucagaaggacuaggaggugugguuuaaaguuuuaaauguuuaaaauuuaguuuauuuuguauuauguuuaugagugcucuuggggaucagaaaaggggucagaucccuuggaacuagaguucugggugguugugagcucugccaugugugugcugggaacugaaccuggguccucugcaagaucaacaacugauuaacugcugagcuaucucuccuccagcauuuaaguagggacuugcuuacaguuuaggcaggcaggcaggcgggcuuugggagcuaacaucugauccacaagugagagagacagagagagagagaacacagagagaacagagagaaagaaaaacaugaauugggccuggcuuaggcuuuuggagcuugaaagcccacccccugugauacaucuccucuaacaaggccacccuuuccaauccuuccuaacccuuccuggauggcccuccaccuggggcaauacuuauucacaccauaccauacgcacauaccuuuaacaggcaccaguccauugcucuuccaccugacuuguguuugccauggcuuauuaccuaugaaaguauaaaccugaacauagagaaucuuaccuccaucacugcuggagauacugugcagcugagcccaccaagcugggaaguuauugaacauuuucagucagaucagcuuccaagugauguccuuucacccugccaacuguucuccaacaguuugucaguuggaaguuguuuauagggcaucauucaagugacacagaauccgguaguuccucacauaguuccucacauagucugcccuguggaaaccaucuccuuggcugcuugucuucuauguguucuccaggcaacacaguccuauagaagccauuuaaauucucuagucagaaggccuaguaguggcugacguuggucugcucucccuagagccgucacacugagcauguguccaccacagcacuccagcgucugguggauacaguugaggcuugaaugaucuuacuaguucccagguaacaugggcagugaauauugcucagugagugggguucgugucuguuguucuacaguauuagguaagcagcaauagauaguuuucuauucauggagaaaccuuuaaaaugcaugugauuauuaaucuuuagggaaagaaaagaaaaaucuucuagcauauugcuuagugugagcuaauuguuuuuguuuuuguuuuuuuaaucucccuuaggcugacauuuuggaugucaaucagauauuuaaagauuuagcuaugaugauccaugaccaaggugaucugaucgguauguacuauuaauacaucuaaccuuagggugaguacaaagaacucaguaagaugggucacugggaacuuaacuuaggaauaucuuuuuuuaaaauuacugaauucauuuaaguguaaaggcugaagagggugaacccuguucauuuguuacagccugcaagucuguuagagaaaggccugucacaccccagcuuugagcucuagacgcucagggauugcgggguuaguaacuuuuaaaagcuuuuuaaugaggaaaugaucucaaauuuauaaaaagcugcaaaauaaaaacaauagaagaaaucuuuuauauaucccuacccaggauuuuccugguuaauaacauugugcccccuuuauuuugugauguacaccucucuguguguguagauacauaaauaugccgucugcacccccccccagucuuuucucuuaaacucuauauagguuacauaauuaguaaccugcuacuauuaaauaugucaguguuuauuuuugaagaaugguacuguucucuuaucaaguuagaaacguguagcugggaaugguagugaugccuguagccucugcacucaguggcugcaugacggucgggaguuuaggcagcgucagguacagggcauguuguugaggaugcugaggccaucucagacuccgugagacccuaucucagaagacuaaaugaaaagaagcacauuucugaucucguggcuggcugguuuggaugguaauggugaaucuaaggccugugccaucagacauguucagaggggcuggauagauggcacagcagcugagaacagugucugcccuuccaaaagacuauggucugauucccagcaccuacucaccagcucauagccaucgguagcucuaguucugagggauccaacacccuccaggaauguacaugguauacagauugcagauaaaacaucuauauacuuuuuuuaaaaaagaaaaaauuugcuuguuugguuuuuucaguauugaaauaccugaaugugcuaaaaugugcaucguauguuuuacagauagcauagaagccaauguggaaagcucggaggugcauguggaaagagccacugaucagcuacaaagagcugcuuacuaucagguaaaagccagagucaaagaaagucacucuaugcuguagacucugugaacuuccaggcuguguuaacacauugcuggcagcugcagucuuuugcuugaguuuaagcuggaugcaggcagucauaguuugcagcucuagucccauuuuuaguauuuauuuuuguagccagaucuccaauaccaucaaauccugaauaacuuacauagaagcuguguggcuauaaagcuaaugccacgagcuagcuugaugccuaaagucuagcaugaugcuaaccuuauauccuaaaugggggacuguugggagaguaagagccgcaggacagcagagcuucagagacccuguagccgacugcugacucagagcauggagccauagaaccggcugugacggacggcucauggugaacaggccucaggcaccauggaggugauucugcuggcuuuaugacuuuuuugagucuuuuuguuuuguuuugugagacagggucucacuguguaguccuggcuggcuuggaauucacauuguagagcagguugucuuggaacucaaagagauucuccugccucugccucccaugugcugggauuaaagguguguggcacagcacccuacucuuucugagucuauaguugagguuuuagauauuaaaaaugguguuguaugaccuuuuagagguaacuagcauuuuagucauuuucuguauuccuaggguagcuguauuuuaccugggaauaugcuugaggaaguugaguuucauaacaguauucuugaaaaacugaugauuuuaguucacagcaguaaaagcguaaucacaucuacucagggucguaguaugugggagcuaaaggauguugaugagauuguagcagaacaggagcguuugugcuaaaugcuaacaagaagaacaccaaauguacaggcugauccaguuacuccaaauggggaugugcacagaugagggagugggaggagccuggcaugcuggcaugggccuguaacccagcuuuccgaggccaagauaguggaucucuauagauuaagcuaacccggacuauagagagagcuccaggcagccaaggcuacguagugagaccuuaucucaaacaaaaagauaaacacacaaacaagagagcagaaagaaguagaaucuuauguuaacagucuuacauauggaugauuauuuucuuucuacugcucauauauuuuacaguaaacauacaaucugauagguguggagugaguuauuaaaaugcacacacaagggcccagagcgaaggcucagugguuagagcagacaggagcccggaguccaaauccucagcucccaucucccacgggggauuguggcacugcuuguaauuccagccgauucaagaguagacuggcuugugagacaagucacaucagcagauaacaccuagaucaaaggcacagcucccucacaaauuuguauuuggggacgaugacacuugcaguacuacuuagaacuguggacuugagauuuuugagaagauguuugcaucuuuaugcguggcaagaguuaauuccaggcuggggaugccacucagaagugaggcgcuuaccuagcaugcacaaggaccugggcugaaucucagcagugaacuauaaguauguucugaaugacaaggagaugcaggauucagaggaugacgcacuccgagucuuagguauacaaaugucuacuuguuucaugagugucuuuaaauauuucuuuccucagaaaaaaucucgcaagaagauguguauccucgugcuuguccugucagugauuguuacagucuugguaguuguuaucuggguugcuucuaaaugaagugcuugccucagagccuccuccugcugaguuguuuucaagggcaagugcuugagagagucuugccagaacagacugaccacagaagagaguguaccagaguguccugugauaauuuagcuagaaucuaacuacuaacuaguccuuggaauuagugaccauggagacaguauuuaucaguuuaugcauacauucuauucauuugucaaauaacgaauuaccuuauuccuuuguauuuuccuuucucuuguauuuugauugcccuuauugcaaguguuuauugacaguuccaucguggauauucuuuuugacaggugacacuacaucauaaauuugucuuuuuguauauacgcaaacuuuaccuuuuuaugaguaucugagauaaauuuccaucuggagccagccuauuagagucugagaaacuguacaauaugccagcaauuuuuauuauuuaacauuuugauuuuguuucugaggggucuguuuucuguuuuguaagauuuuggcacuauauauaacuggggauuaagaacauugcacccgugacuucagacaaaaugagaagaaccuggcagagccggcccacugccagguugugugggacagucugggucugaggugaauugccuuuauugucugcugguguuuacagaguccauccucgaacacuaagccaucccacuccuguuuagagaggaucgguucauuaccaugcuuacaaucagucgggucucucccaccugucugcauagaacggaagaauuaggcacagcccgauuuuggauaguaaauguggaucguuuggcaugauuccaucucguucaccuguggcuuucauucuggugaaugauaaauguugcugucaaaggcuaauccugacccuuguaaguaaggguugccuggcuuugauggcaagauuuugaaauuuagacugaagugggguuuaaaacucagucugugaaccuauugauauagcaaaacaaagguucauuuuguaaauaauacugguuuagugauguuagacuuagccuaauuuaugaacaagagaucaaacucuguguaguuuuagaugaaaacaguuuuaauaaaauguuucugucuuguauauaaauguugucuacugcccuuuuucacaggccuagaacagucaagagaguguguaauugguuuaggcucucagauaaaugugaauugaggccagaaaugucagcucaucuuucucugaguuagaggaucuggcuacuguggcuguauuuauguuuguuucuucucuuccucauaauguuacuuaaucuuguucuacacuaaugugaccagcagagaaacaagggcccacaugcauaaguuucucugcgcuuuugcaccaucccaccuacuuaauaccaauaaacauuuaaaagcuuuuguaguuauuuuuaugaguuaacauccuaaugacauagguauuagguacuguucugccauggaaaacacagagcugcaaaaaccuggagagcagguaagguuuggcuugggaguagaaaaggcuuugaugccuuccuuugaaaagcaggacagagagcagcuaugguuugcacacuucuaauccuaguaccugagaagacaagacaggcagguugugaguucaaggccagacugggaugcaugagagcuuugagaucagacucuguuuuuaagacaaagguggaaaggaagaaaaucugucugcacgacacaguggcccacgugguaacuucagagagaaacccuuguucucagaucauaguuggacuuggauaugucauuugugucaacaauccaagaaauaaaaaacgugaucuguugugacaagcuauugggacaacaaaguggcugugauuguauaaugacaaugugguggcugucacgauggcugugggaagagguaggaacuuggccuggaguuguagugguuuuugggaagcucuaauaaaccuauuccuagaac

SEQ ID NO: 2168 - RNA, 918 nt, Mus musculus
ugcgcgugugcggcuggaauuggcggugggucgucucuugagaguuuucgaacugcuggcggugagcguucucgcaagacccgacuccuccagcugugaagccaguacaggaccggacuucuucagccugucgucuacagacggcgcgccccgcauuccacgaccuuccggccgccaacacgcucauccgcauccugcugcucccgcauccugccgcucccgcauccugcugcuccgcgcggcacuguuguucaggcacccagcaaguucuugcuuuuccaacccaugucaaaaucgaggugaaugcaugagcauggaaugggaccaguacacgugcaguuguacccgacaggauucgauggugaaaacuguucaacaccuaaauuucuagcaagaauaaaguuacuacugaaaccauccgccaauacggugugccccgugcuuacccacuucaagggauucugggacauuguugauuaacauuuccuuccuuugaggucaggcugguauacagggugaguuccaggacagccaagguuacauagagaaacccugucucggaaaacccacucacacuccaaacaaauaaaaaccauucccuuccugcggaauucagucaugagauauguugccagccagauggcauuugauugacagcccaccaacuuacaaugugcaccacaccuacgaaaacugggcacccuucuccaaccucuccuacuacaucagagccucuccuccuguaacagaugacugccugacucccauccugugaaagggaagaagaggguuucugauucaaaagauuauggggaaaauucuaagaaaaaaauucauccuugacccccagggcucgaauaugauauucacauucuucggccagcaauucacccaccaguaucucaagacagaccagaa

SEQ ID NO: 2169 - RNA, 23348 nt, Mus musculus
ccucgcccgcccgcccuccgcagcccgcggcccggccgccgccgccagguugugccugagacugucagauaaagcggcgggccggcgggaggggcggcggcgaucacggcccgggccggacauggcggcgcuguacgccugcaccaagugccaccagcgcuuccccuucgaggcgcugucucaggggcagcagcugugcaaggugcgcgggcuggggcggcggccgggagcuggggacgcuccaggcgcgguucggaacucucgguccagcgaggacggcugccgggguccccucgggcaggguguggccggcccguuuugcggacgagcugagccgggcccgcagaggacugcaggguacuugugggagccccgggcggaguccaggcccuggcagccggcguguccuggugcuuagcaacggcugggguuucuucuccgaccuggugaggucgcgggaggggacagcuccccuguuuguccccgacuggccccccgggaagauuuccuuggaccgccuucucuucugauguggucgucuugaguguagaaugacgguccagagauuucccuuguccuggaugagauugaaccccggaaucaggugcugcuugugaggaguguuuugaacucuggacacuucgugggcacuuuacagccgaucucaaaguuagagguggcaaggcuuuauuagggaaaaugaaaaaaguaccccaacagugucuuggaacacacacgaacagggugacuuuuuagcaucuaauugguagccuuccuccucauccuaagcauuuuuuaaccccugaaaugccagcguuuuuauauauaacuuccucccaccucgucgguucaagagagcaacaguuaagucggcaagcucgugcagaguugccguugacagauccucagauauuucagauacagaaugugugucuguguccguccgcuguguguaguucaccuccccgcguccccccaaaaagaugcccacauacuuuccuuaagccacuuggguuuacugaguccgaaagauaguguuugaaggcccccuuggacauaaaaacuuugaucuaaacauuuuucuuguuuguuuccgaggcagggucauauaacuuguagcucuggcugucuuugaacucucagagaucuaucugacugccucugucuuccaaacgcugggauuaaagucguguacuguugcucagucuaaggcuguaugauucuuuguuguuauuuuuguuuuuuguuuuuccaagacaggguuucucuguauagcccuggcuguccugaaacucacuuuguagaccaggcaggccucgaacucagaaaauccugaacucggccuccugagugcugggauuaaaggcaugugccaccaccucccggcucuuuuuuuuuuuuuuuuuuuuuuuuaaaggaaguucaauaaacaagacagcuuuaaucuuuugccuucguaucacaagugauccuucucauuaucccacaacagcagacggaccagcuggacucuuaccuagagagcuaacgaccaaucuagagcuuauucaugauauauuuguuuuaaaaucuaugaguaguucauacagauuccuacucccacaucaacagcagggaagugauaugcauauagaggagaagguccagagaguuacaugacucacccaggccucuugcuagcaacaguuaguacccagucugcagcuuuuuacugaauucagacuuucugcuccucugguccuuuucagacugucuccuuucauuucaggaaugccggauugcucacccuguugugaaguguaccuacuguaggaccgaguaccagcaggagagguacaguucuccuugaccucgaaagauguuuuuuguuuuucuuguucuuuuguuuauaguuguuuuguuuuguuuuugagaugguaguccaggcuagcuuucuuuuuuuguuuguuuguuuucuuuuuugguuuuugauacaggguuucucuguauagcccugguuguccuggaacucacuuuguagaccaggcuggccucgaacucagaaaucccccugccucugccucuggagugcuagguuuaaaggcagacuggcuuucauuuugagaacagucuuuaucuucaaccucccuagggcugggauuaaaaaugugaaccaccacaucugcauagagaaauguaaacagcucugggcguggugagucacuucuuuaauaccagcaguuccauuggcucugagugcuuaagugaacuguucuuccagaggaccagaguucaaucgaggcacucuuaggagauuccuuguaaguuuacuuccaggggaaucugacugcucuggucucugugggcaccugaagagacagguacaggacacacguuuuaaaaaauaguaaaauuaaaaaaaaaauguaccagacaugguggcaaaggucuauaaaccucuacaaagaaggcagaggcaggaagaucucugaguucaaggccagccuugucaacacagccagcuccaggacagccaggguuauuauauagagaucaugucucucuuacaaagucuuauacaaaaauaucagugcuccuuuaauuguagacugggaagcaaucuggucucagaguggaaguucaagacccugccagguuuacacauuacacagugaaaucaugucuuaaaaauaaaaugugccaggcagugguggcgcacgccuuuaaucccagcacuugggggaggcagaggcagguggauuucugaguucaaggccagccuugucuacagugaauuccaggacagccaaggauauacagagaaaccaugucuuuuuuuuuuuuuuuugagacaggaugccaccacgaccagcuggauaaggucuuacuauguagacuagauuuuuuuuuuuuaaguuuuauuuuuauuguuaacucuguuugugagcucaguugcugguagaagcuuagaggugucagaagccgcuagaacuggggugaaggugguagugagccauggaaugugggugcugaaagugaacucuggcccucuggaaauggaggaaauguuuuugguuuuucgagacaggauuucuccguguagcccuggcuguccuggaacucacuuuguagaccaggcuggccuagaacucagaaacccgccugccucugccucccaagugcugggauuacaggcaugugccaccacugcccggcuggaugaaauguucuuaaccccauaucucucuagucuuaggauggucucaugcucaagagacccaccugccucugccuccauagugcugaggucaaagguguucaccgucugcgaagcuaaaucuuacagagagguagucaguuacauuguauacaaguuauguguuucuuguauauuaauggguuuagaguauaaacauuauuuccuguuaacccauuguuugcuuagguuuuuuguuuuacuaguguaguuuucugccacuuuaaaaaagaaguggcgagcucagcauggugguagagaucuguaaucccagggacuguugagaccuuucucagcuaaacaaagguaacucuacacaaaugaucaaggaacuggaaaguaauuaacaagugacuuuaaacauuuaaccaggcuggcagagcacucagagagagagagagagagaccuugucucacaaaaacaacaacagaaaccacacacacacacacacacacacacacacacacaucaucaucaucaucaucaucaggccuuuaacugcagcacuggagaagcaagccuggucuccauagugagcuccagguguaagacccugaugcugggccuccgcucaagucccgggaugagcuggccaacacccaacuucucgagagaaaaccacaccugaugcaaacugcaagagguuuuauuaucagcuagcugaggacuagccaugcagggcaggggaguucgaccccaagaggugacaguaggggguuuuaaacaacuagcugaggaauugggaggaguugggaggaguugggaagaguucuucucuuccgggcguccuuggugaaauuuacaaggcaggaguggggagugaguucuuucugaauuuuuaucuccgaguccucggcacaggaaggcaggcaucucugguuguaaaguauagaaacaaaaaggcuuuuugcuggcuauagagaacaaagagcuucuuucuggcuguguuuuuagagaucagggaaaacaagcuuggggaacguccaggggcuuuaccuuccagggagaaaugcucuaagucgggguuccacacaggcagcaccaaaaguaagaugaugaggucagccuggggcucaugcugcagacacacaucuuccuccucaccuuugaguucucacauacucaucugaagccaagagaauugacuucuuuucugguguuucguuucauauuuugagggauuuuucuauaugugguaguuuuauuuagggauauuuaaagaugucauaauuaaagcugggcaugguggucucacagauguaguccuagcaacaggaggucaaagccauccuucucagcuacauuagugaguuugaggccagcaugggcuacaugacuaaaguuccaaaccugagggugggggaugggauguggaacauugucugaaguaacccauuuaaacuaaguugucauuauuaguuuaccaaaugcccauaccaugucggcuguccccuagcaccuaagcagugacaauuuccuuggauuuaagaggauuacguuuucagguguucuaaggaaauccuuguguuuccuuuuuucuuuaacaguaaaaccaauacaauuugcaagaagugugcucagaauguacaguuguauggaacgguaaguagcauuuccuuaacuaaguccuagcaagaaugagcuggagugauggcucagugcugagagugcuuguucccagcagccacaugguggcucacagccaucaguaacgccauuucuuuuuuugguuuguuagguuuuuuuguguguguugguuuuuucaagacaggguuucucuguauagcccuggcuguccuggaacucacucuguagaccaggcuggccucgaacucagaaauccacugccucugccucccaagugcugggauuacaggcgugcgccaccacgccuggcuguguaacuccguuucuaaggguccugaagccccuucuagcaucuucagacagugugcacauguaaugcacacucagacaugcagacacccguacauguaaaauagcuuuaacacacacacacacaacuuugccuucccauuuuuccuuccucucccuccucucuucuuugugccuucuguccugaguaucuguugacacagcaugcaugugaauaucagaaguaagcuuuggggaguuagugcucuucuaccuucgugagcucugggcuuuggcaagcaccuuugcacacugagucuucucuuaggcuguuuuuugggguaacguuuugagucagggucucacuaggugaaacucacacuguagauuaagcuggccucagaaucagaaauccaccuaugucuguauucugauugcuggaauuaaagguguucaccaccauacuggguauguuuuuguuuuuguuuagagauagagauucauguagcccaagcuggccucaaacucagcuaugucguauugaauuuuuuguugaauuuuuaucauggauucuaguggguuuuaguuguuauuuuuauuucuuuaaaacaacccuaugggggcgguguuacuuuuuuuuuuaaauuuauuuauuuaaauuuuuuuuguuguuuuugagacaggguuucucuguaaagcccuggcuguccuggaacucccuuuguagaccagacuggcauugaacucagaaaucugccugccucugccucccaagugcugggauuaaaggcaugcgcuaccaugcccggccuuuuuuuuuuuuuuuuuaaagguuuauuuuauguauguaaguacacaguuguuuucuucagacacaccagaagggggcauuggauuccauuacagaugguuaugacucacuguguaguuacugggaauugaacucagguccucuagaaaaacagucagugcucuuaacagcugagccaucucucaagccccagaguguuccuuucuuaagugcuaagaauuggacuucauuugagcccuguggggcaaaugggugauauuggggacacauguuuaccaugugucauggacuacaaaguaggaucauugcaguaaaaaugggccagugguuuaagauauacuaauuugcccuuucuuucugccuaagccuaagccuugucaguauugcaacauaauugcugcauuuauugggaauaaaugccagcgcugcacaaauucagagaagaaguauggacccccauauuccugugaacagugcaagcagcagugugcauuugacaggaaggaugaucgaaagaagguaaaugcuguguuuuucuccuuccucuccuuccucuucuucuucuucuucuuccuccucgacuuccuucuccucuuucucuuucuccuccucuuaaggaguugaguugggcccaaaucagguggaugugcuuuugagacccuucccugccucuguuaccaaccuugaagaguuagacuuuguuucuucauucauccaaucuugacuauucuaacauuuauuuaaauaaagguuuuuuguuguuguuuuugauuuuguuuuugaaacaggguuucucuuuguagcccuggcugucuuggaacuaacucuguagaccaggcuggccucgaacucagaaaucugccagccucugccucccaagugcugggauuaaaggcgugugccuggcucauaaaguauuuuguuaccuuuuuuaauuguguuuauaugagagggaugcuuuguuuguucguuuguuuauuuagaauuauuugugcauguuuggccugcauauaugcaugugcaccacaugugugcuuggugcuggagaaggucaggagagggcaucagacuccccggucuuggauuugggugcuguuguauucaccauguaugugcugagaaucaaaccaggguucucuacaagagcaacaaguacucuuaacagcugugccaucucuccaucgggucucccauuuugcuuuuuuaagacagggucuuggacuagagagguggcucuucaguuagcagcacugacugcucuuccagagguccugaguucaauucccagcaaccacacaguggcuuauaaaccaucuauaaugaggucugaugcccucuucuggugugucugaagacagcuacaguguacucauacauaaaauagauaaaugauucuuuaaaaaaaaaaaagacagagucucuuugaaucuguggcuaucuuuuguuuuucgagacaggguuucuuuguguaacccuggcuguccuggaacucacucuguagaccaggcuggucucgaacucagaaauuugccugccucugccucccaagugcugggauuaaaggccugcaucaccaugcccggcuugugguuaucuuuuaacuugcuauauagaccaggcaggccuuaagugucgagauuaaagggcugugccaccaugcccuaucuauuucuucccuuuacaauuacauuuuggguauuugcuuuuguguucuuaugcacgcacaugccugcccuuguaccccaggcacaccuguggcaaucagaggccggcuugcaggaguccgaccuccuccucugugcuucccaggccuggcagcagaugcuuuuauucacugagcugccuugcuggccccuaucauuucuguuuuguuuuguuuuguuuuuuguuuuuuugaggcagaaucuuaacuccuuauccugucuuagaacucacucuguaacacaggacugagcuaccaccagugucuugucugucugucuguuugucugucugucucucucucucucucucucagcagaguuagaguuuaauaagaaagacguuggggccccgggaggaguucagccccucuggcuggguugagcacccagcacccgcaugacagugucuaaugacaccugucacuccagccucaucugaucuccagaggcacccgguugccugugguacacagaugucucugcagccauacacccauacacauaaagaagauaaaucuaaaacaucuuuauuuuaaagguauuggcccagauaccauggcacaugucuucuuuuuuuuuuuuucgagacaggguuucucuguguagcccuggcuguccuggaacucacuuuguagaccaggccggccucugccugcagaaauacgccugccucugccucccgagugcugggauuaaaggcauucgccaccaugcccggcuacaugucuucuuuaacauaggugagacagacaaaucucccugggcgacauagugaauuccuagagacacagagauacuugguaagaccauguuucucuguguggcccuggcuauccuggaacucacucuauagaccaggcuggcccugaacucagagaucugccuggcugugccucuugagugcugggacuaaaggugugcaacauaaauaaguuuuugcguguguggucccacacuaaguggcuuauguacauugucacugaguccucugugacuugccccaggcucacagggcuggaguguagcugguucuagcugccccgugcauuccuggugcucauggucucuccgcugaccgcacccugucucgucuugucuccucuuucagguggaugggaaguugcuaugcuggcugugcacgcugucguacaagcguguccuucagaagaccaaagagcagaggaagcaccugagcagcucuucucgaggcagccaucaggagaaggagcaguacagccgccugaguggaggcagccauuacaacagguaaccccagacacacggaggacagaggagccggcagggcgugugccguauuuucacaggcaguugaagacgguguugucucauagaagcuuucuguggaaagacuuuaggaaguuucuugcuugccauacuuagaguucccguguuucccagggccaaggagguuucuguaucauggcucuaaggucuguggaacuucugauugcacuucucagccuuacugugcauaagcuuguggggacuggacguuuuguuuccugucuagagacagcauuugaaauacauauuuugaugaauaguugacagauauucuagacuuuuucagaguaggagcuagucaaaagauguccuucccuugauggcuaaagcuuccuuuuagaggauguacaauaauguuggggcuuuagguuuaauuguguaucuagcagguuuucucauggacggugaggagagaagagggucaccucacggggcugcugugaaggcugacugcguaggauguggauagcagucuguuuucugaugaugggauccaauggguuuuagcugguuuguuauuacugucauuauggguuuguuuguucucuaggcauuaguaagugcucucgugggccagggcucugcugggaauacagagaugaauaaaaaccaugcugcuuucaauaguaugcugucugguggagaagacagacuuguaaucaaaucauugaagucuaaugcaaugggcaguacuuuaaaaacuugucaagauucagacgagaaaggcaguucuaauuaacugccuagguuauccggaaggcuggcuuccagagagccugccgugacucucccaguuacagcgauuggucuugucagaugacaaugaagcagggucauccucugagagggacuagugcuugcagaggaccagagggcaugagaccacacagaucccuugagauuuguguugcuggaaacuggagcaggaggaggaaagggccucguaccuugucagugguagugggcagccacugauaggcccuucgagggaagggugcaaccuguguuggcaggaauuacaaaacuaguagagaaggcacugaaaggauagguagccgaggacuggaaauguaguucacugugguguuugccugauguucucaagaccuugggugugaccucuucccaauggggcugcucuuuuguauacguauagaugagcuagaaauguucuaggaaccucaucucaggcuggaggugacugugcuuuccuguagcucucuggagguggucgcagaaggccagcugcagcugcauaguaagccagucugagcuacaggaaacccugccucacccucacauaccccaacuucuccuacccuuccccccacuacacacauacaaagaaccauccugaugaugccuugcgacaguaagaagggacuggggagcgaagcuucuaagaaacuuggaugcaugguucauuugaugcgugugauucucaggguucucacguggaugaaugcauagauccuaacuuaagagaaaacaggaagggggaggaagaaguucaguuuugaaauguuuuguuugagguuccagcggcauuguuuaaacugauccuggaacugagaagauucaggcaugaguugguaggaguacauuaaaaaaaaaaaaaucacuaagagcccaggaguggcagugcacaccuuuuaacccagcacucaugaggcagaggcagguggauagcugugaguuugaggccacccuggucuacagagggaguucugggacagcuagggcuacacagaguaauccuguuuugaaaaaccaaaauaaguuuuuuuuuuuuaaagauuuauuuauuuuauaaauaaguacacuguagcugucuucagaugcaccagaagagggugucagaucucauuauuggugguugugagccaccaugugguugcugggauuugaacucaggaccuucggaagagcagucagugcucuuaucugcugagccaucucuccagcccuccaugccuuuuaaagccacgcugcuugauauauaacuucagagcagagacugaagacagaaguuggaagcauucaguguucaagaaucagaaagcagccaucccaauauaggaugugugguggugaagguuccaagaaggagcgcacucacugaggucacauacugaagagagagaggucagaugagaaguguggccgccgggaagggggcucugcaguuaagagcacucucagaguuucuugguucauuuccuagcacccccaggguggcucccaaccgucuguagcuccaguuccaagggaucugauguuucucuucuggccucugaggaugcacacagugugcacagguacauguacacaaaauacucacacauauaagauaaaaugauuuuuaaaaaugguauguagcaggaguggguggcauuggaacacuugucaauguaaagggguuucaugcuagugacuaggaaggccaggaguugaacugcgccugcucugauucucagcacaucuuuccugcuggagaucaaugguagcucagggaaccuugaagaagucgucuucagggccgagaggauaacuugucuguuucccagaacugugggguggagggugcauuugauucaggaaacaaaggcuguuucuuacugcacugucauaguucuguuuuauagugauuaaaucaggaugguuuugaccccaugggaacugggaucuaaguggacugacccugugaaaccuccucgguugauuuuacuaauuaaaaauaauaagcuagugcauggaagaaauuguuuguccauuucacagacuuuccuuggagugcguuacuaaucuuugauuucuaaucucucucuuucucucucuuugccaucaaaagccagaaaacacuuucuacaucuucaauucaaaaugaaaucccaaagaaaaaauccaaguuugagucaaucacaacuaacggagacaggugagccagacggagugugagugcauacuuggaacacacacacagaacuugacuacacugagcgugaaccucggaguuagccaggcucccagguggaccaguuacgagugcugugcuagucaccuuagaguugguagauaagcugugcugguggcuguuuaucaacugaauauaagaacuuaguuggcaugcuggcucaugcuuguaaucucagaauuugggagguugaggcaguuggguggccuugaguucaaggccagucugauauaaauaaauaguuccagaccaccuuggacuacaguuugagacccugccucagaaaacaaaaacaagauauuugugugcgauggcauauucuuuuaaucuaggauuugggaggcaggggcagauaaaucucugaguucaaggccagccagggcuacagagugagaccccaugcauaauagaacuaguaaccagauuaacuguagucaaauucuuuuuuuuuaagauuuauuuauuuauuauuauauguaaguacacuguagcugucuucagacacuccagaagagggagucagaucucauuacagaugguugugagccaccaugugguugcugggauuuggacucaggaccauuggaagaacagucagugcucuuaacugcugagccaucucuccagccccaggcaaauucuuuaguccacuaagaaggccuaagugaggugccgaauauccugugugucugucugcagccuccucugggaggaguugguuuagagacaggcagagguggggugaaggcagggcugcaugucugacaggauaguccuugcuuccuuggagccuuccucugcagaugcuggggcaggcgagagugcgauacaguucaggauuuuguuugauuuuggccugccuaaaugcauauuuucauuccucgauuuccucucuucucagcgaugcuuccucucaugagcugcauuguccuaauacucagagcccgucuguguuggugcagugggcugcuucccaacagagucuuggagccauccauuuuccuguuucuccaggcccaggcauccugaagugagaacacccaaaggcuuuggaaucuucuucauucugaacgcuggcauucacagcacucccuuccagccugugggccuaugggagcggccagcagaggggcuuugcagggcuggcuguugcuuucucucacaaagugugaaguaucuggggagggugcucuucucuguggcggauuuuauuuacuugacuucggguccuaccaagguagucucuguuggcuccaauuuaauugguuuccaacuucuugaacguccuggcaaugcuuagccuuuucagacugcauaugggaaggaacccugcagacuaacuuucuggucccuucuccuguuuuuuugagcagcuagucuuacuguucugaagaaaacagauguguucaucaucuuugaccuuguaaaaacugcuucaagggccgggcagcgguggcgugcacaccuuuaaucccagcacuugggaagcagaggcagguggauuucugaguuugaggccagccuggucuacagaguggguuccaggacagccugggcaacacagagaaacccugucucaaaacaauaaacaaaccaacaaaaaacaaaaaaacaaaaaaacugcuucaaggaacaauugaagcccuagaaagcagaccacuaaagcccagucccacacuuucaaaccuaccucuuguaccccuuguacugcucauugcccaggcuguguuagccuuccagggagagcucaucucuaagcuccagcucagccagcccggucuugagcagcucugccuccucugagcuuacuuguucuuggggcaucaucuguugccuuggaugcaccaagauaaagccccagacugauguacacauuguugaaccacaucuggccgcaacuggccuuucugaaugggaugcuaguccuuaccuuggcuaccgggucuuuuauuaugucgucagagaagacgaugaaggccauuucucccauacuauuuuugaguguguguggcaguaaagugcucuacugcuggccuggaucucuagccucauacuaacuguaaaagguuauuuauugccauguaugauggcccacgccuuuaaucccagcauucaggaggcagaggcagacggaucacuugaguuugaggccaaccuggucuauaaagagaguuccuugcuagccagggcuguuacacagagaaacccugucugacacccccacuccaaaauuauuuuuauuuuauugguuucucucugugugugugugagcucuguaacuuguauguaguucaggcugaccugaagucauugccucacccagcccacugguuacaagaugugccgccauguccaucuuauaauuugaaauuuaggaaauucuauuuguugccacagaaauguucauuuauaaacacauuccuuuugaauguucacacauuacuagugcuucuaauaaucuugucuacuuacuugcauuuucuuuaaauuauugauaacacagcauaaaguauauuuugcuguccuuuuuacuuuuugugggguuuguccugaucuuuugcuucacuuugaaagaaaagcauucagacacugggcugguggcgcaccccuauaaucccagcacucaggagguggaagcagaagcaagaguucaagguugggggucuggagagauggcucaguaguuaagagcacugacugaagaaaaaaaaagagaaagaaagaaaaggcugggugugguggcacacaccuuuaaucccagcacuugggaggcagaggcagguggauuucugaguuugaggccagccuggucuacagagugaguuccaggauagccaaggcuacacagagaaacccugucucggaaaaaaaaaaaaaaaaaaaagcacugacuguucuuccagagguccugaguucaauucccagcaacaacacaugguggcucacaacuaucuguaaugggaucugaugcccucuuuucuucugaugugucugaagagagccacaguguacucauauucauauauauauacacacauauguauauaucuuuaaaaauaaaaaaagaguugaaggucacccucagcuacauagggagguuaaguaagccugcagugccugaggcacuguuucagaaacaauagaagcauuucuacaguuuuuuuuauauuaauauucaaacaauauuuuauuuauaaauauggaauauuuaagaauuugcauauuguccuugggcagguguuauguuaacuuuuuauucaaauuuuaguguuuguguggcugaagcaaacacuugauaaacugccuguguugccuguaugucugcguaccugccugagugcagguggggcacauaucucauguaucccaggcuggccuuauucucugaguuuuggaggaugacagaugaccuuaagcuuccugucccaucucuaccuccugaguucuggaguuacaagcuugagccauucugccagguuuauauaguacugggaauccaucccagggccuugugcucacuaggccagcacucugucagccagaugcaucccuaacccugaggguucucauguacuuagcuguggggcagcugcugagugacagaguacuuccugagccuguguguaaggcucucaguuuucaucucucaacgcuuuuuuuuuaauuuauguuuuuacucuuuaauuuuuauucuuugugucuuccuuuuguugcuucgugacaguucuauguugaucuuuuacugucauauucucuuauuuaauauggaggcaugucugauucucuuauuugagacagggucuuacuacuauguagaccuggcuagccuggaacuuucuauuagcaugauaagcauggauuacacuugaucuuagccaagaggcuaaggagcaguucuggaacuuuuuguggagaccacggcuggcuuggaccucagggaucuggcugccucuaucucugccucccaaguguaggaucagugaugugcaccgccgugccuagccuccucucuuaccacuguccuuuagcuuuccaucuggaaacugggcagaaugcguuagcuuagcugugucuaaugcuuugauacuuacaagcugucuuagucuauuugguucuuguagccuacaaaguuuacagucccugcucagucuagucuugucuuuuccuuuccuuucuuuuaaagauuuguuuauuuuauguauuugaguacauccuugcucucuuuagacucaccagaagagugcaucggaucccauugcugaugguuguaagccaccaugugguugcugggcauugaacucaggaccucuggaaaagcagucggugcucuuaaccacugagccaucucuucagcccuaguauuuucuaauucacuaguugugacaaaagcuuuccagugugaggaaugugaguuagacaguauuccuuccuugagaaaacgcaccagucacacucuucagucagccugcuaaaugcucccuuuguaggcaguccaaagucaacuccgcagugggcggcagccaaguaccuaguuugucauuuccaaaggacauuuuagauuucauuuuauucucugcccuugagcuguguacaguauugggguuccuaauggccuuugaagauggccucaggacuaguguguuguguuauugcaaaccuguuuugauuucacccaaggaaaauaguuguccugagagugggucuuacagcauagcacaggcuggucuugaauuucuagucuccuuccuaagccucuuagcauagaacuugucuuguauuaaaagcuuucggaaaggcaggaaguccuggagaagcaauaagaccccuguguggagguguuuggagagacuagcugucugucaugcuaacuaguuguugcuuuucauuucuagcacugucuaagcuaagaucuagggucggagggaucaggcccugcccagcccaggauaaacugggcugguuuuaccuacagcugauuggugcaagaguaauuacuacggcuggcgcugaagcucagugguagagaguuugccucucaugcaugaggcccuaggucaguccccugcacugccaagagcagucauggcacaaguaauguaagaagcagguagagcagaggauuggggacaacaaaaaguuacacuaggacagccaggacucugugccuuugcuugugagaguuauaaguuuaaauagacacuguuggguugagggaagaugcguacugauggguauugaaacagauacaaggaaccuuguagaucuggccuuggaggcgccugagugcaggcuuuauugcuuugacuggcuccugcucacccuguaucaguuaggggcgcaucagucuguucuuccucggcugcguuguucccggugcuuagugugcacaggaugcaggcugugcuuucgucagguguuggagccuuccagccccagccugaggagggguugacuugguaacuaggaggaagcagugcaguggaaaggcugcuguuuugcguuucuuccuguguagagaaaugcugcacauuagcugccauguaagauucagggaagagcaaaugcaugcagaggggcugugaguuguugcucuguugacaaaggguuaggaccaguguccaggguuguguauugcuuuaaagagcguucagagacguaaacacagagagaacgagaggacuucuuucagaauucccuggggaaagacaggaaaugaccuuuggcauggauuccuauucugucagaggagcuuccggcacuuuugaaaauuuuggauccucacccagaaaacuuccuguuguagacucagaaaagguucugcacauagaguuucagggcuuuauagagucccugacaugggagaaaucaggagggucuguucaaaggacaggagaguccccaguacgugacaguggagagagcggaaagcauauggccugcaugacuagaguuggccaccuuugucccuuucucagcaucacagaauucuuguuguuguuugagacgaggugucucguaccauuuagcucagacuguucugaaguucacuguguagcccaggcuggccucauucaagagcgcuuccgaugacuauugagauuacuggccgccauugcagcacggagaaagcuaguccucuuccugugcaucccaucuuuuaggggagacuugcugcuuccaggguaagggccauauuuuuguaggagcucaaccucaucacaggacauuagaccugagaaugugccuaaaauugauggucugucuaggauucuagggaccuucucugaugacagcuaugacugucagcagcagugcauuggagauauggacugagccuggagcagugcccguggcuuuaagauggucccacauaugagagguuguggguugugguuuggguuggcaugguuuucugaugaccuccuuuccuaugcaguucaagccuagcagauauggugagucugagggguggagcaauucauugauggcuggaauugagaucauuucugaagccccugaguuuaccaucaagugaccuggaguucaggaccagaagugcauccuuaaguagaaacguuauuccauucaaguuaugaaauuucccucuuccucuucucuccagcuuuucuccagaccuggcucuggauuccccaggcacugaccacuuugucaucauugcucagcugaaggaagagguggccacucugaagaagaugcugcaucagaaggaucaaaugauccuagagaaagagaagaagguauaaccauuaacccuuucaggccagaggcuuacaaaaguaagaucugucgaauggggugugaugcuuacucucuguuggguacuugccauugcauagaauaauaaauaaaucuuaaaaagaaaaagggaagggcuggugagauggcucaguggguaagagcacccgacugcucuuccgaagguccagaguucaaaucccagcaaccacaugguggcucacaaccaucccuaacgagaucugacucccucuucuggagugucugaaaacagcuacaguguacuuacauauaauaauaaauaaaucuuuaaaaaaaaaaaaaaaaaaagaaaaagggaaaaaagguauuugaaaaauaagaguggagaugaugagggguuagaucacuaaaggcauuaaaucagaauauaucaaaauguuuauauucggggcuggagagauggcucagcaguuaagagcacugacugcucuuccagagguccugaguccaaaucccagcaaccacaugguggcucacaaccaucuguaaugagaucugaugcccucuucuggagugucugaggacagcuacaguguguacuuacauauaauaaauaaauuaaauaaaaaaaaaauuguuuauauucaacccuacaaaagagacaaaguauuuaacuacauaguuagaaaaagaugaguuaauuuuuaaaaauaauagugccggcaagauggcuuaacagauacaguugcuugccaccaaacccaaagaccugaguuugaucucuaggaucuacaugguagaaagagggcacugacuucgugagucucccugaccucagcacgcacacaucuaaguagagaagcaagugggacucugaaugcuucuauaaacaaaacagcugcagcaggcggcucagcuggcacagugcuggcuucaaaagccuggcgaccugagcuggaacccaaugaaaaggugaaggagacaagcagccaccuccauagccagccucagaccuccgccugcgugcugugucacuuggugcccaugggagcuacacacaaguaacagucggguauacauuuuaaauuaacugauagaugaagguugauccaagcagugaagccagcuuuucagaacugaagggagagauuacucucagaacuccucagacccagucaccuuggagugagcguccgggguuguuggcacugucgaauccuaaaacacauuggugauuucaguuuuuugcuguuguuguuuuggguguguuuguuuuguuuguuuuuugagacagucucacuauuuugccuaggcuggccuugaacucaaggucgccuccugcuuuggccucuugaaugcuuagauuauacuucugcaccaccaccuggaccagcugaaaugcacucagcgucgggggaggugguguggagcugaagcguggaaggaugugggugccuucccuugauucucuaccuuacugcuugcugaccuugggaggccgaagcaggaaaauucuugacucuaggauuuugaacauagccugggaaaugaauccccaccccccaagaaauagaaagaaagggcggauuugaagaggagaaggggaggaggaagaaagggggagcagugagcucaggagcuugugaccguucagcagagccuuaggaaaaggaacacuguguggcuucgaugaagcgugcuugggcaggaggacccuggguuccagugaaugcaagacaguguuuaguccugaauccaagacaguuaccuuuaucaagguguucuuucuagccccucugauguuuuccuucagaucacggagcugaaggcugauuuucaguaccaggagucucagacucgggccaaaaugaaccaaauggagaaaacccacaaggaggucacagagcaacugcaggugagcgugugcuggccgucuguggggguuguguuugauagccaugucuagauugcuuuuucuccacguacggaggacacagaccccuuuagacagcuuucauuguuuggaguuggcuguguuuucaucuuuuuccccuaagaacuggaauuaauggaugugguuuugauuucuuuaauucagcagacguggguccaggugucugcauuauagauuugccugucccacucaccaaagcuugcggugggcuuuguugcguacaucuucuuucuguaacaguagucaccaagaggucagggcucaccaugcaccucugucagguccuuuuuaacuccgugucaagucccagaauuuccuguucucuuccuaggaccacuuccugccucuugaguucccucuuucuaccugcacagacagcuggcuggcuggcuuucuuucuuucuuuuauuguuuauuuguuuguuuguuuaagacacaguuucucuguguacccuggcuguccuagaacucaagacuaagcuaguuucagacaagauccgccugccucugccucccaagugcugggauuaaaggugugcaccacccccacccaguuaccguuguuacuaugacucauuaaaccuauucugcauuaaaaccacauucuaugcuguggaaacugaguguguacugacuuuauuuuuauuauuuuuaggccaaaaaccgagagcuucugaaacaggcagcugccuuguccaagagcaagaagucugagaagucaggcaccauaacgucuccgugaagacgugaggaggcucccagcaccaagcccgugcucccgggucagggcugcugagcuggcuggucucugggaagugugcuuccuacaaaaucucuauauuuucuuaccuuacccucuuuguucggaugcagugggcugaaaggaacuccuggucugugcccuguuauggcugcaugcugagcgguuagggucccagaccuccuccuuuccuccucccacuccccgcccccguggccccccccucucuguuuuaguacucuguuuuccauaguggucacugcucagugucacgugcagagugucuguccaccaucacaccugccauccccgugagcaagcagucugucgucagcuguacaucacugccgcucccaaccucgaaaacugccaccuggagacucugugcagugagggaggcuuuuucucaccaauaaaccuuuugcuucaggguauacucuuggguuuuuuccagguauauuauguaugaccuuuguacaauguauagacagaguuuuauuuauuuuuuaaaaaggaaaccuuuucuugauaaaggaaugaugguagccuagcuaguucuuguaaaagugaugccucuuugaaaaaagaaaaaaaaacaaaaaacaaacccagucccguuugcuagcuuuuaguagaagaacgcaaccuuuucuuucucauugccuuagagucuugaugcugagguaauguuggaggcguacguguggagcuaagugccuuuuggaggaccccauggaagagcgugugaggagaggcuuaaggacgguugcugaguauggccagucugucuuuaaguagggcagaaagaugcuuguccagguuguacuggacacuuccuccucuacccaccccuccuccuccuucuacauaauuuuaaauucccacacugccacuucuuuuuuaaaaguauuccuguuucuugcuacaucagcugucguaccacguuguuaucacaaccuggaucuuugguuuuguuuuuuaacuugagcagauucaagcgggauaagacgugaacuacugagcauuuccgaggguuggcauggguugcuugggugugggcugcacgguggggaggaccucacuguuccuuccuuucucucccucaucccgcgugcucccuguucuuaauggaaagucagaaagcacgcgcuucugggagccgaagggugugcccuuaucccugucugacucaguaguugugggaaggagcugcgccccuccaucuuugggaaaggaacuagagauggggaguaugugcugggacacagagcaaacccugcagugagugccagcggugcuggagcuagagcggauccugaaggcagugacauugggacagucagggucacuguucaccugcucuguagucugggauuacguucuccaaagagucacaugcacacaggugagcagcgguccgcacucgaguggcucuucccgacaggagauucgaaggacuguguuuuuguaacacuggucgggagugcaauuuucccuucuaagcagggaaagcugcugugcuaaaucauuuuguaacuuuccgaaugagagacuucgguaaagauaaacucguucaguauuuuucaaaugcauuugcauuggcuguggggaaaagaugguaggaaaagaauaacagucaugguuucgucaaugaaaaguaagacugagaaauuguugguguggugugacaauauacaaaggcuuacuuaguuuuauacuaaaccuuuuuuaaggucuuagcauuuaauauucagcaaauccacacauuuucuaaacuaccacaagcuccugaaagauagaggaaccucaguccugaaauggugauuuuuuuuuuaaaucaugacagcauuuuaccauguaauugaguaacuuuugguaacaccuucugcuucuuuguauguuuguaauaauggacauuuuaaaacauaggaauguuugcuuuguacagacuuugacaaauguguguuaauaaaacuucauacugacucagau

SEQ ID NO: 2170 - RNA, 3675 nt, Mus musculus
uuuuaauguaggcaaggucagaaccacgccuuuagucuuagcacugugagaagcagaggcaggaggaucucugugaguuuaaggacagccagggccacauagagagagacccagucucugaaacaaacaaagaaauaaaaggauaauuacauucuuuuagcacgugugcucucagacaucaggaacaggggaggucagaggucacacguugggaaucagugcucucucuucacuauguggauucuggggucccgcaggcugguuguaaacuccuuuaccuggugagucagcucacuagcucucgggcacucagcauucuuuuuuuuuuuuuucaagacaggguuucucuguguagcccuggcuguccuggaacucacuguguagaccaggcuggccucgaacucagaaaucugccugccucugccucccaagugcugggauuaaaggugugugccaccauuauauauuuauuuucuagcaucaaccucccacuaucauugacucagacuaugaggacuacaauuuuaaugguuuacucagucucuggaaugaguagaauaaacaguauauccaauucauaguaggcacugagugcguacuucucgaauggaaaaugacugagcgugugcuuagcuaggugugagaaauauauacguguucugggugugcgaguggacuuuuuguuuuguuuuguuucgagacaggguuucucuguguagcccuggcuguccuggaacucacuucguagaccaggauggccuugaacucagaaaucugccugccucugccucccaagugcugggauuaaaggcaugugccaccaaugcccugcucaacgaauggacauuuuuuauugugcguguccagauaggugagguuucugucacgcgugacaugugaaccaaaucagugcuuuuggaugccugugugugucucaguguggaacugcauaccugaagcugugucaugacugaagugacauugcuaguguuggggacauggcugcgugugcacaacucugugugcaugugugugggggcgggaaggcgcugccggcuucucccagccuucagcacucacucagcuucaccccaggucgccugcugcgaaaugucagcggcagagaagcuaaaaauauccucucuccuccuucugcucacugcuggggcugaugggacuguggggccccagccggccccuugggcccugugggaggaggaacugcuggaugugggguugggacagggaaggaaagcaggcccuuuccaauauguucauccuuccugcuucuaguuuuucuaggcuucaaagccagacuccagguucgccuuuuucaggaagcccuccaggccgugucccgccccaaaacugucacuugcucauaugugucucuauauguuugugucugaagcuguccuugaaggagaugugcuuccauccauuguacuccagguuucuggggcaggaccuucccuccuuugucaguccagagacuucagagguuagggguccuaugcucauccagauaggggaucccugagggaacugauggcacugucuggguacugccuguucccuagggcugaggauuacggaugcgcuggcagcaugugacuuccuucagcccuguuccugggacuaggacuuuccaacuucaaggcagaugugucacuauggacagcuuguggguggggagaagccucaauucuguccucaccacaccccgggcugccacauguuugugccuugaguacauguguagguucaggugggacaugucagggccugugguccuuuggggcuccugggugugucuuccugugccacuaucugccuugggcacugugggcacucaauugaaggguugaauguguccuugugugcaacugagcacauguggcugacuauguacgugggcuuuugucuuuugucacacagcacugcgaacacuauauaagcugggugggcgugggaguugcugauuuguuuugagugugucuguuggaugguccaugccugucuuuggugucaaucuaucugcagguauaucuguguccaugugucaaacauguaaugacuguguucuuguagugugugugugugugugugugugugugugugugugugugugugugccuuuaggcaucucugugauauguuggauucugaugucacuuuuuugcauuuuguuuugugacagggucucauguaguccaggcuagccuugaauccuccguaagacagaggcugaccguggaaaucucauccuacagcgucagccuccuaaaugccaggacuuacaggcguguaucaccucuuagcaugugccucuagcacuugauuugugaccagguguccccguguaguguauguggcuguucucuguggcacuggcaugugguagccuucuguuuuucuuuccuaaagcuauauauuuugaaauuguguguguugccugcuugugcguaugugcaccaugugcauaccuauaccacgugcaucuacacaugcauuucucucucugucauauguagacaugcccaucaaggccagaauagggcauuaaaucuggugcugaaauuacaggcauuugugagcugccacgcggguggugcugggaaccguaccucugguguccacuggaagagcaucaagagcucuucauugcugagccgcgcuucaagccugcgguuugcuuuucuuaagucucucccuauucugugaugaaggccuuaggguuguguuugagcgugugccuuugcccuucccaaagccucaggucugcuuucuacuucucuuucuccuguggccuugagaugggagagguguaaacagggcaggcagacgcggcauccacgacaggcaggguugggaccaggcugccacgagggcccugccucagcuuugcuccaagcaagcacuaagccagagccucgguuacauguaaacaccagcugugucaagacagcgcagcuucuucuaggucaacagacagcugugggguugcuaggcaaccgucugcccccccccccaucaggcuccccucucacugccucuaccugcaaagccucugcuggcaccccagcucuacggggccuucucucacccccaaggcaguuaauauaguuuggguagagagucagggcagcuuugggacugaaauccagcaggaggugugacucuuucuagugugcucacuacucagggcucaguguucuucaguucccaccucacccuauuagggcugaacuggagggccgaggagcagguccugaaagauagaaggucuaucuagccguggugguaacgaaguaccccaaccccaaugucacacgaggcuuggagaggagcuggaagcagggguagggugccacuguguugaccuuugacgagaucgcguugaaagacaagauugcagagccugggucucucuuuugcucagacccaccuaaggguguccgccuucuuuccaaggcugacccgugcuuccuguugcaaagcccgcucggcaucugcgccggcccgcccaggcagguagccccgcaggaccaggcugucaucauugggccuggcuggaccucaaggagggaaagaugaggcgauagcgucccgggaccaagggcucaggaucugagaggagcgcgugggccgagggcgcgcgaccgagugacgagg

SEQ ID NO: 2171 - RNA, 3200 nt, Mus musculus
uauccaaaaaaaccauuuuuuuuuuauugaguaggguuggggacugaacaggaaugcacugggggccauaacccgauuggcagagggguggggguacuggcucuugucccgccuccucucgggcaccucaggguaaggccuggcccccaggccauggcuguggcgcugaaagccaggcuggagugagagaugggggugcauuuuacaaucccgacugccuugucgguuugcaauucccccaaauggccaccagagggaagccgggccucagcgcagaggaauucucgguugcucaggugauggcuucuuaaaaaaauaaaaaaccagaggcugguguguucucccugcaaacccgagcagugcgggccuggggaggaggcucugguuucuaugauuucucugauaaaaaauaagcaaaaauaacaaaauacgugguuucucuuuuuccaucccgcccccuucggaaacugaggucagaaauggggucauggaggcugaggauacccugauaugagcuagauuucuagguguaggucucuuuuuucccccuuaccacccauaagcaaauuuauaaauaaauaaauaauaaauaaauaaauaaaccuucucuguauguccacauauauagagauaaaucuuucucucaucuaggcaacuaagugauuaaccucugacucuggagcuucgaaauucaaaagcgacaugaucaaggucaaguuucugggaaggaagaucaaggacuuggaaugguacuguaaaauucccagccuucuggaacugcaaaccacuugggcugugagacauuuccgagugggacccugaccaucuggaacauucuagagccacgcggucagcuggggugggccccccgcaggaaucuugaauaagauccuaaaacacccaacguccuagaacuccagaaccagcugggucuuaagggcguggagcuggggauuggaauuaagcccugguggaccuaacacucuggaguucuauaguagucaaagccacagguucaccaggaugaaacuagacaucacuaggggaccgggaccggaauggaaucuuggaaguggaacagcagcagcagauggcccacagcaccuucugcacaucuugguugcgaaaggcguagaugacaggguugaucauggaguuguagguggcugggagcaggguaagauagguguagagacggggagagucggcaucucccaggaggcaguagacagugaagggcaaccaacaggcagcaaaggcgccaagcaccacagccaauguggcgaugcccuugcggguggccacguagugagaggcaggcagcaggugucguuggagggcgaucugcugggcauggcggcagacgaugcggcagaucugggcauagagcugcaacaugaugccaaacaccaugaagaaggcgauggccagaaccaccagaugguucuuggagaguggauagaccacaccacacguggucaggccaucccggcaguuccaggccagcacgggaaccagccccaggcccagggcacccacccacaccaaggccagcaucacauaaguccgaguuaccguugucucugaguaguaagugagagcauuguacagggaaagguagcggucaacgguaauggccagcaggcugccgaugcuggcagugaaggccauugcuagcacgccgaccagcaucaagcucaucucuggugagccaaugcagaagucagccgcaaagugcaggaccaggcccaggccugccagcaggucugcuacggccaagcuacccaccagcaggaacaugggggcgcggaaggcaggagugcccacaaugauggccaccaccagcgcguucucgcaggacaccagggugccugagaugcacagcaccacaucccaggcccugggagagggcagcaguguagcugggccuguggguuccucuacuggguccacgcugcucacguucacacugccugagccagcugagaaccaggccauagagcuuccugcuccccacaucaugguaccuguagaagaaagguccuaugagaugcuggcaggcccguauccugacaggaggcccuucgagaaaagaaagcugucaggauaacagguaggguacggauguccugcacaccccacacccccaauucauguccugugguuuuuguccucugaugccuccaggccucuaaacaggggucccuuuuucucggugaucccuuuucugugucccuucacccuccccuccauuccucuaaguccugaagaccucuuggccacacguggucaaagaagugaaucaaagcuuaccauaagugaauaggggaagcacaggauucaaggugugcccucaauaggcucaugaauaggggagggaaacacgucaagaagaagagcagucagcucccucccaccagacacgaugacuugguuccugaagcucccagaccccucacgauucaugggcacugccagccucaagcuccgcccccaggcaaagccggugcagcuucuugccagcccccacucgacauucccaggguaacaccugggaacucauuuccccuacacucucccagacuucugacuccggacagacaccccacacacacugcccccuucuuccuccuaaccacugggucuccguagcagacacccccuggugaaagccggauuccugagucagaccccuccuucugcccggacaccuggaucuugggccugacuccgccuccugccuuggauagccgaagccccaaauaagacaccacccgcuacucggacgucuaggugcccgccccagacgccuccuguucucccaaccucagaugaccgcccgucccucuagggccucaggucccgcaggaaugcucacccuuugccgggucaccccaucauaccacucgagagcacccgaacacuuggggagcugccugcuuaugcagacucugcacauccagagucccagguacgaccccccgacccugagcaggggcaagcagccuuccgccggcccggcgccccugcacgcuguguccucccagacuccggguacccgcggcagggcccacuacucaccgguggcucaggaccgggugcggccgggccgcggggcgccuccacucagguucuggcagagcaaggugugcgcggaccccaagaagcccccgcggccgcgggagacgcggcgugaguca

SEQ ID NO: 2172 - RNA, 1530 nt, Mus musculus
cacccgcguuguagaaggaguccagcgcagcggugucgccuagcgccagcgucgcaaaggguaggcugcguagcugcggggguggccgugugcccuggagcugagcgcaggccucgcgcaggcaucgcaacggcagcggcucugccucgguucccgacccgggcuccaccccgagccccggcucccgggucagcacguagaccacacugagaggccggcuccgcgcgcagccccgacccgugaccgcaggagacgagcggccccggcucagcgccuccgccagcggguccugccagcagcugcccgcccguucuagaaccccggccccaggacauggccccgccaugcgggggcgcucaagcgcggggccccgggcgcggggaacccgggacagggcacgaggcugaagguguggauccagucgggauccggagaugggcuggacguccuguuccggaacucuuaaguccagaaagacuucuuugcucaaucuuucacgguccuuacagaucugcaauccaggacuggguucugggaaucugggguacccaguaauccucggcucacaggucacagaagaguccugggaagucaaccggcagcgugcuacacccagacuucucaagggagcgcuggcagucacucuguccugcccucacauguaggcugggcccagcccuuucccgacugggaaaggcuccacccucggcccuggggcaaugaggcuccccagcggcucucccucccuccucuccggcuagaaccucugacacuguccacuuccggaacagccugugccccuauucgggccaaacacuguugacugcuuacugcaagcgcucguaagacgugugcccagcccagggauaggaaacaggacagccccgcccugcagggaccugguaaaugaauggacacugggcgggggaaggacgggggagcaaaacauuguguaggcggcacauguaauguuccugcugguaggggucagaauguugacaagcgcuuuccucagagccucucuugcagugaaaccuuguggaccuuauugguccacccgaaacuugaccauggagcugaaaagcacuucuacgguaaacuuccuaucuacccuuugaaggaacuccagaagucuccgcuuuuuggguuacaagguuaucccggcuucaaauucaccaagaagcuuuaacaucauaguaugaaucuaaguugcuauaaaccuuagagggcccugaacuuagaaaugagacuuugagacucugagguuagggccauguuucauaaucguuuauuaugguagggcuugggcaugagagacagcacagcuguaaagaccacuugcugcucuuucagagggcccugguuugguucccagcacccacaugguggcucaccaucaucuguaacuguaggcccaggggaguccuggcacucuccugaccugcauaggcgcccagcacauacauggugcacauauauaauuacaggcaaaagaugcacaugaaauaaaacuaaaacuuuauaaaaaua

SEQ ID NO: 2173 - RNA, 56907 nt, Mus musculus
ucuucauauugauauuuauucagauuuuuaaaauuauaguuaguacauccuugugugugcgugcacaugcaugccacaggacacauuuccugaucuuccugucuugaccucccuucagcgagauuacaguagcacacuucugggccagcucuucguguggaugcugggcucuggaacacaacagaggacuacuuguuaggaaaucaguucucaaugggggugaccuuagcugugacucacagcacuggggacauggaaccugaagaggccacuuccuguagccaggcaggaaccccaguggagcgauagggacaccaacccacccacaaaacuuucaacccacaauuuacaagaacugcagggaggggggauggagcggagacugagggaacggccaaccagucacuggcccaacuugagacccaucccaugggcaagcaccaaucccugacacuauuaaugauccucuguuauacuuguagacaggagccuagcacggcuguccuuugagagccccccccacccccaccccagcagcugacucagauggaugcagagaccacagccaaacaguggauggagcucagggacuccuuuggaagaaucgguagaaggauuaggucccccaaggggacugaaauuccacaggaagaccaacacagucaacuaaccuggaccccuggggcucucagagacugaacuaccaaagagcacacacauacacacacaggcuggaccuaggccucccugcucauauguagcagaugugcaguuuggucuucauguggguccugaacaacugaagugcgggcaaucccaaaagcuguugccuguacguagguagguagauauguucuagcugggcugccuggucuggccucagugggagaggaugaaccuagccucacagagaugugccaggguggggguaugcccagggggcccccaccugcuaaagaggagaaggagagggaggacagggauaggguuguggaauugggggugggggugggggacagugagcagaauguaaagugaauaaauaaaaagaaagaaaaucaaauuucuucuuccaccaugugagccccauggaucaaacucaagccaucaggcuuggugacaaaugcccuuaccacuaagccgucaccaguauucugcuuuucguuauuaguuagauucucaccauucuucacuauuagggucucacucuggcuguccuagaacucacuguguagaccaggcuggccuuacacucagguccuccugccucugccucccaagugcugggguuaagggugagccccaccgcaucucgcucccccauguccacuuucugggagagggacucuugcugagcagagcuugcugacucggcugaaauggcugccuagcaaggccccgggcgggcuccugccgucaucucugccuccccggcacugagccuacagcagcaccccccuaggucagcucucacugaaugcugggccucugaacccaagcacgcacacuaacuagucaggaggcuuuaaaaggagagggcuccgcaggugaagcgccugcuguugcaaguguuaggcccugagcucugcuuuuagucccucgauuuguggucaugcuggauucuguaugugguuuccccaaaaggcaggaagagggucaagggcaucggcuacaggacaaucugguuggguuaucagaaggaaacuaagcccuccuauucaacggggacaggcagaaagacggguuggaaucaggcaagaauuauuuuauuguauguauauguaaaugccuguaugcaguuaugugcaugugugugcagugguuaaccacugagccaucccagucaggaaaaucugaaugaaaauucuaacccacagggagcagugccauuaucuguggccacagccauggugggacaacaccuuccagaggcacagccuucacccuuucagcucuaaagcuuuuuauuauugcuaucuuugagauagagcgcccauggaacccccagguuggccccaaagaacccuccuacuucugccuccgagggggacugggcagaagcccugugcucuugcugaggaguaggggucacugguccucauccaacauugcccauacccuuugaguguuccagcuguuuccugcugggacaucaauacaggaaugcacagugugguucucgccuauaauucuuuugccauggcccaauucagauauccuaagacaagucagcucugaguccaggucccaggcugggcagagccucuuagacaguacugagacuucacugcccucugguggucugguacuggaauugcaccucaguucccaucucuucuuuauacagggaccccuucuuccaacagggaagucucuaauucccaggugaggacacagcuuagagacuuuguacugcccuuagacccccaaccauaaacuacaagguuuguccuucccuccuacguuacugagucagacacgcuggcucauuaaacaucgaccuaauuaaggaaaauggaggaauuccaaaggagggaugucccauagugggcuuucucaggccugcacguguuaggacuguuauauuuggauguaucugaucccuucuccgacuggccucugcagguggcaguugggcaugccauagucaggagucuuccugacagcaccugccuacuaugcucaccauucacaaacuagggguuuuccgacugugugaccaccgaggcuuuuuagcaccaagcugcggccccagcacauggagagacauaucacaguguaacuccagcaucugcacacuggaccacacagcagcuggugguaacaauguuucuguuucagucuuugaguugaguuccucugacgcccuccuuccugaagucccccaggcccaggaagcagcccuggacucuuaucaaaaacucacauugauuuauuagaauaugaaaaagguucaguuuccuuuguacaggcggcagagcggcagcagcugcgguggcuuuguacaugguugucgaugucacccugccuggcaacuccugcccaaaacagcacuugcauggagaggagacagcugggccaugcacccauggccccauccccugggagggacccucugacuauuauugcacgauccuggggagggagugcccagggguugggcagauacccaugggcuuggccccagccaugguggcgguagggagugugugccugugagcaaaggccucuaggggguccaguacuuucuacucuacagaaugcaggaaagagagugguccagauaagggguggugguagaacuggccaacagaaguaaaagcaggcccaagagcaaaggagguaccaggaggcccccugcuggugagcuugagucaugacagguugggccacaucagaaucggugcugugggcaagggcccccagcagcagagguuccauuuaagggacgguguuagacacgaggaaggacgagggggaaagggcagagcucugacuggcaugggggacucaaagggucugaaaacaagagugccucugugcaaacagaaucauacuuacagugaggugcaaauaagccaaguguaaguagaggacacuuuccagcgccucggacagucccucccguguaagccccacuaaggcccagugguccucaucaccccaaucaugucacugucgaaugugccccagcgcccagcagagaagcucagagacgcccucagcccgcagcucugaguaaggacagcucgggugguggccagagcaccgaggcuagcgggagaaccguggcgcugccgugggcagcucugcuaugggucacgggucuguuucccagccacaggccugcuguccucugauacaggggcccagucacggccacggaaggcucagcucccuccuuuccugcugggaccacaguggagccaguggcucuuugguuagaaaugaugaucaaggauggagaguuggucuggaugaggaggggcuggagggaaggagggccuugaggagcccugguuccacuaugggagagccuggaucuagagauggggcggggccugccucagcagcccagccguccgccaaauggauggauugggaaggcaguucuguaggagaggacccuucccaggaggcaggggcaagccgugcugcagugggggcugugggcccagcugccaugcggaggaagggggcagagccaauccaggucaggagacaagaggagcgcccagcccccacucucgugggagagucugugggacacccacuagccuggcucuacuguccuuuggggaugaaaggcucucccuccccaggcucagggugggggccugggucacugaggcagcguuguauucucugggagcuggggcugucacuugauccaggggugaagacgucgucggugccuggggaugagggcuccuugcuccgaaucaugaugaugccguccucaucuuccuccuccuccuccggagucacccugggaccccgguuuagcccuaggaccuugcccuucaacuccucguucaccagguccacagacucaggggacuguggggaggccgggucaauggugaugacaggcaggucugccuuggguucauaggccagugggucuguggauugagagcauagacagguucugucccugagcccugaugggauggccacaccucaacagcccucagccugugcuagugucccucagaccuuccaaugaaggcaaucaugucucugggauccacaguuuccugagugaccgcucuguuaccagaugcucuucccccuggacaaggacucccacugccucuccaucccugccauggugcucugugucacagcuccaucacaguccccauccugaacccaggcagucccuuugugcccggguuugacagguaggcuaugcugcccucucuguuaacacacccagcccucuagauacaaaugaagcuccuggggaaaaacuaacuucccguugccucucugaggccugucccgccugagggcccuucuuuagcucuuuaccugagccuaugcgggcccgagacagggugggcgaguccagcuugugggccgguacugucagguaguuggugaucugacagagagagaggacagguugaguggacggugggcuggcagaaguccucugccagacacgcaggcagcaggcucucacugagagugugcuggccacccacaccggcgcuucagggccuuccagggccuugucccaggcucccagaaagccgugcuagcuuucugagaaucucagacacaucgauucuucucuagcuuugccuccaccccacaccugauccccaagguuucagauuaaaacaaaaauagaacaauaacaauaaaaacaaaaaccaacccaggcagcauaccuaaguccugugcacccugggugucgcaaacccagcgcaccgagacugagcucagcgccuugcuuuucagcacacggugcuccuucuuggccacgcuggaccucuaccuccccaguggccccacuucaaacugguaacccagucaccacgucuuacuagugucccuuccugugucccucacgcucacuccuuucucuuuccccgacagucacuccucuaggauaaagcccaaacucuuaccccguuaacaaaccucccugucuguuucuaaaguagcucggugcgugcccgaagaggagcuggacagagcccggcaacgcaccuucugcuccagcugccgggccuucugccuccggagcagcaucugguuccaggcuuccucguaggggucggccaccagcgugugucuguuauaggaccgcagcugaggggggaacagccaucagagcaggagagggcucagaauccaggcugggaggccagagccagagaggcucuggcggugugggaggcaggagaagggcggaggaggugccgagggugcacacaggagagaagcuaaggagggccaggcugagacgggaccucacccguugccggguuuucugcagauugcuccucaagauuuugcggaucucuuccuccuuguccuuggacagugcuggcaagaugcggucugaagucacagccuugggguggauguuccugggacaacagaacacagguuaggucucucuuugacagcacaaggccaugcuggggucaaaagcccagggguggguugccaaugucccaaguccuuagaauggccgcaaggaccucaagcccaacuugaccagcuaggcaacagcguagcccuggaguccaucucaggcuaggcugagggagcuagcaugggguagagaugcugcccagaucugccagugguacucacugcauagagacaguggagacagcagaugggaucuugcccaugccuccgcucuccaccagcucaauggccugcuucaucuccaucuugugguagaaggcaaugagcuggggcucuuuggagcgcucuccugcuaucaggcacuucuucacauacuucuuauuaaaacgguugagccugugggacgagggagacggagggggcuaguuccuaggcacgaggacguuccccaaggacccuuaaauguccuucccacccuccugcccaccagaccuucaccuacuuguccuuccagugaugguggccauaaugaccacagauguccucgaugccugucagaaggugguccaggaacugaaaugggcccagggccaggucaagccuuacugcuggccuccuuccccacuccacccaccuuuuccccaacuauggcuccgcuuagccugcccccuacaguuccaggaagagccaggagguggcgccuucccguuacuccuccugaagcccaggccacacucuggugaguccccuucucagaacccacuugaaccuaaugacagagccuccugggcucccaagcgcucacaccacacugucccuucagcuagagccuggaagggggcccaaggggccaagacaaccuggcacugagauaagggaaggcgggcuuaaggcccagcucugccucggcuccacaaaccucugcaacccaaggcccagcccagcccccgguaccuguguguggaucuccucguugauggagcgcuuuguuucuugcuuuuucuucacggccaacaggucgaccaggggccgaauggucaugcccuggagggcaggugggugucagacaaucugguucugcucuccugacagagagguggaggaaccacccuucuccucgaaggccccccacccccaggcaaggagggucuccccuuugagguucucagucucccuaccucagcaugcaaagcaaggcaggccuuuaaaggccacuucuuccugauaggucagccaguggaccaagccucacugcuggggucaggcccuguagacggagccccucugcccugccuccgucagacucuccacgauugacuaguaucugugccucaguaucugcacuaucccugagagaugcucccagccucacugcuggggucaggcccuguagacggagccccucugcccugccuccgucagacucuccacgauugacuaguaucugugccucaguaucugcacuaucccugagagaugcucccauuuuacagcuguggaaacugaguggcagcggggcugagugauucccuauggccccacagaagcagcagaccccgagucaggcuggcugggucaccgugaugguacugucacccauggaacacccacagcaaagcugaggggaagcaggguuucugaggauagcgcaggagggcauggaggagcucucuccugcaaaaggacaggaacugcacccccuuccaagaggucuccccaugucuuuucucaugagaaggcagaggugugucgcaccucacaccaugagugcuugugcccagggugggagguagaggaugggagagaaacagaggcccaacagccucucaccugcucugggccagucagccgagggucagcaguaugcacuaucacacacaggccucccucguggacagcuagagacagggcggaagccugcuaagccugggucauuuaaagcccagaagucaugggccagcaggcuguaggggcuguaaccagcuagccccgacuccucacugcagacaggcacgccuucccaggaaacagcuaguagaacguuaggcugaguccaggccuuccugacucaggagacuguccggccgccuaugcugaacugcugcagaugcuaaaccaugaugccacucagcccuaccaugauggggcaguagaucuugggccugccggcugcuacccacgucacuccaguggcucuuacucaaguugggcaacauucgucacuucauauacugauugacuucucauugucacagcugagaacugaggccucaaagggggacggcuugcccaaagucaugcggcaagcuagugacagcaugcccacagccuuuuuuuuuucuaccacaaaagucggggcccccaggcaggggucugcccaccccaggcccagcaccugcacaaagacggugaaaaagaugacggugaugauggcggugaggaacaggucacacauggggaagugcuucuuguccaggagguagcccagcgagaaggcgauggccccucgcaggcccccauaggcaaugaugaacugguccuugggggucagcuugacaaugcggaacuuguugaugaaccaggucaggaccaggacaccugccagggagcaggcggaggagaggucaggcgguccaggaagcuccucccacuacguccaaccguccaaccagcucacucgguuccugggucccgcagcccaggaacuccagcucacucauccaaaaccuugguaggucuuuaaaggguuccucaaccugcauuuguucugaauaucccagaggccuucacgggguacaggucaagggacuggaggaaacaauccugguacugaguuugaacuuauuaaaacaggugggaaauaauuacccuauugucucuacuuuucuagagacugggaauuguucauagugaaccacuguuucgaaguguaggcugugaggagggaugcagagagugcuugcccuggaucugggcaguucacagcugagaucccagcacuugggaggcugaggcaaaagaaucaccaagaguucuaggccagccugaucuguauaguaagaucccgucacaaacaacuaacaacccuaaacaaacaaacaaacaaaccuuaaaaacuguggaugggggaacauacgguggaccucuggcuccuaagugcacgugugcggaaaagggaguaagauagagaaugcagcagcggccuggccauggaggccaggagaaucuagcacaagggcagagcccacagacccgauuccaugggugacacuagccugguagcuuuggacacgugcgccaugacaacagaacacuuggcucaggguuccaggcuggguugaggaccugagagccaccaggcuuuuggagagucuagaggcccuucaccauaacuuucugcgacagugucugcggagccuccacgugagcaggaggcaggcaugcggcuucucccuaaugcucucaaauggugucagcguugcagagaagcaaugggagcacccagagccauucagaagggacagggacagggacauacugcacucuacauaucucaccagccccuccauaugcuauacuacagacaccccgacacacuguacuagacacccgcacuuaguuccuccacacacuguacuauagagaccccacaggccagccccucaauacaccguagugggcacucagccuauccucucuacauaugauaugauaccauacaauacagcccagcucuuagacacauuacuacguagacacaaacaguacuacacacagacacagugcagcucuuagaaacaucaacacacuuacaaacccacaaccuagccccacacuauauuacacauagcuacuccauagcccagcuccucucccuacagucacguguauacuguuucucucucucucucucucucucucucucucucucucucucucucucucucucucucccucucucucucucucuccccucccuggccugggccuggcccuuacccagcacccgggcgaugaggcagaagagcagggugcugaugacgaagguccaguuccacuggugggagccggccacaguggagacgccgaggaagaugaagaugagggucucacugacgcugcuccacaucuucaggaaguacuugaugguggugugggauuugugggagauguuggccuccacauaggggcgcaucacuacuccugaggcgaugaggcuuggggugaagaagaacggggugcaagguuacaggcugacaguccaggcugagcaagcacuagcucacuggacaacugugagggccaaacgcccaugguuuucccuugauccucacaccaaguacacagggccagcaaauucagacgagacacgggaguuuuagaagaauuaagucaccuccacugugcacacugcgucugccccgacagccagggccacacucuguggucuuuuggguucaccccuucccaguauaaaguucccaacacacaggguuccucuagggagcugugcuggcuccuuccccgcuucccagaguccccggucuagguuggccugcacacuucuacuuuccuugugccucacugacucuucucaggggccucugagauucaggcguggaagaugccuggugagcccuucuggggagccuugucggcuuccaucuuuaagaaaaugggaggaaguaggacugagaccuaagacuuccagcucaguuuccuaggguaguaguagauucugcccauaauguucagauuccugaaucccaggaguccaauggaaguggcuucuuauggaaggccucuaaugaccugggccacgucagcgucuaccaugcaagccuggagccucaggugcuggggcgcuccuucgugaccacagagauccggagacuccaugguaaguaacuaccccaccaagcccgucaccugccacuccgacucacgccaugauuccggacagguggaagagcucagcugacagguaagccauguagcuguagaggaagacgaagagcggcucgaugacccggaugugagagguaaaucgggaggugaaagcugcgauuaccccguagaccacgcccacaaacaccccaccgagggccaccacgaagaagcucaggaagccgaggaagauguccgagaugcccacagagucauagcuggcaaauuccucaaagaggugauagaggaccuggggagagcacacaggcugguaggcaggagggcagggcccuggccccauggcucccugacacuguccuuccacaauucacaaccauggauucagaccucaaggcagcuaagugcuaaguguguagaaccuagccuggggcuuacggagcggcacgugcuagaggagcacacugggggccugcagcacccccugcugguaaucaacauacacucuuaaagcuacaauccuuugcacacauggccucauuuucccgugcuucaguuuuccacaaggugggggacaauuggggugcucacaucacagggcugucauaagaacuaaguaaagcacucagcaugauugggacucccugugguacucuccuucagcacaaguuuagacaguaaaccaggacaggaccagucaaucucugaaaguaacuggggccaggucauaugugaccugggauccaccaaguaggaccgagaaaucuccauuuaaacaagcugccugguuacaaugggcagccaggcucacaugcuguggagcuggaggcccuggaaugggccacagccugcacauggugggcacaaucucuacugggaugcaggucaagaaccuaugcccuugguagagggaggcucaggcaggcccaaaaccuauuccuucaguuucugagggacugacuggcacggcugcucucagucuaaucaagucuagcccuagagagcucugccagaaaccagcuuugggggaggggagauguuccaggccuggaaagaaggggcaacaggcaggaaagagugagaggacagagcugaugccaggcagcucaggugcagccucacugucuggggcauucacaccugaacuaagcucuagaaaaggcccaauuugccaggcaaucguagcacacaccuuuaauccuagcaagagguaggcaaaucucugaguuugaagcuggcuuggccuacagagcuaguuccaggagagucagggcuacacacacacacacacacacacacacacacacacacacacacagaaaaccaaacaaacaaaaauaaaaacagaaagaaagaaggaaaggccgggcagugguggugcaugccuuuaaucccagcacucaggaggcagaggcaagcagaucucugugagggcagccuggucuacagagugaauuccaggacagccaggacagccgggagggcgacacagagaaacccuaucuuggacaaaggcccacuaugggcugcagaaaggguggcugcuaggcacuggcuaggcaccaguggaucacagcuuucugggacccaggcuggaccucagcagcaguguguuccgccaucggcuaaccucaguccagcuuggggaugcucaugagugaccacaggcuaugccaugagucacaggaacgguacugaggcuggguccucuuuucucgcuuggagcuaucgucagugacaugauaauugaaaaagaaaagcaaugugguguaggccugugggggucaugugaccccagcagucacgugagcucuucagcuaagaaccuccugaugccuccacuucaagagugccaucguccugcuugguuuguuuugcaggggucaucuuuccacaagcuagaaucacccagggagaagaccuacuccuucagacugccuguggccaaugccauggggcauguucuugaugagggagaacccagcucuggccaggugguccugagcaagcuaauaagcaacacuccuccaggauuucggcuucagcuccuaccuccagguuccugccucgaguuccugacuccccucagcgacggcacaugacuugacugaaagcuaaauccacccuuuccuccucaggcugcuucuggucaugguguucugccacagcaacagaaaccauaacaaagcuacagagucacugugcaaaccagauaggguagcaggcauccaaaccgggagcgucugagcaucagccacgugaccagcccagcgcugcucacggucaggagacugcauagaucuuauacacagauggaguuaucaacuccaugcaagcacaccauuguuuccuguacgucaaccugaaugcauagccagacucagcugggggaugguucaaauuaggcacccacacuucaggugcacacguacaagcuggauuccaacaggaaucccaggaaaccccaccuggccuuuggacaacagcacuaccacucggucacuugaagucugucaaaggaggggccuggaagaggaagaauuucucacuuaaagucacaggaaaccaaguagucagcuggguagucaggcagcggugaugcacacaccauuagccccaacacucaggaggcaaaggcaggcagaucucugaguuugaggccagccuggucucagaaggaagucccaggacagccacggcuacacagagaaacaccgucuuaaaacaaaaaagcaagaaaccaaaaaccaaccaaccaaacgaaugaacaaacaacaacaaaaccacacagucagcccagaccuacuaauuucacuucccacauccuagagguuuggggggaccgaguccuuuucauuuccuuugcccagaacccugcacauaccaauucuuaaacagccaacacaagagcuaaaagccuccucagagauuaaaugggcuaugaacagaagcaggaagaagcccaguggcugggcaacacaguaucaaaugcaagcuagccaggaagcaaaugaccugcuaggccagcagcucagguccuagagggcauagacuggccaagcauacugccucaaagcucaguuccgccgcacucuaguaagcuaacuucuguggguuguuucuaguucuguaagguaagaaaauacgucucuccucggguuauccauguuccagugcucagagcagugccugacagaaagcauggagggacccuggccaucuuuauuagcacuaguggaaggauaaggcauugccugugccccaugugcguguggugugaccccugcccccucaccacagugacggcaucguugagcagggacuccccgaagacaaggauguguagcaguucguugauguggaucuccucgaagacggccagcacagccacaggguccacggcagagaugaugcugccaaagagcaggguguccagcaggccaauguuguugaucugcucgccgcccaccaggcacacggcguacaggaggccacccaggaagaacgcauuccacagugugcccaccacagcaaagaucaggauggugcccagguucuccgugaacugccgcagaggcaggaaguagccugcauccaggaugauggguggcagcaggaagaggaagaagacgucugauugcaggaaggggggcgucucuccgacgcccuugaucaggccccccaccagcagccccacuacgaucagcaggcagcucuccgggacgaugcuugagaugguggggaucacauggaaaccugugaagggcgagagaacgggaggccgugggcuuuucaggggagccagaagaacagaagguuggggacaggacuggggaccaggaaagcagcuggcgagaggugcacaggcuuggucucagaaggccgcucuguuaacucucugagcucggguuccuugccuguaaaacggaagggauaauaccagcuucacagggcuguggcauaaaauaauuauuuuaaaauuuauagugugugugcgcgcgcgugcacgcaugugcacagauaugcauguaccaugacacauggguggaugucagaggacaacuugugggaguugggucuuuccuuuaaccagguccuggguacugaacucaagucuucaggcuuggcggcaagcgccuuuaccugcuguuuucacagaguauucgccaacuguccguuacagagcagcagcucugcaugccucugacagacagaaaucaaacugauaaucaaggugcaaaaaguuuccacggcaucaagcuacccugaacccacggcacuuccucaggcaccuggcuuacaucccacacagagacaaccacagguacagucuaacaaucccgucucggggcaggcggcaggcuccgugccaucgggguguauaagcugcaggcugacacugggugguguuaaagcggggaugugagagagacaggagaaucaaggagcgucagugccaggagaauuuggggacaacaggcccgggccugcacaccugcagagcacauucagcgaccuccagcccuagacacgcaagcagcaggcagcuguacgcaacugaggcacaccaggcggcugcuccagaagaucccaagaagucaaaggccaucagucacuuugggcaagugaaaggugaagggauuugcccaaagucagagcaaaucaacagcaggaccaggagggagccuaggucugaagcccagcucccagcaaacuccauaguucugaaaguuuaguucuccuugccucccuccacauccacugugacaucugucaaccccacguaguguuggccauccucuguuguggcccaugcuaaggcuccagacccaggcuucugaggauaccuagccuuuggucagaaccccacauucccuaugagcucuuugguuugcuuuuggaguaggaaggugggugaagaccugagcacccaaaugcaugcuggguacucaguccccaaagccaacuuggucaaaagguagcgaggccuuugcucaagaccgaugcucucuccucucccugccaagcaaguucugagcuggcgaacccuauaguauaugcccagggcugaggcuaccugaggagcuuagcacacgccugcuggcuggacacaaagggaagggacacaucucgugagcuucaggaccugccuggccagaucuuugccaucauuaccccuagaccuguggaaggaaggacauuucuuccuauggcaaagccccuccucuguucagguacugaccuaggcaacgcuaggauagcacuacgugcccaugacgccaagcucccagagacacuaaaaacauauuagggaaaaacaugggucuuaggguaggaagaaaucucaaagcaaccuuguacguguuccuacuacaaaagucacuucuugugcugaaaagcugccugggucagagagcccccuagugugcuggguuguagauucuugggccagggaguggcaccauuuggagauguggccuuguuggaguaggugugaccugguuggaguaggugugucacuguggguguggacuuaauauccucacccuaguugccuggaagucagucuuccacuagcagccuuuggaugaagauguagaacucucagcuccuccugcaccaugccugccuggaugcugacauguuccugccuugaugauaauggacugaaccgcugaaccuguaagccagacccaauuaaauguuguuuuuauaagacuugccuuggucauggugucuguucacagcaguaaaacccuagcuaauauaccuagcaacaccaguguucagccagcagguacaucucuuaccccacucuccuucccagcuccuaauauucagauucuuugcaauugccucaaaggaaccccucccuguuucagcagauaggcucccaacucugcagcuggucaaguguggugcugccuccucuuccaggaagucuucccugaccauccugccucucuugugccuccuccucuuacaaccuuaaagccacagccaucaccuuucccccggugaccucagaggucaggcaaccagcuaaagaguggagacaaggcugcugcaccuuacccagagaucugcacugcccugaaggggagacuauagggccugcuacacuguggaucuugaaguuuucgauaccuuaagucauaaagaguuaauaacaccaggaagaugacagaaccuuuaugaugugugaucuaggagauguuuuuaggucacugaaagugugucccucaaggggagagagaaagaccuccgagguucucuccuugcucucuuugcucuuugguucaugauauaagcauguuguuccgccaugugcugcgcccacaauaugcugccucaccacagacccaaggcaagaggaucacucagucuuagauuaaaaccucucagacugggguggggaugauggcucgguagguaaaagugucugcugauccaacaagaggacuguaguucagauccuagcacacacacacacacauacacacacacacacacacacacuguaaacacauaaacccacauccacacacaauauaaacaugcacaugcacacucacauacaauguaaacacauacacacacaaagcaaaaauacaacccucuaaagcugaguuuaaaaguuuaaaaauucucagggcuggagagauggcucagcgauuaaaagcugaguucaaaucccagcaaccacaugguggcucacaaccaucuguaaugagaucugaugcccucuucuggggugucugaagacagcuacaguguacuuacauauaauaaauaaauaaaugccuuuuuaaaaaguuuaaaaauucucuuuaaaugugcagucagucauaggaaaguggaccgacuaagguuaagggaguauaauccuucuaaugggccagaaagcagcuucccacggucaggaaugcagcucuagggacugggaaagcgguucugugagucagguaccuguuaccaagccugacaaccugagcuggaucccuggggccacacagagagagacccaacucuuagagguugucuucugguccccaggggcaggcuauggcacacagguaagcacauauacacacacaaauaaguauuugagugccugggguccucuguagagucagcaacaacagcugccuuaggagaaggcagaggugcaggagacagcccagaguaagcagaggagagcgugcaccuuuaccuagcagaaggcuggaagaugccucucguccucuguauucacagaacuggccugguccuugaaaugccagaccgugagccagcaucuugccuggagaggguguguguggagcaagcugagagcaguaacgggaaggguguucacuguuccugagggcgucccacaagccagcacugugcuggaagcacgugccaucacucacuccugacagucugguuuuguuccugugcugcagagggcaagcuccggcucugcagggaagggucccacucuagcacaggagucugaagcuaggguaaggagcucucagccaucagccacagagucaguaucuucccugagccugcucugcuggccccuggggauggccaugcuuuucuugaagacgaguccuccauggcugguggacagguggcaagcuggagcucugagaggcaggaugggcuuggggucuucugaccaggggacagcaugcugucuucuacuuaagacagcucccagggcacuugggcugcagacaugucccugcaacccuuucuucccacuucucccugcucuccuguuuggcccugcuuucuaguuuucugccgggguuccaggccugaggggccucuaggcugaacacaggcugcagggaagggcuggcucuguucucucuuggcuucuugccugcagugggcagcacauuacgggaaagugcuugggggagggagucuaucaggaggcagccuccucagggaaaggagugugccugccugacaucugucauaguguguccccucccaaggccuuccugagaucauccuagcaugccccacucccaaggccugccugagaucuguccuagccuguccccucccaaggccuugauuccaguuauucccauccuguaucccucaagaguccugaaacacaggaaacuagcugacaccuaugaugaaggaggcagcaaugacagaugggguaccugguguagugagaaaaaccagcguugaggcaagaucucaagaaacaggccccuccagggugcagaugaggacagcagugacuuagccacgauggaauuuggguagggcacacauaguuagaaccagaucuagagacaagggagccagaauggaccucagacagcauuuaacgcuccauaauguggagggucagagagagcaagugaccugucaauggccacagaaccaguuccacaagaguuccucaaggccgggcagugguggcgcaugccuuuaaucccagcacuugggaggcagaggcaggcagauuucugaguucaaagccagccugaucuacaaagugaguuccaggacagccaggacuauacagagaaacccugucucaaaagaacaaaacaacaacaacaaaaggaguuccucaagguccucaagcccugugcugucuuguccuuccaggcauccgguccacccagagggacgaggcaggaaagugugggacuccacaucccagccuugcacaaaucuugaaaacagcucccagcuggccucccugugggaaguagcuggggggcagggaggagagggggggcucacuccuuccuguaagugcucgucugaacaugugugugcacaagugcaugcugacagaaaugucaccagauuuuggacucacugggaacucucaaggcucucugcagcugcucugcccuucaccacgaaacauuguacucacauuucucaagcuguccccaucugcuugggugggcacaguagaacugacaagccugccccauguuacccauggcugcacuucccacaggccucucuggccugggaaguuagagaggaaugcuggguagaggagccucagaggccuaccagugugaggucaccugggacggggugguggcuggggacucugacacucuacuuccaggccugagggcagcucuggggcccuggggaugccuuuguucacugcacagugauucggucucuuaucucccucuucaguagccccagcaaccaagcagucucaggcacagcacugagaggugacgccucacaugaagcuauagugacacgguguguagggguccgcccugacccuuagaccucaucugccccucaccauggcuguaaggggacucaguuuuacagacaaggaaacugagccauagaaagguuaagcaacucaguucaaaucuagacagucaguauguggagucuguucuuagucacucgcaccauuaccccuacuuucauuccuagcugguuucucagaggaccggcccagggcuaaagaggcccaaagcaguucccugaagaccggaggcagccauuuuuuuuuuccaugagcccuucuuccccagggaaguccuugcacagugucuguccucucucauggcucucuugaagaccaucugcuuuugaaggcauccuccuaagaacuaugcagugagcugagggucuuggcugccagcuguuagggcaguagcucagaguucaucagacaugauuucuuacuagcaccucagcucugggacccauagagcaaaagugguucagauccagccacugucucagcagguucccagacagaccugcaggagacaaggcuguguagcaguggcuacccauacuguguuccacagccagcaaacugggucccaaucgcgguacagucacugaucagcaggguggccuugcaaaguuacuuuauggccccuguccucaguuugccgaccuguagaacagcaguggguagaaggagacgcaguaaaagagaugacaaagguaaggaaugccagccaugaaggagcuguagcagugccuuccuauaauccuacccacuugagagacugaggcaggaggaccacaaguuugagaccugccugagcaacucagugggaauuaaucucaaaaagaacaggggguucaucuccaaauaaugcugaugcccaugggaaacgggcagccgcucuagucaaguucucaccaaggccuagcagauggcccuguggguagugcugugcuucaagccugguggccugagcuggauuccuggaacccuacuaaagguggaaggagaggagcgaucacacggaguugucuucggacccuacgcaugcacaggcgcaguggcccccauaucaaugcacacauguacaacaauaguaaauaaacuugaaguaaaaccuccucagcugaguguaauauaaagacgccaucauggcccacugcugggcugaaagcuccggaugcugggaacuccggagagccaucugagacucggguuuucagcccagaacaagcguucacuccgugugacugagguaugacugagcugucaggugugagcggaggaaggaggagagcaggaggacucugagcucuugagacaaagcagugcuaagggaggaagagcagguggcguuccuagggcaggguaacugagcugggacuuaaagguucaacaacaacaaucaccaccacaugccuaaggaucagggccuguauccuccaaagagcuucauaaaccgggccugguuggaucggcuguggaucaacuguaacuaugcucgagguuaaggcaggaggauccagguucaaggauugucugggcuacagggcaaguucuagucccuccucagcaacuaaaugagagcccgucagagaauaaaaaauaaaauauuaaggcucagaguguagcacaaggguaaaguguuugccuagcaugugggaggcugaauaaacaaacaaacaaacaaacaaacaaacaaacaaacaacagaagaagaauugggccuggugagaugagacugugguuacgaaugcagucuucuucugcagaguucuguucucagcaucucagcacacacacacacacacacacacacacacacacacacacacacgaaaaagaacacagucgggcauggugauucauaccuuuaaucccagcacucaggaggcagaggccagcggaucucugaguucaaggccagccuggacuacagagugaguuccaggacagccaugguuacacagagaauccaaucuugaaaaacagaaacaaacaaaaaaaauuguaaacuaagggcuggaggguguagcucagcgcuggagugcuugcccagcauauaccaagcccugagcggaucuccagcaccauaggauauaaaaaucaaagagacaggagcugauauuaccccucacucagcuggcuucacaccuuuagucaauucacaagcuaaacccagcacagagaaaucacaacagucgugaugcaaggagcgggcuucggccuucaccugauccuugcuugacggcuaagcaaaggaucagagaggcaacgagaccugacagggcuacauaaccgggaagggcuuccgucaccacagucuagggcuccuagcugccaguuuugugagugccaugaaaucuaagccuggcaggaucaacagaacaagaauucaagucuccaguaugccuccccgacagaaacagucagaaauaaaucugcucccaguaccugggcaggaaccaccccugugcccagaaaagccaguuucucugugcuucuccccagcaguuccauacagcagcugucucuuguuugaauccauacgucagagucuuucuagguugugggggaaggaggacacauaaggucccagcuccaggaauaaagucuacauaacagaacagcugcagaucuaccugaaaucaugcuggugaugcuggccucucugggccaggaaggagaaggcugagccagggagcccagaggcaguuccaggccuggcucugcccucuaauaaccacgggcccuguugucuugaggcuuccccacuuguggggcacauuacagauggaccuguuucugugucucgucaggugaaaauccgugggccagacacugaagcaccuuuacaccgugauguggcagaggcagcugauaaaaccuuggaacaaauagaugggccacggcaagugggagagggccagcagccuggaggaacccacagugaagacaggauuugucucugggaggccgggugggagaggcuguucuagaugcagagaacugugcccaaggagugaguguguguguguguguguguguguguaccuucuuaugguuuauaggaguuguuuuuuuguuuuuuguuuuuguuuuuucauuuguuuuaaaaacagggguuagcuaagugacccaggcuggccucaaacucacagcaauccuccugccuccucuuuuggccuccuacuugaugggauuaaaggaaccuuuguuuuuucuugucuuuacucaucuaccuccaccaaucccucuuuccagcugccagaaguuucccaguccugcuucuguauauacagugaagaacuuugcuccaucuugaacuucuaccuaccucccaaaacccagucaccuacucuaggaagcccucccugcacacuccagauugaaucuacuguuacuucaaacuguacuagguguucuacauuacugccaggcaucccagcacagcccugaacccuaaacagaugauacucaggaaaacacgguugaggggaucaugggagcuuccuaaaggucauacuuaggaacaaagaagcagagagcaaugaccugaagccuucugcggcuucuaaggcuugcugccggacuggaaaugaagcaggaagggaaaaagacacaggcuggcacugcggaccuucuucccaaacucuguguguguguguguguguguguguguguguguaggcuucugcuguccuggggccuccagucaccagagcucucuguaaagucacaggcaaugaguuccccugcaguggggcaggugucagggagaaggaaggacagcgaccaggacagcaguaaacacugccuguagaagaaacagaacuacucagcaaccacaugauggcucucaaccaucaauacaacucuacaguauacucauauauauaaaauaaauaaaucuuagaaaaagaaaaaagaaaaaaaaaagcagcuuggagggaggagaugguucuucagugcaggacugcaggaggcuucggcagccagcaggcucgguaccuggaacagagagcaggggcuguggggacagcucaguaagcucccgaggcucagggcuggucggggaccgcgugauacacaccgauuuccuuccaggggcggcuguggcgacuuuaagcaggcccgugauaauuuaaaacugugcgugcuaucuuccugucagucucugcugacacagcagcccagccccagcgcugaguuuacuuggagacuuuaaaaccuuucagcuucucuugcuaugcucuguuuuauuuucaagugugagaauagaguccagcaccuucuagugcgcuaugcaaacucuccacuacagagucccaguuuuucaugcauuaguuaaaacaguaaauuuaaguuuuaaaauuauguaaaaggggcuggaaagauggcucagcaguugagaagacuuguuccucuugcagaggaccuggguuugguucccagaacccauuucaggaaauuucagcuccaagggauucaauccccucuucugacagguguaggcaccuucauguauacaguguagacacacacggcauacccacucauuuagacauaaaauaaauauuuacuuaaaaaaaaaaacccagccaggugaacagguauauacuuucaaccccagcauucaagaggaagaggcagguggaucucugaguucaaagcuauccuagucuacaaagugaauuccaggcaacacuacauacugagaccuuguggaguaacaaaacaaaacaacaacagcaacaacaaaaaccacuugcugcucugcucugucaggggaucccaauuugagcuucuagcacucacauuaggcggcucacaacccccuuuaaucccagcuuuagggaaaucucacgccuuccagccuccucaaguauuauacauacgcauacacacacacacacacacacacacacacacacacacacacacacacacacacacacacacacacacacucacacacucacacacagaaauaaaaccaaaaacaaaguaucuugaaauaaagcuaugcauaaaugguuaaguaccccucuggagcagacacuaagcacguuacugcaaagcacuugguugucucagggaagcuaacgcaauagugcgauuauuauccucaguuagaaagagaccuagaacaggccacugccaauguggcucaggcuaagucaguugcugggaggcccaacuacccaagcucuaucccugguuccuaccaagugagagguaagagccaauucccaaaaguugcccuuugaccccuacacaugcaccacagcacucaugccccaccaccccccaauuuaauguaauuuaaaaauuuuuuuaaagaucauaaaaugacugugugauggugugugucuguaagccauuuggaaacaugaaauugaggccagucugggcuccauaguaaguuccaacuaagccugggauacaaagcaaguuccuguaagaaacaaacaaaugaggggcuggagagauggcucagugguuaagagcacugacugcucuuccagagguccugagcucaauucccagcaaccacaugguggcucacaaccaucuguaaugcgaucugaugcccuuuucgagugacaguguacucauauacauacaauaaauaaauaaauauaaaacaaacaagcaaacaaaugguacaggaggaaaagaccagaauaugcccucuuccuugucccaaggacacacagccaaggcuacagaguguuuggggugaccgacacugggagauccuaguccucugucauacucacaccuauggagacaccuuacaguaguauggcugugcccagaccacaguuucagagcaauucccugcagaggcauuagugaagagugaagggggggggggguucggacauccucuaccuagagucccacacaggcucugccugggccagcacuggcaguaucaccccacggccuuggugucugguuucaaugcaccuucaccucauggcaccacugacacuggaaacaucuaaaugacauuccuggcagaggaggcugucucggcuccccggcuuucaaccuugaggugagaaggagggaaagcagaaugcuggagcuuacacaaaaccuggaagugaucgagugucagccacuguguccuccuuuaauucccauggccugcuccgcucacuguguggcugcccagcugggcucucauucccacaaccacugcagugccggccuggccugucucggggcuguagugggaguuccacacgcuacucugccuuauaucugagguguggcaggggcuauggagaaacaaugcucucaaguuucaaaacuuuccaaugcuuguuagaaaugucagagcuaugaaaugcuagauuuucuuuucuuucuggugggguaagauacagucugcaaaaugcagacacaagacagaacggaaguugaucacaccaaauaccugugguuccuaagucggccucucaggcugaggcuggccuaagucagaagcaccacagugaguucaacgcacugugcgugccacacagcacuugugcacagauggcaagguggcacaggaguggcaaaaaggacucagcacaaagagaaccuuuccaggaaacccccugcagaaggugagucacagagccucacuuucagcugccacacagauuggcagaggguugcaaggaaccagacuagggugguauuggcuuacucaggaagacagccgcagcccuuagucccucacagaucagucugcuagucaggggcagagcuggcucuuccuuuuagaccugugacuuuagcccuucacugacccaagucgcugugacugcugccgcgaccugcugcagcaggauccuucagucuccuucauccacugcacucuccagccccaagcucagauccugacacgugaugagaaggcucaagcuuggccgcugagccugucugaucacuuuggaaccagacugcuaucuguccuagcaacuguccuuugcuagugagagcagagagucacccaacaggcagaacggagaggaacagugugcugguacaggcagaauauuucuguugggaacacauggcaacacaggcuagagaggaaguuguuaguuagaugaguaugaagccccacuuucucugguucucgcaugaagccuuggcaguggauagcagaugaagaaagagagccaggccugcugacucccaguccagugcucacccagagacagggguauaacaucauuuugugagcacagucucaaucaauccacggaggcaagacagccuacagggcuccaacgacccaggcucagcauccuggaaucucaaagagaggucuggucacauggucaugaagucugggcuccagggaaaccagcaauggccccugcaugauaccagaucgaggaaggaggcccuaaccccccauucagaugccuugagagacuacagcuacagucagagggagagagggcuagagacaggcccacacuggugagcggaaaccugggucgcaguuucuagauuaccacacacugggugcucauaacaaaccuugccucucuaagcuuccguucuuccucuccugcagauauaggcaaugucuauggcucaaggcagcugaagaaaacaugacccacacacugacaaauguucugcuuucagggauagaaaccaggguucaaaaugaagccgggaagccaacaggcuugagugcucugaaacucaaggugacacugauguccacccugaacaucagagaguguggccuucucugcagccaugacucucacuagcccugacuuggguucaacagcagcauaacauggguguagaagcagagggucccauuuucugcuggaacagagcucauacauugccugacaccucugaaaacucaggccagcuccaugccaggcccuagagaggccaggacucaagggucaacaaagcagcuaacccaggggcagcuauuccagaccagggcagccagcacucuggggccgggagaccugacccguguacaagcugcaggggcuggugaagauggcugaggaggaagacgucaccaggacaagcagcaagccggucugacuuucaccccagacccagugaugcaucagggaggcuccauggccggcaggaugcucucucucccgccacugacuagcaacggcuuuaugccagguacuuaagcucucacucaguuccucauuugagaaguggaacucacaaccauuuccaccugggagggcuguguucuaagcagccgaagagcucaaaauagucagcuaagggcaccaucccaucucugcacaccucaccucuaacccaaaauagacugccagcaugaggauagagcuauggagaaggagcagaggccaggagaccugggcuccgcacacaggcagcaccacauaagcacccagugccuguuaguuuuuggagggaggcuauagagcacaaaccuucuagaggccccaaggggccagguccuugugaccuguacaaccacaaagcuccccuauagggagcaaaccuacaggucacaagagucguggaugugcuaggcuuugcaaaaacuccacucucccggacagacguaggaugccugggcccuggguagcagagucccugcaggcagguguggcaggagcuugggaccacacagaaccccagaacggugguagacauggugagaggcaugcucgaggaccuuucccugucccuccccccaccccacuccacccccaccccgggacaauggggauaguuugucacucaggccucuaggggcaguaauuggacugagcagauaggagaugagcgugaccagagaaggcugcgcuguagaaggcacugcagagaaaugaagaaacagcagguuuugucccaaagucaggaggggccaggauccuuccuugaaggagagaagcagaaagaugcuauaggaaaugagggagagacagccaaccuaaccucugcuuaaauaauacaaaugaagcccaaaggggggggggcugagucaaggucaugaagcaaaguggggguaaagugcuggacgagcacucggguucgucugcgcugaaauugguccucacgcagaacacgugcaccaacccugcaaaccacuccugcucuguuugauuuuaaccauccucuccugagcacacugaccaacacuuuccucaugcagcaacugaggaaacucaggguaggagguuuguuuuguuuuguugagacaaagucucucuacauagcccuggcuguccuagaacuaaguauguacaccaggcuggccucgaacucacagagauccucuggccucugcugggauuaaaagccuguagcaccacuccuggucucaguguggaguuucaacccggcccuucugccuggccuuuuggacuccagagccacggucuccugcugccugaaaagcugggcucugguuuuugucuugcugggaaacaaacaggaauuguggaaagcaagagcuggaguuugcuguuggcuucucacucuuucgugugcucucaggcagaccaccgacccacucuaaaccucaggccccucuaagauccacagcaauacacacaaacccuggggugaggcaggagccaccugccacccugacacagaggaauggagcccugcugggucuggccuaaaggucucugcucaauuccagcaugcacugacuuguggaggagguggggacaugacaguguacccucuagcuauagacugccagcaaagggaagaacuaccagcaagccucaggcauuuggcccucagcagggccacggagguagacacuacuaguuccauuuucuaguagacccaccagcaggcucagagguuaagaauccgcucaaaugacauacacaggaagcaaauccaucaugccaggccuggucacuguuuccuguugauaccuuggucuucuggaaugaguaccaggauagaggcugggaucccuucauccaagcauggaggcccaagggucccagccaggaugacagcugccucccugccuacuugcuugccagucagccacccccuaagugugugcaugucuggggaggagagagggaagccuuugucagcacuggcuucugccuggugccgcauuaacuguacagacugcagucuacugaggaaggguaccuaugccucccugaggcagggcaaagaagaugcuuguggcauccagacuggaggagcagcuaccauggggcugacacaaagagucagccuggggggagggguguuguuuuuaauuaguucaguccccguuccucaagggauggagaugcugguggcagugcuagcuagcagucacugaagccaugagccuucacagcugcccacgggccuaggcugcagcacauuuccaccacagaugaaggaagcugaggcucccagaggcucaggaccagccagcugguggggccaagcuggauuuaagacccagaagugaucccagugugggcugaugcucacacacgagcauguuucucaacagcuccccauuugcaccaaccagaaaauucacugggugacaagugucucaaugauccuaaagccacagucguaaccugggcugccucagagcguguccacagggacaagugaggcuucaccaugauaaggaccagauccugaacccagaggugacacuggcccuggcucugcucggucccuguccucccauccccgcaaggauucaaagccguccagucccaccaccuuccuaagcagguuagcugcccucucugaauuuuggggucucuaccucacagggugaggggagcagcaccugagaggcgcagacagaaccuaacaggaagccaggugagcugaggcuggaucaugagcugcuggugcccacugccuaucuccuaucgccacucacugccaccaggacaagugucacuucaagaccucacccugaaggcagauaccagggcucuccucagcccccgcccugggccaacagggcacucccagauaggccgccuggcuccuugauuaucaucaccaaagccuuucuuauaaaagccuguggccacaagagaggccagaagccaggguacaaaaagcuaugugccugguaccaaaugugguggcuaaacauguaggggaguagggcccaccuggccuggcacuguguagcccuuaucaugccaaaugcucccuggcaaagggccaggagaguggcuaaggccccagagauuuccucccagucagguuugucccuggguucuugaucucagucuaggcuagagucuacacagaucugggggugccugcuuccuuguucucuuggagcuauaagguuacagaucagucccuaaggcaaaaucugauaggauauucaaagccaggccugugggggucugccucagaggaggggaacggaaggcccaguuuaacuuccuuggaucagaggacaagcagaagcccagguugcugugacugacuaggacaacaucauccaaacccugcaccucuguugugccuucuaagagcgcaggcugacgagcacauucagggccucagccgggaugaggggcaggggaggcagcugaagcaguggccaccuccuagugucuuuccucccuagcaaggagucacacacgcaggaagugucaggucagaggaaagcucaggcucacucagaggucucuugguuccugaaguagccgaguaggcucccacacaucagaaauggcuggcuggcucuggccacauuacuugcuggggggggggagggaggcuuccugggcccagagacugacugugcacaggguacagcuggacagcaggcagugggacaggaggagugacucccagugcucuauggauaacuaugguauuaacaauuuuuccgaagugcuggggacugugguccuugcauaagagacauauuaccacagagccacauccccaagguugcuaauaacuaauccaaucuuccaaaguagaagauuuugaguauuccuaguacaaagaaaugguaacuaucagagguaauauacccaaaacccuaaucugauugguauauaugggacacaugcauccagcugucuggauuaguauacuauagacacuugcauacaauuagauacauuguauauaagcuguccagcuguucccaguuagccucugugccucucccacuuaacccuuccuaggcucugguaaucacuagccuacucuugauuuauaaaauuaacuuuuuaguuugcauauccauauuuuauaauuaauuuuguuuaauuuaaaauuuaugcauaaggguguuugacuguaugcaacccugaucugguuaguauauauuguauacaugcaucaugacauuguucucauuggucacauagcacaugccuuuaauuucagcaucucagaggcagaggaagaugagucccugugaguucaaggucagccucagcaacauagugaguucuaggacagccaaaacuauacaaaaagacccugucuaaaccaaaacauaaacagcaacauucagcaugcuuuuuaaaauauuauuuauuuaauguaugugaguacacuauagcugucuucagacacaccagaagaaggcaucagaucccauuacagaugguugugagccaccaugugguugcugggaacuaaacucaggaccucuggaagagcagucagugcguuuaacugcugagauauuuuuccaguuccauugagcauguuuuuaaugucaacuuuuuaauuuuuaaaaauuuuucauuagauauuuucuucauuuacauuucaaaugcuauccugaaaguccccuauauucucccccuguccugcuccccuacccacccacucccacuucuuggcccuggcguuccccuguacugggcauaaaaaguuugcaagaucaaggggccucucuuuccaaugauggccgacuaggccaucuucugcuacauaugcagcuagagacaugagcucugaggguacugguuaguucauauuguuguucucaacuuuuuuauuaaauaguucacaucacuauagagaaaagcccaaugggacacagugguguuuuaauuuuucuaacaagaaaaauuaaauaaaauaaaaauccacaaccccaccagggaggcaguuuuucugagucauaauucaacauuaaacacuuuacuguaauagauuaucucauuuaaaucccacaaaacccauggaguauaagaaugcucaaagcagcuuucuucauaauugucaaaaaaaaggaaagccacucaaugcuuaucaacaggagaaugagccaacugcagugcgaccauacauacagugaccauacauacauaaggccagcaauagaaaagaacaaacuagccgggcgugguggcacacgccuuuaaucccagcacuugggaggcagaggcaggcagauuucugaguucgaggccagccuggucuacaaagugagcuccaggacagccagggcuauacagagaaacccugucucgaaaaaacaaaaaacaaacaaacaaacaaacaaacaaacaaaaacaaagaaaagaaaaaaaaaaagaaaagaaaagaacaaacuucugguagacaugacaacaaagaggaaucucacaaauauacaaauaugcucagcaggaggucaaacacaggagucccuauuauucuuuuuuuuuuuuuugguuuuugagacaucuguguagcccuggcuguccuggaacuuacuuuguagaccaggcuggccucaaacucagaaauccgccugccucugccucccaagugccauucaaagacagaugaaacggcaggagugguggcagaugccuguaaucacagcaugugggagaaagaggcaggcgaugcggaguucaagaccauccccacuaguuaggaggccagcuuggguuacaugugaccaucuccaaaaaaagaaaaaaaaaccauauaaaacuaaccaagaugauagaugucagaauagugguuacuccaggggcacaggggacuauagaccagagcccacaggaauccagaaugcacaaagauguccuguaucuucuucuggguaguucaugugaacucacacauuguaaauggcacauuuaaggauuacaugcaaaacacacacauaaagauuaugcauauuuguuacaguguauaggcaaguuaccucacaauuaaauacaugggagggugcuaaaaaaacacccaugcagucagguuaucuaccuacagucacagagcuggcacacaguagaguugguacuuaaauuaggccuucagggcugaccccugagaccggcugcagagaaggaugccuugaacccccaccggcagagccgccccagcucuccacaggcagcuuauuccucaguucuaaugugggacccacuugcuccuccugccagacauuagcacugugguucagccacucccggaaacuagacuugccagaagccucagcacaccgacagcugccguuuugccagugaggccaaaacaggaucaaaagccaggcccacaacuaaagcugagauucugcugggagcuauggcagggugaaagcuagcugggacaggaugggacagggugcccagccacacccuacauucacaacagacccuggucuacaacgugaagagccaggccacacaagacauaagcagcucagaggacccaccagccuggccucuggccuacaaggccugccacucccaugaggacggcaccuguuaacccagaaaggcuacauucugccagccagucuugcacaccuccugguauggcaagacguauggaggacucagccguuuaguuuacagcagcuuccauccuguuuggcauucucagcccagacuaugcuucccuccucucccucuccucguccccaucucugaaggagccaccgccugcugcuuggaggcagcuauuuccucucuacucuucccacaacuccuacacaaucccugucccaaaccauuuccugcagcuucccaucugaucaguuucuuaggaagcuaauuauccacagagggaggaggcgggaaucgcucagagccaagaacauggagagaaaacuucaucuccacuccgcgccuuccaggacaacugugguguaacacugacccaccgugcucguccccaccuaagacgccugcgguuccccauccacacagaccugucuucuacaccgacucugaggccacucagaaucaguucuaaccccagugcagaccuguugccaacacacucuaaggagcaacaucacaaaggcccauguaccaccaggacccauaguacugcccccugccucaugacaagcacuuguguguuagcugucauagcuauaucuccuaccacaucugcccaagcacgguaggugcucagcggcaagcugaaaagguggaacuccagagcaaaccuagcucccucugcagaagagccaggaauggagggaagacagucauuuacuguuagcacagaaaggccuagcuagggucaaacaguugagcccaaccccaguuuugccaccacccugcugcccuugagcaagucacuuccgcccuggccuucugcuuccuccuguguaagaugggagagcaggccagguccugucuacaguuucccagaguccuucuugcugggugcucuuuguaugcucauuucaccuccccagcucugcgcaggagguccacguagcugagaaugaaggagccgacuucucucucucccauugcacucacgggauucuagacuuagucuagaaucuccaaaggcucugaaaucugacuugcuccuuacauggucugaccacaggcuacgagcagagcugguguaggaggagagaugaucagguccuagcgcucugaggugccaugcccuccuucaggaccugucuacugacuggccugaaucugagcacagccccucccccuuagaggcucuccuaggcugguacuccaacagcaaugguguggcaagagcugcuuugcuggggagcucugaucuacugucucucagucccaggcugagggacagauaagcagaaaucugcuuugcgcagaugccucugcagcuagcucagucuuaaacaucucccuaauaccccagugcaggucagaccaugucacccugcuccugaugggaccacacaacacuuaguacugacucuagcagccaacccaagacccagcagaggucuggcccugucuccuccacucucucuucacacuucucuaaucacacucucuucaggacccuggucuuugaagagcggacugcuucuuuccugucacucagcugccuccuuggagagccuucagaccuauguuuauuuccuuuauacacauacuccugucugacauuguuggauuuacuguucaacacuccauacuuggaugugagcccuuugacaccaaauccucuucugccuugaugcuggcugcauccuaaggaaacggacacaaagaggauggaacuggcugggaagguuuguacugacauuaacuagccugggugaucaggaaggccacucuggggacaugugacuugaaggaaaaugcuaguuugaggcgguauacagacgguguucuagguuaggggacaagcagacacuacagucucagggggaagcgggcuggcaagggaaacaggacaugacauugagaaugguauaagcuauagcucugagauugugucucaaguucaaaaggaagcaucaaaaagagcuucagcagggaacaccauguuccgguuuacauccuacaaacuccucgcugcucuauggucaccucauuacagccagcgcugggggccagagucaccacagggugcucaggcagggacagagagacuagguguggaaggaaugaagagcagcccgugaccuaggcuacaguccccacaggcuggagcuccagcugcucagcaacccaguguaacccaaccuacuuaauaaugucgcuucccgcuaugccagcgcagauucuuucagcugggcgucuacucaugucagcagcucagucuuggccagugucccaggccuccugauuugaugccucuuuccuacgggaucugcucacuggucuucccagccacaucucuucccucucuagaggcuucccaugugcagcaaucuccaaguuacccagugucgguuuccugagauaguuauaagccggcuaaaggcaaacacugcagcaugcucggcucagggucaucgugaaauggacaaccaugcacuaaguggaauccucagcacaagaccaggaacuggcgagagcagucacggcggcucccuagccugguccagggcaacacacgucauagacucucaccaacccugacaauggcuucugcuuucccugcuggcuguuugguggaaggauuggcacugucccaguggguuucaaaagcaaagggcaaucuggacugguggcuuacucaugaacacagcagucaguaggguaaggcaagagccugcugugaguucaaggacagacugggcuacagcgcuagaggcagucuuuuuuuuuuuauuuaagauuuauuuauuuauuuauuauauguaaguacacuguagcugucuucagauaucccagaagagggcaucagaucucauuacagaugguugugagccaccaugugguugcugggauuugaacucaggaccuucagaagagcagucagugcucuuaaccacugagccaccucuccagcccuaaaugguaucuuuuuuuuuuuuuuuuuuuuugguuuuucgagacaggguuucucuguauagcccuggcuguccuggaacucacuuuguagaucaggcuggccucgaacucagagauccaccugccucugccucccgagugcugggauuaaaggcgugcgccaccacgcccuggcugaggcagucuuuuuuuaagcaaaugcaaucagcaucacuuggggcucuuuccaucaucaccucacggccgugccuuccucccacucucugucagagagcaaaccaacacuuccccuucaggaccuaggucaaugcucugaaagugagucacccccuccaacacacacacacacacacacacacacacacacacacacucacauucauauauacacacacacucauacacacacacauucaaacacacucacacauauacauacucacauacacacucucacacacacucauacacacacauacacacacacauucacacauacucauacacacacuaacucacacauucacaugaguucgaugcacauauacauaacacauacacacauucacacauacucacacacgcacacacauacucacauacacacucucacacacacucauacacacacacacuaacucacacauucacaugaguucgaugcacacacacacacauacucacacacacauucacacacacucauacacacauaaacacacacauacaaacauacauguucagcacacacacucacacacacacauguucaacacacacacacacacacacacacacacacacacacacacacacaccaccccaagccccgugggcccugcacagcaguacucacagcagauccugcgcuccuguauacacccugcuucuuccuugaggcguacauacucaacuuuccauugucagcaagcagucuucagcagagaccaacccuugccaucuccccacuccuaacugaaaaccaaauucaguucuuucucucauuuacaagucuacccugaguacugaucauauucaggccuaccccagugcccuaaggccauauaccuaauggcauccucuuuuaaugugacagggacaguauagggaagcccccaaugugcucaguaaugcucagacaccacccuauuugaccuagaaagcugagguuuagguguggugguuaagcuaaaaagaggcaaaaguuucugcccuuaacacuggcacacacacacaccuuacacucauaggugggcuguuaaaaacuauuauagcaugggcuaaggaucuaacucaguugacagaaugcauaccugauaaguauauggcccugaguucagucucuagcaccauaaaaacuaggugugguggggcauaccuacaaucucagcaccuaggagguagagguaggagggggaggcaaucagaaaucauucuuggcuacacaauauuugauggugucuugcaguucacuauauagcccagucuggccuugaacucacagggggaaaagggaagggaaggggaagaaaggagaggggaggggagggggaaagagaggagggaagagaagggaagaagaggggaguguguagguaggaaggcuuaguaggccaugcuggcuggauaauccuaaagaccugacuccgagucccaacacucauguaaaaaccaggcaugaugacccaugucuguaauacccauguaauacccaugucuguaauauccauguaauacccaugucuguaauaucagcucaaaggaucuugccucaaaauguaagguacagagcaacugaagaagacacugagcauugaucccuguccuucacacacacacacacacacacacacacacacacacacacacacacacacacacacacacacacacacagagcauagacacauauuaugugaacugaguauagugacucauaccuauaauuucagcgcuugagaggauaacaagucccaggccagccugggaagcacagugaguuccagacuagcaagaaacaccgagcaaaauccugccugaggaaaacaaaacacacaaacaaaaauaacuguucuguaaagcugaguguuuuuauagcuacagauucauuugccagcuaacaucaagcuuccuucaucaaaugucuugagaaacacgucuuguaacuuccacuggguagaacucacgcuuauucuagaggcagcccggguccaauauccaacacacacacacacacacacacacacacacacacagggucccugcucugcagggacuggaugccuuuggagugugugcacuccucgggaagaccuggaucuucuaucccagugcuuagcacaacacuggacacacagcaggacgccaagccucuuacugaguggcugcucaguggcaagagacaucagccagcauuccuguuucuccugcuccuacaagucacuguucacucucuucuaaaugugucaaacuguagaaccagguccccuggaauuacccuccagcuagccacaguguuacagauggcuacugagacucacugaggaugacuggcucaguuacucaguagaucugaggugugaagcuagguggcaggaugagccuguguuccucaucaccaugaccguauuuccacggggagcugcuuagggcacuccagcaagcucgggguucugcuucagguagaccuguccagugacgcccaguaaacccgacaaacaucccauggaagacuagcuaucuuccagggccuagcucacaaagccucuugacccucgcagugguucugcaucucuguacagccaggugggcgggcucaggaaggguggguggacgcuugcuccuuuuccuuuucccuuucccccucuagccguaagcucagucuuggacuuacuuggacauauaaacuggcucuugccccaugugggcauccugccuaccuuguacaacaucuggauucuucugggccugacccagggcccaggagauaggagauaguuuguugguuaaaaugcugaaaaagguggggggccggacagaacaaccuacucuggacucucugguguaacccaggcuggccucagacucagaaucuguuaguucaacacuagcuugugauuaacuacaagaucuaaaagauuugauggguaaggacaaaggccuuggaucagcacagaaaaguucuacuguaaggaccaguguggccaauacccgaguuuccugguuccugacaaugaccaccacugucuuuccuaggcuugaaaaaauaaguuuguuaaugcuuauugcauccaggcacagaccacagugccuccuccugacccaccaccuagagagcacuguauuagcuaaaaaagcaggaaggaggccugucucugcccucauccauuuacauguggcccaaggccaguccucccuggccucaagugaaugaggggacugcaucaaaaugucuccuucccguuggggccgggagccacagaccaugaagacucuaagcaggacaagaccagggagcaggaguccuggucucggaaccggugugugaccuccagacugcccaccuucugaggggaucccuuccgucggcaucuccaggguggcugcuuccucuucugggucucagagcuguguuuggaucccaggcauuucagggaagaaugugaaaggacugagucacaccucaggugugagcugggcucuccauggcaaccugaggcacagugcaagagaacccuguuguaucacucugaugcccaguauagaaaagcuuuuucuacucagagucacuugcucuucucuucugccaggauauagcccacucuugacauggcucacucucgcuuugagcagguuccacaguuugcuagggaaagcacaccaaccucaggaggauguaccaaagugcccgaggcacccucccagacaagcaguccuuuaucccuuuuuaauuccccauaaaauaagacuugagcacuuagccuuuaggauccguggcaguacuggccuucucccccuguaacaguccaagcguaaaacagcaagguguggugacacacagcuuugagccucauacuugggagucagaggcaggcagacugugaguuugaggccagccuggucuguacaagaguccaaaucaacaaguuauucuguccauucuuccaccuaggcuagacucccuuagccauacccucucuucuccccuagaguaaggcuucuuaaacuuuccucauuguaacucuuuugcuggagaaauuuuuauguaauccuauguauauauaauauguaaaauuauacaaaccaaaacauuuacggauaaaucaugaagaaauuuauuuuaagagggcuagagagauaguucaguggucaauagcacuggcugcucuucuaaaggacugagguucaaucccagcacggcacuguagcucacagcugucacagugccagaggacacaugccguccuccagccuccacaggcaccaggcacacaguggugcauagagcaggcaaagacucacacacauggaauaaaaagaaaucuacuuuaauacaauuauuuaguauuauacauguaauuuuacuauuuauuaaagcaaauauacauacuaaugagaugccuagcacuugcuuauuuuaucuuuaaagaauuaaauucucacugaauauuugauacugaagaauauggagcaucuucaauguuuuucugaguugauuaauacuuuaauuuuauaaucaucaaugcuaagaauguugcuaugcauaaauauauacagcacuaccaauugugguggcacaugccaguagacuacgcugaagaagcagaggcaagaaauucaugaguuccagaccagcuugcacuauaccuuggggugaacaagaaagcaccugccuccacaccuuauagccugagcucaauccccaggagccacaugauagcugaagaaagcagaguccugugaguuguccuuugaccuccaugugugcaaccauccaugcacacgcgcauacauacacacacacacacacacauacacacacacaaaugaauaaacgugacuuuuaaauuuuuuaaauaaauaaauacguuuaacuguaguaugaaauggcagaauaccccauuguauagggccauucagaaguuguugcaaauucuguccuaaucucuggccaaaaaucacuacaguauucuuuuuuuuuuuuaaugauauucaaaccaacaacucaaagagcaauuucaaaaucaaauaauuuaccacaauaugauccaaggauguacuaacuugcgacuuuauaugcuaugaaacuggauaguagagaaauauuaagucuuuguuuucuauaaccauuauauuucuauaagaacagaaagguuuuuuuuuuuuuuuuuuuuuuugguuuuucgagacaggguuucucuguauagcccuggcuguccuggaccucacuuuguagacgaggcuggccucgaacucagaaauccgccugccucugccuccugaguccugggauuaaaggcgugcgccaccacgcccggcuuaaagauuuauuuauuauuauucauuaguacacuguagcugucuucagaugcaccagaagagggcgucagaucucauuacggauaguugugagccaccaugugguugcugggauuugaacucacgaccuuagccauuucgccagccccagaaagguuuuuauauauagugaaagcacugcaauuagcugagaacggugcaugccuguaaucucaacacuagggaggcugaggcagggggacugcuuucaauucaaagcuagccuggaccacaaaguaagugucaggucagccaugaauacagucagacacuaccucaaauccaugcaugcaugcauacauauacacacacacacacacacacacacacacacacacacacacacacacacacacagcaggagauggggccagagaguuggcuuagagguuuaaagcacugcuguucuuuuagaggaccagaguccggcucucggcacccacauuagguacucacaacgccuguaacuccgggaugaagcuaccuuacuucugaccuuacuucuggccucugcagacacccacauauauguggcaaagacucauauagacacaaacacauaaauaacaacauaaaaauaaauuuuuccuuuuuaaaaaaaagugagggagacaggauccaggucaguugguaagugcuugcuugguacaauaguuugaaugagaaacguuccuacaagaucacacauauugaacaccugauucccaguaggugcuaaguuugggaauguuuuagaacuauuaggacauggagccuuggagaaagaauaugccauuugaagaaggcuuuaagagcucauaaccgggggcuggagagaugguucagcggguaagagcacugacugcucuucuguagguccugaguucaaaucccagcaaccacccguaaugaaaucugaugcuucuucuggggugucugaagacagcuacaguguauuuacauauauauaacaaauaaauaaagcuuaaaaaaaaaaaagagcucauaaccucgggcuagagagauggcucagagguuaagagcacugacugcuccccuagagguccugaguucaauucccagcaaccacaugguggcucacaagcaucuguaacagaaucugaugcccucuucuggugugucugaggagagugacaguguacucauauacauaaaauaaagaaaucuuucuuuaaaaaaauucacgucauuaaucccagaacucuggaggcaggggcagauggaccucugugaaguuugaggcuagccuggucuacagagcgaguucauagucucacuccacucccaguuugcucucccugcuuccuguggguggucgaacaugugaucuuucagcugccugccugcugccauucuucccucuggaaugagaagccaaaauaaacuuucuucuacaggucaauuuuuaaugauuuguuuaccuguguguuuuuauguauaugcagagggcauuggagcacaugggacacaguuguaaaugguaguaagccaccacaugggugcugaggauuggacuccagccuccucuagacgucacuuuugaucaugguguuugaucacagcaauagaaaguaacugacacgccugccuugcagaaaaggccuggccugcaccuccucugacgccagcagugcuauggcagcacauacuuguaacccuucccugauggguaguagaaccaggaggaucgggaguucaaggucaucgguccugucucaaaacaagaagaaaccggccaguacuacagugaaugacagugcagucuagaauaggagcccagauguuuaagcagugcugaggacucugcagcaggaaugcacacacgcagaacggagcaugcugcacacaggaaaccagaccagggcucuuuuugaguaugcucagugcaauacagagggcucuggagaaacucugggcuuauuacacauucaccuuugaguuaauuuuuaguguuauguuuauaaaccuacuguuaccaaauguaucaaguuucaugaccauauccaguugcucaacccauaguuugagagugugugcccugcaccacuucuccagaccaucuccucucagaccugcaccaccucuccagaccacuuuuuuucaucuccccuuagguucgagcaucaaccaacaccacacagugcccugcugugccuccucccuuauacacugucuuaguucuaggaaccgaugguuuaaucgcagagcccauacaugagaacucugugcucuucagccugagaacuacgggagcccugacccacccccagaggauggaccuuguagacuuuacccuccaaguguuugagucccccaaggccucagcggagcaggggcccaacagagcuuuucacauuaaaaugaaagagaacuaaaggcccaagagagcaaaugacuuagguaggaaagagacaaagcugguucuagggcucaagucccaguucacagccuagagccacaaaaugacuucaugaaaacuaaaucugcccuccaucgcacguaaguccacacagcauggagaguuuccagaaaagaugcauaguacagccgacaucaggaacaucuggggaacugaaugccaguggccagagagcuaggagacuuucauuguuuacuuuaacucccuccuagacuguugcugaauuuuacuaugcuggucuuauuuuauuuauuuauguaaaaauaaaucuggcacagaaggaagagucgggucccaguccacacccaguccacaugcacaaagagaagccauaacuaagccuguucagguaugacuauaaacuaacaagaugcuguuuuaugugguuauggccacuggucucauuaauucagucacagugcaguuuauggcuugaggaaucuucucagaaaaagccuaauucaauuaagagcucucagcagcucccuguggaaguuaugguaucucacuuuuacucacacacagagggcagaccagacagacgcagauccucccagauacaccccacccagcccagcgcagaugcccuugcagagcaaagaaggcugugcccacaguggcacucagaugccgacaccaugcaugagugucacuuuccauuaacagcuagccugccaccuaggagcugggaacuucccuuccccuccucucugggcaaccugguuucuagucuaccccaaucucuguauggaccccuuuuccacauggaagucagguacgucuuccuuccuuccuuccuuccuuccuuccuuccuuccuuccuuccuuccuuccuuccuuccuuccuucccccauucauuccccaauauuuacagaggccuuuccuugugccagaagcaaacagauaagaaaguaaauacagaguauuacagcucauuuaaaaucuguccagcaagguuccuagcuuuuacugguaccauaucaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagacaagcgggaggggggacagagacaaagaaaggagguagaaugagagggcagggguggaagggauagcagaaggaagcaagcacacaggcccugccuuccaggggcucccaugcucgcccacauggacggacggggucagccucuaguacagcacguugcucugcuuucguucccuccaagguuccacucaggucccaccucaccuccucuaccacugcagcucucagggacugcccacucccucucaacuugcccucugccaagagucugcccagcccucagacacaucacaucuauuaugucuugucucaucucguccagcccugagcacacugcgagcgccugcugaacagggcccaguuuuacuuuuucuagugcauggaggagugcaagcuaagagccugcaggcagacuaccacggcugucucuccugccuccuuuucuucaggcuagccagcacaaaagacacagccuucccaagccuuacccugcaugcagcaaaggcuacacaaguggugcuggcuacugacuggguuugguaaacuucugggcucugucacacauaaagcugugaugucagacagacuccucucauuacagaagagccacucuaguuugagaggccugggaaggaacagaacuccucacccuagcccucagucagaacaccagaggacauguauuuacaggaauuugcugggaugaucuggggagcuccugcuuucugggaagcaguauuagaauucagagaucaguccagccugauaaccaaaaccaguccugcaugcuggaugggcuugggggaggaaaugaaaucagcaggauuccagagaagaggggcagcccacugauccaggccaaccuaaaacuuaguucaguuaaaauuagauuagcccauaagauuaaaaauacccacauauaaucacaggcugccuaaaguaucaguugauguuuauuggcaucuaaagagacgguuuggcccagugcggugugugcagacaaccuuggggagacucgucugacucagacauuugcagagggagcuagagccgcaggaggagcccacacggcgggcgggcgggcaggcgggcgggaugacucaggaguaacccgggcccugccugugcugagcgagacuucucugccuagaucagaagaaaagcagguggggggcugacaggagggaggagcccggcugcaggcugagugcaggcucuccccagagggcaucuggggccccuuugcccuaggucccagucauuccuggguguaugaaugcuaccucuuagauggcuauuucuucaccguggacccuggacugcgucaguuuucccuaaacccuuuuuuuaaaacugagcaagacagaagaauauucaaggcuuucaaggcuccaguucagaaugaugaugggaaaauggaaguucucaauugaaagggccuugaacaugacacuagaagaucacaggcuccaaaguuggccugaguuagguuuguuuaucaccgugcaagcaaagcacccaggaaucucucaacuaggaauuuaacaagaaacagcuagaaaauaaaaauaaaaaacccacuaauauaauuaaccaccagaucacacacaccaggggaugggcugagaggucugccuuaucuacagccacaaggucagagaagaccagagcugggggugggaggugggcaaggccccagguucaauccccacagcaaaagaagcagaacaccugagaucugaggucagcccuccucacucuccuugcuuccucggaguucccacugacaguugcuucucuccuuccccucuccucggguugggguggaggagagccucccacacgcugacaaaaagaacacuccuacuucauuucuaagguuugcugcuccacacacuaggaggugaggaggcaagccucccucugacuucacagccacaugggugcaugagaggaugcugagaaccuugcugagugaccagagcucuggccgcccagcuccuacagcccuccuuucccaugggagagacacugucccucuuaacaaccacccagguuaccgaugugggugcgucccaucauuuucucucucuuuuuuuuuucuuucuuuuuuuuuuaaagauuuauuuauugguuauauguaaguacacuguaguugucuucaaacacuccagaggagggagucagaucacauuacggacgguugugagccaccaugugguugcugggauuugaacuccggaccuucagaagagcaguccggugcucuuaccggcugagccaucucaccagcccauuuucucucuuaaagcaccacuuugaaucuuucuugagacaaagucuggcuguacuggaaguuacuauggagucaucugccugucucugccucccuccugauugcuggaguuaaaggccugcaagaccaccacugcuaccgcugccacugucaccaccgcccagcuggaucuuuacuaacauucaguauggcuggggguggagggauacaacuuuaacccaaguacucaggaggcagaggccacagaccacagaccucucugaggccagccagagcuacagagugaaacccccuguuaauuaagaacaaaaacaaagccacaaagcagugguggugcacaccuuuaaucgcagcacuugggaggcaggggcaggcggauuucugaguucgaggccagccuggucuacagagugaguuccaggacagccagggcuauacagagaaacccugucucaggaaaaaaaaauuuuuuuuuucaaaaaacaaaaaaacaaaaauaaaacaaaaaaagaaucacaguuugcuggccaggcaggaaagaagacagacagcaccauggcuagcaguccaagaauuguguccuuccccccaccucaggcagaucacaauccuacuuaguguucuuaagcuauaaaagaaaauaaaguuaaguauuguauaugcaagugaucuggaaacaaaccacagcacuacuaagaacuacuacuucugcuuccagagcuaaagaaaacucugccaccugcucccaucaccgaaaaugccucucagaggaugccacagggcccugaggacaaccaagagcaggcugguacauucuuccucaagggcaggaggucacagucacaaagcuagccaccccccucuggcuaaagaaaauccccuuucaauugucuugcucuuaaaggagagaagggaggucugucagacugcuaagagaggugccagguaggaaacuaccugagaacaaggaacaggcucaggcuaccacaggaucugugugcuuucacacaggcucagagacucuuaaggacaggcccaaagccaggcccaaaacaccuauagcucucucucagguaggcacgccccucggauggaguccuaguggacugcagaagcaggggggggcugggcaccacuccaagcagggcaaugagagagguaggcgaugcagcugcacccccucccccaggagacuaugccaagccgccaacagaagauaaagggcaauucaccaucgcaccgaagagaaccccugagccguuuccucaucuacgguacagagggagccuuuaucucacaagacuuugguggggauuaaaagauuacuuuuauaaagucccugacacugcgcuguagauacuggauaaaugguaauuauuauuagaacauacaccccaauaacagaagcgauggcauagggcaggcuagacagaaugcccaggcuguggacaaacaguauggggagaagggucaggagaggagagagcagcaggcugaagugugcuaagaaaagaacccuagaucuagaauaguccccaacgguccaauggcacuaucgggaaguugugggaauuugagaagccuaauaggucuuuaugucuaauggcauauccuugaagggaggacaguaccucacuacauacuucugccaucaggugucaccucaucgcuaggcaaacaacaggccauguaaucauggcccagagcccccaaaacugugaaccaaaauaaacguuucuccucaugcagugauuauauaugauauuucugguauaguaaccuagaugaguaacagagugggggaaagcuaaugaacucuaaaagccaccagugagccaggcacaugcacacacgcaugcacacgcacgcucgcgcgcgcgcacacacaaacacacacacacacacacacacacacacacacacacacacacacacacacccaucaaucucuaccucagacucagaagauggagauaguauccucacuucacuaacaaggcaaggcaaguccagagaaauguaccaaagggagcgucaaggacagagaccaagguguccaccagggcuuuccuuagagcugggcugcaugugccggacuaggcugccuggggcugagaggaaaggugaaccucaggugaggagcugaaucaaguccaggccauaugagcagcccaggccuccaaggccccugcacaacuggaagccccuaccgcaggccuucccacgugcuggcugacgucccugagagcaucccacagucaggcagcugguuuucccgggaggaaaagguauccuuuucuuuuuggaguggcaucugggauagagacagcuucaaggugaccuuuaagcuguuucuuuccuuuugagaaguagaaaagguagguuuggguccugcuuuaacagaccaccaggcagggucaugacugcuuacaugaagugggcagaaacaauauccuguaucucucugggcuguggugguccacaccuuugggaggcagaagcaaguggaucucugaguucaaggccagcccaguuuauaaagcgaguuccaggacagccagagcuacacagagaaacccuaucucaaaaaaauaaaaauaaaaauaaaaacaaacaaacaaacaaaaagccaacaacaacaauaaaaaacuaucuaucuaucccucuauaaacuaaacuuguucuagggaggaaauagcagcauauaccaaagaccaaaacugaaaugucauaagaucuaaagggacaaaagaagccuuuuuugucccuaaucaggagacaagaugaauaccugcuuuauaggaggcuucugggccuugccaggcauuccaggucaggaauaugggcaaacaccaggggugcugccaguggugagcugguuacaggcgcucucccugagugagaacaugcacugccugagagucaggugaacugggacaaagcagaauucaugcgagagccaaaccacaguacaggaaggaggcagagaauggcccaaccccaaaggguucaggacaacucucaauuauucauuuauucauacauuuauuuauuauuuacuuauuugagacagggccucguguaucucaggcuggccucaaacucacucuguaacugaggguggccagccuugagcuucugaucuuccugccucuaccucccaaguccuaagcuuacugacaucaaccguccuuuuuuuaugugguauauggaaucaaacccagggccucaugcauggugggcaagcacucuaccaacuaagcuacaugcccagcucugguucucucaauaauuuaagucccucuuaaacuacuaauucuccucccaccaagaagaggaaagaauccucgacuaaaagagagaaacagugucuggagaagggaggugauuugccugaggucaccuccccaguccagaggcaucaauuacucuagagcauuaacucuugcuuugucucucccaugucaaucuccacaagauccuccuuuggauuuuggcacacaacuaggaugggaaagaagacugcacacugcacucucuguucuuagcugaggaguaccgugcguggcaaggagcugccacagcagaagggaugggggcuccaccaaaccccuacccucucugggacaaugagaaaacagccaagacccugaaauaaagucucuagcucuuggacagcagacagugcagaguucacugccccagcccuccagccuguuaucaaggcaccaccccgaaucuuccgacaaccaccaaaaggaggcagcucaagagaaaagauaggauaggccacacagagaaacccugacacacacagacagacagacagacagaauaagucagauaaacagaucugaaaccuuaaggaaagacagacgguggaccagggcuaaggaauagugaauagcguagcgcuccaaucucagagaauauaggagguaggauucugccguagguggcggcuccucacccugcucucucaugugcagcaagccaacuuuaugcacuguaugcaucacacugcuagcacucacacacuuuugaaccuuguacuuugcgaauguccucuaccucugaacuacacaccagccugcacuucucauuuucugauaaagaggcucagagaaugugaaccgguggguggguggugcauucuacacagcgaccucacaucuaaccuuaacucaaaggcgcagguggagaguggaguuucauggcugccaucugcacagcgcuuugagguccuucguccccauucccucuacucuuuagccccagaacggccaggugccaaggcccccauuuucagaagcagaaaaaacgccuuuccaagccagacacacaggccuuugggauugcaugggggaucagauucagccuccccauuuuacagaaggaaaacugagguccgaguuucaaaagcuuaaccgggguuuccagaaucggagcaacaacagaaaugucagaccuggaaaggauccugaagaucagcaggcuaaggagacaugauuggucaaggucauggggggagggggggaggagaacucaguuuccugacugauauccuugccggcaccgucuaugguauccaguggcccagggucuguugacaaagcaggucagggccagccagcacacauuaggacaagagcuaucaggucugcaggaacaaaguugggacuucccagaguggggucuuucuggucaugcuaguguacugacuaacagcagacacaggucugcagugugugugccagcucccaggacugggacaccacggggcugagggagguguuaauuuacaggcagcacuuaugaagucucuccagucucucccucgccuccuacagacaaaugacauauuauggucacuucagggucuuacaacaaauacagacacacggugucaugagucaaucgauauagucaaauagcaauuccgaugcuuauuucacaagaaagaccuucaggaagacacucagcuguucaaggucaugcauuuagguuugaaucuguauccacgguuccccuugcucagaccuugauuuuuuuuucccccccaggaagcuggcugccaucaggguguaggugcugauggcccagcuccaugcccuaacucggccacuguaaccaccucagcaccaaagccccauaccaggaagccagcuccuggaucuaucaaaacagagguacugguuaguuccugcagcaugccacagggccagccucacaccaguuugguguccuugggaaaagaagcugcgagacuuccugcccagagucucuaacuccucaaaacccaaaucucaagcaaagagggaagcagagagagacccgguggcucccacuuucaguucgcugaaagugggcuggaaaacuuaagguagcuugaaaagcccccuagauaccaucuccaggaacuucugggcuaugcagccucgggagaaccccaccaaucacccagcagaacagggugcucaggcugggcaggaaccccaacccuuggagaaggaacagcauuuucaugucauucuuccaaaaagaauauuuuaaaaucucuuuagacccagcucuucucuaucucuuugccuucaaugggugguccccgucucuagucaguuggguacaaaccugaaccaaaccucaaccuccucuacuuucuugccauccccaaauggcuggcuguagccauuccuaugaacuggauaacgguuggcauuucuggacugggaccugacucaggggcuucugacuggccuuggcaggcaaagcugagagguaucacucuggggaugaagguaaauaagucucuggggaucccuguguucuaccacacaccuaagugccuuguaccuaguuccuuacucuacgcaaaauccuuagacaggccaaguccuaaaacacccuuucacaaagaauguaauaaauccguacugauuccuguugacaggacagaaagggccacuugcuaaaggauauuccugucuuacacauagcuaagcaccugccuccucucuaggucccaucccagcuguaggagaccagccaagccuuggcagcuuuucugaaaccaauaucagaagcaucccaucucgugcacgcuccugacccucccuccugcuacauaaugccagcucacaggccagagcuggaguuuaaggaccaacaaaaaggagggagaggcugcccgcccgcguugcagaagugguucauucagagccugagaagcagaaccugguaacaaguggggcaagaagcucaccuaucuggugguggcagcaacagcaccaucaugcacuuaccuaucuucaugaggcaggccaggagaauccagagggagaucucaaagggugugcgcacgugaggguagucaauguccaggacugggaaggccuuccgagauggcuuaccgccauguucaaugauuaaguuggucaaauuguggucaucugggcgauggagaggcucugauggugccguggugacauccccaauugagcguucccggggugguucagaaccucugauggugcuggcaguagggcugugcuggaggccguggcuccugagaacagguagcagucccaccaaggcaaccaccaccagcaaggaggggaagauccgagguggaugaaauccccagacgccggaccaccgaagcaucauacugaucccccagccuaggaggccucagcccuuagcgaagugcguguaagaccugggacauagguagcaaggaguccugcagauggggugagacuggggcaaucucuaggaaaaguucauguuuuagagaaguauuuucguuuucuagagauucacaaucucaaaguccaaacugcaaaaagggguuaaguaccuuggagggacuaaggaggaaaccgaaaggaucuagaacuucaggcugagagaaggaaaucggggaaacugcguccugaagagaggggaagggccggauaggcuggaccacgggcaagggaaaggaggaagaaggauaggaccuuuggcuaaggaaaaucaccagggugcuggaacucggcuaaaggggagggguaaggagccugggcuaaagacggaaaagggugagacccacuccgcagggaaaggcgagagaaggcuggaaggccagccugggauaaaggaguauagcaggaaaaaggcuggggcuuucccacccacaggagagccaggguccagccgcgccgggcugagauuccggggaaauggagggaggcggaagacagaggcagacggccuggcgggaaggugccucggcgcaggcuggaggcggcucgcagugagccagcagcaacacaccccuccuuaagaccccggugcagagcuguguuccaccccggcccagcggcagcuccuucggucagcuccagcuccacuuccagaccugacacagccccgggucccgcgguagcggacugaugccucgcugagcacagcgcagccauuuauaggcaccaacgaguagcaggcgcagcaagcuagagaga

SEQ ID NO: 2174 - RNA, 261 nt, Mus musculus
ccugcagaacccuaaugagcugagacuucuuuaucagaggcuguguugugcuucucgcuugccgcugugaucagaugacugggauaaacagacggaggaccgccgucagccugaggcuucacaaguucuguccaucaaggugcuggggguggaguggggagagauggagcaggauagcccaugccaugacagggaggagagagacaagcccucgcuagguuuuucucacuuauuccuuuuggacccucagccaaugggaug

SEQ ID NO: 2175 - RNA, 7401 nt, Mus musculus
cagacaaguuccggcggaauccggaagucggaacuuuucccuuccuugccggguaguuuguucguuuuucugcuugaguuuacuuggugaggcgcccgugggcugccagcuccacccauggcgggggccgccccgacuacggccuucgggcaggcagugaucgggcccccgggcucggggaagaccacguacugccugggcaugagugaguuccugcgcgcucuggggcggcgcguggcgguggugaaccuggaccccgcuaacgacggacugccuuacgagugugcgguggacgugggcgagcugguggggcugggcgacgugauggacgcgcugcgccuggggcccaacgguggccugcucuacugcauggaguaccuggaagccaaccuggacuggcugcgcgccaagcuggagccccugcgaggccacuacuuucucuucgacugccccggccagguggagcucugcacgcaccacaccgcccuacgcagcaucuucucccaaauggcccagugggaccucagggugugucucgggucgggcagaaggaaucccugagaccgggaggcggauaggugccacgcccccaaguuacauugggagauagcggcugaguuaaguuugaagcagaacuaaagccucugagauagaauuuuagcucggccccaacucauuucauggucuuggaaaguccuuucacucaguuuugucaucucuaaaaugaaugugacaguucccaauuuuaaaaacaguggaagugacuacacagaaaguggcuuagugauugguuaguugguguucagaagugugaugaaagaguagagagguaggugcagugugauuugaacccuuuguccacugcaggaacugugcaagagaccuuggaagagguguuggagauuagcucagugguagagaacuugucuaacaagcagaggccacagucccuggguuugguccccagaauaguaggaaggacaaaaugguaaaauugcccccuaucuucuuggaggaggacaugauguuauuaaauuuaaauuaaguugccuggcggugguggugcacgccuuuaaucccagcauuugggaggcagaggcaggcugauuucugaguucgaggccagccuggucuacagagugaguucuaggacagccaggacuacacggagaaacccugucuuggaaaaaaaaaauuaagaacaagaggcaggaaaauaucucaggccuguaaccccagcaaugugguguggaggcagaaagaguucugggccaucaagcccugucucaagcaggcacaugaacaggaaauagaacaguacuaaggaaggaauagaacaguacuaaggaaggaauaaaacaguacuaaggaaggaauagaacaguacuaaggaaggaauagaacaguacuaaggaaggaauagaacaguacuaaggaaggaauagaacaguacuaaggaaggguacacuggauccgugggcugccaggcucucgagggagaugugggcucagaaguguccucccucaccaggucagucuuccucucacccuguaccuucugcucacagcugacugcuguccaccuuguggauucucacuacugcacagacccagccaaguucaucuccguccuguguaccucccuggccaccaugcugcacguggaauugccccacaucaaccuccucuccaagauggaccuuauugaacacuaugggaagcuggguaagagacugccugcagcgcgaagggagcuaccucgcugccuuccugacuuuuggccauuauuuugugcgcugugcuagaugccacaguugauuuagagaugagagcuacagauggggcuuuaaaggauuuaaaacaggugguaguacaguggcuggcugaagggaguggaucacagcucacugcucugagccauggcacccugacuuuuggguaccuguucuggccuguacaguagaggcaaagugcuguccuaguuggggcuguuguaaucaaacuaccaucaacccagugccuaagacaacggacauuuauuccucauguucuagagagugggaagucuuaagaccugcauggguagaugcaaggucuggcuaguagguggccaccuuaccccugcauccucacauggcaaggggaguuggguagugucaugucgcaauggccagcauaucuuucugccagaucauuucucugcugugcuaguagcaugggcucuuuaaacuccgaagucauaaaggaacagagggaaggaagcugaugucuagcaggugagcagagggggaggcugggaaaugacguggaaguggccuugccuggugaggacauggaaggaugccagccacaucagucagcucaucuucgagggcagcugaccacggagcccaguggcugucagggcacucuuccucuuuauuaggaaacugugcauggagcaaaagccugcuguuagagcaucugcucugguccugcucuaaggaacuggcccaggaagggaaggugccuuacccaggaggccuugcugcuggacugaagagcgauucaguuugaccagcguuuccuaaguccuuccagugugugugcuaaggcccugggcucugaccaagcuucaggaagcagggacuaagcauaguucucaguaccuguuugacacugguguggacaaccauugacugacuguuucuguguacaaggcaagaugauggguuuacaagcuguaguccucacaacagucccaaaaggugugguggugcaugucucuaaucccagcacgugggagaggaaggcaggaggauugcuuucaaagccagcuuguuaugugauacacagaggccaaaaaaggaagcuggucucccugaagcugcaguacaggcaguuaguugucagccaccauggagauacuggggccugaacucagguccucugaaggguggcaagcgcccuuaaccucucaggcugcccauuugaauuaaauguguucauuugugggggacacgugcuuguguggagccgauuuucuccuucucuuguccuagagauuggccucaggaauggcuccaguugucagugugcgugggcagucucggacacucauuuuaauuagggucucacuaaaucgccuagacugaccuuaaauuuacuauguaguccaggguagccuugaacuuucuuucuuuuuuuuuuuuuaaagacuuauuuauuuaucauauguaaguacacuguagcugucuucagacacuccagaagagggcgucagaucucauuacggaugguugugagccaccaugugguugcugggauuugaacucgggaccuuuggaagagcaguugggugcucuuaaccacugagccaucucaccagcccagccuugaacuuucaacccugcugacuuggcugcuuauauaccugggauuaccagccugugccauuggguuuuuuguucuuguuuguuuugagacaggguuucucuguguagccccugacugcccuggaacuugcuuuguagucccagcuggcuucaaauuuaagagaucugcuugcuucugcuucccaggugcugggacuaaaggccugagccaacagugcccuucagcauuucucuucuuaguuacaucaguucacugcgguucacggcagcagcaggugucuuagugaaugugaauaaugggggaucaggagucagcgugcagcugugcccuuacccucagcacacaggagcugugagagccagccugggcagcucacacgguggcagacuagccagagcggaggugugaaacgcugucucagcgaaauaacgacaaagagacaaagaagacacagccccagacuuugggucucucuucucucauagugccguaguccagcaccgcauguagccaggcuagcacuccacugccugcuuuguucaaaagucaacuggguaugacccccacccucacccccaagcgcugaggacugaacccagggcuuuaccacugaagucaauccccagcccugguugugguuuuuaaucccccuuaggguguuaggaacggaacccagggccuugcaaaugcuaaacaugucuaucacugagcuacacccuccgcugcugcagcccugaggccucccgccuagugucagcagcaucugacuccaucucuccucagccuucaaccuggacuacuacacggagguccuggaccuuuccuaccugcuugagcaccuggcgucugacccuuucuuccggcgcuaccgacagcucaaugagaagcuggugcagcugguggaagacuacagccuggucuccuucaucccccugaacauccagguaguggccagugagagagcucuucccugugcugcagcucugacaugccacgggcauagagagauuugagguccugggucuguccuugacuugcuuucaggcccaggagcagacuucauucaguccugcugauucggagccaccaggccucugcuuguguuuccucccaugugugaaugagcauaagugaguccagagagucaccaacaggugacccacgaccaagggguccguuuagcugaguggcuguguugaguuugcagaguggccuguggccucugugucucucauccuuuuaaaguggagguaacccaggagacacuguggucuuagauuccuuccugcaguggagaccugagccagcuuccccucuaacucagugauucucaccuuggagguugugacccuuuugagggucacauaacagauaccuuccauuuuacauuuuuuuuuuuuacauuaugguucauaacaguagcgacauuacaguuaugaaguagcaagaaaauaauuuuauggcuggcggucagcacagccugagggacuggauugaagguugaaguguuaggaagguggaggacacugcucugacagcacacuuggcuccugcggugugacaagagugugcaugcagcccucacugccgggugccuucccggccagcacugugccgagggcugagcgcauuauguugggcuguauguuucauugagauauauggacuguucugacugucgucugugcacgaggaaaccguuagaggacaaaugacgccgguaugcucacugucaguaguucuguccagacacuggggggacgcugaucuucacugacuucuggcccaggaagagaagagugagacaguuuucuaggaugguagggaggcucccacaggagaaggcccuaggcagggacugcacaggggaccugaccuucuaaucuaaucugggcaguuguccgccuagccaggccccugaggaauggagggcuguccugggccaaggaaaguucguauguguccuaggaguuagacgaggccaguuagcuguggucucagcucuccacagcugacucacucacugaguucucuucucugcucugcucaggacaaggacagcauccagcgagucuuacaggcuguggauaaagcuaauggcuacuguuuugggguucaagagcagcgaagccuggaagccaugauguccgcugcaaugggagcugauuuucacuucuccucguauccuuagggaccaugggaaaggacgaauggaagggccccagacgcagaagccuggaaaggaaauggcguugggcugugggagaaaugcaaggacuucaguuugcuuucuguauuacauuuaaaggaagaagaggugcuggagggagggggcguggcuggcaguggaucacugggguguagcccaggaugggguguagcccaggauagaacccacgccuucugccauuagugcaaggguaaggauuuauuuaguuuaguguuuugagacagggucucucuagccuuagcuggccuacaucggccuguguagugcaggcuagccucaaucuugaucuuccucccuggguuucugagagcuacugcacauuuuaggaaccacccuguaaauguggcaaaugcacuugguggguguaauuaggaguagcagaguucuuaagagucuugcuagauaagguguguguggugggggggcacgaaauggagcugggugugagguuucgugccuguaaaccagcaguugagaaacaggaagaucaccaaaagcuugaggcuagccugggcuacaaaguaagagccugucucaaaaaaugacaaaggagaauagggaaaggaguauugguugaaaaauauggaagagguuauuaaaacaguuagugacagagcugucagggaguggagaagagacaggucuacccuauagaagggacaagcuggcagagggcaccacuggaaaccagagcagcugggccuuugggguugggauuugaccaguuugcguguuccuugggucagaggcugucggagaggcugaaggaaaggcuugcccuuuaggucgcuugucuuggagacagagcauuugcccagguugccggaggugggaauuuagauaucugugucaggcccuugaggacacgugucuggaauaguggcaguagaacacgaggucccucgugggacugccaaggcgagggcucgugugucaccaguguuagcagugucccaucuguguccugucuggaagggaaaagacccuauggcccaagaagacuagagccuuugccuugguagaaagaaugagaugacaauagguacugagcaccugugugccagcugucaggggucggggagggacucugucuacuugugaucuugcagaagagaaaaagggagugauggggacaggauuuggacacccuggccuggcucuugagcaucugccacaccaacuggagggccagugcucccugguccuuuguggggaagaaacuggagccccaagggagggcugcaaugggcggcucauacccaccugugggggguggggcagaagagaugugugugggugguggucuugagaagagggcagcuccugcccaggccaguccccccaucuucugccgugucuaagccuuaaccuccccucagcacucugggcauccaggagaaguacuuagcacccucggagcagaccgcagagcaggaagccaugcagcugugacacaugggccuggagagccggggacaccucagcgagguacggacccaaaaaccacguccagccagagcagaggcugggaggaaaccuccaucccugcaaaggacuucuagagaagaagccacgcauagcacccuuuguggugccgacaagcucaagccccaggaggacuggcucuacaugggcugcaguggaugggcaugcuacgauaggagaugagucucuauuuuuuugugaccuuaaaccuuucuucaacccucuggacccagggauuuggagaacaaagaaaugucuuuaauuaacguuuuaauuaaauuuaauuuaauuaauguuuuuaaauaacguuu

SEQ ID NO: 2176 - RNA, 1833 nt, Mus musculus
gaggagcagcuacgccugagugagcuccacaugcagaugagaaggcaggucuagagagggccagccauuugcccaaagccccacagugccuucuuucucaucucucccaucccaacaccacugcaguaaacacugugcggaugccucuccacucauccuagccucugagaguccacugucccagcacgugaagugccgacggcacaauacacuccaaaacccagcuauucuuuuguuagcguuuuccuaaauuugucaugugucaaaauuuaauuuuuacaauuauucuguaagacuauguuauuccuaucuauguucagugcagucauuccucagugacccaaagaacuguccccagggucuaggaagggaaccccagguacaaaaauacaaaugacauagguuuuguaaauaaccuauguaagaaacccucuugcaccuuugaaacacgucuauaauccauaauguguaagugguauauaaacaguuguacuguguuauuuaggaaguaauggaaaaggucuaauauacucauucagucuaagcuccaccccacaguuaccuggcaacagcaggugccugacucacuguaacaggggcugcucugcucucucuagcucuugccuucuugcuccuacucugucggcucgcccccuucccuccucccuuccuccucgugcucauggggcuggccucuacucuucucucucagucucucuuucucugucucuaccacccucucagcuucccuugccaugcccugaauaaucucuauucuauacuauguguggcuggucccucagggggcagggaugacucagcaugggccagcugaggcacccccuccccucuuaccugacuacaccucugcaaaacauguuccuccuuucuuuaucuuuuuuuuauaaaacacaacacucaguacugaucaauuucuuuuuuuucaaguguuucuuuucuuucuuucuuucuuucuuuuuuuuuuuuuuuuuuuuuuuuuugagacagucucacuauguaagccuggcuauccagguacuugcuagauagaccgggcuggcauagacuuaacagaaauaugccugccucuaucuuccaaguucugagacuaaaaaccuaccccauucaacgaucucugauguguacggugguguacaugcauguaugaucucaaccuggaggauggacaguucugggccagucugggggauguagaguucaaggucaauaagaacuauuaugagaugucucaaaauauccagaaguaacauuuaccuucccauaagggauggcugaguuuauggauaagaacuccguaggcacggggacagaugagagaagucaggcugaguucagugagcucacacagcuuuaguguacaguggguuggcucuggagccagaucuuagaguaauuccuuggcucccuucaagcugagcgcucuucccugauucucuucccaucugcuguagucacucucuggcuggggauguagcucaccaguacagcacagcgccuaccuagcuggccugacagguuugcccccagugcugccaaugcuaacuagggcauggggggagauaauauacucacucgcugcuuucaacucuuugaagauguguuuauucuuauguauauauguaucugagugaguguaugccauguguguucaggagcccaaggaagcuaaaaagaaugucagagucccugggguuggaguuaccagaggucuuaagcugcccaacaagggugcuuggaaccacauagaccacuggaagagcaguaaacacuuuuuguuguuuauaaaaagauaaagagggaauugguggaagu

SEQ ID NO: 2177 - RNA, 1833 nt, Mus musculus
acuuccaccaauucccucuuuaucuuuuuauaaacaacaaaaaguguuuacugcucuuccaguggucuaugugguuccaagcacccuuguugggcagcuuaagaccucugguaacuccaaccccagggacucugacauucuuuuuagcuuccuugggcuccugaacacacauggcauacacucacucagauacauauauacauaagaauaaacacaucuucaaagaguugaaagcagcgagugaguauauuaucuccccccaugcccuaguuagcauuggcagcacugggggcaaaccugucaggccagcuagguaggcgcugugcuguacuggugagcuacauccccagccagagagugacuacagcagaugggaagagaaucagggaagagcgcucagcuugaagggagccaaggaauuacucuaagaucuggcuccagagccaacccacuguacacuaaagcugugugagcucacugaacucagccugacuucucucaucuguccccgugccuacggaguucuuauccauaaacucagccaucccuuaugggaagguaaauguuacuucuggauauuuugagacaucucauaauaguucuuauugaccuugaacucuacaucccccagacuggcccagaacuguccauccuccagguugagaucauacaugcauguacaccaccguacacaucagagaucguugaaugggguagguuuuuagucucagaacuuggaagauagaggcaggcauauuucuguuaagucuaugccagcccggucuaucuagcaaguaccuggauagccaggcuuacauagugagacugucucaaaaaaaaaaaaaaaaaaaaaaaaaagaaagaaagaaagaaagaaaagaaacacuugaaaaaaaagaaauugaucaguacugaguguuguguuuuauaaaaaaaagauaaagaaaggaggaacauguuuugcagagguguagucagguaagaggggagggggugccucagcuggcccaugcugagucaucccugcccccugagggaccagccacacauaguauagaauagagauuauucagggcauggcaagggaagcugagagggugguagagacagagaaagagagacugagagagaagaguagaggccagccccaugagcacgaggaggaagggaggagggaagggggcgagccgacagaguaggagcaagaaggcaagagcuagagagagcagagcagccccuguuacagugagucaggcaccugcuguugccagguaacugugggguggagcuuagacugaaugaguauauuagaccuuuuccauuacuuccuaaauaacacaguacaacuguuuauauaccacuuacacauuauggauuauagacguguuucaaaggugcaagaggguuucuuacauagguuauuuacaaaaccuaugucauuuguauuuuuguaccugggguucccuuccuagacccuggggacaguucuuugggucacugaggaaugacugcacugaacauagauaggaauaacauagucuuacagaauaauuguaaaaauuaaauuuugacacaugacaaauuuaggaaaacgcuaacaaaagaauagcuggguuuuggaguguauugugccgucggcacuucacgugcugggacaguggacucucagaggcuaggaugaguggagaggcauccgcacaguguuuacugcagugguguugggaugggagagaugagaaagaaggcacuguggggcuuugggcaaauggcuggcccucucuagaccugccuucucaucugcauguggagcucacucaggcguagcugcuccuc

SEQ ID NO: 2178 - RNA, 893 nt, Mus musculus
uauguccucccccaagccgcguuccgacacauggcacgacuggagcccauuuccgagauacccuagggccagcaucgagcacccaaacccaccaagccacguggugcccuguaaaucagccccgugcucgcuuggcuuccgcguggcuacugcucccaucaccccgcgcgcuccccagauuaugaccccgccccugagggggcguuccaaccugaagccccgcccacacacgugcgugcgcgugcucccugggccuccugggacuggcgauagccaaagcuggucccugggaagcuugggucuggugucggccucggugagggcugugauggucgggucagagccguacaugagcugggcgguccugggagaggcugucgugugucguggacgacgucagaucagacgcuuggaggggagccugugggagcuuccaguuucgggcccagaggacccagugcggucacuggcucccacgcacgcgcggagcucagcucugcgucgcccccgugcggacagaggaagcagugccugccuggcacccgaggacuccucugggcugcaugcgacccaggcacgcguggccaccuaggcgaucuacucuccagacaccgcccccuuccguugauggaccggaggacggucugauguugucauggcgacggcugaccagugauuuccucuagcuacugugaaucuuacucuggacagagagagcacuggaguacgguuacccagccuccuugcuguguccucagucaguaaucuaaauagaugagaauugaucccucccuaaagcagcaaggccuugaacaacaaagcaaccuuuccuaaaagccugcuuaccuagugaaaucaaagaucagugauaauaaaaguauucuuauucccag

SEQ ID NO: 2179 - RNA, 893 nt, Mus musculus
cugggaauaagaauacuuuuauuaucacugaucuuugauuucacuagguaagcaggcuuuuaggaaagguugcuuuguuguucaaggccuugcugcuuuagggagggaucaauucucaucuauuuagauuacugacugaggacacagcaaggaggcuggguaaccguacuccagugcucucucuguccagaguaagauucacaguagcuagaggaaaucacuggucagccgucgccaugacaacaucagaccguccuccgguccaucaacggaagggggcggugucuggagaguagaucgccuagguggccacgcgugccugggucgcaugcagcccagaggaguccucgggugccaggcaggcacugcuuccucuguccgcacgggggcgacgcagagcugagcuccgcgcgugcgugggagccagugaccgcacuggguccucugggcccgaaacuggaagcucccacaggcuccccuccaagcgucugaucugacgucguccacgacacacgacagccucucccaggaccgcccagcucauguacggcucugacccgaccaucacagcccucaccgaggccgacaccagacccaagcuucccagggaccagcuuuggcuaucgccagucccaggaggcccagggagcacgcgcacgcacgugugugggcggggcuucagguuggaacgcccccucaggggcggggucauaaucuggggagcgcgcggggugaugggagcaguagccacgcggaagccaagcgagcacggggcugauuuacagggcaccacguggcuugguggguuugggugcucgaugcuggcccuaggguaucucggaaaugggcuccagucgugccaugugucggaacgcggcuugggggaggacaua

SEQ ID NO: 2180 - RNA, 2768 nt, Mus musculus
uuuuuuuuuuuaagaacuuggaccuaagaacgcaggaaagaugcaaagcaggaaaguauugauguuucagcaccagggacagagcuacgggcgcucucagcacccuggacagagcaagugaucaugccugcaugccugcgggggaaacccaaccuuguuggaggcugaccaagagaagccuggacguucaccucgucuuucuucuucccuucagaagaccucaaccaccaacguaugaaccucaagagcaacuguauaaggaacagauauuguuaacgggagcggguuguauaaauaaaaugacuuugguugauacacucggacaacuccaaaaagaucuaacagucccuagcugggaauaggacacucuuaaugauacuuaaaaauuacagcuuaguagcacaaggcuugccauagucuuuuucaucccucaaaguccuaucucauacuuuuuaugcgcaugcaaacauucguagaaaagagaacaacaguauuccucacagucaucuccuauuccaucguccauuucucuacaccaucaucuuuuuucugucuuagauacgcacuugcuuaugagcgugcauguauguauguaugcacaacugcagcgugugaaccacaagagauucuacacacuuguggagaagacugaauucaggauaagcugaugccccugaaagcaggcucugucccuuuaaauggguuguagcugugggggaggggaacugaccggagcuggcauuguccaguuugaacugagcaccggaagugaaggggcagggccagggccgugcacugagccccgggccauuguccaucucugaccagggcaguggccaccccucugguccacccucuuuaucuucuaguagggaguuuaccucuuuaaaugagaagccucucucuauccagucuuuucaccagucauacuacccgaaggguagcucaauuuaggauggugacugagaacaggagggucugggaauuagagugucccgggucuuggaggaagugccuccacccaccaaucuauucucuuccaccaacggaugggacaggacgggacgcggcaggcaggggcccgaugagaacacagcuaccacagagggcauucuucgagguuuccacaugcucucucagggagcuguaccuggaagcaacuuuagguguaggcuuaggagggagcgaaggacucuuugcacagaaucaacuaggagcuuguuucucacugggacaaacccagagaaacuguuguugaaauuuggagauugaggcauccaguagcacccagagacaggccgaguuugagaggcagcaccuagguuaagacagaucagcucgguggggucuccagccgcuuccuugcaccccuaucccggcuuccuaauguccagaacuccaggucuaucuaagcacacggagguggggggugagagcaggucagcgccaagcagccgggucagcucugaggccugaggggaaagagggggaggggcgcugaggggcugggggagggggagggcucauccauuucucccuugacaggugguuuguguuucugauuggacagcgccaccaggcucacaccucccucccccaacucucuggaauguauaauuaucugcccggggggugggggugguguguguguguguguguguguguguguguguguguguguguguguguguguguggucacgugguuauaaaacuaccccccccccguucccccccaccuguguccgcuuuggaugcccgcauugaguccucaaagugcaggaucccaaauucugggguacugaagacuuccagugcaaaagauccccaucuccagauguguguauguggagggggugucaaaucucaagguucugggaagggacaccccagaggugucagagaccagagcagugggggagggccgaagccagagccagagggaaagggagggguaaggagagaggggaggggagggggcugcccgcgggggguugggucauugucuuuuagaauuugggagccuuugaaaagccgugggcccucccaccgcuauugugcgggggaagauguagcagccucuucuccgaaccaccccuuugccuccggacuucucuggggccagcagccgcccgaccuggggcccggggccacgggcucagcagacgaccaugggcucgguguccaaccagcaguuugcagguucgagcuugcgauucagcgggcacaccuuagggugcagggagcccaaugucuaaauagaagggaggugggaaagugucccacggacuuguccgcgggacccccaagucccuauggccuccugcuucugggggccaucucuggacuagggaacccugguguuccaguggcuuguacaccgagcccgugggggcggagggagagaagaggaggggccugucccuccgcgugugcacgggcaacuuguugugggaagacaagcaaaacuuuuggggcgucagcauccucuguguaagcuuggggaggcagccaggacagguuucuucuuaccagcugcuugguagcugccuccuccugggugucuauccgcgggcugaccaccgagaucucccagacgggucccugagagggccugcgaucccuuggcccccagcugaucaccuggcccucccuaucuccagguggcugcgccaaggcagcggagaaggcgccagaggaggcgccgccugacgcggcccgagcggcagacgagccgcagcugcugcacggggccggcaucuguaagug

SEQ ID NO: 2181 - RNA, 12627 nt, Mus musculus
cggcugcacggagaucugguaggcucuucacagccuucgugucaaaacuucccuuggccuuuacccuugccccucgccucuuuuuucacucuaaccucgucaccucucugucuuccagauucagcuuuucucaggccccaacuuucugggcgaccacauuuccuuugaggaugaccaagccucucugccugcuuccuuccauccccagucaugccggguccacgguggcaggugagcagguggauuggguagagcccagagugcugggagaggcaaggggagaaaggagucaggucaggcagcucacagccauccuaauucuaguuccagcuacucccuagaagucuagcuacucccuagaagucuagcuacucccuagaagucuacaggagcaguuuaccuucuuaccacugcauuggccauacguccauacaggcuagacacucauacaaauaaaauaaguuguuuuguuuaaaucuaaagaguagccaggcagugguggcacacauuuaaucccagcacucgggaggcaguggcaggugguucucugugagucuaaggcuagccuagucuacaaaaugaguucccagacagccagggccacacagaaagaaacccuguuucgaacuuuuagagcaggugccuguguuacaggaaagcuuuggggauguuuggagggggggagggggagccauagaaaggcucuccacacccacauaggcacaggucaguggcauaguuacauacauagacccuguccauguccagcggauuagcugcugcucucgggacccagugaaggucacaaauggccuugcuugacuugaccccguucuguccacgaaucuuccuccccuccuuguuugcuacuauauguuuguuugaaggaacguaaccaucuuacucauaugcuucccaucuucucucucucucuuucucucucuaucucucucuuuuuccacaacuggcagcuaaauugagggauaaguugucugauuuuuguuggcaagucuguguaaugaugacauaaacuugcuauugcauaggugugagacccaugagucuugccuuuccuuuuaccagaggguaauuaccaaauuuauuccuucuucuuuaauuaaaacauuuauuuauaugcauauguguccauggguaucuguggagauauaaggacaucagaucuccuggaauaggguuuacaggugguugguuguaagcugccugagacggguccugggaacugaacaugggcccucgguaagggcaguaugcacuuugaacugcugagccuguaccaggaaagcaaaauuuuuugagauagcaucucaccauguagaccaggcuggcuuugaucccguggagauccaccuaccuucgucuccuuggguguguuacuaugcccaauaauacuauuuaaauacaaaguguuugugagacagggccucacuguggagaucugaacuagcaacagagaccguugugugccugguauguucaauccguguagucacucuuccugggcaugcucagaucgcuccaccuuuggagcacagucucuuaguccuuuugacauggccccguagucuggggaacauccuuguuucaggggcacaacaugaugcccccuccccuaaaacaauuauguaugugucuugcccaaaucuagaaucaagaauuuccuaaggaacuccaguucccuuuauaggagaugguaauuagcaccccacaucugcauacuaaguguuucaaaauuauaauuauauuauuaauuauauuguauugcuccccaggguguugaucuuagguccgauucuuccucucagccccaugcuuccagaaauaagacucagacucaagauauauuuacaaauaccguggccauauagcuagguucuucucuuacuagaucauaacuaaaauacccuaucuauauuaaucuauauucuccucacgucuucccuggugaaucuucccgugccucguucuaucccagaauuccuuugccucccagaugccccgccuucuauuuucuauuuauucuuuuuuuuuuuuuuuuuuuuuuauuuauuauauguaaguacacuguaguugucuucagauacaccggaagagggcaccagaucucauuacgggugguugugagccaccaugugguugcugggauuugaacuucggaccuucggaagagcagucgggugcccuuacccacugagccaucucaccagccccuucuauuuauucuugacaggugucacauccauacaaacauaagauauucucucuacaccagaguggagccauugaaagcugugaggucuuucuguuucuuuuugcccucaggacauucucuugcaucugcauaguugguaauagucaauaacuaccuuuuaaagaaaauaggcugagguagcaggaucaugcauaauuugaggccacccugaggcucuaagucccuaucucaaaaaagcaaaaauaaacaaagccuggcacacaacuuuaaucccagcacuuggagaguagaaacaagagcguaggcucauucuugccuggguugugaguuugaagcgagccugaaacacaugggaaaaagaaaaucugagagaaauuuaaaaucaucuuuuugaggaagauguacuuauuuuuguuuuguguguucgauuguuuuaccuaucuguaugcauguucguguauguguaccaugugcaugcaguuucugggcagaccagaagagggcgucagaugucuggaguuggaguuacaggcaguagugagcccccauguggaugcugacaaccaaacccagguccucugcaagagcagucagugcuuuaaaccucugagccaucucucuggcccuggaaauacucauguuugucugugauuauguuauaaacuugcuguauagugagauuaauuuaauguguuuucaacuuuuaggaacacauuaucuaugcuuauguaucuguuuguaaggaaaagggcugauccucccggccucgcaugcacucagcaagcaucuacuagugagcucugcacccaaguccuaaucuccauuuuuuuggagggggguauagucuuuaagauuauaaauuuaggccaggcaugguggcacacgccuuuaaucccaguacucgggaggcagaggcaggcggauuucugaguuggaggccagccuggucuacagaguaagauccaggacagccagggcuacacagagaaacucuaucuugaaaaacaaaaacaaaacaaaaccaaaaaaaaaaauuauaaauuuaggggcagguggaucuuugugaguuugaggccagucugaucuacaaagcgaguccaggacagccagggcucuguucuacagaaaaacccugucucauaaaacaaaaagaaaaaagauuacaaauuuauacaaauaagcaggcaugguagugcacaccuuuaauuccaccacucacaaaggcacaaucacugugaguucgaggccagccugucuacaaagugaguucuaggacagccagagcuacacauagugagguccugucuaaaucaaccaaucaaauaaucaauuuaugcaaauaaccugaacaauucagugugcagagagauacaggaggaggaagggcugggaaggaggugugccaauuggucugaggcagauggacaacacacacaagcucacaccuggccaggaacuuaguagguuuuuguuuuguuuuguuuguuuguuuuuaagauuuauuuauuuauuauaacacuguagcugucuucagucauaccagaagagggcaucagaucccauuacagaugguugugagccaccaugugguugcugagauuugaacucaggaccuuuggaagaggagucagugcucuuaaccacugagccaucucuccagcccugaacuuaguaguucuaaugauagaagcuguuucuacaggcuccuguuguaacuuagcuucaucuaacaagauaaacugugacuuaaauagcagaaaauaaucuuuucaugguuuucccuccugcauccucccuuacggcagaaagcagagcucuggucucuucugguuuuugagucuggugcuuuagagccuuucccauccagacacccaucuuccuguuccauuuucuuuuuuggcagggguggguucaugacaggguuucucuuguguagcccuggcuagcugucuucgaacucagagauccaccugucccugcccugcuccugccccugucuucguagugccaggacuaaaggcgugcgugcuccaucacugcucagcccucuuccuguucuuagaaggacacucaucccaacuuagggacucaacuucccaaucuucuaaacugaagguaccccuggaaggccacauaugggagacagaaguugagccucucccuccaccauauccgugguagcaguugaguucagguguccaugucagcagugaguaccuuuacccacagagcugucucacuagcuuugacucuucuuugagacagggucuuacuaaguugccuaggcuggucuugaacuuguaugauccucugcuucagccucccaaguagccagcaggcccaaugcugguggacacugggguuucuaccgugcuuugcaauagcagugcugaaggguuagacuucugacuguguuguuuuguguguuugaagagugcccucguuuagagcacuggcaggcugccugccugcagagcaccauguuccucuucaaagggcuagcuucaaacucaccaagcucugucucccucugcuuccgugaaugcuuggauugaagaaggggcaccacugugcccacgccuuuacuuuuauuccuucuuuucuuucuuucacccuugcuccacucaaguccuuuuuuaugucugaccuuggucccugcugcuguaucgucuguccaccaugaaccucuccuugauuagacgaagacccaaguucacaggcagugugcacucaggguaccugguagguguagcauaagcuaagcucugaugucaccuuucccugucuguccccuuccagcugggucuuguuugaggacaagaacuuugaggcagaccagcacauugugucagagggcgaguuccccacucucacggccaugggcugccuggccuccacgguccugggcucucuccggaagguuccgcuggugaguuccccauccagaugacagagguagagggaguguccugucucaccugccaccuaguggccuggaugagcaauggcuucccgagucucucagugugcccuugauucugaggccccugaggcagcucaacugaccaaguguuuuuugaacauucacugaaauaguuccuggagacaccagacuuagauagcgagaccuaaaggugacagugcagaggggugugucacacugggaugggaccaacugacugacacgcagacuggcugagaggcagggccagcuuuugcccaggugauggcccauucagagagggcugugcaggagagaccagaagggcaaggcagggagaggcuaccucagugacccacaauggagguaauaugcuguucccgggaagagacugacagaagccgcaugcacacugcgaugaugcuguggggaccaggagagugacugagcacugcugagucagaacagcugacaucugcugagcggcccuuuucaaaguuugugaguccccgagccacucugacuuguuccgggccacacagcuagaaacagagcagaaguucucccgggcugccugguuauccagcuuguaccccauaccagcacauacccugggcacuagggaucauuagaccugggucuggagcccagguguugggcuucaagucauuggucuugccuucuucagccucagugccuucucugcuaaauggagaccaugauaguaucuaucucagaaagggauuggacaaauuguucucccuaggaucuggccugcaacaagccauggauaaagaagagcaguuauuaaucucugugaugauuaguuaccaucccugagaaaugaacaagagaugauacagaaugagccccaaguuuccagccuacccauuaguucucaggaguuccgacucucugauagagaccuguaaucccaggacucuggaagcuaaggccugcgcuauguagcgaggggaugguugaguuugagguggugccagucugucaacacauugagacugaaaaucuggggacacagauaacagucaguguccucagaagggaagaggcccucagauccaagacacggaucuuggggucacagggcagagucuggacuuggguuauuucgcggccucauccgucucuccuucuuuaaccccagcacuuuucagagccuucccugucccucuuuggccucgaguguuucgagggaaaggagaucgagcugacuggggaggugcgaagccugcaagccgagggcuucaacaaccacgugcugucugugcgcgucaaaggcggcgugugagugugugcuccaaacuguguugggugauuggugggauggggaccccaccccaggccaugaaggagggaguaguaggccugaaggccucuggcucgggugggggggugcggggaggggaggggugguggagguggggcucaguuguaugcugaguucuaaaaaccccaaauggacuugcuagccucuuccucccgcugagggcccucacccagugugagagaagagggggcagagguuguucuaacauguguacuuuguccucuuguccuccaccugucucugucugugucugucugucuguguuccucuguguugcuggcaccugcugggcacagcuggguagugugugagcacagcgacuuccggggccgccaguggcuagugggcagcugugagaucaccaacuggcugaccuacagcgguacccagagggugggcucccucuacccuaucaaacagguagguagcagccagcuugagcgccucggugggugugccuguccacacauacgccugccuguguuucccaaguuugcuguuggugucaggucacauggugaccggugaccucauucucuucuugccuugccaccucaguccuuuuucucucaaucaacuugaaaacaaagcagcuuuaccuguccuaaaggacaauacaauaaauauaauaagcuuauucacccaaaacugcaaaucaucucauggacggaguuugcaugcaagagugcauugucuauaucugcuugucuauacguuggcuucaguucugcacacauauauuucuuuuuuuuuuucuuuuugguuuuuugagacaggguuucucucuguagcccuggcuguccuggaacucacucuguagaccaggcuggccucgaacucagaaaucugccugccucugccucccaagugcuaggauuaaaggcaugugccaccacgcccggccacacauauauuucuaagcuauggcuguggccugugugugugugugcaugcauguaaggaguauguauacacacacacaugugcccuucuaagagucugucuguacguaagcuauuuggggucuggaggacaugggugucugugugccuguccaugccugugccccagagaguucugagcuguguaugagggcauguguuuagucucauuguucacagacucucauggcaacauugucggaagaaauccuggcaaauaccuuaaacucucauauggggagauaaagacccaggggaguggacaaggaguuucuccgcaaaguugggcaagcacuguuugucuauggaucuugguguguguguguguguguguguguguguguguguguguguguguguguccgguaguauaacccuggcuagccuggaacucucuguguagaccaggcuggccucaagcauccaucucccucugccuccugaguucugggauucgacgugugggccaucuugcccagguguuuccucaucuauaaaauggggauaacauuugugguccugcauuuguugaagacugaaaauugauaaugacugcagaaccauugggcagugcucuagugggaaacauggcucagaucgaacuuagggcuaacaucauccuuucugcuacugucaccacaaacaaagacccugcuaauccagagccacuucugaucucuggacaccuuuagcuuuagcauguauguaugcaugcauuuucuuucugugugugugugugcgcgugugucucuguguauaugugugugugugugcaugcgugaguguguguacaucuguaguuuuauaaucagcuguaccuguaguaagcauaagucgcuggcacagaacgggcugggaggagcugugugucaguugugaugugaaugugauggcugcauagaccuguggaaucguuugugccuucuauaaacugccaccuuguggacugaggguauaccugccagggucccuuaacacaggugcagguaucuauaguuacugagcuaugcauauaguauggguguauaaaaaagaugugacuuugucaguggggacauuuggaggcaggggagauuuaggagugugggucccucgagggucccuaguugagggugguagggcaucccugacagcaacgucucagccucuucucaccaucagcgccgagccuauuuucgccuguggaaugcggcacuagggggauuccugucagugccugaucacguggaggacaugaaagcaggccgcgugguggucuccgagccccaagcugggggcagcugcaucugguacuaugaagauggccugcugaagaaccagguacgguuccagagcuuguuuugcugagaccagguuugccaaccugccuugggaagucccagcccaguuagaugcaagaugcaugcaacccggaaguagagaugcgagcucauucaucuuucuuauguuauaucuucaaagaacuaguguuuggggcugggcaagugccacaguaguuaaaagcacuuguugcaagccgggcagugguggcacuugccuuuaaucccagcacuugggagguagaggcgggcggauuucugaguuugaggccagccuggucuacagagugaguuccaggacagccagggcuacacagaaaaauccugucucgaaaaacaaaacaaaacaaaaacaacaacaacaaaagcacuuguugcuuuugcagaggaccuaaguucaguucccagcauaaaaaugaugacauaggccaucccuaauucuaguugcagaguauuugaugcccucuucuaaccucggugggcaccaggcauguguuuauugcacagacaugcaugcggucaaaacacucauaaaauaaaucuaaaaaugaaugaagagacuuaccuagggcuagauucaaaaguagugaaugagcuggacaggguggcccacguauucaggaggcagaaagaguugaauaucuaugagcucaaggcuagccuggucuacauagcaaguucugggcaagccaaagcuacauagauacugcgucccagacaaaagaaaccacaacaacaaaaauccagcgagcgaaggauggcuugagcaugggagauuuccuaggccaaaucucacgaucuucuggggccucagauggcccccaccaugagccuacaggugauuggaccuccuagcccaggcuccaaaguaguacuaugggccgagagccgccuaccacgccaaaccuggagcaucaaugaauugggucacaucugcagccaaauguuugaaggccagauccuggaugugaaggguaauguaggggugggguaagggugcauaagaggggaguaaaaacugggcugcauccagcacucucugaccaccucugaauuuucccccuccucuccccccccccgcaggcggacgaggguaugaccgugaccauguggugcugugggaaccaaccaaggacagacuuucccagaucuggacuguccauguacuuugaaccaaccaacgccaucaccaguuuccuucaggaggcuuuugcugggaugaaguguuuuauacagauuuugcugugaaauaagcuauuuucuacuaugcugcugguggucucgucucugcaccuugauguugggauggagagaguccaguugacccucagccuccucuucugguugguuucacuuccugugcagcuuccccugaccaccagggggagcugcauaccccacacuggugugucauccguucugccucucugacuguagggacuagccagccaagccuaugugauucccaccccagugcaggacucagauggguguucaggggacagaaguggauggcugucccacuuggaagagguacuguaggaguuggccaggccagaaagaaauaacagcagaaacuauuccagggauagagauguauccaagggugaacuuucaagguucggucugugaguccacagugggcagggcaagaaagacaggagggucuacauuucugcuucuucuaaaucuggucacaaagccugaagguuuagccuugggcagaaaagccaggagaaggggcugggucccuagcugugugacaggucaggauaucagagaccucgggcugcaguuauguugccauccucuguugacaugggauccugggaagacacagaggcaaggacccuugggaaucagucugagcuuccuugucuccuccaaagaccacccccaagcccaggagggcagggugguuagaggggcugcugguccuuccugccuucccuggcugaggguguggguagcaagccuugccuccucauccucuugcccagugauagaaggcauguggucagagacuugggagccauccuuccgcaaaccuucccagacacgggcugcuucugggucuguaguacucccguugggaguuuugagagaaacagccaaacaauaugugauuucccagaaucuaucaguaugaagacaucaagggcaugggcugggcaccugccugaaccugggguguguggggcuugagagucaagggcaguacuggguucacuccuaauacugccgcacacaugacuccugaggccagugaugugcagugaucgaucacacgugggaccccaucuaagcauaaguauaacuuuauugugcccuagcugggugucacggccccgcucccauuccggccauuggcugucaacuuuagccuccuuggauaucugcuaucaacccuucccguggguugggaugucucucgcuacugaugguggcagcaguggguggagcacggggcuucagaagcugcgccuucaccucagcugagguagaagaggcacauuaagguauuggcaaagaagaggaaacugcaggcacccgcaucgaugauggaugaggccccacucuuuaaggggguuuuuuugguggaggugcuguuuuuguuaguaccagaagcggccguaguggcuugucccaaggauccuguuuguaucugcaagagaagcgcugcucaguaggauuugaaccuucuguugagggcuccugccccuuuguucccuuucuucaacucuaggcuuccauaaaacugccaucagcccuguugagauguuuggcuucccaccucaucacaggcaagggaaaggcagcccccauguuugucauucuuccaccucgaaacuucccaccacuuuucaggcugccagauccuccagcaaagagggaaacagaaacccaaaugugggcuuccccucccagagccucgguuuccucaucuccuggugaucagaguccaccaugguccagaguaucacacgugacgggccugaguaaggccccuggcagagggugggguggggauggcaggugacaagcuguccuugaugcuugaucgggcaguaacugaaguugcccuugauggucaucaaacuaguuuugguggccaucaaacugccuugaugcauggucuagauguucuugaucaagaacuugauggcuccauucccugugcuaaucaggccucucugcguacauagugccacaaaggaugccucccaggguggcaguugaucugcagaguauaugggagacuucugucucuguauuccugcacacccacaauucacuauggcaggggcaggggacccucggucaccuauggcagucuauuagaccucucuccagcccucucaaaagggccacuucugcggcucuccucaucagggcuuccucuccugauccagaauuacccagaacccucugaguagcuucacacaucagacaccuucugagauuucccucucugaggccagucugauagcgccugugaggaguagaaacccagccauauaggcccuccuagaucccugguuuccaguuggcgaccaucuaucucugucccugugguagaaggcaaggguccccaccaccaccaccgagaaccugcauuccuuccccagaaccuggaccaaaccauuaagcuaagaccuggugguagcugcagugacucuaggaggagcuguccuuaccugaaucacaaccagaagaaugauagugaggaagaggaggaagcucuucauccugaaaucuuccugggcucuguagcagcuuugagagaugaguucaggacagucugcaggccacuuugaaccuggcugcuuuuucugcagaagagaaag

SEQ ID NO: 2182 - RNA, 24200 nt, Mus musculus
ccuggucgccugggaaaccccgagacaacaagauggcggcgccgcgggacggcucgcuggccccguggugagugccaucuccgggccuuucugccccgcuaagucuucccgcaggccgcggcccucguccugacuccgagggucggcgacaugcaugacuuggcucaggagggaaguggggaccauacucaccguguccgcgcguggaggcgggacaggcggcggaauccuggggcgggcuuugggcgcacuaaccuucuuagugccaacgugcccagcaaaggauuaggaggaugucgcgcagcuaucaggcugucgccuggugugucgagugauaacugccuagggcagcacucaguuugguccuucagaugaagaaacaaaggacacguuuguaacccucaccggaggcgacaaccguaucuuuacagacuuaauggguugugacauaggccugcacucuauguaggggccgaggagagaggacuggaguacgaagccuaucuggcuacauugcgagucccaggccaaccaggguaaaucagcgaaacuuuaccuuaaauuaaaaaaaguaaaauaaaacaaagccaggagugguggcucacaccuuuaaucccagcaaaguuugaggccagccugguuuaacagagugagacucuugucucaaaaacaaaaaacaaauaacuaaacaaaauagaagcugggccugguggucugcagacguguaaagcuacucaggaggcugaaacaggcggagcacauguucaaagucagccuggacuuuagagccaguucaaggccagugggggcaaagaccuuuauauauauuauauauuuauuauuaucauuucauacauauaugugucugcauguguguauguguaccacaugcaugucuggugucaaaggaggccagaggaaggcaucaccgucccuggaacuggaguuacaagagguucuguucugagcugcgaugcaguuacugggaaccaaaccgagguucuucaagagcagcaauugcucuuaaccucugagccauuuucaagcuuaagacuuuauuucaagcugggcauggucgcgcacgccuuuaaucccagcacuugggaggcagaggcaggcggauuucugaguuccaggccagccuggucuacagagugaguuccagggcagccagggcuauacagagaaacccugucucgcugguugaggccagccugggcuacacauuuugggcuggugagauggcucaguggguaagagcacccgacugcucuuccgaaggucaggaguucaaaucccagcaaccacaugguggcuuacaaccauccauacgagaucugacucccucuucuggagugucugaagacagcuacaguguacuuacauauaauaaauaaauaaaucuuuaaaaaaaaaagaaaagaaaaacuaaaaauaaauuuaaggggcuggagcgauggcucaccaguuaagagcaccgacugcucuuccagagauccugaguucauuucccagcaaccacgugguggcucacaacuaucuguaaugggauccgaugcccucuucuggugugucugaagacagugacaguguacucucauauauaaaauaaauaaaucuucaaagucaauaaacaaauuuaaagggaccgagugucuugcucagcgguagauccucucagcccccagugccaaaacagcaacaagaaaauaucucuggcccaggggagcgagaaggcacaguggugcccaggagaaauccccagacugaaggcacuagcuaggucuuauccacagggcccagggcucacaggacgggcaguguaaaagcucccgaagaauuguccugugucacaggagaaaagaacccacagcagagacaggguggcauuugaccugaaggguuugggagcugauagaauggagagaggcuagagagaggaaaacggugcccuugggugaugggucccaugaagaagggaagauggaggaggugagucucuggggcagugauuuuucuguggugguuuuacugauaacagaauugauacagcccgcacaucacucugcacuuuguaaauucuagucauuuuuuauaaagauuuauuuauuuauuuuauguaugugaguauacuguagcuguacagauuagaugguugugagccuucaugugauuguugggauuuaaauuuuuaggaccucugcucacuccggucaacucugcucgcucagugccugcuugcucuggcccaaagauuuauuuauuauuauuauacauaaguacacuguagcugucuucagacacaccagaagagggcgucagauaucauuacaaaugguugugagccaccaugugguugcugggaauugaacucaggaccuucagaagagcagucagugugcuuacccgcugagccaucucuccagccccaguccuagucauuuuuaugcuucauuuauaggaaauguucagaaugggcagauguaucaguagccaccaaacaaaaaaucaaccaaacaaaaaaagaagugugaaacuuggcaagcugacagcagggccaggcuucugccgccacggccaugucugagcaccagcauuccauccucagcauccacaggauggaaagagaaaaccaauuucuucagcguuauccucugauugccacacgcauuuaauggugggcaugggcccaucuauacaaaugaauaaacaaaugcucaaaacaauauaaaaacacauggcucgggccaccccaugcuggggaaaugcaggcacuugggucccuggggcuugcugcuugccagcuuagauuguuucacaaguuccagucuagugacaaacccuguauguaauuuuaaaaauaaauagaaguguggagagcgccugggggcaggacuccugauggcccucagagcacugcuccuguuugugagucccauggacacacaaauaaagagugguggcaguugaaggacggugacaccgggagacugaggcaggaggaucacgaguuaguggcugaccuggauuagcuaguaagaccuugucucaacaacaaucaaacaaaaccccaaagcauuaaaaaagaacucuugccagauguuggcaauggcgcacgccuuuaaucccagcacuuaggaggcagaggcaggcgaauuucugaguucaaggccagccuggucuacaaagugaguuccaggacagccagggcuacacagaggaacucuauaucuaaacaaacaaacaaauggaaaaacaaacagaaaaacuuuuaauuuuauacuuugaaaugaugaaguuuaugaagucugacuagguaaagcuaaguaagaagaaagguaguuggcuaguaucugauuccacagagguaaguaacuuuaucaaagaaaauuccagagcugagcaggaauggugggucauuucucuacuccuggcacucaggaagcagaagcaggugagaccucugacuucuagaccgaccagggcuacauacugcgaccuugucuuaauaaauaaauaaauaaggaaaggaagaaagaaaauuccagaugaaagcacugguuggccagcagucccagccagugggggggggacgggacgacugugacuugggcuguagcaggaggcccguggggagggaaggggcugcuuggugaugauggugguuaaacccuaucuguccccguuaucagauggcgccagccugugccucacucucuguugugguuguguugauggugacuguaggaggaagcuuggugacgggcaccacagggccucucaucucagaaccacuguccugugacugauaacuuccaaauaaaaagcuaaauuauguccuaagaacaaauagaagggacuuugagggguuagcuuagccagaggaagaguauauggcugaggagagaccaggcugccgacugaccaggaucccugugugcaagucuuggcucagcugucuuccuggcagggagagucagguagguagggauaaguugagaggcagacagggccagaucacguaugggaguuuuauuuuuccucuccuccuccuccucuuccucuuccuccuccucccccuuuucuuccuccuccuuccuccucuuccucuuccucuuccuccuccuucucuucuucuuccucuuagcaucucaugauguagcucuggcuggccugguacaaacaaaucgcccuccccagguccugggauuaaagugugcaccaccaugcccaguuuuuguuuuuuguuuucauuaucuuucagggaagaaaggagccccuggggagguuuguucaggguuguggcuugucuuuguugcuuguaagcauccgugaagggagccacuaagggagcugccauauuuaacugcauaaaucacgagggagcccagacccacagagcaaugccgggauggggaggaugcuggaugauggggugagaggccucuggucccuucugaggaaagggcggggcaugaggaagaaggugaaggaggcugucuccaggcagaaugcagugucagcucagggucccccuuugcuuucuauugaggugacaaagacccugccauaaggaaccuggggaggagagaauuuauuucgcugacugugacuucccaggucacaguccaacauggagggaagucagguagggacugaaauagagacuuuuuauucaacucaggaccccucugcccaggaguggcuccgcccacagagccugggcccucccugucagucaucaaucaaggauaggccacagcuuuggcugcagccucauuugaugggguuuucucaguugaggggcucccucuucucggaugacucuagcuugugucacauugacaaaaacuaaccaucacaucgggcgaggagaguguggcaugaccugcuuuggauuuagccugaaaaagacucauuucagacccuccccaauggagaucccccucuuuggcucuaggcuuauuagauuuuaguccuguuagguagggaacagagugguggcucugagguacagcuggcuguacacauguccuuucuucaucagaagaaguguaugagcauuuuugugugugucagucccaucugugugccaauaaggaugacccauacagccacaauccagcuuucaggugcucccucugagcuuggcagaugcuuuaggacuuugugcccugccaagucaucugccugguaggggcugagaccaugcacaguuuacgugggaggaaauaaagugccacauaaccguacacagcagagcuugugcccacgguacacgacuguguuuucaaugacuucucucugugggcugccauucugccucagagauggcggaggugguaccuggcuuccagaagccacgaggagacaccuuggcuuucugccuggcagcucagugcugaguuaguaguggcacaagccuuuugaggagucugugcccacacuccaaguguggagaagcugcaggcacugcaccgcaacaggcaaggacuuccauguucagaacagagaagcagcaacugggaggagucaccaugccaggaaccucaccccaugccugcuucuccccggaauagugcuucucuucaggaaaagcugcagcucccuccugugaccugaagcccugggucucuguccccgaggccugauuucccucuuuccccucaggagucccugacagugaaccucaagacuagagcuaugagcucaccucuggccucucuuagcaagacgcggaaggugccccuagagucggagucugugaauccuggguaaggagccagcugguccuugaccccugaccugucuccuccuugaucauuuccucaccagaggaaaaugaccccuagcgucuuggggaaagcagagaguagcuaguggccuucugugucugcccuccuucucuuuaaaccuucaggaaacugguuugugcuggccaaagaugggugggaccuuucuguaaggcccugugagaguggcugagagcuugcccuucacuguuuacccaccagcucugcagacgugaagguccugccagccugggccaggcucugugcugggcucuuuuaaaugccguugccuuauaucuugaggcaacccuugugcaaagccuuuucucccuccuguucccuuauugcuuuucugagcucacuuagagucuggcuaaggaaggccaaggugauccagagcagcuaagcagcaaucccagggguccacgguacuucagagaggagccagggucagcuuaugggcuuuggaaucuuguggucuucccaucuaagguggcccugcggugucccccuauuuuccucuguugggaggaguuaggcguuggacagcgugucucuuggcucacccuggcuaagguuagaugggggugggagucuucaggagauggaggcuuagcuucuaucucuuuagcuuugcauggggccugggacuuucccuugguggcauuccaaggggguuaacuuauauuuguuccuucuuccugccuggguucccaggagacgagggauaagagucuacggaaauggugagugugugcccuguucccauguccccuccccucucaccagccuacaucuucuuacagcuaggcauguagggaaggagcacgcugaggucuugugagacugggcaucuggccugccuccuguauucaugcucccuaccuguugcucaggggccugggccacccacuugcucugaucccucagcagagagauccacaccaucauaaaacucugcccccaaaaagaugguuauggguaccucagagcuaugggaagaccagagauguggaccucagccucugccuuguagucuucucuccuggagcccuggccucaucacuggccugauugugcaccuuguggggcaguguauaagcuguuucaucuuggccaggacccaggccagaguguucucuggguuguggucccagagcagugacccgggcauuccugucugcagaagaugagguggacauguggaaugauggccaagacucagaagagaagaucucucugccuuccugcuauggaggcaucggugccccugugaguaggcaaggugagaguggagggcuaaaggggcguggcucucccuugcucugggggaggcucugagaacaguggcuccuacucaucucaccugcuguguuuagaugcugcucccacugccccagugcuuguaccccacacccauccaggacaggaguugaccuaaagccacagguuaggaaucuggccaagccccaagccaggcuguggcuggaaacccuccaauuuccagcaagcgugacgucaacaggucugugauugaggcucagagacagugaaggcccugaagggcgagcucagccucuggcuaucugcuuccucaucugaacgcuccaaaaagggcugaauuccuuaggaggccauuucaccugacucuguaucuucaaagggcuguauggaguugccuacaguaggauggggacagagggagagugggcagacaggcacugggaaggauuagaaguugugacgaggcuagaacuuuccaucagaagugacaucuuaagcuucccuguccucuagaggaagagcaaugggcuggcaugcuauaaggauuuggugaguugcugcuuggugggguuccuagcugucacacaggggacucagagcagaggcccauuagccaaggcagugggaggcaacugccagguaaucuuggaccaaacucccuuccauuugacacuggcaggacuugcccagcccaaauccuacaguggcuuagucacaaagccaggaucuccgucaccuagccaggcacaguggugguccugcagccaccuccuucccuuuuagggacuguacauccucucacugcugcucccugccacaucuagcugguguguccccacuaaggucuccaguaggaccugucucuccugcuucaagucucugcucagcagcuccucuccugcuccuacugccuuccuuucugagcagcuccgugcuggcuagacuauugauggcgucccuuccucccagggucucucuuuuacuguccucaguaccucccuuucuucgccaguauucacuguggacauuccaggcugccaccacgccacacacuggcagguccugaaugcuuccacuucuguggcuuacuaugcuuugucucuaagucccugacagcccucacugagugagcaugcccacuagggaugguaauucagggacuugaagaugacaucaaggucgaguuaagguuucuucaucuuucuccugagccauccugggcuuccuguguggucuccugacaguggcugcaguuccugcuuuccauguuaggggagugucuggugacaaagagggcuuguguucuuuaucucacucuuaucauuuuuuuuccagagacugggguuugggacagucaggguugccucaaauuuacuuugggcuguggauggccuugaacucucucucugggauaaaaggggcacaucucuauccgaggcacucaagcucuauugugaaaguuuuuacuguacagaaaagcugaaguaggaggacagugccuucccuccccuccccuccccuccccuccccuucugccucuacagagaugcucucucauacaggggcuucucacagagguccugacagucguaucuaacuccuuugguacccugcauguccuaaucaugaggcacagacaguguuauugcugcaccucugagcaugaauaauccaguaacccuccuaacaccuaucucuucuauauuacaggcuccucaagaguuccaaauagcucuuagaaugacuugucccugguuggggaccugaaaggcagggaggccucaugugucauugcagagucuaugccuguuuagauuguacccaguuuuuaaaaacaaugacauuaacuuuccuuuugggggguagccuugcuguccuagaacucacuauguagacuaggcuagcucccaacucacagagauccugccuucgucuccugagugcugggauuaaagaugugggccaccaugcccaucugagaaagucucgaccucucgaguugcagagcccagauguguugagugauuuacuuuguguguguuuguuccuguguguauacacaacagugaguguguaugcaucaaagaaaacucacuuuuccuuccaucgugugugucccagggaauccaacuuaagucaccagguuugaugguaaggagggggcaggguagguaaacgcccuugguauaaaugcaagaggcccugagcucaaguccccaggaccuguauaaaaggcucucauggcuguguacgccuauagucucaccauuagcugucagagauaaguggauugugggaguuuccuggccggcuagccuaccccaaacagcagucuucaggugcaguguuugccuagcauacguaugguccuagauucgguccccccaccccccuaaaaggguggagagugauaaagggaggcauccaauguucucuuuuuccucugcuugugugugcaugggaguauguaacccuguacauguguaugugcgacuuaaauacaaccuauauguucaccacugauaaacauaccuggaacaaguugcugcaccccacccccacuuccccaagcaggcccgcucuaacugacugcauggcccgcuguaacugacuacauggcccgcuguaacugacugcauggcccgcuguaacugacugcauggcccgcuguaacugacugcauggcccgcuguaagcaccgcaugugcugcucuguagagcuuccagcgcuccugccaccaagcgguagcugcuguuggaauugcugguucuguucuuguggcuuucucccccucuggcccuucucaucucagccucagcuccaggacuggcacaagaaacuuuguccccuugucaggaccccaugacucagagcugauggccuccaugaccaggaagcugcaggagcuggagcagcaguugcaggcccagaacgacgagaugcuguccaaggucggcccugggucagggcggacuguuccuccuguugaacuggcuguuggcauggcaagccgggaccuaggaaugaucuugguccccagaagcugagcagaaggcagaggccacuagaaugcgggcugcugagcagagcuggacacugagcccaggacaugggcugugucuuucucaccuagugugacuguuagagagauggguuaucugaggcucaggagcagaggcuguaccaaagguugggagggacaggcucacacucacaccuggucuccaccuucucacccugagucucacugcuucaggagcggaagauccuggaccuggaggauuugguacagacccuccagcagcaccagaguaagaagcccuuggucaggugcucgguuggguccaugggucuugggugcuggacagagacuuauggguaucaaggcuccaacagcaccaggcagacugcugauggggucuggacagcugggaccagagagacaaacuacccagugccucugcacagacggcauuguccacagcauggcagagccacacuccaagggaugaagggauggguggcucuugagagucaguucaggcaacucucuccccccacaccaguguuagaagagaggucuagggucuagauagacucaggggcuguucucagaggguccccagaagaccuuaggggcaacgcaccugcagcuuccaguugugacaguagaaccccucacccacgucuucccccagacaaugcagcccugcagaggcaggaggagcuggagacacaaugcauucagcugcagcggcagauuggugagauggagguaagacugguggaauggacagccaggcugcccucccuagucuagagcugccuaggauuugcagcagcgccugccccucaggauucuccaggccccugccuguuucccugcucugggcugacucagaguuuagagccagggauuagggggaggggcuguaucuggcaccaugaggcaugacucccuguggggcugaauagaacccugagcacacgagcacucuuccuuaauauacugccuuauucuccacuugcucuaucccaaguccucgcuguggguuuguggcugggcccugcucuccuaucuggaaccucucuacgcuccagccacgccacaucaucuuccucugguucucugacuaagcucauuccuccuuagaccccagccugugcugguuucugcagggcccggcccgccuccuccuggagaagaacuuggacucauuuccuugaggccuuccugaccugaccagggcaggcucuucacccucugcucucccugggccucaucucucuuccucucugggacuguaaccuccacgaggggcacauggcucacgcuggacuuagugccagguggucuccugccucaggccaugacuucuuuacccaaucacuuggucaccucagucacuuuucuuccacucagaauugugggcacgcuguaagacuugagcuggaaggcacugggcacguggcggggccacuccugccuccuuacugccaguguccaguccucugcuggccccuuucaaguccuuucuaaaaugucucucuucaagcagaaguguuuccaaagcuccagcccacugcaggccuguucacaucuggggcugugagguacagcugcagcugggccccaccugccugccaggauugggacaguagcguggggugaggcucagccaagcacaccccuggcuuaagcaaggaccuuucagguguuuauugaguccuuaauuguuuuguuuuguuuucagagacaggguuucucuguguagcccuggcuguucuguaacuccucuguagaccaggcuggccucgaacucagagaucagccugccucugcuucccaaacacugggaucagaggugugugccauuaccgcgugucugauucaucaaucgaacaaaccuacaguaucuauccugguagacacugccauuaggcgugugucaucuguacagaaagucaugguccccacaugcaugaggccgacaguccacagaagcagggagucacauguuagaggagauagaagaagauaggagagugcaggaaaucauuaguuaggggaccucugaagcagagcuggagcugggucagguggcagacuugggguagcaucuaggcaaugagguagaaggcuccaccugccaccuuccccuggccggaagucaggagaaggggagggggaaagagaggccaggccaaauaggccucacugugugcucggucuggagggaguccuuauguauguggaagcggagaagagccauaacagggagagcgugguuggagcuguguguguguaucuguguguaucucuuuguguguguaucuguguauguguguaucuguguguguauccauguguguauauauagcuguguguguguaucuguguguguguguguguaggugcagacagaagggcuucagggucucacaacagcaggcaguuggcaaccacaccacaagcagggcagugaucuguggagcagaggggcagagaagaaagugguauuggaaauauagacuacucuaaccaggugugguggcacacgccuuuaauccuagcacacaggagacagaggcaagcaaacucugugaguucgaggucagccuggucuacaaagcaaguucuaggacagcuaugcaaacccugucuugaaaaaagcaaaaaagcaagcauguagaugacuuccugggcugggaaaggcucagucauuaaagaggaccuuuguccugucccuaaaagccacuuaaaaaaccagaaaaaccagaaugguuucauggauggaucaccucggagcugggugaacagaguugaguagaucucaggcuucuuggguagucuuggcacccaguggacaccaagauggacggacggggcucgaagaggaacgacacccagccuguccucugaccccacauaaaagugccugugugaaugcgcaccugcacacaccugggaucgcagccacaugaacacaugcacgcacagucuaguguggcaggaagaagagggaggcccgcucuuguagagcaggugugucugccucuucaugcuuaggucagacccacaaaguccucggaguucuagaguaauguccuggcuuagguacuggcaugaagggucuuacugagugagacagggcugccaugucuccuccuagagaaggagcugaaccugcuguucuggaggucaagagcuuuggggucacaggcaggaagugcucagggccuccagcacauucuuuguccaggccacccuggguugacugggggaggggggaggaggguuuggccaggugaugguuuccauggaaaccaggcagguggugcaguaucaccucucccucuucugccccauagcgguuucucagcgacuauggccugcagugggugggcgagcccauggaccaggagaacucagaggaaaagacagucucugaaaaugaugagcgagacuggaugaaggccaagaaguuuuggaagccagguagagcaucugcccuggcccccaccuuccugagggccugccagucuuccagaggcccauuguuucaagcccugccaucccaaccauggggugaggugggguugugaguuaccuacgucaucagggaaagagaagccaagguuucccucccuggccuuacuuuagucucugcuugcucaucugccaaggguuagagagucccaggguuacuagacauuugaugcucaccccuccucccagacaggguuucucuguguagcccuggcuguccuggaacucacuauguagauuaggcuggccucgaacucagaaaucugccuucugacugcuggcauuaaaggugugcaccacugccugaggccccuggcuuugaacaaacaacaaaacaaaacaaaaccuggcauggugguacaaaccuucaaucccagcacuuggaaggcugggucaggaagauugagaguucaaggccagccuggacuacauaaagagcuugugucugguuggggagaugggaaaggagggaagaguaaaagugaucagguuuccaggccucaaccaccucccuguucagcugcagcucugugagccagggggugggaucugccccggcagacuccaguucucaugguuuguccucauccuucauuuugauuuguuuugcuuguuuuuuuccagaccggguuucucucuguagcccuggcuguccuggaacucauucuguagaccaggcuagccucaaacucacagagaucuaccugcuucugccuccuuuuaucacuguuaaccauggguauuuaguggggacccagcccaccuuguccuuagagcuguuucugagucagagccuguugucuuuggggguggagaagauccaucuguaggaacucagacccccucauuucuacuccaccccuuguucaagguugcuuuguggcuugagcaagccacuucccuuuccugacucucaaguucaucaacaaaauggggcaggcucucucucucucuucaggguggggcccuuugcaugucugguuucugcuuccggggcuuuucgggaacaggaaucguggcagcaccgcccccaaggacagucuagaggacgacagucuuacaagcguucuuacacguguuagccucaggaggcucuuccugcauagaaacccagauuccagggcugagccuguggcucgguugguguguacuugaagugcagaaagcccuggguuuauuccccauugguagaguguguacuuguagugcagaaagcccuggguuuauuccccagcacccguuaggacgggcauggugaaccacacaugcaaucucgacacccaggagguaaggauagaaaaaucacaaguuccaagcugguccugagcuauggaacaguguggaggauacccugggcuacaagagaucccacgucaaaaaacaaacguggggaugggaugaagccaugacuugggguuaggaguguuuauugcucuuccagagguccugccuucaguccuagcacccgcacuggguggcucacaaccaccugugacugcugcagugccagggcuccaaacccucuuaaacccugguacaaucaucauacuaccuugcuaccuuguacuugggccugggcuccaucucucugccccuaaauugagacaggacuucacuguguagcucuggcuguccuggaacucugucauggaacuugccguauagaccaggcuagccuugaacucagagagagauccuccugccucugccuccgagugccaggacuaaaggcgugcaccaugcccgucucuuacuacuuucaaaaaaucuugagugacaaacagccuuggcauaggcuaaagguauuccagcuuauggcagacuaagauagaguagcugaugacggcugaacagagggcguugagagcucacugggagguggccccagucauugaguagaagaugagguaggugcugcuguggaggacaagaggagacaggagcgauuuggaggugagguccuuggccuuuuugacagaugcagaggagaggaggaggagucagagcuggcccuggagcacucugugagaaggugcugggagcauguguggccccaggcugugggagguaaccugaggcccugcuggacaagaucuagaguagcccagggccuggcgcucugaccaccuuucuccagagacuaaggccacagcagggggcuggcucugugugcugagaaugcaugggggaagggggguucuugcuuugccccuggagcccaccacaggagguggggcucugcuucaagcggcccucacauccggagagcagccugccuucuggcagaaguuucuucuguuuccucuaggagggggucagaccacauggcugaucucugaacgcaucuucuacaugucccaaguacuuccuccaccaacccucuccagacagcauccuguguuguguuuuguuggugcggccgcuccaggccuggcucugaagccguggugaaggccgccgagccuuccacgucgggguuccugggccaccgagccuucuacacuucucuugcuuuugccuuccggugugggacagaccuuuaguucuuccugccaggggaggaaauguccuccuuuucuaggagcuuuuccuccuccgagcucccucuugucucagggacuagccugacugucccuggguccucugcuaccugcuuuggcuucuugcugguuugugucugggcauccguccgucacuuccuacagcugccaguggguaggugagcggggcagccauggcugggggaagaggguugaaauggacuagauccagaacuuuugccuuaggaaggagucaguuucuccaugaagggggccagcagaggggagccuggaauuggggugaugugcagcugaaaccccccagccucucaccaggauacaaguaucacauuggcugcugugucaugugcucuggccucagcacagagcagguuuugggccugggugaagagaacauucgaggcuuggugcuugucucuuuccugucuuuccucaaauucccacccuuccuccacaucgcccgccugucucuuacuagaucccuacccccacccuagccuccggcccaagccccugcccuggugcuucucacauuccuaggucaagaggccauauuggcagcccugcuugauuugcccuggccuaguccuggguaggcgagcuucccccccaaacucacuuuuauccugacauugccccuccagcagauccccacagacacuggggcugcugccguagcugugccagugucucaugggaagagcagugcuggaacaagggguuuaaaggcucaggcuacauguucuagggggcagccagcaggcucugaacucacugucucguccccuggugacacccaggagcaugcaguacagugcuuggcacaaggaaggcuauggcaccuggggaacugggacaaucagucccccagaacagccccaagcuggacugcagaggucagggugagagcugcaggcaucaggacaaaccuguccagguugagggugugcucgggaacuacccagaggcucagagcacaugcgagcagggaaguggcugggguaggccuggcucgcagaguugugguaacaauggcuguuuucugaugcgagaggcugagagguggaccaucuccaauccagccccaaaguagccagucauccuuccaacaagccugcagggggcgccgcucauccugugccugcugugggcugugcagaacacacagggccucuggguaucuaccauugcuguuuggcacccugacuucucuagggaugagcccgaggggaggggacuccgggagggcgcuggcaggacuuucugagccuagcagaaccacacugcuccuccagggguggacaguugggucagcacaugcuucuggggguaccccugccccccaagccaggcuaggguucagugcucuaacugguguuuaaaaagugcccagaguaguuggaaggcaaaugaucauacccaaaauggcgagaaugugugaccagggccaggagcaaaagaaccaggcaggagugcaugggguagccugaggccaaguaaguugggacagacaacagcagccacccucugagcuucggggcugcucuuguccaccuuuuacauaagaggaaguuacgacucggaagcuuagaagcuugucccagccuacagagcucacaagcagcagcccuggcuguguggccuugcagggccaagaaagagucaaggagagaggucaggccagcacuugggagggggaggaaggaaagucaagaguucaagguucauccucacagugugggcuaccugucuuaaaacaaaaacuccuaaagugacacgaagucucagaggucuucccucacacugugacccuuccuagaaagggguccuaaguagcuguuucccaagugccaccacugggcagcugcuaccuacauagagcugagugagucacguagguccuguagggcucacaugaccuggagcaugguaccucacaaggccuccaagggccauuaagucagguccacugacaugaucuugaggccaggucaggguucuuuuuuuuuuuuuuuuuuuuuuuuuuuucugagacaggguuucucuguauagccuuggcuguucuggaacucacucuguagaccaggcuggccucugccucccaagugcugggaucaaaggcgugugccaccacgcccagcucaggucaggguucuuaaccugcucaugccacaaaagggacaugucucuccguuagcuugagccaacacaaggcuggcuucuuggccuauacugucuuguguggaagcuccugcuacaggcuacaguuuucuccaaaugaagguuucuuuugaaccuuggcuguuuggcgagugcucucugacuuaucucugcccugggcuggccauagcaggcucaaccugcccuacuuccugaauguuucuccauggagcugugcugccuccgcaggugcccagucucucccgccuguccauugacccaguggcagcccagcccacucuaccuacucuguccucuccuggccagggcuagauguccuuuucaaggcagaaagcagaccaguucccacuucacuaaauguccugucucucugcugucuuccuccacaucucuuuucuaucuaaaugcucugccacauggguccauagccccuguccuccaggccaguauucugaggcaaacuuuugccaucaguauuucuuaguaccaucccagggacuccaucuguccccuugccucauuacccacccuguggcucucccuaagccuuggagcgcugagguugccuguuuuagauagcaggcuuagaccucacucuccuuaguugugggaagagguacggggccaguuccugaagucauuguaaagaaaacucaugucaguaucauuguggggcaggaggugcaauacagcggacuguugguggucacacaacagggaagcccaguggcaggaggagcaggcauagccuuucagagaguagccagugccggggagaagggagggcugagggagggccuacagcucagcagcugcagagacagcaggaaacagccccuccaccuguacuuccacuugggggcgagcaguuagauccccagugcccugaccuacauccugccacaaaauagcucucagcaagcucacagucaugucugcugaaugcuuguccucuuuuguuguuguuguuuuaagauuuauuuauuuuauguaugugaguacagaugguugcgagccuucaugugguuguugggaauugaauuuuaggaccucugcucacuccagucaacccugcucccuccgguuggccccacuugcucagucucugcuugcucuggcucaaagauuuacuuauuauuauacauaauuauaaauuacuauacauaaguacacuguaguacuacaguagucuucagcuaccccagaagagggcaucaggucccauuacagaugguugugagccaccaugugguugcugggauuucaacucaggaccuccgggagagcagucagugcucuuaaucgcugagccaccucuccagcccuggggcauuuaacagaagcuggccagcaaccccucugccugccauccuuuuauggcaccuuccugaguguccugguuucucccucuccgccccuagaacugugcagggccacgugugcagcaguuuccagaggaguccagaaccuuggcagaugcucaagagucuguaaccaucuggucagcagcugcccccacauccuaagagccaucuguccccacccuuccccucccucccugaugaugcgucuggguucuacuuucuccagccugccagguggccuggggugugucaccuuuccuuuuucuaaugcuguuuccucaugaaucaaguagagguuaaacagccccugccucccagccuugggguuggccugaggaacauuuguacaagguagagcugaugaacuuggaacaguucaggcuguuccaaguuagcccucaugcggccacuuccuuggcgccuuagagccacccagaacauugugguaaggccagccaggaagaagugcaggagcugggauuugaaccgugaaagcuuugauccagagcugggagcuuugccagcccagugcccaacacucucuggccucaguucccaucucugaaaaugugaaggaauaugaauaacccuuacaauguaggaucggucauaagcagaagaaaugggaugauggauaguaagccccugacccaaagcaagugucccgcuagguguggugacacacauguaauacuagcacuugggagguggagguagcaucaggaguucaagguaaauaaaaaguuuaaaguaagcugggcgugguggcgcaugccuuuaaucccggcacucgggaggcagaggcagguggauuucugaguucgaggcaagccuggucuacaaaaugaguuccaggacagccagggcuacacagagaaacccugucuggaaacaaaacaaaaaacaaaacaaaaccaaaaaaaaaaaaaaacccaaaaaaacaaaguucaaaguaaguauccaauagcugccauuguuagcuaguguggugaaaccucugcucaaugugggagggcccagagcugccagggcacacagcagccacagaggcucaugggcaucuaucccuuuugccaggggauucuuuugugccccccgagguggacuuugacaaacugauggccagucuacaggaucugagugagcugguggagggagaggcccaggugacuccggugccugguggggcucgguuccguacccuagagcccaucccgcugaaggucuaccggaauggcauuaugauguuugaugggcccuuccggcccuucuacgaucccuccacgcagguaggauggagcucuggguccaugccuacucacacucacgccugcuuagacaugguggggugccacugcgagagcgugcccuccacagaaaacacaggucccaccccuccaaucucagagcucccaguauuuccagaauaugauguuuauggcuugccaacuaaacagguagcaggcuuggcauggcauggcaugacauagauggcugcagaggccucaccuguucacuccccugcagcgcugccuccgggacauacuggauggcuucuuucccucagagcugcagaggcuguauccugauggaguccccuuuaagguaagcagcaguucucaacccacccuuucccugugcaguguuggagagagugggguuaauaguuuccucagggaaauagccuuccuaagagggagccauccacgcaagggacccacccauccaggaugcccugcaggagggggagcugggaccgcagugaggaggccacgaggcucccccaagcugagcagcugacagugcccucugcuggcaucuugaagguacuacauugccaaugggaccaccauucugcccacccuucccagcauucagggcaccuuaacagcgcaacugccaagggaucuguaaugcgcagugggccuaguuuccccuacaagcuucugaagccacgugguucggguagaaggcagggcaugaguugcaaacgccgagaagaggcagaguuggcugggcugcagggacaggagaugagcccaucugucgccagggcugagugggaugaagguuguccucguggggagcaggaagcagcaggcuccagaggcggguuaucuccacagcgagggugugugcugucaugaugcacaagauagcgugagucaugacuggggguuuuugagguggcugugaagaaagccuugagacuaugccuugaccgagcagcuguggugaccugcagggauggagugggaacugcagaccagaccggagcagcagcucugcccucuccugacauucagacccccaguggaguggggagggggucuucaguacuaugccuucagcuaguaugaguaagaagggugcuugcauaaauagggccugagugugaacuggggugcucuuagaucaucccuuggguucuugagaccucugggcaagcaggaaugggggugagguuucagggcugaagaguugggcuccccacuucuguggcccuuuuucccugucagguaagugaccugcgaaaucagaucuacccagaggauggucugggccaauucccaggugagggucguguggugggccggcagaaaaugcgcaaggucacagacaggguggaggagacuucagguaagcgggaccccaagguuggcuggggggcugugcagagcaagcuccagguggccucucccagcacuuacaguuccuccugggccaaggcucccaaugcccucccugcaggcuccaggaugacugcugaacaauuccugaacaggcuucccaaguguauaauccgacaaggcgaggugauugacauccggggccccaucagggacaccuugcaggugaggccagcccuaauuacccagcagccuucugcaggggacuuuuaucaucagcccuggcucagccuacagucucuugccagaggcaaggagacccucagaacuaaaucaugucucuguggagcuggugaggacucuguaccccgccacccacaggacaacuugguugguggcuacaacugagggggugagccuguggaccuaaggcccaggucccgcguguucuggaagagcuuggcccaggugcgccuggcuaaugucccgcaagccuuucagaugcaguugucuucugucuucacucccauuuucccuucccaagucuccccaccaaaaagugggugucaagccgcaugccuccugacauccgucuccuuugcccuuugcugccuuguccaguuuggccaccccuugagguccucccugcagcgcacugcccauaccuaggcuccaguaucucacagaugcccuuucugggccggccuuccugcuucauuucuucccguaccagccaugugccccaacagcuuucucuguuggcauugucuggggauucuuggagaaaaccaaggucacuguccuggcauugaagacccauuuugugacacuacccucucuaucugacuuuuccuuccuguccgccugauuugcuuccuugcuucaagagcugucaacggcuggcaguuucccaacuagaccccuccuuucauauuccugugggucagggugaucauaccguagggaauguccucaauucuguucccuuucagaugacugcaggcuagguuagggccccaagccuggccaccaucugggcgggcuuguuucccacgcuggacuuggagaaugacaaugucaccguccagagccuccuuuccuuuucuuuucuucuugggccucagcugacacagaacaccucagcucuuuagcucacuggucccaucuaucccugcucagagaugagccaguccucccugagggcggagggaaugauuuaggugagaccuaggcuccagccacucuccauggcugccuuccagaacugcugcccaaugccugcccggauccaggagaucauaguggagacaccugccuuggcuucugagcggcagaggugagggcgaggcagagagaugggagcagggcggagaggaaaggaccagggagcuggggagcgcugaaggccucuggaucugcaggagccaggagucaccugacaugccaaugccucugcucuccaugcuucgcaucaaguccgagaacggagagcaggccuuccugcugaugauguggccugaggauaccauuggcgacgugcggaaacucuuagcacaggccagguggguauagggcaggacuagggcugcagggaguuccuggcuccacggccuggccugauguacucugcuggccauccagggacauggauucagcugccuuugagaucuugagcaccuucccgcccacggucuaccaggacgauacagugacucugcaggccgcaggccugguucccaaugcaacgcugcuguugcggacccgcagagcccugcugucgaaccccaucucccgcccaggcucacugcccugaauaaagugccgccccugacauaag

SEQ ID NO: 2183 - RNA, 1388 nt, Mus musculus
cgagagcagugacucgcgggcggagcaggaaggaaaccgcucccaagcgcggcggcggcagcguaguuccuagccgugcagcugccgcucccaccgucccucaguuggucugugucccccgccugcagcaugaguggccugcgcgucuacagcacgucggucaccggcucccgagaaguaagugugugccugggccggcgcccggagagggugggccgucucugugcuccgaccagcgcccgggagccgcccccacgauggaagcagugaggugcgggguauggccucccaggucugguccaagggcugggcccagccugaacccccgcaccaagggccccucggcauccccagcgugagcugcccacgcucauucccccaguauagggccauccauucucuugcaccaacccccgaccgcuuuaaucccgcuuccucuccacugugcggcuguggaggaggagaugugucuuguagagagggccugccccucgccgagucuagcuucccugucaugcacagaacuugcccgucuucuuucugaaacucuaguaguuuaccugucuauccuuggacccuucccaucccuuaguggccagaaccuccccucagagugggcaggauagaagcuguugcucacacccgaaggaauuccucccacaaauccuucagcuugccugccaacccugucaauccuccgccccuagaucaagucccagcagagugaggugacccgcauccuagaugggaagaggauccaauaccagcuaguggacaucucccaggacaacgcccuucgagaugagaugcgaaccuuggcuggcaaccccaaagcuaccccaccucagauugucaacgggaaccacuacugugggguaugggguuuggguucugggagguguuggaggacugcagccagggucagaccugggcaaacaacuggggugcccugcaccucgacucaggugacugccucccuuccucaggacuaugaacucuucguggaggccguggagcaggacacacugcaggaguuccugaagcuggccugagucaggauggccaccgauccuauccagcuagcucuucaccaggccuuguaaccaacuccuugucguccuaaucugcaaacccagacccagacccuuuccgcagccgccuccucuuccuccagaggcaacauuccuuauucaccaacuagucucaaaagauugucuuaagcccugacgauggcuguccccagccacaccuuggggcauccucucugccuggcccugucugaugagcauuucuguugcuuccaucagccagagcucugccaaaggccccgcauccccauccuaggagugcccuagagacaauuaaauguccauuccucuggugcugac

SEQ ID NO: 2184 - RNA, 2113 nt, Mus musculus
ugggucagugguuagaggcuggugggaauaggucuggucuuccauaucaucuuaaauagagagcacagaggccccuuuucuggauccagguacucgagguggggcugagugaaggggagaccaagagagaugccacuacauguccacugaugcccaccuggccuuucaggaaaaaaaaugaguucccuuaucuaccaaguagacuuugcucccuggggcuaggacagggaagcaggccugaccuccaaggucuaaggagagauagacaggccagaugcaugaccacagagcucaggaccuuggcacuggggccuugaguguauagcucaggguaaugggcuacacagagagcuugucacccacccuaugauggagaagcauucauccuagcccggcaucucuuuaccccugugugugguugagggagcagggguggaguggggugaggaagagagcacagauacccaauucuaaagcaaagacacauggguucacgucagagaaaucaacuuuauuugguggaaaagcggcucucguguaaaauaaacaccuauccagaucuggucugggaaaccuuuuugaaugccccaggaaggcagggacaucccagaucugaggauggguugagggauuucugccucacagagagggcgggagauuuccuuccacucuaggggacacgugagcagaguguguggaaggucuguucuuggagaugucuuaaacacgucagagacugggaaugaaguaguccucagccagggucagaggucaggagguuggcggcuguucucugggguuaagggaaaaagcugggagggcucuucagggucaaaggggaggggcuguggggaaugagcccuggagucagaguuugggucugaggagcuggucugggcccacgucccuccccagguucucaggcccucugaguauagcuccugguucuguuccuuccacugucggaacuuugcacuugugaguucaggaucacccagcacuuccuccagggccugcaguuccugcagcuuugccugagguaaaaguaaggggggggugggggguggagauccacagucauccaagaggaacagaaccgagaaguauaucuaaguccugcgcccaccaccaggauacccuggcccaagagucugggugaauauauagucucuguacacggaaucuucuagaacuugccucagaacacaguugagacucaggaguauggagcccuggauugagcuccaacagauccagggcuuguagccuucagccuacaaguccagagcucacaguggagcugggaaacagacaccaccagggccugaagcccagagccuuauccuagcugggacccagugugcacacccccccccccccccgcucaccuugagggugcucuggagugcccggauacggugugcacgcucauugagaugagggucacgguugcgccucaugaaagaacuccgccauuguucaugggucaggggcuggggcuggcccaggagggacaccccucccugccucagccccuguaccauuccuuccagggcucugucacugcugucuguggaaucaggaugcaggaugaguacacaugaguaugcucaggacagcccugaagcccaguuccccgcucccagggcagcaaccuggugaagaguuaaaggaaguucucggacucugcaggggugaagccacgggugaugugucacuccacgcuugagcugggccaggcuagguccaggcaggaaaaggaggauuagccugagccccaccaccugccauccagccccucccuccuacucugaagugacacucuacucacagaagcggagcgggacccagccuccucaucggggucuucugcuucugucucacuguagcagucuaagguggggaguuggagaaccacagguuggguuuggagagccauggagugggccaggagaucugaguuccugcacgcagccuggggcacaguagggacucggugcugccugggcuuauuuucccucugugauguacucaccuuccucucuggcagaggagggggcccggccuugagccugguacuuggaaaugcagguaaugagaugucgcacccacc

SEQ ID NO: 2185 - RNA, 3004 nt, Mus musculus
cguccccgcuguuccuucugccuucagucugggcauacccagggaccacugcaacucagcaucuccacccgacgacgagugaguguauccagaguccaacgcugggugggagggccacuugcgaugcaugggaaggagacuggugccaggcuacugaagcuagaagcaccaguguucagagccgaagcuggaguggacagaguuggaauuuacuaacucuagggcugggagaguuuaggcaguggagcagagaggacaagacuggcuaccagucuaggaugggcugucuguggucaaacaucaaagccagcccugaaaacagggaacaggcaggggacgguagacuauuuugguccuuguguuuagggacuuuuuauagccucucugcucaaggcuaaagagagaaggagaagacagaggccauccuugaggucagacaagcucagugcccucccgggaccuuggaaucugacccauugccuacuauaguccccgagagaauagagcggggcacagggagaccguuauugcugccuagguuucaaccauucacacucuaguuagauuuaccaccuacuggagggccaugcugaauagcgguuauggaacauguaacugcuugggcuggggcccgcaguuggcagggucucugcucuaaggccucugugaaguguggaggacaccccuucuucacacacccuugccuagucuguuccuuugucaccuucagauccaagguucucucaguccccagaaccaguaagucccucucagcugugugggaacgggaaaucggagggcagggguggguguguuaaaccauguggguggcccauucuguuagcggacaaggaaacugucagcucuugauuuaccuucccuccugcccuuuuccgcagcacaaggggggugaaggaaaaaggccagaggucuuugaaugugaaggggauagggaccccgagggccaauuucugguguggaaguuauucagaagaauugguggagggaacagauaagugagacgagggguuccugcccaguuuuagaacaacaagaucagaaaccaaaccucagagggaaacguucugauagaccggcagggaguccaagcugaucuagaucugcacaguaaggcaagaaaucuggguuucaagguggcacccuaacucucaaagggacccguuuaaacccuuucauuuccaggccauuguccuggccucugaaauggaaguguggggguuguuggacggaaugguguuuacaguuaggcuuucugggacuccccuuggcaggggcauagaguggcuggcagucgcagauugauacggcccgcggacaaccucccucuccuuccugaauagcccuguugggccugggcaaggaagcuggcagcagcuccuagaggcuucuacccuaugguuaugucccugaccucggugcuugggggcgggaagggugggucggcugcagucagccuguggcuggggagccuccuugucuuggguuugaagcuacacuguugggaagagguauuuuuuccgguuaaggccgguuucgggaaccgggcuaggaccccgccugauuuuccuuuccaaguguccugcuugcuugucuuguguacaugguucagaggccaggucgggauguucucaaaggagcauagaugcccccuccccaagaaccacccaaugcuguaaaggaaggagggagguucucucuucugcuccuugggcauggcaccaguucgugggggagggguaacuggcugauccucuacccaggaaugccugcgggaaaggaacaggaacagccuacuacucucuuccagacaauuccucucuccccacaggcgccaggaacuccggagaauugcucgcugcuccucagcuaccugugcguccuuaacuguguauggagcccugaccugcccagcuccguuaagaugcugcuguccucacccacuacaccuucgaggggacgaacccccagcgccguggagaggcuggaagccgacaaagccaaguacgucaagacgcaccaggugauuguacgucgucaggagccagcccugcgcgggggaccaggaccgcugacaccacaccccugcaaugaguugggggccucugcaucgcccagaacgccugggccugcccgccgggguagcggcaggcgacagccaagaccugacucccuuaucuuuuaccgccagaagagggacugcaaggcuucggugaacaaagagaacgccaagggccaggggcuaguacgacgccuuuuccugggugccacccgggacgcugccccgagcagcccggcaccuacagagagaccuggggcucccgcggggugggcuggguccccggauacaccagaggcgacaggaaagcgcgcagugugucccacgugcucgcugccacugucggagaaagagcgauucuucaacuacugcggcuuggagcgcgcgcugguggaggugcugggcgccgagcgcuucucuccgcagagcuggggcgcagagcacggcccucaggucgcaacgucgccgccgcccggcuccggggacaccagcgauuggacauccagcgacagggacgcggguagcccggacugugcgggcggcggcggcggcucggaggcggcagggucggcgcgggacggacgccccacggugucggugguggaacgcaacgcgcgcgucauccagugguuguacggcugccagcgcgcacgcgccccgccgcgcgagucugaggugugaccaccaccagacaggaagacggcuccgggagagcuagcccgguccgugaacaaauccuucccuggaucucagguucccagaucugcacgcugagcaggcaggaccacaggcaggggccaggcgaggacuguggaaacggguaaaguggccacguggccucucuagauucuaaaugugagcagcgauggacuuggggugagagaugaacgaacuacugaauaaagcuaaaauguuauuuaauaaaag

SEQ ID NO: 2186 - RNA, 12075 nt, Mus musculus
augcaggggucagguccugggggcagagccgcaauucccuuugcagccggccacccuccccccuccccgcgggcuuuugcacacgacgcgcggcgggcggcuucacaccagguggcgaggagggccggggauaaagcgggcgggcgcggggcgcagcggcagggccggagcggaagguggaaggugacugcgagcugccaucgucccgcgcgcaacuucgagggcgcaccgagagaggcggcaugcagacuauggacaagcagaaccugcuggagagcacgcgcggagcccgguaaguucaagccccaaggggcgggaagcugggcagcaucacacguaccuccucuuugaccaucucggcugugguugguccgagcgggggcuugaacugggacccgauccgagggauggggugaggcaagagaaaggaaauuggcggcggccucguagccucagggaucaccugucucaccuggccaagcacacaguuccugaacgcugccugccuguacgcccgagugggacguagggugccuggaaccccgccuucacuccagcacuuugaucccgggcagcccugagguggggaggcccgguguccuugggugcgcugagcuauggucuuuagcugcuguuugagccagaacucugcucagagcucuuucucugagcucgaccggacugacugcccuuuggcuaguucgcaaagcucucagccugggaauggguggaggagcaggggaccaucauagaacaaggucccaagacucaccuccccaauaccacacccaccccccuguaacauuggcugcauaccucugcuuacccgccagccaacgcgggguucggaguguucuuacuuguucuggaaacagcagacuagcaauaacucccagagacuggcccagugcccccucccccgucuccggcugagcggucuccuguccuuccucuugccuccagguccuucuuaggaucucuguggaagagugaagcuagccggaucccuccuguggaccugcccgcgguugagcuggcuguccagagcaaccauuauugccaugcccagaaggauucuggaagucacccugaccccgagaagcagagggcccgacgcaaacucuauguggccucugccaucugccugguguucaugauuggcgaaaucauugguaaggccgugugugugugugugugugugugugugugugugugugugugugugugugaauuaagugaaaguugcugugcacauaggcugaauguuuacauuaaugcuaauggcaguaauagcuacccguuuuauugguuacuuuuucuucuuucuuuuuucuuucuuucuuccuuccuuccuuucuuucuauuuuuuuuuuuuugagcuuucacuuugcuugccuagaacucauaucugucuguuucugcuucuagaguguugggauuaacgauaugugacaccacaaccaccauuauuuauuuguuuguuuguucguuuguuuauuauuuuucgagacaggguuucucuguguaacccuggcuguuauaacucccuuagaccagacuggcuucgaacucagagaccugccugucucugccuuucaugugccucuaccaccgggcuaauuuuuuuuuuuuuuuuuaaggcaaucacuuggcauggcucuguaguuaagagcacuggcugcucuuccaggggaccuggcccugcuuccccgcaccuaugugagggcucugucaucuguuacucuaucuagccccagggagucggaugcccucuuguggcuucugugggcaccaggcauaugguauacauacauacauguaagcaaaagacauacacuuagguuaauaauaaaagagauaagaagagccccuacugaggcccuuauuuugcuuuccugucccuaggugaacuugauuuucugugaauaagaucugagauaaacagcugaggugcauauuuaacauaacaaagugaaccaggccuccagguucucccagccuccuucagucucuaccugguaaaaucugcccuccacccugaacuuuucagcccaggggacuaaacaacuucucccccaagagggacuguuuccuaaauaauccagacauuuuggcacccugcuuugaacucuaacucacucucucucucucucucucucucucucucucccacacacuuccuuguucuucccccuccccucuaucucccucuucaugaagacuucccuggccucuuucuugggaccaauuaacucaccugagagccacauaagagguuucccaauaaaccugccuuuaaauauacuuuaaucugcuugaauuagcucauuuucccauggagaaaugacuuuucuuucuucccuuuuauuuuccuugaauuuuuuuuuuuuuuuuaauuagaugggauuucucuguagcccuggcuguccuggaacucacacucuuuuagaccaggcuggccuugaacuccuagagauccaccuaccucugcuucccgagugcuggguuuaacgguuuccccaccaccagcauuacacacacacagacagacacagacaggguuccucuguguagccccggggcuggcuuggaacuugcucaguagcccaugcuugccucagcucagugccuucccugucucucugcugggaugaaaggugugcuccacuacagccugugagaacuccauccacaggcgcaagaguggaggucaggugcccauguuguacaacugagagacucagagaccuugaacccaauuuggcucaucuucuagggugugugggcucuucgcuguacacagcuaggggagcuggcucuuuuggggaaccucaggguccugaaucucgauguugcagguggguaccuggcacagagccuggccaucaugaccgacgcugcgcaccugcucacggauuuugccagcaugcucauuagccucuucgcccucugggugucuucccgaccagccaccaagaccaugaacuucggcuggcaucgagccgguagggaucucaguggaccggagaugggggcugaucaagagaaaauguacgggucacgauaugauuuuguuuggaauuuuacauguuuugagacaguguaguaguaguccgggcuggccuugagcuuguaaguaaccaaggcuacuuacccauucauucuuguuccuuaugucuccaccuccugaguccuaaaauuccaggcuuguauccuacccagcuagucuuggaguucucuuuacaggaucuugcuagguagcccaggcugacuguaaacccauaguaacucgaugucagaggcucccaagaacuggagcuaggcuugcaccaacccaaggaugccaagcuagaagaacaaggucucuuagggggaucccugaguaaggcuaaguggaguucuugcuccuauggaacaagagagugucagccuuggcuucuguucccugggaacucccuaucugucaucugggagcuagagguuaauggugaagccaaguucaccuugcuuagaaaguaguggcucagaauaaugacaguagcauugccugucaccagggcucagcucugggagaaggaagagucgguaaacacacugccuuagcugauaguucacuucuggguuggcgaagguauuucccucuagggagagauggccugguguccucagccuucaauugucaauugaacaaaacaaggaacuugggauggcccagcaguuaacaccugcuccucuuggcucacaacuccagccuggggagggggcugggggcugggggcugggagaggcagcuccaucugaguccccuucuggccugcuaccuuaauuaaaguagguagugacccuaccuuuauuugagaguuggggcgggggggggggggaccuaggcauacgcccuuaauccuagcacaagggaggcagaagcaggugacucuuaacuucaaagcuagccugaucuacauaacguggccgcaaagaaacaugaaagggaggcuaucaaagccaggcaggccccugccucauguucucggauuagagauaggcaccagcgugguagcuaugauauauaucaguguccauuucuucccauguagagcaaauagggugggccuagguagcucccucuagcuccgauguacccagacaucguuggugggaugagccgggucuuaaggagcugacagagagacccaggcccugacuuuacagugggagagcccaucguggaguggguaggcccuccuacccucagcaccccaggcucagguugcuguuguggcugggcuuucuuccagagauccuuggagccuuguuguccgugcuuuccaucuggguggugacuggggugcucguguaccuggccgugcagcgguugauuucuggagauuaugagaucaaaggggacaccauguugaucacuucgggcugcgcuguggcugugaaccucaugugaguguggccccaguucccuguaacacacacacacccuacaccaccccggccaccacugcaggccuccaucagcucccaagggaaggagucugugcucuccuuccaggagcugugaaugauggguuuagaguuuaaggcauucccuuaggacagaauuucccccgagguuaugaguucugauaccugccccacaucaucaucauuuagaucuuaggcucaggacauggguguuauggaauauaaugcagcaaguggguaccuggcagccccaugccaaggugugccccugaguaauuacgccaugcaacaggucugguauaaagcugguuaugggggcagggagaggagugaggaccugggaaagggaagaggggagggggguacagaggaggggggaggagcugggauggccguaguccuuuuauauguggcccacaccugccgcaccuggcagaggaugacagaagguccccagggaggagccuaauggagccacccguaagcuaacaauggagguuacagacaugcaccccauauuuuguguccaagaauaacauugaaggccaucacagcaaaugggugcaucugguccaugcuagaacagagguuaagucaggcugauguggcuaaaacaggucucgguagaaagggccgggugggcagagcauggguuugggguucuuccguuuccugucgucacuaucucagucuccccgcuuguaaccugaugggguguaccugcugacuucauugcccgcuuacccugagauucagcucuggagauugggcucagagccuaggcagagcucuuugcccuguggcacugagccagggcuguagggcuagauugcuaagccugagacggucacugagugcagaggcucaggaugucacucgucgucgucggggaggccagcccuaauggguagacugagccuggcugacuugaaaccuccccugggcuuugucugccuccacagaaugggguuggcccuccaucagucuggacacgggcacagccaugggaacagccgugacgacagcagccagcagcagaaccccagcguccgagcugccuucauucaugugauuggggaccuucugcagaguguggggguacugguggcagccuauaucauauacuucaagguuagaacugggcucagaaggagaggggcaggucaguaccuggggcuccucucgcugcacagggcuuuuucuauuuugggcucccucuaguugggaaugagaggguggggaaagggaaggaauguuuauuuaauacuuagcaggucuuggcaccucuuaugacgacagcaagccuuuaagguaggccguugucaucuaugugguucugaaaaguccuguaacuuguacaguuucacauaggcugugaagcuggaucuaagcucaggacugugaugcuaaagccagaccuugcccaucacacaggcagugggauguagaaugagccagguguguggccaaagcugugugaugagugaugugcuugggucucaccgaaccucaguuuucccaccuguaaaaugggaaugguggaucaaaugcugagauuucuuuucuagcuccgccuaugucucgacucuuuaggaaggugaguccugagcucuucuugguggagagaagaguagaaaauugacagacaugggccagagcgaggccuguucuuacccagaugagagaccucccugauacaguguuccugggagggaaguagggaggacccaggcugauacugacgaggcccggguuugucuccuccugcagccugaguacaaguacguggaccccaucugcaccuuccucuucuccauccuggucuuggggacaacguugaccauccuaagagacgugaucuugguccugauggaaggugacuuggaaguggggauguagggcuuugggagucugggggugaguggcgcacacggaugcagacugugugcgucccuuagguuguguguagaaaccagaguuugccaccagggugucuuccucugccuaauuuuguuguuauugguuuauuguugguguuuguuuguuuguuuguuuguuuguuucugagccagggucccacuguguagcuuugguuguuguccuggaacucacuuuguagaccaggccgaccucaaauucacagacauccauccgucugccucugccucccgagugcugucauuaaagcucugucaguaugcucaccucccucccagacuuuuuuuuucccucccagauuuuuaagauagugucuuaguuaggguuucacugcugagaacagacacaaugaccaaggcaacucuuauaaggacaacauuuaauuggggcuggcuuagagguuccucugauaaugguucaguccauuaucaucaaggcgagaacauggcagcauccaggcaggcauggcgcaggaggagcugagaguucuacaucuucaucugaaggcugcuagcggaauacuuaacuggcuuucaggcagcuaggaugaggaucuuaaaaggccacgccuauucuaacagggccacaccuccuccuaauagugcugcucccugggccuagcagagcauauaacaaaccaucucagauagggucucacuguuuagagcaagcuggccuugaacgcacacguucaucugccuuugccucugccgugcuaggauugaagcugcuaccauacccaccucacuuugguuuuuaaauuacaaguuagggucuuucacugaacuuagagcuuucucaaugcugggcuggccugcaagccaccugggucuccuuguccuucaucucccacccagcucuaggguuacugaagagguguguguuuguuuguuuguugguugguugguugguuuguugguuuugcauuggugccgggcaccugaacucaggcccuaauuucacccacugacccuucuccccaaagcugaagcucucuaauuagacuaagcugacuggucaauaaguccugaggaaucugccugucugggauuacaaaugugcacuauuguuugugugugaauguguguguuugugagugugugugugugugugugugugauuagugugaguucugagggaaucuaacagguauccagcacuguuguuaccagcugaaguaucuccccagcccgacuugggagcuuucccucaaccuguggcucacgaagucuaaucagccucaaggaugguguggauguuuggagaacucacacuagaguggggagcuaguucccagcugagucguagccagugcuuaucccacccuuagccccauaggcccagggcugccuccucccucugccguuuggaaugugucuuccuuggcuggucacaagacugagaggccuugguaacaccuggaguuccagccaccccucccccaacagucaucaggugguuuuuccacagaaagaccgggauucggguguauuuuaggaucuuugguuuucuuuggggggcagaguuugcaauaggaccuggcuggccuggaacucagugccagguuggccucaaaguuugccucccaagugccaggcugaaagcaugcaccaccauacccagcaacucuuuaaaaagauuuuacuucauuuuugagacaggaucuuaauauguaccccuggcuguuccagaacucacuauguagcccagacuggccucaaauuuacagagauccaccuaccuuugcugucugacugcuaggaucaaaggguggugggaaucgaaccuugguccucuggaagagcagcaagugguuccaaucucucuaagcccuugguuuugagaccaggucucuaugccuuggccuccugaguguuagaaauagacauaugcccuuguacuuguuggaugaaucuaucucagcucagcccuuucccacgggucucacggacugcauccuguuugugccccagcugcaaagugguaaauggucuuccggaaaccaccucaguucaccgggaucagggacaguuggaggaguggggcucaggccuaggauugauuggcaggggcuccaaggcgaggcagucaaagcauccaaugugacugaccuugcugcgccugguggggucacaucuguaaccccagcagcugaagcagaacuuuccaagaccagccugggggggcgguguacauagcaagacucugucuaaaaagcaaacagauuaaaaugaaaauggaaacaugguucugcucugggcacugaccuucuagcugugagcaagacagccuucugcucucaagaguuuccguucuagacacagaucaguuaaaccauuccaggggcuguccccuguaacaggacagagugggggaugggaaccacguggaaacugcuggcugaggaggccuucugaguagauggcccuggaggaauggggugggguugggggcggggggggggcagcgaccuucagcauuguucuugauguccucagggacucccaaaggcguggacuucacaaccgugaaaaaucuccugcuguccguggaugggguggaagcccugcauagccugcauaucugggcgcugacaguggcccagccggugcugucuguccacauagccauuggugaguagagguaaaggaagaagcgcaaggccuggggcuguccaggaggguuugccaagcucugaccacaugcugagcguuuaaaugcucuuugauccuccccacugcauuuauagggagagagaacuaaggcccugcuugggguggucagguccuuguacuugcuguugggugggggagacagauuccagcucucaggcuugcuggaugcgggacacccccuagugucucuuguccccuagucugugccccagggguagacaugagcccaagcaucccguguuucucucgucccagcccagaaugcugaugcccaggcugugcugaagguggcuagggaccgccuccaggggaaguucaauuuccacaccaugaccauccagauugagaaguacucugaggacaugaagaacugccaggcgugccagggccccuuggaaugacuccccagccagacaccgucuccucggaaacacggucaggaccuguggguagaacuguccggugugcagccgggauuccagcaaggcacagccuggaccacuccacgguggggcucuccuuagccucucugagcucacaggauggggacacggcagaugaggccccacuucucuuccaggaugguguuugggcaggguccugaacugaugucauccuaacaccaccgcuggagagacacugaggcacagaaagggauuuggggguguccuguaugauccagggucucugugucugaaccaaaaauugaacaagauccauguaacacgugaccggguuguccggggggggggggggguucccuuggcagggucggucucauugauaaaagaaccuggagcuggacucaggaggaagaucugaggcuauuuuauuagaauuugggagaaggaaaacaaacaaaacaaaaacccacaguccaggcaagccaugaaucucggcagcuacugaaggaaagugagcgagaagagagaaagaaaaucagggcuuuugaauuacggucagcgauggaguucuguaaacagcugaaugacuauaaugggggaggggggguuaaaggaacagugagaaagccacgcaugcgcacacacacaauuucaagaugagagaaaaaggggggaaggagaaaucgggcuucugaguuagaguuugggaagacaagcuaacuuagcaguucaggucuauaaacaagugucuguaaagugggaccccagagagccuucaguguccuaaucaaggagauaauuguuccuuagcaugucucugggugacugacaggcccaacugaaugaacucuaaaaaaacugcagagaggucaaaccauaacuugguggaguuuuuucucuccaucuucagguagucaggucugagccacuuucgagggaggcgugggggcuaugggagguaauguccuacucuuugggacacaucuucaucaggggucaucagggauagaaccuaguuucuauccuuuugcccaggaggaauuugcuucugagggagaugggucucaaggaccccucccugguuugcuuuacacaguugggagcagagcccuugccucugcuauauaacauggcuuaccaaggccauggggacagcauuuauacacucccucugagaugugggaccaaagggcacccaaggcuucucucugccuugcucacuuuggcugugggccccaugugacuuccuagaagaggaggagaaagaggccucuuuauagggaaaaaccugucugguuucuuccuuccugguaccccagcccaggaagccaagucaguguaucuauggccuugaccaaaguggcagugauagauuccaguuagaucuugcucucacagccucagggccaggccacuucccuugaccuaucucacgagauaauagaugcugcuguuucgagggugaccaugaccuaguuagggugaagauguguccagaggcugacaggaggggugucccgggagucugugugaagaauccuuugagcugguuugagguuacagaugcaagagguaagagcugucuccagucuuauagaguucauaggaagucccuucuuaggaaguuccaggccaauguuuauaucugucauugcaggccaacugaagguugucacuucucagugccugugacucauacagagaccaggaacaucaugacaucucccccacaggagugugcagacagccgagccugcuaagcacuggguaguuguguauuaguuucuuugaucaguguccuggaaaaggcucuugugaagggccagacgggcuuccuaaaguuccugcaauggcucuguccuggcacaguaaggagaaaggcuaggguuggccuccaccaccagcaccaccaccccaauuuaaaaaaaauaaauggcauuuguuuuauguguaugaguguuuugccuugcagauauauaugugccauguauauacuugguaccauuggauacaggaagauggcaucagaucccuuagaaggcaaaaaugguugugagccaccuugugggugcugggaauugagcccagagccaccacguggaugcugggaccugaagccagcgucucuaaccccugagccaucucuccagccccucaguuucuguuuccuuuuguuucucuggcugcucagguagcccuggagauagccucggacuccuccuggucuucuuaaaaaaauuuuaaaaaaugguuauuauugugugucugugcaucggugugggcauguguguuccauggugugugggcaaagaucagggaguugguucucucucucuacucugagcucuggggagggaauucaggucgcuaggccugucccuucccccacagccaacucacuagcccucuugucucugccuccuaaguucuggaauuagagguaggcagcagacuuuuuagauaucccacacuagccugcaauugccauccuccugcuucagccuccugaguagcugaaucccagcaugcaccaugcaccaccccggccuccucaccuuugaacuucucuccaacuguaaagaaaagcu

SEQ ID NO: 2187 - RNA, 3297 nt, Mus musculus
agaauuccaaaaaucugccuuucacacccucggagacuuaucacuccagcuugguggagaucugcucugcugucuuaacccucucucuccuacugcggcugagaguuugucggacaggaugacaaucuuaacccuucacuccauccucuggaucugcuccugucccagccgccucccacucaggaguucccucccacucagcggcuccccaaggguagguuuacuuacugcugggguccagggucuugcucacagugccugucccagaggcaggcugaggcgugggugcuugugauacgccaccugccuuucuccucugcuaccgccaguaagguggccccagguuggggacugugcugcugcagcuugccgggagccccaccucgcaaugggugagcuucggggagauacgggagcgcuaaaucgaagcccggucggaagauguccgaggaggggcuggccucagcuaccaucgccugucccagccuggugcaaggggcuggguagagacucaacaccagaugguuccggccuccguuccaguucggaggcaggggcccgcaggcuccucuacgauccuggcuggggagaaaaaggagaaggcaagcgucugcugggcugagugcagaguagcgggagccuuccaaggaauccaggauccugcgcugagccucagaggucggaccagccggggagugcacaaagaucuugaggaccuuuccccuacacuuggaggugucaaagcaggcuccccaggugcagcugcuuccccgagagacccgagggagcugugcgacaucuucuggguucgucucagacugggagaaacucuguaagaaggcagcauccagccagcggggccagccuugggagcgcccuggaagaggaccgggcaacacugccaggcgaagggggaagacuccuaggaggacgaggaggagccagaaggcugacaacgccagccagaaggacuuucuucuccacagcauguggccaccaacagcuaggacuagaaggaagugaggaauuucuguagcaaguggaggaggcgaccccaggcaggagggagcuggaaaucagccuucugguccagcgcucucaccauugaaggcagguccccuagcuaaguucgacuaaccauuggccaccugugggauugaccccucgugggaaguccaaggaggcucuggcuuucuaaauuugcauucccacucuccgacugcuuucucuaccuucacacaaccuugccacccuuugcccucucaucgggaccucugcccugggccacugcucgggcugaugcaacccuuguccagaccacaagaucguguccauuugcgcucaggacugcaccccugaucuuacccuugacccaagggcaggcuaucuauggagaacugucuggguucauggggaguggguaucgggaggggguggccaaggaugauguagaaggaggcaggacuguccucucccacucuucccucugccccaaaagcucuugaaaaaaacccuggcuaccccuguguuugguggcuggccuucuguggcagaacuauaaauagaccuuguguccaugugggccaccagagccagcugaaguuggagccggagugcaucccaugcccgccgccuggggaaugagaagguucggaguguggucuucuuccccucggcuauggccccuaacccaggcagcugcucugcacccuccggcuaggagcugucacagggcagagggcaagaccuacgcuccaaauuccuguuccugccccacagguccagccggcagcuccaggucccacuccagaagguaucaagucgguccagcucucuuucgcagcagcagcagccuggccacacccccgccagcucugauuggcuccuggcuaggaggcaggguuuccacuuaaccccuugcaaccucuuucgcugggguaccguuucguuucuuuuuccuuuuuuuuuuuuuuugagacgagggggguggggauguuccuguagccccgguugguuucaaacccaccuugcaaccaaggacuuugagucccugaucaaucugucuucaccucggagugcucgaaugccagcuaccugccaucacgccuggcucuggaagauuaauaauggucaggagggcaccauaccucacugguggcuguggauugacaguuugcuucucuccaaggucuuuaccagugauccaaaguagauguuuaucugccuuucccccccccuuuuauuacgauuaucauugucuauuuuuagaauugauguugugguacugggaguagaacccaaggcuuugugcacacuagacaaguauucuaucacugaauuacaucaccagcucuuuugucuuuuuuacuauugagaaaaaugaagcgcagagcagggauugccuuucuuaaggugacccagcuuugauguguccaggugaagauuugaacucagagccuggccugauggggccucuucuuguccccucggccacugaauggagcugggcagugucuaccugcaucuuuaaaauggauuaacaucauucccuuggaggguugcuauuguagguccuacaagagcacuuggugggguguccuucaacaaggaaguauccuuccgcuggccucuccuccuuggugagcagccugagggcagggcacagugaggugcccaggaacauccucaaaaugggaucaagaagaaucuggccucuugcaguaagagguaggucgcuccgugauagacagcugcucaggcaaaccgcaggcuuucucacgcaggagacaggugugggcaugcgcuguugccaucccaccaggcuuggaauuggcagaagguucccuuccucuaggaagcggcugagacuccugagucagagccaggacccuccuucaggggcucaagcuugcucuggccacauccauguucaaucaucuaagagauccuucgcauccuaacuuggaccagguucccagggaggcacuggaagugccaugcugaauaagaguaauaguguaggugacuauguccugagcacgcuggaaaugacuauaaaggagauauuacuaucauucccauuuuacagaagagaaaguugaggcucagggaacuugaguaacuuugccuguauucccauggcuuagccagguccuaagccaucuaucuauacaucuucucuuuuauucugaggcaguguuucucuauguagccaagaacacacuauauaaaccaggcuagccuugaucuugcgugucucuguguccccugugcuaggauuaaagguauauguuacca

SEQ ID NO: 2188 - RNA, 3297 nt, Mus musculus
ugguaacauauaccuuuaauccuagcacaggggacacagagacacgcaagaucaaggcuagccugguuuauauaguguguucuuggcuacauagagaaacacugccucagaauaaaagagaagauguauagauagauggcuuaggaccuggcuaagccaugggaauacaggcaaaguuacucaaguucccugagccucaacuuucucuucuguaaaaugggaaugauaguaauaucuccuuuauagucauuuccagcgugcucaggacauagucaccuacacuauuacucuuauucagcauggcacuuccagugccucccugggaaccugguccaaguuaggaugcgaaggaucucuuagaugauugaacauggauguggccagagcaagcuugagccccugaaggaggguccuggcucugacucaggagucucagccgcuuccuagaggaagggaaccuucugccaauuccaagccuggugggauggcaacagcgcaugcccacaccugucuccugcgugagaaagccugcgguuugccugagcagcugucuaucacggagcgaccuaccucuuacugcaagaggccagauucuucuugaucccauuuugaggauguuccugggcaccucacugugcccugcccucaggcugcucaccaaggaggagaggccagcggaaggauacuuccuuguugaaggacaccccaccaagugcucuuguaggaccuacaauagcaacccuccaagggaaugauguuaauccauuuuaaagaugcagguagacacugcccagcuccauucaguggccgaggggacaagaagaggccccaucaggccaggcucugaguucaaaucuucaccuggacacaucaaagcugggucaccuuaagaaaggcaaucccugcucugcgcuucauuuuucucaauaguaaaaaagacaaaagagcuggugauguaauucagugauagaauacuugucuagugugcacaaagccuuggguucuacucccaguaccacaacaucaauucuaaaaauagacaaugauaaucguaauaaaagggggggggaaaggcagauaaacaucuacuuuggaucacugguaaagaccuuggagagaagcaaacugucaauccacagccaccagugagguauggugcccuccugaccauuauuaaucuuccagagccaggcgugauggcagguagcuggcauucgagcacuccgaggugaagacagauugaucagggacucaaaguccuugguugcaagguggguuugaaaccaaccggggcuacaggaacauccccaccccccucgucucaaaaaaaaaaaaaaaggaaaaagaaacgaaacgguaccccagcgaaagagguugcaagggguuaaguggaaacccugccuccuagccaggagccaaucagagcuggcggggguguggccaggcugcugcugcugcgaaagagagcuggaccgacuugauaccuucuggagugggaccuggagcugccggcuggaccuguggggcaggaacaggaauuuggagcguaggucuugcccucugcccugugacagcuccuagccggagggugcagagcagcugccuggguuaggggccauagccgaggggaagaagaccacacuccgaaccuucucauuccccaggcggcgggcaugggaugcacuccggcuccaacuucagcuggcucugguggcccacauggacacaaggucuauuuauaguucugccacagaaggccagccaccaaacacagggguagccaggguuuuuuucaagagcuuuuggggcagagggaagagugggagaggacaguccugccuccuucuacaucauccuuggccacccccucccgauacccacuccccaugaacccagacaguucuccauagauagccugcccuugggucaaggguaagaucaggggugcaguccugagcgcaaauggacacgaucuuguggucuggacaaggguugcaucagcccgagcaguggcccagggcagaggucccgaugagagggcaaaggguggcaagguugugugaagguagagaaagcagucggagagugggaaugcaaauuuagaaagccagagccuccuuggacuucccacgaggggucaaucccacagguggccaaugguuagucgaacuuagcuaggggaccugccuucaauggugagagcgcuggaccagaaggcugauuuccagcucccuccugccuggggucgccuccuccacuugcuacagaaauuccucacuuccuucuaguccuagcuguugguggccacaugcuguggagaagaaaguccuucuggcuggcguugucagccuucuggcuccuccucguccuccuaggagucuucccccuucgccuggcaguguugcccgguccucuuccagggcgcucccaaggcuggccccgcuggcuggaugcugccuucuuacagaguuucucccagucugagacgaacccagaagaugucgcacagcucccucgggucucucggggaagcagcugcaccuggggagccugcuuugacaccuccaaguguaggggaaagguccucaagaucuuugugcacuccccggcugguccgaccucugaggcucagcgcaggauccuggauuccuuggaaggcucccgcuacucugcacucagcccagcagacgcuugccuucuccuuuuucuccccagccaggaucguagaggagccugcgggccccugccuccgaacuggaacggaggccggaaccaucugguguugagucucuacccagccccuugcaccaggcugggacaggcgaugguagcugaggccagccccuccucggacaucuuccgaccgggcuucgauuuagcgcucccguaucuccccgaagcucacccauugcgagguggggcucccggcaagcugcagcagcacaguccccaaccuggggccaccuuacuggcgguagcagaggagaaaggcagguggcguaucacaagcacccacgccucagccugccucugggacaggcacugugagcaagacccuggaccccagcaguaaguaaaccuacccuuggggagccgcugagugggagggaacuccugagugggaggcggcugggacaggagcagauccagaggauggagugaaggguuaagauugucauccuguccgacaaacucucagccgcaguaggagagagaggguuaagacagcagagcagaucuccaccaagcuggagugauaagucuccgagggugugaaaggcagauuuuuggaauucu

SEQ ID NO: 2189 - RNA, 2152 nt, Mus musculus
aagccauggaguucuuuuauuucccgauugucgugccagguguuuccaggggcacucgaagcugguggaggaaguagaaugaacccaggcuuagcccagggagucagggcuuuccagccucucugcuccucucugaccuugagcaggucccucccggcacacugggggcuugcaaacuacaggguaugggcuuccuuuccuugugcaucucuugguuguggugagaagcaacaagaggcacuuuggaaaagucgagagcaucacaugaccuccaggcuggauucuggaucccucuucauccaagauggcagugggagccuucagccugauuccuuccuuuucucauuuaucuguuccugccucacuggagaagcaccgagagccccuguaccagaugcuguuauuuucucagagacugaggauacccacaggcuccugggaaaucagagggaggagggagcaagucuaaauaaacaauaauuaugaugacuagauaugaggccuguuugucuugagucgggaucuugucauguagcucaggcuaccuggcuauugauggaaggccuucuagauggagaaccaucuuccuugagguguccagggagcugugaagaauagaaagaggugcuugccuguucucccagcacuugggaggcaaaggcaggaagauugggaguccaaagucauuccucaggaaaccuauuugccugguuaaaaauggccccagaagccaggcgugguggccuuuaaucccagcacuugggggagugcagcggcaggcggauuucugaguucgaggccagccuggucuacaaagugaguuccagggcagccagggcuauacugagaaacccugucucaaaaaaaagccccaauaucauauccaagggagagaucugugagucccugauaccuaucugacuuuccaggacaucuggggcaggugacaaucagccuccugaguuuuuguuuuguuuguaagucuucucuuccuaaagccagacaggccacagcaggacuucuggauccagcccuagaccaaaaagagcacagagagccugagggaacagaaaagggcgggggggggggggcggcgggcauugagugaucuccuggcaugcgaccuguucccuaagccauauguccuuacagaccacaacucaguaacccagagcaucccggggguauggaggggauggggguggggggugucuugcaaacacaaaccaucaaugaguagaaggccagcgggaccuagcucuuugucucuccugaggaaguauccugaagagagacacagggaauguguuucuggcuggcacuccccacacagugcaguccccacacaguggcagggaggacgcugacagaggcuccagggaguggcugugggccuggcuucuagaaagacagguuaaaaagccagcuucaagguaagauccagagcugggaccccggccaaucaguccuuuggccugguugccauggagaccgaccggcagcagcugcuaaggaaagaacaaccugcagcuucuacaucuaggauccguagacaccguggugggggaggggacgcauacccuccuuucuuccuggaugcugagacccuaucuguccccagcucacaggcuuucaggcucuccacugucgccaagucacaaaacaagagacaggacaaaccccaauuucuugccucuaggccaacgcccauucguuauaacauagccuucuauucagcuuugggagcaaacaagaccuucuagcgcugaggccuggggcccugggaggguuucucagucaccuccaggaaggguccauguccuuagaugugaaucccaguguauuagccacuagaggccaauuuggcccagcuuucugucacuuucucucuggaaaaccuggcuggccagagagucugugaacagccuuugucuggguagggagcuagcugaagcugagcccagaggcaaauggaaagugacaggguuuauuguccccucguuugaugcuauacugauaucauuaauuugcagccuggcuggcauccuucaggccgggaccuugcgggccaagccccccaccuuccccuuacagguuaucucaggaaaccccaggcgggaggggaggggucugggauccaagucguuggucc

SEQ ID NO: 2190 - RNA, 6255 nt, Mus musculus
cuggagcuccgcuucuuuauugaauggagacacagccucaguagccuagguuggagucuucaauuccccagcaccucccaucucugcuucccacgcgcugaaauuccaggcacacaccauuaagccugguccccgaggcccucucagcccuccugcuggcaggcucuugcuguggacacucagcuucuaagagcuuuaugcagauucgaggggcagacagacuguaagcaauuaguuauuucccaaaagggccaggaaagcugcccaugccuucccugagccgagaggcagugugcugaccucaguggaugucagugcugcucuccuguccucacaggugucacgagaacagcacaauuagguuccugagcauucugaaaucucaggaugucgcuugcggaagggacauagggugcaccucuccuccuagcugucauauuaagcaaacaaaccaucaaauauccuaagaccuuaaggacgccucuaaacuguucucuggaaaucacucugugccuguaagcagccuuucuaaggggaacaaaacccugcuuguuugcacguaaacaucugaaagaaaauaacagcugagcuggggaagacagcagaacaaagccgagcuugugugaggacaaucagagggccugggagcugaggacuggcugggugucugcagcagcaggaggccacagagaaaaggucuacggccugucacuaccugaacagaaagaagucacugccaccaacagcacugugcaguuuauuaaccauucaaguacaguagcaucuggugagauugggacagaauugggaucgcaaaguggacagauauucagcaucuaauggguuggaagaagccgccacauacucuucacaaacaucuuccacagucaauacagaacuagccauuaacccagcacaccgauugugcccgaguggaaaagaugcaacgagaaaaauagcuacauuagaaagaccaacacuuuaaaaaagaguaaaacacuuucaguuucuccccuugagccccuaaaacaucucacggucuggaucuaccuauacgguccuacaucggcuucuagacuaucugucaggagggaaaguaaaggacacuggccaguacagucuuuggauauuuaggacggggucggggagaaagucaguucucgggacaacuuagucagccucagucucauccgcggggucuuuggauucuuuguucuuccgcaccucuuccacgugcuuguccuggaagaaacuguacguaagugucaucuguccaaaaaauaacuuguugagcccuguccccugccuacgagguccaacacagcuucagucacacaacccauggaaaucccaaaccaaaaaucccgagacaucaucuuaaagcuguuggucucuuggggcugagaacagcuaggcucugacuguucucccagggaauaugcacucaugcugggaacuccuacugaaugcuaagccccaaacugaugacaaaaaggaaccagucauauuuuuauuaagacaguuuaagccgauucaccccugccugaagcugcuaacucucuaaagcaagaaaccaaccuucucucgcaagcgcuccagcuuggccgccaucugcgccucccgguucucuuuguuagccuccauuuugugggucagcuucuccuccgccaucuugcugaaguuguuguucuccucgauggcuuucuggagcaccuccuucucaugcucccgcuucuccgcgagcugcuucaagacuuccgccucaugagacugcaaaaaaaguuaacaggccccucugaaguaccuuuggcauuuguuaaaacugcaacaaauuauuuaucagggaaaggcagaaaaaagguccccugaaacuaaauauucaagcaaggagcugaaguaccugaaucacccguuuuccuacuauggaaaacuggcuguacauucaaaagcuugguuuugagacaagaucuuguguagcccaggcuagccuggaacucuguguauagcaagggcucaccuggaaccugacuuacucgcaucccucccagaguugggauuauagcuacagaacacaccggccuagcuugcucagauuuccuuccaaauuaccuguuaaggaaacccuuagaagaguuugaguaaaauuuuaaaaauaguuuuacuuuauugcuuaaaguauucagaugacuugaguaauaaucuacuuaagugcagggcaccuuugacaguaucuguccagaugggagcgucaccacguaggcaguuacuguguagucugacuacggaacacaagaccuagcucuccucucuaguuauauuguuuucuccugcuccuacaugaaagagcaggcagauggcacaccaggguaaaugcugacauccuuuuuauuuguguucugagacaggcucugacucuaggcuggccuugaacuaacaaccuugaaaaugugaucuucccaccucuaccauguaagcacucuugcagcagaaguauagccccagccaggcuggcuuccaaccguucauuuagcuacagauaauccugaccuucucaucucccuaccuucacuuuucaaguacuaggauuauagauuuacccagcuaaauccuccucccuggagauggaagagauuuuaugcacacuuauguaaaagucuuuuauaaaaguuccuaauaacaauacuguugcauggacagaaauacaugguaacaguggauaccucuaggaaauaaaaugacucuaauggcuauaguuucauguuccaacucuucuauaauuaauauuuguuaaacuuuucauuaguuuuuuuuuuuuuaauguguauggucuguauaaaaauauaugcauaugugucaggccuuuagaaaccaguagagggcaucagaucccuggaacuagaguugcaggagauugugaacuacccaaugcaggugcuaggaaccauuuuggucuucaugaacagcaagccucuuaacaucugggccaccucuccagccucucauaaggccuuauuucuuauguauuuuccuuuaugugcauggcuguucagcuugcacauuuauuuauacauguguuacuugugagugugguaccauggagacauggcggcagcuggauccccuggaaauggagcugaguguugugagcuaccccaugggugcuggcaaucauggauucucuggaagaacaggcagcuuuuaacugcugagcuaccccuucgggccucauuagguuucaaugacgguuagguuacuuuauaaugaacgugaggaaacgcgucccuggaauuuuaaaguuuuuauugcauagcucuuuaaaaacaagcaaaacuaaggaaacaaagggucacccaccaccuaauguccuguuugguaaagagaaaaggcgugagcucuucucugacguaacacagguuuagcuuaaauucugccuccagcacuuacuaacaggacuucaggaaaaugcccuaauaccauuuucaagucuguuaccugagacaauggccaccauggagccuccauuuauuacgagaaagcuccugaggugaggagcuggcucgagcggagcucauuaaacgauggcugcugcuuccuuugaaccucuggcacaaggacauuuccuacuuaagaucacaguguagcuacaauccuuucuuccuuuguaggaaaaugaaaccaguuugucucauuacauuaauaaguuuccuguaucuccugaaaaucgucaggguuaccuugcgucuuucuucugcagcuucuaauuucuucuggauuuccuccagggaaagguccuucuucuuugggggggaaagggggaaaucggggacagauucuuuugaccgagggcugagaaucagcucaaaagccuggccugaagcgcgcuucuccagcucuuucaccugaauaucuggaguugaucagaugcaugauaaugagaaagacccggcuugcuuauuuaaauaaaggguucuauaauuuuuuuuuuaaaaaccaauaauucuaaaaaacaagcagaaugaaagcuaaugaagguguuuguaguaaucgaaucaaaauacaaaucaaaagaaaucaaguaacauuuuuuuuuuaaaaagcuuaacauuuuggacuaacaaauaccaucuugaggaauuaguacuugacagucacucccuaggaaacaaagaaugguguguguaaaaccccacauuuugcuuuggaccaagccaaaaguaugaauggcugagauuucuauauauuuauccaacuaauaaacauuucucaauugcauuuuuacuuguaaauuaaauuuugaaaagaacacaaaugccaaauuaaaagcuuaaggccugcaccacuuccuauucuaaagccauaagcccgcccugauuucaguuuucuaaaucaauuaccuaccagaagaugccaugucgaacagaagacaagagacuggcuguauacucuacacaauccacuggcaaggaaagcccuggaacgauuuuucaaagcaugcaaucaauuucuccacauuucuccuaugucaucagcacaaaggggucucaaaucacacccuugacaaugucaggaaaaucauuaugugaaaaucaagaaacaucauuaaaauaucaaucuagaaacacugggacauauugagauauuuucauugaguaacgcuggcagcagaaaaucaaauuaaaugauauucuucaaagaaagaaaaucuuggaauaucaaaacucagggguucaaucacaagguugaagaauuccgucccuuaauguuuuuguccugcccaacauaagauauuccagauucaacccaacaaugagaucggagccaucuuaauucugucuacaacucauugugcaauugaaauacccaccccugcuuugucugugucugccacggugaauaacacccaagcuggcagccaaugauauucaaguccuauuguuccuaggguuuaagcuacuagccucacagugagaaaaugaaguuguaugaaccucuagguuucuuuugagggcagggucuacuuaauccaggcuggcuguaaaauuacaauccucuugccucagccuccucaggguagaggggugggguuuagcccacuggguuaacacuuaacauuugcaaagcccuggguuccauguucgaugcauacaugggcggggggggggggcagcuucugaguguugagauuacagacaagcgccaccacacccgccugagguuugucacauuugaugccuuaugucgcaaacauuuuuuucaacaguucucgaguauuuuuuuuaaaaagaucaccauucuuuuagccccgaagcguaugacuaaagguuccaaacacuagacacugcaaaaacgaagcaacgaaaaaaaaugcauuuaucuguagcagagcacccaacgcagcagacuacacagcaugggcgugguccuggcccaggcgggcaggcuggcggcccgggccaaucagaacacgcccuacgcuccggccccuggccccgccccucggcuccccgcgccuuuucgaaucuccgcgaaccucuccacgcucgggagcccgcgcgcgugggcagcgacagaaugggcggggccaacgguccuccgggguggccccgccccucucgggcuggcagcgcgcggccgucugccccccaacucccgccaaaaacaccucgcggacacgcagcccugggguggcuguagagggcucggucgcacggccuucacccacugacggagugcccagagcuguccgggaccaccgccccgaagccccgggagaccgggcgggcgccgccccucagcagcacgagcgcccccagccucgcucuccuucagacaauggggaccccccgaacagccgcgcccgccgggcgguagaugcagaggacggcucacgccuccuauugucuccacgcucgcacccgggcuaaagcccagcgcuggccgcgcccccuccccuccagcccgcaucuccagggaauagggacaaaagccaaggcuccgcccgagcuccacacaaaagaccaacgccccccacccgcuggggcucggggucuccgcccaucuccugugcccggcugggggacccgccgcguucccggcugcuccccagcccgccguagccuccgccuaagccaagccugcacccaccugcucgguccgagccgccuggccacacucugagcaccaacagaccugggcgcgcacaaaagcgccaaacagcggcacgugacccagaccaggcgcuccgcauuggcugcg

SEQ ID NO: 2191 - RNA, 9840 nt, Mus musculus
aaaaaauucaccauuucuccaaauccuucauuuaauaucagguaaugcuucaacucacacacacaguauucauaucauagagaagagggccccaagggccccugagugagucaugcaugaugcaguaaauaaagucuuggcccaacccagagaaaucggucacugucuuagaaggaggauaccacacucuuucuccucauuuuuccuuccuagauggacuuaguccauggaagaagaaaauuucaaucaguggaacugaggaggcccuggaggguagaucagguuguaguuuuauaaaauauguuuuaagaaaaaauaggccaggccucccugcagcagcccagauguuggcugguccaguggccuggacucuguagcuagaggggaagggugacugcugggcacuggggcaggucuaggauggagcagcagaagaccuuccugugaacaugaacauaaauggccgcucccccuuagcccaguggcgcugcagggaagcugcugagagccacagcugugcacguguccagcgagaccaauuauggagacuaaugcagugaguuaauuaagucguucauugagggcuuaguuuucagagacaagaaaaaacaaacuucaccccuuaagcagauacacuccacucuacccaauuaucuguaacaaaugcuucaucucaaaaaaccauagaccuuggcuccugccaaggcuuaagugcaggaaacagcgaguaauccagcucuucucuucuagcccaagcccuagucagcaagacgguugcagaucucggagacagacaucugcggugaggaaggcagcuauugaaguucaggagcaagagacaguuugcagucagugcugucaguucccuuuucuacugaugucuucuuccuucagggcaaacuuccuccugaggaccucagagaugaggacagcagggucuucuuccuucaguaaacuccggcuccugagacacaagaaccuguauuuagggagcccuugcucuguucugggucaugguguaugugcacucuuuacccugaaucuucacagcagcucugggaagcacuuaccagcgcauguucccacgccuauggaagauucggcacgcagagcuggaguuacagucucuguuuggccuaccugaucuggacccaucucuuaacuagaaugccuauauuucuuacacagcuacaaaauauggguaaaaucaaggccuaucaauuaguuggaguucugaucuuaucucaaaagggucuucaguaaaugacugauggcucagccauucugauccuuacuaguccuggagacacgacauccuggagaucuuuuaccaccaucuucccuuaagugagcuguuugguuguggguuccucccaacccccgcccuuaaaagaccaaaaucaucuacauuauaaggaacugugggaacaaauugaacucuaaaguaggcacacauuuauauaaaagagcauccuggaugcucuggaaauaguugucugaagcugcuaauuuuuacacuuaucuccugaagguguaauuuaacuggucuuugaagaaauaccugaaggucaaagauuaacuucaaaucugaaaguaaaacaaggauugucuuuggucuaucacauuaucugaacuuuugcugaccuggcuaacggaaucauucuuucuucuauuagagaaaaagaugccaagacacaugugggacagguuuggcaaugguuuggauauaauuugcucuaagaagccaaauacuagaagcugagcuggugacaaaugucucuguuuguagaacucgggaagcagaggcugaaggaccacaaguucaagaccagcuugagcuacacagacaagaggcaagguuuagaacaaugaguagaagaaaaggggaucaagcugggugugguggugcuuuaaucccagcacucgggaggcagaggcaggcggauuucugaguuugaggccagccuggucuacagagugaguuccagaucagccaggacgacacagagaaacccugucuugaaaaacaacaacaaaaaaaaaaaaaaaaaaagagagaaaagaaaaggggaucagggucaaccaaaacgaagugacgcagcagcugaauuugggggaguaagagaucagagaacccuuacgugucagauaggaaggcuggaguggcaagcuuuuugcccagcacucacaaggacaguuauacugggcacccaccaccaaguuccaccuccaacuaaggugcucaagaacaaggcccucggggcuggugagauggcucaguggguaggagcacccgauugcucuuccgaagguccgaaguucagaucccagcaaccacacgguggcucacaaccacccguaaugagaucugaugcccucuucuggugcgucugaagacagcuacaguguacuuacauauaauaaauaaaugaauaaaucuuuaaaaaaaaaaaaaaaaaaaaagaacaaggcccucuguagagucacucgguacaucuggagcagcugugaaggacaggaucccccaggcagcugcagagcuugucuagcaggaagcuucucaggggcuccgagaauggccuugcuucaaacuccaggccugcucaaauucccucaggcuugaacaaagucccacagcuucauucucugggcauucugcuuuguaaguuuaauguguacaaaucagggccgggcgugguggcucacgccuuugaucccagcacuugggagguagaggcaggcagaacucugaaaauucaaggccagccugggcuuuacaggaggaccuugucucaaaacacaaaccaaccaacaaacaccgcccuaaaucaguuuugguaagcagccagauuuauaugaauuuuacauaauauauuuuauauaugaaggcacgaggugguggcaaaugccuuuaaucucagcacucaggugcagaggcagccuggucuacagaggaguuccaggacagccagggcuacacagaaaaacccuguuuuuuuaaaucuaaaaacaaagcuugguucucaagucccugaacuugaagguuuugcauuauacaguacuauuuaugagugcaagugccugcagaaagcagcuagagauguaagauccugagcuggaguuacagauaguuguacuguggguacugggaaucaaacuuggguccuuugcaagagcgcauagugguuuuaaccacugagccaucucacuauuucaacaauaaaaccuguuaugaaauuuuccuuccaccaaagucuacuaguuugagacaccaguauguccuaaaaaccucgaaaggauagagcaugggaaacgugguagcuagcagcguguaaacuaagugcucuccagcuccauagcugcagucuuaacacucgacugagguaacuaguagaacaaaugcaaaguguugcuuuuuccucaaacuagguccuagucacucagcaagcuuugugaaugcagcaaccaugaaugcgaaugugaaugcauucaucacgagccaggaguaagagauagccagagcuccugucagauacucacaggucuuggcucuguuuuauccggugaaaauccuucaggaugcccaucaugucugcaaagcugcuggccuuggacagagagaugcagucauccucuucagaugagcugcagguaguuuuguguucugguuugcaacacucagggcuggcagaacaaaguagggggacgguugggagcucagggaccuccaccuccgucuccucggugaugucacuaaugacaaaggaaguuguagaguggagggaggacccaaagcaaggcaaaggcgaagagacauucgaacuuccggaagagaagaaaucugguguuaaugaagccgaagcugaaagagaaaacaacagcaggcaucauggacacugggcugcaguacagccacaucucucucucucacacucacacacacacucucacacacacacacacucacacacacacacauucccugagugagugccacggguggaauauccucaagggagucuucccacugagagcugaguguccggaacagaaaccccaucccacaggaagucaugacuucuaaaugcucccauuuccacagugggauacagguuugaagcccuauuucuguuuuucccaagacagcugcucuguguggcccuggcuggccuggaacgcugcagaccaggcuggccuggaacucacagagaucugccugcuucugccucccaacugcugggauuaaaggugcacaccaccaccaccacuggcuggaagcccugguuuaaacagaagccaagcaaggccugcauuuccuacauuugucauuuucucaacugugaugguguuuugguuuuacauuuugaauuuugcuaucuaugagcuguuuuagacaaaaucucccguuuuaauugaaacagcucuuuagaguuccuaagaaauguuauuacacuuauuuaaguguguagguacagguuuaccacagaguaggucaggacaaccugcagcagucuggucuuuguucccccauguggguccuagggauggagauggaacuccaaaaguuaggcuuggugacagugccuuuaccugcugagcaccucagagcccugugccuaucuucccgagucacagacuauaaauguucuccuccguaucuugcucauuaaucaggggcagggaaaggacagccugcuauacacuacuugcuugguggggcuccuaccugcgucugccgccacgauuuuagcgaucuggcugcgcagguggcugagcucauccugcagcucaguggugcggcucagggcaggcagggccggcuucuucagggccaggagccucuccucagagccacgaagguugggcacugaggcauuacguugcaugacaaucagagggcuaggcuuccagguaugucucagagggcguguaucacuccugggccagaggaagagaaguaugucuuacuacagacagcuagcugcuguaugucacugauuaaauuccuucaccccacaguccacuccccuguaagcccauaacucucaauccuaucgccccucagcaucuuauaagcacccuccuugcugacacuucugguagaaacugcccagcacagcagagcagcuaccugacccgagcauauguuuccucuucaucugcagcaauccaggcaaugucagccagaguagggacuggagggacaucuuucaaacacaggucagagauguugggcagggucugugagaaagcaaaauucaacauuuacccaacucgaugaacuaaucagaugaaugcaaaggggacccuaauccagcacuuagaaaagcuuccuagaguaaggacagguuccugcuuacaaaucaggcuauuuaaugggacuggccugaacugccccuccacccuuuaaagugcugucugcaugaugucuguaccaugugccuaccugguacccacagauggcagaagaaggugucagaucuucuacaacuggagcuacagacagcugugaggugcccuauggguucugggaaucgaaccugggucuucuggaaaagcagcugcugagccaucuguucagucccgcauacuaaauaugaaugcuacucacauauacuacucugaagagccugcauccguaacugucuuggcucaguagcaucuggccauggauacagucagaagugagggaacgccuacagugucacuacacagcuguauucccuuugcuucugaguaaccaggaccuucccaugcuccuuugacaguucuggauaguguucaguaaugagacacuugucugggaaccacauacuucccaucccaaucuuaccuaccacuaacccugacaccacuucuaacccuggacucaguuccuacacagacucacucaacuugcucuuucguuucucuuaacaccuaaggcucagguccucaugcacauauuuaugucucugcuucccauacuugcaccauaaccauccaacacagggcuggugccucaccgcaaguucuuaauggaagcaagucuuagagaccuuggccagucaggaaucucuacuguagaguggaugcuuuuaaagccuccauagagacagaguaaaguggcccaguaaucgaguggccauguuugcacagaagaguauggggauuugaggccacagagaaacacuaaaaauagaggcaaagugguccacucaggagucacagcacucacggagacagagacacaaggcacagaugccucagauguaagucaucuggagaucugguuuagcaaaggcuuuggggccugcucugauaaaaaugcauugcuggaagcuuauaaaaccucagucacuuaguaguagcaacaaauauaagaugaaagauugucaauuuaugagcacucuggaagucugacuguuguggucacaugucugugugcaaucagaaaggcaguguccaggauccauuauaaauacucaguaaaucaaagugaccaggaaagcaggcaaaaagaaaaaaaaaaaaaaaagccuuggcaacuggcaagauguggaggcacagaagcagcauccaccucccauacacagaacccuuccuguacacucaccucaaaggaugcccguggacagggcuucagggggagauuggucccaauucuucuuaccacacuucgagcagccccauguggcuuguuuugccagauugggauagucuagagaagacagacagacaaccccaaaccucagagugaguccaacuacuguucccugccugccuuucucuuccuggaggugagucaagccaauuguuagggccagucucagucucuacagcugcugcugcuaacauaugccaaugguugggagggucuagagaaggaacuagaauuagcaggugguauggcuguucuggcucccucauguuucucuguacaaaaaaaaaaaaaaaaaaaauagaaaguaggacccagccuugcucaaauggcagggcuucagggaaaagcaaacaugaacuggugucucagggacucauaucauucuuaagccaguacaguacucggcucucuagcccccagcuugggccuccuuaccacauuggcuuccauuccugauguuucagccagcuccuguaccugaaggacgaggcacccacagggaaagcuggagggguggcuccuucauaucaggccauuuccaggagcacgagguuuccuuuccugugaaacaacccccagagaucagcagcacugaguggccacaaaauaagccauuacuaaaaccagcaccgccaaugguuaaaggaagaaagcuagccacgaaggcugcccuuccuugucccuggcuuuucuaaacccagacccauuacaggcuacauuucagaccuguugagaaagcucgaccaaccuagggaaacuuccaggcucuaagguuaacugaggcaacaccuccaagauguagagagagcacucuggugguuacaaagcccaacagagagcaaaaccaagaaugccguccaacuaagcauuuauucuugagaauucaaguggguaagaaagauucaacggccaacucgugcuaauuucagucuacugggcuauggggaaaagagcuuuaagugguuggaauggaucaccccacccccaacuacaaacauucugucacagaaccacaccuccagccccaagagguuuuguccuccucaucuaugacugugucuuauaaugcuuuuggauguugcuuucuucauugguaaaauggagaaagguaaaguugccacucuagacuacccuaaaggucagugaaauugggugggcaaagugcuuaacaaaauuuaaaauaagacaguuacucguaaauuuugagaauuaauuuauaagguuaauauacaaagcaguacuccuaacuguacccuucacagcugcccuggcacggagguucaauuagugagcguuuaugucuauuaaacacaaaaauacccacuagugccaggcaugcagauauuugugcuuuuaaggaacucaaguccaaugggaccugcaggacccggacacauuuuucaaugaaaggcugggucucauuaagagguaacuacagcccagggccccauggugaguuuggagagacuaggaaagugaaagucuucuaaagaggacagagcaucccaagggauugcaaaaggcagaccagaggucuugugagagucacuggagaaccuaggucuggcucucaacagugaggagaugaacuggauggucggcaucucuuaagggagagcuggaguuccucuucugccuuagagaguugucaugagaguauacauggagagaggaaagaacuugucuagccagucaccaaauggcuguucaguggacagugucuaaagucugguccagguucugauaugugcagccauguucaagccuacaaagucccugugugccagacuucuugcuaaaggccacuuaacugugcuacuccugccauuacgcccucuccuguccugcuucaucuccaaagacuccaaccgaaucuaaaccucggguuuaacaagcugccgguucuauuacucugguguuuaaaucuuucaacucucuucuagacuccacaguccugccagcaggauauaccccaucuuccagcucucuuaagaccaagcucuaauacaguuuggcaaguacacgaucugcgaccauacucacucccuagucuucugcuggggccaugcuacuaccgggcuaccagcucccaacacaccuaucugugccccagucuauaccacugccucugugggacccaacuuauccagcuuaucucagucccucagcacccagcucauccaucacucugucccuggcagccugggguucgcaguucacuccguggcagccuggaucgccuuccgagggugcucaaaacagaaauggaaguaaccgaacggcccauaucccggccuccggcagccgcuguaagcacuuggcuugcuuuuaagaaaccgcuguaggcgacacuaacuuggcuucgaggccccgccccccgcgugcccgcuagacgcucuagccgguuccgcagccccggcucucccuccgcacaucggcgcugccgcagcuccuucugcgcuggccgugcccgcgucuucccgugcggccacucucggcagacccucucugcuccgagagcgccucgacccggcagguccugggccagggagaaacuuuagcccagcggugcccggcggacacccgggcagagcgcgcgagggucucacgaggcgccgguggccagcaagaugcagcccccugcgcccucaacgacggguccccacccccgcgacggcgacccggcccgggccaaggucggccaaguuccuaccgcgcguccagcggcccuuggacccgcgggccgggccgggccgcucaguagccuccaggccggcguaggucccagauacgccgcgcggcccggggcguaccgcgcuccaacggcuggggcgaccccaaccgcugggugacacggccagcaacuacgccuggggaccagugcccucaccgaggggggcagacagcggcgacucccgcgagaacuugcacgggaacagggaacgcgugcuccccugcgccgggacggagacgccggcgacggcccagggcgcucaccgagcccgucuccugugggaccccgcaucgggcuuagcccggacuccagcgccacacucaccucagccccuccuaccccagcgggcggcccggccucgaagucccucacuuccgcugacccgccuccggaagcaaucauuugcagcugcgcggcgagcaccacgcccaggagaggcgggccuagagaggggcccggaaug

SEQ ID NO: 2192 - RNA, 2822 nt, Mus musculus
acagauuccagaaccuuuauuugagaacauuuuggaaagcaacaucuuuggucaggauguagaauuagacaccagagguucgccaaagcagcucaggaguugcagggcugcccucugggaguaaggaagacccagcacacuacaacuugugccugcugggaaguguggaaccagggccuugaugaccugcaaauuccugugcugccugugaccugcggcuccugaccucuucagaaggcucccagaagccuucuacuucugccuugauucagucauuaccauacggagucaggaagugccugggcaccuggucauggaguggcucacacagggcccccaaaagcagagcuaccgagccaucaagagcaucuucaacuuucuacuucuucucgugagguccaccuggaccauuccgcacuuagcagacccaccaggcaucccgugcaauaccccucaacccuguuucccacuggcguaggcaagcaugcaggaccagugacuucuggggaaccaugcccccgccccuggacuauuauuaagggucaagagcagaggccucuugucauccacagacagggccaagcuggugaucagcagaaaugcgcugaugguugccuagcagcauggccucgugucccagcccacuucugucugggccggaagcuccaagcugcccagcaguguuaugcuggcauuagggggccccaggagcuccccgugagcaaugucauguucucuggguguucuuagugaccugcagggggagggccaccucaggacacugaacacaugggaccugaguuugaggccugugguaauuaaccucuacgauccccacaaaggcagauaugacuuggcagccauuaggucaacucaaacucacuaugugacacugcaaauguucccuuccaguccucuugcacuggcacccacugucccuccucugauaaaaccauccucaagcuggcagggaaaaggaaaagacagggccuggugcaaugggcacauggcccugcagagucccauggugggcauguccagggcagcagcccaaggugggcagccagcuggguaggcgcagcauagcuucagccaauggaucugcgcagugggcaccugccagugcuaacuguggaaucagcucccacgacguucuaaacuccccacuacuggugcagaggcagaaauaagcuuuggauugagauaccccgggguucaauuuccagacuuaccucuuccugaauguaagccugaggucggucaccuugcugaucuuuccugucccucagauaucccagagaugaagcgggacaauagaagauaccucccuacaacuuauuggucagggaggucccagaggucacccaaauuaguugguaagauucuacugcggaagacacacucugcuugcucugacacagacaucagcugaaagcuuccucagagcugacuagcuuucagagcugucgggagccaugcaggccaggggagggagaaaacacaucggucgucuuagcuagcacccaauccuccaugcuacaagaccgaccuaccaugcccgaucugcucccucaggcaauaauagcaugaagguuaugaauaaccagccccuuuggcauugaagaccuacucugcaggaauucagaccuuguaccacaaaccuugucaaaacuccauaguuagaccagucacgggccucaugagggacuucuuacuguucuuuugcuaaaggacacguaaugccacgcuggcuucugaacacucaugucuguacccauggaccagcgcucuucuuacccuuggccagcauggcuucucuccacagugggcagccguuacugcagacgccuaauggguuaguacugagacaaguggcuucucccuauacagggcguuagugucaaccuuucucauaucucucucccaaggaucagggaacacugggaagaggaggcgcgcuguugucuagacgggauauagacagcacagucaagaacucaccacggccaugacuaccuacacaggauaaagccagcaggaccagccaacauuccaacaggcaggacuaacuguacucuggguuacaaagaaggaaaaaagaaagguggcacaaggaauguguuggggguccugggaggaggaggguugaguuggggguacacaggaucaagacacuguuuacaucuauaaacuugucaaagaacaaaugaaagucauuuuuuuuaaauaguucuaagacuaccuacuacuacuaccacccaccucccagugugccacagcagacugaucucgccaaggcugggcacaaggguccugacaagguuaguaguccuuccuacuagccaagcagguugccuguucugcugcaccaggcaggguaaacccagucuccagccugucccaggcacggaagcugggaagccccucugcaagguguaauugugacagcgucuccuggagagccagcccaacaugcacccagagaagcugaaggucacaucaagucugaaaggcagcuuuguucuuucacuaugccuguuaugcaugaaagagcagacggcugcgcucaggauccauaauuugagacauccggagacuaaaggcguuggccaaauuuaaaccgaaagaugagcuuguugggugucuuuucaaauuaugggggaaaaaggaaggaauucuauagucugcucugauccaccgggccucucagggagucugcacggcggcuggcaucagaaggcucugccucagcauacuugaaguaggccuauucaauggaaugaaggcauaaaugcccgagacccccacaagccacagggagg

SEQ ID NO: 2193 - RNA, 1308 nt, Mus musculus
ccacaagcauuuuuuucuucuuuuuuuaaagauuuauuuauuuauuauauguaaguacauuguagcuguccucagacacuccagaagagggcaucagauuucauuauggaugguugugagccaccauguggucgcugggacuugaacuugggaccuuuggaagaacagucggcgcucucaaccacugagcuaucucaccagucccacaagcauucuuuauugcugagccauccugguggccacaguaagguuuuuauuucuucacuuucgcuguauauuggggaaggaggaggaaggaggcacgaacaaagaguccuuauuucugucaucucccucuaaaauccagagcuucuguaaaacccugccuaauuucuaagaacaccaucucccaauauugaaauagcuauuucguucagugcuguucacuuacccacaguuuucaaggucagauaugccucaugacauugaguguuuggaauuugcccuggaaauaagauuaaauguccuguccuaaucacacuugucuuagaacagaccuaucgggcucaggaaauggcuuacuauuaagagcacuugcugcauugccuagcacaaagucuggguucccaacacccccauacuugguggcccacaauggcucugucuucgguggcauccuguacacacaaauuacucucucucucucucucucacacacacacacacacacacacacacacacacacacacaaucaaggaucacuguugcuccucaaaggucaacuguggucguuggaauuccugucucgaccucaaauuaccuuaauuagcucaaacaaggccguuaaagcagccuuucuaaauuaaaacuauaucuucgggguccagggauaccccucccaaucuccaccauaggaggagccaagaagggaagcugggcagcggcugggggagggaggggacgacacaugacccggggacgaccgaggcacgggaaccgacuuguccucuguguccuugauccagcuuuugagccggcuaaauucuuugcuacccucuccuuuucccgaauuucaaaaucgaaagcaggaaaggaagccaaacuaaaccaaaccaaaccaaacaaagaaaaacaaaguugggcgugguggcgcagacccccuagcugagaagcagagacauggggauugccgcgaguucgaggcgugacagggguacacagcuagcuccugucucaaaaaaaaacucaagauccaaaagcagccaaggaccccacaaacaaacaaacaaaaaacccugaaguaaacaaauccucaaaauacccggaug

SEQ ID NO: 2194 - RNA, 867 nt, Mus musculus
ugcuaucaucaucaccaccaccaccaccaucaucaccaccaucaucaccaucaccaucaucaucaucgcagcagcagcagcacagggcggcauagaucccuaacuggccuugcacuuuguguugcugaggauaauucccgauccucccuugucuaucuccuggguccuaagaucucagguauguaccaccaugccuggcucgcuuuuaaaucuauugaagaacccccuguggcaaugaccacaggaugcugagguggaaugggagacggggagacggggagugcucgcucucggcuccacacaaggaaaguaaguucuaagaauguucuagaaagagaauggagcuagugagcugcaugcugugagagacagacacuagacagugaggaauucagcugucaaauagggcaggaggcuaaagcagguccaggggccagggcagagucagcuaaugggcaagguuuauggaauaaaugagagagagaguccgaggcuguguuaugaucccgcugaggucaggccuuggagccagcaucugggccucaggcugugugaccguggaguucccugaggucaacugcucaccuguuguguggagagaacaagucaccuccaugcucucucuccucagcuucccucccucaggucccccaggguuggucaucacuucuccauugcuucugcccucacaagcccauacggccaugcuggugagauggcucgccccagggaaaggcacucaaaggccgcuaaaccuuuuccugggaagccacacggagaagaaaagaaccaguuccugcaaguugcccucugaccuccagaugugugcugacacaugugcacucccauaaguaaauaaauauacua

SEQ ID NO: 2195 - RNA, 21552 nt, Mus musculus
ugugcgccggcgcagcgcgcccccugggcgcgaggaacccagggagggcgcgaggcgcgcgggcccgggagcgcgcgcgacgcuggcaaccucgcucagcccuaggucaccgcccgugucgccggcugaggcggccgcugcggcccgcguugagggcgugguggcuccggguggugagggucuguccgccccaggccgcgcucgugggcauccccccucgggccucuccccucgagcgcacaggugagucuccccuucgcagggcggggccgggucgcggccgcucggaacagguuugcagcagcucugggugauggauccccaggaucccugaaaguuaaagcagccucagcuagagcagcagcugcccagauccuccaggaacccccuagacguugcuaaggaccaaccgccugaugcccaggaucucccccagcagcuucgggguaacguccugcaaaacaacccucgcccccagguccuuucuccuccaccagcaauuucuccacccgcaguucgacuuuuugaaagaugucaggcccaaccuggccccccccucccggagggcagggaagguguggcuaguaaaacccuccuggcagcagguggaagccccacuccccucucuccuccccucccccaggaugcaggaauccucgugcuucucugcuucccuggcaucuggaaacuuguccgcuuccucuugaacccuucaauagcugucuguuuccagguugugggguuccagcuuccgugcgaaaucucaucaucuccucuggggauuaagauucuagcggcucacguccauguuucagauucaaacuaggauuauguagagugauguuuuauuguaggguuuaaaaccaaauauauauauauucgcgucccaauauugaaggcuaucuaggacaauacauuuacuugaacuuuucguagaagucucucaucuacuaguuggccagagaaguaauugaccaucuguagcuaugauuagugauuacuuuaaaauguuauuuuaagaacuggguguggcacacguuuauaauauuagcaagugggagacuagucuggacuacauaauacgguccugcccaacaaaacaaaauaaaaccuaucuuaacacaaugccauuaccucuaguccaauauaucaauauguaguccuaugagauggcucagcugguacagacagacacacuuacugcaaagccugacaguuggaguucccggaucccggggaucaacauggcaggaggagagaaucagcuuuugcaaguuguccuuugacuaauaccugaguguugcugaggccacagucaaacacacauauaaacauucaauaaauauauguuaacaaaauagugugccgggggcgggggauguccacuguuaagagcaccuacugcucuugcacagaacugggcucugaguccuagcacccguauguaacuucaguuccaggugaucccaccccuccucugaccucugagggcuuaugcacacaccugaugcauguacacaaacucagaaguaaguaaaagggcagaauuugaggaauauauuaagucucagagucuggguguuuaugcagcaugcacaguuguucauuuugauggggauuucacguuagcguucaguuauacauuggaugugggaggauuaugaaaaagaugaaaucaguauccuguuacucuucacugcagcuuuccaauuugcuucauuggcagccaguuuccaagagaggagcuuuuaguguuuugggggaacacagauuugauuuuuuuuuuuuuaacuauucaaucaugcuauauuuuaagguuuuaaaaccuuggagugcucacuaacccacgagaagcaaugcugcaugauguuacaggaaguguggguccaaagggggggugggcaggcaugaagauacuauaacuuagagcuccagaccugccacccagcuccaaaaaccuacacaaagcucagccuggccuagagugauguaguucaaugguaaagcccuugaccggcaugcuggagaugccagguucaauccucaauaugaaaacagagaaacagaaaaacccucucgccauugagcugcaguagcagugcccugaagagaaccggcucugcucgggugucugaguuacaugcagcaaacggaauggagucagcuacucuccacagccuuggcaggcgguguuuacauuucgucuuucucauacuaacacaccgagcaggaaugucaccagugauagggacaguuauagauuaucaauaaaaaugcggugacuuuaggucuugaaaacagaauacagaaauguaauuuuuagguuuuuagaaguuuauguguaugagugucuugucugcuuguucugugagccacagacaugccugggguccucagaagucugaggaaggcauuggcuauccugggguugugagccccugggugggugcugggaacugaacccaggucuucugcaagagcaaaagccaucucuccagcuccagaaggauaacuuuuaaaaauucauguuuucaauugugucugugugugaguuuaugcacauaagcacauaucuguggggucaagaagaggacauuggauccugcggaacuguaguuacaggugguuaugaaccaccagaggcgggagcuaggaaccgaacucuuguccucugcaagagcaguacgugcucuuaacugcgaagccauccaucucucuagcccccaaaaucuagucucuauaaccgauuuuacauuaauguuccaccaacuuuauuauguugauucuugucacuacuacuacugaaaagaaaaaagaagccgggcagugguggcacacaccuuuaaucccagcacuugggaggcagaggcaagcagauuuuugaguucgaggccauccuggucuauagaguuccaggacagccagggcuauacagagaaacccugucucaaaaaaccaaaucaagaaaaaaaaaaaaaaagguaguagaguucuaccugagaaugcuggaugagagaugagaggggaaccaugguagaccagagccccaggguuggcaggaguuccauuugaagcaaaucuggcuaagagauuagaauguucccggaguuaggaaacauaauauuuuguugacaaauucuagaggagaaagaauucaccuuuuccuugucagcugaaauugcuugccauucagcccugauggcuuagcucuguccccaggcuggugcagcagagcagauggucaaggucuguccuuggaggcuucccacucacgcaauguuugcaugaggaaaccauuagccuagccuagcgggaagccagccagggccgggcagcacuggagaugaugcuaggcggggaccagcacagguggggcuugcaacaguugcaggaaucagcacuggagaugaugcuaggccuggaccagcacagguggggcuugcaacaguugcaggaaucagcacuggagaugaugcuaggccuggaucagcacagguggggcuugcaacaguuacaggaaucaggaauagagccuuugugcuggggacagaacccagggccuccugaugccaggcaaggccuggagcucugagccugggcuucagcccuguaguguuugcuuauugcccucaugaaaccaaggcuagcuuaucucuguccauacuucucuuuuccauuugaaaugcauuuagcaugucaggaaauucuaaagugauugacaguguaggcuuuugagcaaaaaacaaaacaucaaaaacucucacguauuuucaucaagauagccgauaucuaccuagaaauggcagauaauguaugacauaaaauucugugaggcucacacaaggccugguggccuuuuccgggcuguuuuaaaucugucuuuacacuagaagcagagaacuaagucaguggcuguuugggagcucgguuuccugauagguccucucugcuuuccuugaggucauacuaaaugcuaggguuuuucucccuuuauauugugauuuacucaguuuuuuuuuuccuuuuucauuccauauuauagucuaaacaugaguucuaacaguaguucugguacuauugggcuccuuucaaccaacagggaaacucacaucaagcuuguguuaaauaguugcuuagcacagccgugugugaaguguuacucugaauaugagcauuauuucuccuaauaucuuuauuggguaaaagauuauuguuaucucuauuuugcacuugaggaaccaaguaaaaaaccaaggcagguuuggugagcuggcucaaagaguagaggcauuuccugccaagccuaacacagcccacguuccacaugguaggagaagcaacuccugaaagcuguccucugacucucacacacagcaugccacacgccggcagacacuccaccaccaccaccaccaccaccaccagaaacacauagguggaguaaugugucuaaacagaguccugcagggccucagaguuccaguguugaaggucugaagauggauccugaccccuucuggggauacuugaggacugaucagauauguuuagaguucuguguaucugcacagucuguuauuuuaaguauauagagcuguaagucucggagcaauauuaucaucuaauuugaucugggcuugaugggauaggccuguaaucccagcuaauguggaagcugaaucaagaggaucaaaaguucaaguaagagggggcuagagagauggcucagugguuaagaacacugacugcucauccagaaguucggaguucaauucccaguaaccacaugguagcucacaaccaucuguaaugaaagucaaugcccucuucuggugugucugaagacagcuacaguguacacguauucauaaaaauaaauaacuuucaaaaaaaguuucaaggccugucuaggccaaagggguuauccagagccaggcugaacauuuuaacaagauccugucucucugucucaaaauauggguacagagggcugagaaagagcacagugguagagcacuugcccaguauguaagaggcccugaguccaucuuagugcuacaauagaugaguaauuuuggagaaacaaaaucauuauuguugccauuauuaggauaauuaacaaaauuugaauauagacuagaguagacaguacuauuuuacccuuguuaaauugaugggucuugcuguguagaaaagggaucuugcuuccaugcuggcuugggaguauuuguauuauaguauacuuuguaaucacugguaaauaguuuuaaaaggcuguuggguaacucaagauaaaagauguguuguugccgggcaugguggugcacgccuuuaaucucagcacucgggaggcagaggcaggcaaguuucugaguuugaggccagccuggucuacaaaaugaguuccuggucagccagggcuacacagagaaacccugucucagaaaaaaaaaagaaaaaagauguguuguuuuguuggagagagucucucucuguaacccaggcaggccuggaauuuacuguuuaacccaggcugaccucaaacuccuggcaguccuccugucucaggcucuugaggacugagauuacagacgugagccacuaugccuaagcccauuuuuauccuuucuuuuugaaguuguaucaaaggaaaguuaacccacguugaagguagaaaaacaggaaaugaagauacaacauucuaaaccaagcaaaggauuguucccuaugcucuguuuuuauguccuucucugucauauaggaggaaggaccuugaaaaaagaaauaguuguaaaaaguagacugggaagccaggcaugguggcacaugccuuuaaucccagcacucgggaggcagaggcaggaggauuucugaguucgaggcuugccuggucuacagagugaguuccaggacagccagggcucucugugugccaccacgcccggcuucucacaucuuuuaagaagggaaauaaauaaaauggggaauuuaaaaacaaaacaaaacagaaagaacuaaugccucuaauagacaaguugcaaagagaccacucugcaaagauaaacuagauaggcuacauuauuuccuaagccacacagcuuucagacauuucuguuccucgccuugugcaugcaugcucggugcugggcugugccccauucuuugccugaggacguccuccacaaccucuuugggagcccaucucuaauuccuuacggaccggaaucuucugucugugcugacaagccagugacaugaggcucggugcugucugcuuuugcucggcugcccuuucuaagcagcugugagucagaaacuaugagaggacuugggaauuugaaggccuggggagucuggucgcuagggccgauuuuuaaacagucauguaggcuuagagcagagaaggcagcagagugaugauagaguccaaccucucccucauaaaagccaccgugagacauauuccugggggccucucuucagacccaaagguucaggcacagcaauauaauuaauauaaucagcuaaaaauugucagaccuugggcuacccgaauaaaccuauguuuagcacaaaguuaaauaucuaauuguagaucuaggggaaagguuccaauccccaaauauggucaucuguggauccguaguugucagcuguagagggcagagccaccaagagguggcucauaauuucuuggagacaugguauauuuccgugcuucccaugucgugccgugcagauccaguucucguuucccccugacuuuggugcuucguggcuuaggagcgauugugugaaaggcaaugugguacugcuacugccaccuggggagacagaaucaggacaccaagcugaggacuaaguagccaacggcuucagagcagacugcgcaaaaaccccagagaggcauggagaggcugggagugaaggaagggacucuggggccuaggggccuucaugucaguagugagggaaguugaagccaagagagacuggcagccagcucaugagacuaagccguggagugagugcagcgaaggagacaagcuaggugacugagcucgcucaugcucacaugugcgcucucuccaggaagugggcaggaagagaaguaggggauggaggcaagguagagcagaugguggggaccccaacaugaacaggcuugugugccauggaagaggagcauuggagaauucgauaguguaguagacaggaugaggccuguugcagaaugugacugggugggccuacaggagaacuguuugccccgcuguccccagugccuggcaguaggugcccagauagugacagaaacagguauagaugcuucccccccccccaaagguugucuugagugcuuuagaauaaugggaggcucugcuauuuuuaucccauaguucguaaccaguaggaaauguagucuaugugcauaguguagccauaguguaucuacagccuuguguccucacaaaugaagggggaacucagaagcacagucauaauaaccauggccgcucagugucccugccaccccugggcuuucuucagucccaugccaccaccaucuugaaauacguugaguccaaagggcaccagacacaggcagauucugucccaggauuuuacagagggacaguaucagcuuuaagccucugacuaagugcauccccuggauugucucccagcuuaagugugugcugggugugcuugcauugcguguuuccuuuguuuguuuuuguauuugguuugguuugguuuuucaacucacucuguauaccaggcuguccucgaacucagaaaucugccugccucugccucccaagugcugagauuaaaggugugugccaccacugcccgguuugccuugcauguucaugaacaucuuuuaaagggaacucgggggugggagccuaagugacuuaauaacuuaggagucugcucagaaaaaccaggcuggguaagaaaggcagagccucacagacggcaucucggugcagauggcgagcagaucgagugggugugauucugcugggccacuuccaguguuugcaccucaaacccaaaacaaauaugugaaggccgugcuggcucccaccuucccugucucugcuuguaaacucaaggacauguugauaugaucgcucccauuacccuuucuauccugcacuugcuuuuggauuuguuuuuuuguuuuuuucugcuucguauuucauugucucuuaaaaucugcuaagcaaaucagacuuguagacaggaaagucacucaugagagcuggagcuaacuuaaauacugauugaucuuuccuggauuacaucguuuugcuugaugaauugcugucgugagaaauagauugagugccacauuacaaagccuucaaguucucccuccucgguuuuuucuuuaagaaguaucuggcaggcauccuagaacuuuacagagaagaugcuccgagacagccugaaaucuuggaaugacagccagucagaccucuguagcagcgaccaggaggaggaagaggagauggucuucggugaaaaugaggacggacuggaagagaugauggaccuaagugaccugcccaccucacucuuugcuugcaguguccaugaagcaguguuugagguccaagagcaaaagguaggcacacacccugucccugcgcucacacugugggaagcaaagauagcuuuggccccugagccugugacauuauauacacaguguguaucacgcuggccccucucugugccuuaggagagucucagugugccaccgucaggcauaguucagagccaguccucccaccacacuggaagaacaaugaacuagugaacucugagucagggcgauaccuggcuaagaaugcacauuuugcugggcagugguggcacacgccuuuaaucccacccagcacuacuggaggcagaggcaggcggauuucugaguuugaggccagccuggucuauaaagugaguuccaggacagccagggcuauaaagagaaacccugucuugaaaagucaaaaaaaaaaaaaaaagaaugcaguuuuuauucauucacuuauucauggaguuuuggagacuagaauugaagaaaagcuauuuaaauauuuuacuugaagauauuaaauauacagaauguguuucguuagcacauuuuauuuguguacagggccugucucugcucuuggguaccuuucuucccuccacuaagucugccuuuaccuaacaugcuacuguuguuugacagaagaacuuuguagcucaggcggaacuggcuguguggcccaggcuugccugggauuggccuguggugcagcugaaggcucuaacuccugaaugcuaggauguguccaagugcuguugcugcugcuuuuuuaaauuuuauuuauuuauuuauuuauuuauuuauaccuggcuucuuccuccuugucuucuugcacucacuaaagaggcagcucagcuuucuccuggggcuuauggggacuaugaggcuaugaggaauaguuauuagcucauaguuaacauugcucuuauugcucuuuauggcuuuaaaggaaaaauggauuuccuuuuaaacuacuuauuauugacuugcaaagugucuguguguauccagcacacguucauaaaagccuacauagcugucuuucuuuuuuuucuuucuuuaagacuuagucucacuguguaucccagacugacaucugggcgauccucuucagccuccugagcacugggauuacaggcagaagccaccacucuagacuuggccuuuaaauggucuagucuguaugcaaagauuuuucccuuucagugagaguggcucucacucuguagcccaggcugggcuuccuuccagugucuuagggacagagcuggauacaugcucagauaccugggugcucaaaggccugcagaguaaggcuccaugcccauuagguugggggacagugugcauuguucagcuucugagucccagggcggacaguccuguaguccaucggggugucaaggacacagguucacagccagguucagcaagucucucguagggacaaguggccuugaggaagaccugugagaauuagaacuucagcaaaaaaacgaaucuucagccagagaaaaccagauacacugagacuaguuagacaguaugaggcagggaagagcaacaggcauucuguaugacugacucucagucucucagcacccgagucaagaacccuaggcugggagguggguguugggccucccugcagaacauugcgaugcagaguggaaguugccucuuacgggguuucaauccuagggcuucggagcaaagaguggcauuugaaacugcacugggcucaggagugugauggggagguucagggcuccuuucuggagaugggagccugugcggugcauggggguuggggucggggaggcauggccagccacagagggguucuuuucugguuguuuuacuuacaaaugcuguuucuuugcccaguuuagccacaggucaggaaucugaagcaucucuccugcuuucucuuuuuuuaagagcucugaauuucauauuagagauaauuuguguguguguaagaaagcacauguauuuaacccagcccuuuguaucuaucaguggauguagcauccccaaguucaaacaaucgcugauggaaaauauucugcuaaaaaaagaauuaucuaggcuagguggugguggcacacgcuuuaaucccagcauuuggaaggcagaggcaggaggaucucuggauucaaggccagccuggucuacagagugaguuccaggacagugaguuccaggcuguggagagagguccugucucagagagagagagagagaaggagggagggagggaggagagauagagagagggagcaagagggagaagaaagggguuguuucuguacugaauaccccauuccuaagcaaugcgguauaaaaacugcccaccuuguguucugaguuguaggucaucuagcagugguuuaacacauuggggaagugcacagacccuuugccgauacucuccucuuuauagccggcacuuacuauacaagcauguuggacuugagaggaucuuaggaccauuuuaucugaaaaucauagucacaagauuuuggggacagggggcuggugagauggcucaguggguaagagcacccgacugcuuuucugaagguccagaguucaaaucccagcaaccacaugguggcucgcaaccaucccuaacaagaucugacucccucuucuggagugucugaagacagcuacaguguaccuacauauaauaauaaauaaaucuuuaaaaaaaaaaaaagauuuuggggacagugagauggcucucugggagaaggugcuuguugcuuagugacgucagccugacagccucccuagaaacccacagaaaggugaacgacccucuaugaguuccacacucagcugcccacacacccacgugugcacacagauaacaguaaguacacacucaacuucaagagucacggggcagagcuucagaccugugaaucuacuucaggggggugauguggaaaagguuugacucggcagaagcuugaguucuuguugguuuucucuuguuggugcuguguuuuguuuuguuuuguuguuguuuuggaucuuuguuuuauuuauguguauaugugagugaaucccuagagagaaaccaggugagcguaauggaccccugggaacuggaguugaugguugugagccaccugcuguggaugcugggaaaugaaucugaguccucuguaagagcagcagauguucuuaaccacuaaaccaucucuucagccccgguuuucauuuuuaaaaccauuggagggguaucuguaucccagaccgugugugcuugugugucugcacgcacguguguuccagugucuuaggguuauuguugcugugauaaaacaccaugaccaaagcaacucggggaggaaaggauuuauuugucgcacacugccacagcacuguucgucacugaaggaagucaagacaggaacguaauuaagcagggcagguaccuggaggcaagagcugaugcagaggccauggaaggugcugcuuacuggcuugcucugccugcuuuuuuuaaaaauagaacucaggaccaccuggacuaugugagaccuagucuuuaaaaagcaaaagguaggaagugauuuaccugcguuagauugugugcacaugcuaaguggguguuguucagauucuacgaggaagaagucaaaggagcccucgccagugucagacauaagcaugcagacaaaugccuagaacuucgaggaagcagggaagggucugagugccagacacuccugucucccgugagaggaaucacugcuggguauguuggugccuugacagcagccaugccaugcuccuguucuguguacagccgcguguguguguguguguguguguguguguguguguguguauguguguugucuuacacaucauaaauauuuuauaauaaccuuugaaccugcaguaucuaacagagguagccauuguuaaguccgugcagauugcagacuugaacacgugagucacgguguaucuauugcauguaauuuuaaaaagcccacgcaugguccggcuaggcucuagaaucgguagccuuccuccuugcccaaugcgggaaaccggccaucuggcccugguucccuggccuggcuugcuaaaccagccaaacgccuggagcuaccucuccuguuccacagaccgaccacaccugguggucugcaacaucaaccaccaaagacagccccgcaguuucagucucucucuugcccaucuaaaucgucacaaauggaaaacacuagacagccaaauuaauuauugauuuaccggcagauuuguauugguaaaucuccaaacccaauaugcccaugccaagaacacacaacucaguuaauaauauuuauaaacuauaagccuagacugggcagaucgaccacuacacuacucuaguccccagcugugagaucccuugcuacuugcggcuccucuaggccacguggcucuccuccauccuccuuucucugugccuucaucucaucauccuuucuuccuuccuccucuucucuaaaacuuccagccccaccuuuuucuuccauggcccaaucacaggcucuagccauuauuugaccaguuaaaauggggagcaggguucccauguuaucaccugaguagugauccgcuccucgcuggggccaggauuagcaucaaaauacaaacagcaccaaggcaaucuacaauagguagcaacucugaacaccagugagaaaggagccgcagcgcccacgcgagcaacauagggaguuugucuggcggcuuccccuuagcaggucucccguuaacaggaauauucugucuucccucccggugcaggagagguuugaggcccuguucacccucuacgaugaccaggucacauuccaguuguucaagagcuuucgcagagugaggaucaacuucagcaagcccgaggcugcggcaagagcgcggauagagcuccacgagagugaguuccacggacggaagcugaagcuuuacuucgcacagguaauggccguucugcgccugcgcacacagccugcuccaguucccgcuccagcacggggucagaggucugugaggucagcagucacgugagccagggcugccgugcuuuuucugacuuuacacauacgucauuucauguauuuuaagagcacauugagccucuguucuuguuucucugagacgaacaccuaagggauucguuuuucuggcgauuuugcucagcuagggcucugugagggaaguccugauacuucgagguuggcagauuaaacacugugcaucuaaaauggcaccgagaacaugacauccgugggaaaacagaacaaaaccuucaagggucaucaagauggcccagggggugaaggugcuugccaccaagccuggcagcccgaguuugaucccaggaacucauccacggguggaaggaaagaaccaaccuguguccucugaggaccacauaugcaguuuucucucuucugagacaguaguguguuuguuagucagcccuucccagcgaauuaguuacugggaugagacacugugaccaaaagcacccaggagacaaaagguguauguacuuuacuuauaaugaaucaccauucauugagggaagccaaggcaagaacucaaccugggcagaaaccuggaggcagaggccauggaggggugcuguuuacuggcuccucggccuacucagccugcuuucuuuuuuuuguuuuguuuuuugguuuuugagacaggguuucucuguauagcccuggcuguccugaaacucacucuguagaccaggcuggccucgaacucagaaauccgccugccucugccucccgaguacugggauuaaaggcgugugccacugugccuggcuucagccugcuuucuuauagaaccuagaaccacaacccaggcugguaucauucacaaugggcagggccuuccccacauuggucacuaagaaaacuuccugccugcagucaggucuucuggagacauuuucucaguuggguuccugucucuugaugacuaaagcuugcaucagguugacauauaguagccagcacacccacucacaccacuagcaaauaccugggagagucagcuguaaaggagaaaagucucggcuugugguuugcagguuucagucugcaugugauuggcacuuuuccugugagccugcugugcaguagcacauaggggcagagcaaagcucuucacuucguucaugggaagggggaagaguaagggguugggguuccacugucccuuaggguauguccccaugacuaaaggccucccugccuccugaaggcucccaguuugaccucucaggggagcaagccucuaucuacuauguagagcccaagggucacuuagagcccagaccacagaguagcacguuuaucaaggguccagggccuguggccacuuccaguccaccaccuggaaggucacagacaguuugagagacaguuuuaaucaccccuccaagaaaguaacaauuaccauaaaguuggaaaugaaagcccuguggugauggugcaggccuuuaaucuaagaacuggaggcagagaccgugagaucugugagucaggccuacagagugaguuccaggacagccagggauacacggagaaacccugucucagaaaaagaaaagaaaggacagcugcucacaagcacgccuuucccugcaggugcagguguccggggaggcccgggacaaguccuacuuacugccaccacaacccaccaagcaguuccucaucuccccucccgccucaccccccgugggguggaagcagagugaagaugcgaugccagugaucaacuaugaccugcucugcgcugucuccaagcugggcccagguacugcauuccaccuucgcucuccgaguccucggacauugcuguucuguguguuggagacugugugcaguauggggugcagagcccagcaacaccagcaccguccagugggcgguguggccacaccagucugaguucacacucgagcuguacacuuuccagugcugugguccucagccaguugccuagccuggguuaucugaguguguucuaaggauuaaacgcugucugcagcgugauaacuuuagccauucagccagaaguuaauauaggcgguuagugaacauccucacugcuuucucucugcaagccagucagcacagugucugucguuuggcagcugcuuugggugacagugacaaugaccuaucacccuuccaaaguucuaucucucucucuuuucacuucuuacuuccuucuuuucuugcucggucucacucaucuuuaauacugcaagaagccgauucuucuagggcacuucagaggcuuuugagaaggcacucuaugcuccugggcgguugagcucuucgauggcagaggcccuaccguagacaccgcugccuagagcuuagccagugccucccauggcgccccaacaccacugugaauuuaacuaucccaccuuaguuaucuauagaacagcaguuagcauuuauguuaacauuuuaauuaguauuuauguaaucuaaucaauggguucucgucuucuuccugagcacaaagccagaguaagcauagaacagaagagacaagaagagaagagauaggaagagacaggagcuguuugcaaagcaagcccuccccgagugaaggaagcuguguauauucauacaguggcaugugcacuccugagcacgcgcaguugaaaaucauggagaugaacaugguggacagggugugcuuggguucgcuugcaccaugaaguuucacuugaaaauaagagaaggaugguuuuaaggugugugcuaacaggagucugccuugaaggugccugaagugcuuggauuuaacuccuagggcucaggacagaagggacggugucuuuauuuauuuauuuuuuaagacuuauguauaugaguacauuguagcuguacagauggcugugagccuucaugugguugggaauugaauuuuuaggaccuuugcuugcucccaucaaccccccucgcucuggucggcccugcucgcuagucccugcuugcuccagcccaaagauuuauuuauuauuauauauaaguacacuguagcugacuucagacguaccagaagaggacaucagaucucauugcggguaguugugagccaccaugugguugcugggauuugaacucuucggaagagcaucaagugcucuuacucacugagccaucgcauuagcccgacagugucuuuacaaauagaauuucugcagggcauggugguacucaacuuuaacagcacuugggaggcagaggcuggcagcucccugggaguuccaggucagccugucuacacagugagccuaggccagccugggcuacauagugcgacuccagggaguuuuuguuuuuguuuuuguuuuuuuuaaaugccagcacuugggagauggaagcagaagaauuagaguucaaggucagccucagcuacagcagcaaguuucuaacuggcccagauuucaugagacgcagucuuaaaaaaaaaaaaaaaaaucagccacugaaugacguaguagaagaggaaguugggagauagaagaacuugauuuccuucacugggaguaaggcuccuuccugugcuugcaggggagaaauacgaacugcacgcgggaaccgaguccacccccagugugguggugcacgucugugagagcgaaacugaagaggaagaagacacaaaaaauccaaaacagaaaaucacgcagacgcggcgcccggaggcucccacggcggcacugagugagcggcuggacugugcacucugagcggcugcggugccugccgcgccugccugucccaccacuacagcugcgccugucuaggagcacagcccagggaugcuguugcauccgucaggcaguugggccagccuccccaggccagaacguggggugaaguagcagauucggccagcuguuugaaauucugaacaguauucucaauggcacuuuaagugacaagguuagcccugaccauguggcaccugucuccucccccagaaauauuaguucccuugaaccuguagagcauuggguaccacaggccagaacuagagucacccagugcacugccauuuuuacagauuuaaaaauuagucuuacgguuucaguacuuugguguggguauuuuuguacagguguggcagugucuuaacaaauauauugagcaaaggcugaguguuguucaguagacaugaccuuuuuuuuguuguugcaugagaagaaacccgagauacaaaaucauuuguagaagucauuucucacaaguauuuuuucacuagcuuugaggaugaaaggccaaaugacugagauugucagauccagauaucgugggcagaugugcucuuagcucuccuggcuguccgucuguccugccucucuuggcagucagugacagugguguacaggacucugcucccagcucagcccuucccagccucggcucugcuggaggaaucucccuuugccagugggaugugucaccgggaagcuuggcugaggacuacagaguuggagucuguggggcagcucuucaguuacucucuugacccuccuaaugccggccugcuacugcuugagguuuccugugcugugcguguaaucaaggacguuagucgucuuaacuuuagaagauaaugauaagacuuugugaagaccgcuuuaaauagggagagccaguuugcuuuuguuuucuucaaagacaggguuucacuuuguagcuccugggccucaaguccucugugauccuccugccucagcuucccaagugcuggaauuagaggggugagcaccacacauuucaaaguuuuccauucaaguauuucagcuguucagaaagaaaaaucaccuguccuuucccccauggauuagggaaaguaaucauucuuuugggggugguuggguuuguuuguuugguugguugguugguugguugguugauuuugagauaagguuucacgcuguagcucaugcuagccugucacucauuauguagcccaagcuggccuugaggcccagaccacucucuuuccucaggcucuguuuguuuggauuguaggcaugggcuuguuguagucuaugcuuccuccuuuaacaaucauuuccaccuuugcuugcaguuggcccucagguagaauugcuucuuacacuugaagauguguuguuggggccuccauaggucacucagcaucacuggucccuugcagacuuuccugccuuugagugcugggcuacagguacaucagcugcuccacucaucaaguauucagagcuggcuggccuaggugaaggggcugggcauagaacagagaggaacauagcugcaacugcaaagaaaagaacguagagaaaugaagccaugagagccguguacuuugcgugacauguuagggcugaguccuuuugugguaggauugauuucaugagcgugcaugcaugagcucacacacaaacacacgcacacaggugcauugucugucauuaaaaccgggucccauguaguccagguugaccucaaacuugcugugucccaaggaugacccugaacugcuccuccugccucugucucauaagugcuaggacugagggugugugccaccauaccugacaagaacaggagagugucccuugccuucagguccuguggaaugcugaauucugcguuugccauugggagcccuccgugcagauucaguugcagauuacgauuccacccgcauugguuuuuagauccaagucaucugucagauaaagugaguuugguuuugaggugacagcucaguguggcccagguuggucucaaacgccaggccucagugggucuucccaguugacuggaugcaggcacacagcugcuguaauccugagacuuuggaggcgaaugcaguagaucaagaguucauccuuggcuuacagugcuuugcagugcugagcucggcaguguacuucauuugauuguaagguagacccuagcugccagcaaguguguucucacaguuggggaguuuguguguuccccguuauacaguacacguucucucuaauuuucuaugugaucauaacccuguuuuaaaauuugucuuggcuuucauuuucuaccccucaaugaaagaacauucuuuuuuuuuuuaagucaagaaguucaaaucugcauacuugaugcuaccuuggccacuggcaguuguguugccaccuuaucuggguucccuggauagucacauucaugccauguguuagaauuuacauguuaaaauguaaacaguagugagagcggagccaggcacaaaggaugcauggaguuaaagguucuacggaaugucccucucccucgguuuagagaaucaaguucuauuccagacuaacggugggccugggcuuuauauuuuuauguaaacuauuuuuagacuggaggauuugguuuucagaggaaagcuuuacgcauaauuaaaccaugggaguguacuggauucuuugaugccuuggguucacaccuaccugcuugccuucuucucuauagagccugagaccucaccccgggucaccuccagccucccucugugcuccauaauacaucuaucuuaaaggaaaccguugucugggugugguggcccuggccuguaaucucagccugcaggagacugaggcaggaggauugagagaacggggcuagcuugggcuacaugaguuaaaccgucucagaauaagguuuuuccuuuuucuuggugugacaguacagagcaacugggaaaauauuuacuucuagccaagaagucuguucuggacucauucuacacaaacuuaaguacacacacagagagaguacgauguaugaaccuugagcaaccacaugacaaaugacuguugguguuucaaacucccuucaagaguguguucuccagaaaagccaucccucucagagugccacuguuucccucagucuugaguggagcgcaguucauagucaggauuaccguguauucagcacagugacauaggcuguccucucagcgcuugggaggcagagguaccagggcuuggcaagcuuaaggccagccugggccauguaccgagacccugucuaaaaacaaggggauuccuggguguccagguaucccagggacagauaacagcaacugugcaucuuguccacggcugggaacgugccguauuccuucccugugguuucuagucaaggcuagaagugaucccagauacggucagcaugcagacaccaccuacucacucggguuagugcuuucucuuggaaaccugcaguucuugaagugggucccgagacccuugcaggucccacauggccugaccugaccggaugugcguuuaugacacagggggguuucuuuucuaucuaugcagauaauuugugguuuucuguaccguucccuguuggcaccccucuuccuaaguccaauugaggacuaagggaccacaggucucaguccugugccgugcugugcccucugcugucagccucugaguaucuauucacgucaugugugucuuugacgugugagaacgcauucacagcuguugcacauugauccccacaacugaaccugcagcuggauuaagucccgaauccagcaugucuguaauccccuggucugugcacuguaguaugcucgcugcacguguggaaacuggucagugagccucauccguguguccugugauuucaguaucguugaucugaugggccacaguucauuaucagcuucaacuguccuguguccugaggcuuucgaacauuccuuguccuguaaggaggugacagaggcagacugugacccggaagacacuugugauuaccuguaacaaacguugauguugaaacuaauaaagaauuguuguuuuuuaagucagcuca

SEQ ID NO: 2196 - RNA, 31746 nt, Mus musculus
ggaagugugcauggguaggcuuuuauuacuaaacccuaugauauacaaaaugcauaaucgaauaacagcuaaaaaaauaguucaagaaauaugaaauacauauuuuugaaaugauaaaaauguaacauggacauacaaaauguugcauauauguacauaauauauacuuacauauauauauauauaaucacauaaugaaaacuguaaauaagaaauguguacaacaguagguggcaaggguauuuguuccugucagcucgaugauggugacuuacaucuugugccgaggaagucaauaagaaaguuuccucuccaagggccucacaaaggcaucugcugugaaagucacgaguuuucaaguuauuuggccaaagugugagaacucucuggucugaaguugguagaaaggaaacagugaacgucagaaccgaucgagacagcggguguagcccugcagagaagguggugugacccccguccccuguaagggccucugcagcgggacuuagaagagaaagcaggcaguugggucuguguugcucagacucuccggugggcugggugcuuucaggaagcucuggagugaguucgagccugggugggacauuuagauccuggaaccuucuuggucucucccuggcuuggacaucaccgaguugguugcuugcgagaccucuuucccaaagaaaggcauuucaaguaacagcugacacagaagagguuguacguggcuugagccgggccccgggugugggacgcuugaggccgggcccucauagcuccuucaggaugaucuggaucuugccguccagcucacccauguccagcaggaaggccacgugguugcuguaguguuggaugauguuguuguccauguuaaccaggaugcuggaagagagaggagggagacaugguuacuaugcguccaggccagcugucaugacccucugagcaacaagcuugauagcaaugcuacaggccacuucuguagcuuucugugacccucaagaccaggcuguaagaugaggaauuccaguggucaaguuucagcucggaacccagccugccagccaugccaugcuggugccugcugguggauggcuucccuucugcugggcugaauguggaugcuucugagugacuaacaugaaacucugggagagaugcuauguucucagucauuagacugggggcucggacuguaaacucaaguucaggagguguaguaaucuggguuucacagaaagcuacacugagccacucagguguguuggccugagccagagacaggggccauacaacaccccucucaauugauuccugucaagcugaaaucucaaggggauuauauaacagacuggaaggauggagccuccacccucaagucagggacuugaagcucaagaagcaugaacuccauggcuaugggcucugaaagggucaaagucauaguuuauaucaagaguacccuguaagagcugccucccugauaaaaagucacccagaggucaccugagcugugcuuugucucccugcuaaucuucugagcaggugauagaauugggcauauacauucaaccauuuauccaucucucuguucaucuauucaucaucugucuguccauccauccaucuauccaucuguccauccaccuaucugcccauuuacccauccauccauccauuuguccauccguccauccauccaucuguccauccauccaccuacccauccaucuccccaucucuuuccuccauccucccuccauauauccauuuaucucugaucuuucagucuuugcuggacacuuucaugugcaggacauugcuccugcacacaaauuaauuggaccugaauucuguccuccagaauuucauccagaaaggaagacuggguucuuaacaaccaugccaugccaggcaauagaauggagaagcuacgauucaaagacacaaagcuauucuuuuguagccacgguuaguagauggcagagcucagguuuuaaucuagaccuuuguauuucuaugauaucacuuuucaggauagggaaaagagccacaaaauccuauaaauacaaguuagugggagucagaaggaagccaaaaaucuauguucaggcaagagcucaguagaugcuugcuuuuguaaggacucugggaaggguggcagggacaguagugaaccugagaagcccacugggcuauuucugucaucugucagcaccagcuggcagcgccuucuuuuggggaaaagguuggagguggggcucccagagucugggggcuggcaggacccugcauucccaggugaucauuaucuugggggcugaaggcuggagauacacuagagagcagggcuggguggggaggagagaaggugugugcucuggaaacuucaggguugaauugucuguuuccuagcauggcauucaucagccucagcguacugggcuguguaagcgcaccuccagggcaguggugugaagauggauccuccaguaagaggucagugacaacuggguccccagccaguggcaggcacuugucaacaguuauuguuauuucuuagcuuccaaccccucugccuguauugaguuaaccccccuggcccacugccagcaaaaacaguguguugguuaaucuuucaagcacucuaugaugcuuguaaaauugauuuuaucuaccuuggucuggaggacuuggggggaggagaccugugagaauaaaguaggcuuuggguuagaauauccaccuuucucugauguggacauauauuugaaugaacucauauauggaaauauggucuuucauauuucuuaucuuugagcugaaguucucauggcuguggaguucaugugcuccacagugcugagugaacaauaugugcauauuucuuagaggucagaggaacaaggaggagaggugagaucaagccguguguguguggggggggggggugcacuuuaggucaccgagaaucucuuuugcuagucucuaacucaggaccgcuacuuugaaccucagcuucaaaggggggcggggggauccugccgagcucaagggcagccgggaugaugccaggaauuacuggggacaguaucuggcccgagggaagaacuuccgugauggaagucaugacaauuacaguuugagcagcugccuggauugaugggaaggccucccggcaaaggagccaggagcuagaacgcugagccucacagcucaucaacuucccaacuuacacagacuaucccuggucccucaggggaacccugcacaggaggggcagaaagcagggcacauggguguggcgcuaaaggagaaguggggcugggcuugucugggcaaagcagacgagaagcagucuuacuccagacagagggugagccccuguaugaaaccgaaacuugaugggauggcggagaggagagggaggaggcuggugggaggggagagaccccacacaccgacaaaacccucuagauucucaugcaacccaaaccaaauggguccuuuucuacacuccagccuuuugccugggaggcuagcugggagccacagaggaaggacaagggggcggggcuuggaggaagccaggcauucucaaugggagaaugugccgaccaccgggcgggucaugcucaagugcagcuggaguuagacugucuauuggggugcagcugugcuccccacagagcagcgggaggacuagcagguccuggagaguauggccugcuucucuccugccugcuguagccuggagggggaagagaaccuuggaguuucuuuugauugggcucuucaaccuaauccccaaucaaauucccaccuaggcuccuggcagccaccccuuccugucacccucugccuggggaggcuccucugggccuccuuaccucuggugccuugcucacugcuccugcacccaccccugcuuauugccuccgagccucaguuuuccugcauguaaaaugugggugugugugccagugugauuccaaggguuaaaugagauagacucagucugaugucuguaacaggagucgggugaauggagguugcuacaaugaacauaauaagagaagaacuuuggucuccaguguuuuggggacuugaacuugggucuucugaugagcgagccgcacuccccccucuaugccaggagggucacuugugagaagacccuugcaccuccuccuacucucacccagguuucugcagguggagaggugaccaugaccuuggccugacuuggggacucuccacccucacugagcaugcucucuguaacuccgccaaggccaagcccagccuugguagcucugaguagccccuggaggacugaaguggcacuuacccucgcuugcauuucuuguagacuuugcaaauauucuccucggggaggccguacuucucagagaucuggaaggaaacgguaagguuucacugccuguggcccaaacuggauuuauacauacuuuauacuacugccuuuuacuugguggcuauaaaaguaauaaauagcgggaaaacaaagagaauuacaaugauccuauuucccuggggagaacaccacugucaccugggcaccuuccccucugugugcugugcaugcguacauacgcauaaauuuacaucacccguaggggguuugauauuauuuugaauugucuuaugauaagccaaaucacaagaaacccuuagcaaacugcauuuuagugucuauaaaauaucuaguugagcaucuaccauuuccuuugguucucaccuagggucugaccuuuggaucuguguuuaaggacugauuuuucacuggcuggugaccucaugcagacucuuuguggggacagcaagaaugccucccccgccccccgccagaggacugcugagagaauuaaaugauuggcugaugaugucauauguucacgccagcuccugccauguaccaaagcccccaugagugucacugucacugucuugggagcaaugggcgugcuccagaaccugcuuuuaggugggguaccccgcaugucccucuccugagcaggaguucauaauugcagcugaugggguuggcccauggagcgccaagugcccaagccuggcucagagccuaaaggcccauuagguccacaugagagcuuccucuauaggugaggcagcuguggcucuaagcuuggcugagcagccugccugaaccaagacaaguggucccugcccacacuagaguugccuaacuugucauuguuguuguuguuguuguuugagacaggaucucucucuaucacccuggcuguucugaaacuuacuauguagaccaagcuggccuugaacuuacagagaugugccuguaccugccucuggaaugcugggguuaaaggugugugccaccauacugggggaguuguagaacaguguuccugugccucucuuaguuucacuuuuggacaaugaaaagaacuugggaaggaccaggucuggcccacugucagcucucagucaaauacuggugcccaguggagcaggcagcuuuaaagcuucaguuaagcccaggugguccccucugggcgguugagaaugaggaagaguucgguguccuggguaauuuucacagagaucccuccuagcuagaaaugucccuagacuuucuucuaacggcacuguaaucagaagcugccagggcucugugaagagcggcaagcucugcuuccagggaagcagagaagccaagagugggugccgucgaagcuaaugugcugugccguucagcccaaagauucuaucugcuuucaagugacauuaaugacuuuuugugagcccaacuuccuggggcugaugccaagcaggccggcaauauguuauaagagcaggacagcccggagggcaggaaacuugggcuugacuggcacuuacgccaccuuugccagucccuggccucucagagcgaggcgaugcccagucaauaaagggaagaggcagucacgcacacggcagacagaacaaaacgcuuggcccgugggucuccauuaagcaggucgucaaggcugccaaggaucucccagcuacaggggcucagcuguccaaugagguuucaccuucaaguccaaagcccccggugacccucaacuugcccaggcugggcuguacucaggugacuggggguuggggaaggucuccugguccagauacagucccacccucgcccucagccacccuagaguccugcaaucccaaggaaugaggccacccugggaggaaaaaaaaaaugagcgucucuggggccuggccuuuuuguggagggcuuuuucacucccauuaaaacagaaacagguuugcaaagccaacaaaagcccugggcugucagacagauuaaggaggauuuauggugugagugacucucaggguggagcaggguucugacagggugauaagaucgcaaggcacacccccuagcagggcccuggccccccuguggggugggaagagcagaccaccggagcccuccugugggaaaugaggccccuuaccgcauuccucaggcccuucagguccggggucuucaacaugagcgcgucaaacaccuccucugucucccuccucacauacaacagaacugaaaaccaagaacggaggauguugagcacgggggugggggugggugggagguaggggucugggcgggggauggagaaggcucucaaaaggcaugcaagggugugcucgcauccaguccuuuccaaacugcccugcuuugccggaguuugaaucuugggucuggcuccauuauguggcagucagugaccuugaaaaggucauuuuagcuccauuggcauuacugugugugugcauugggguccuugccaccuacuucagagcugcugcugaaaucaggagcagugucugggaacccccgagugcauuugcuaagcuugguuccugacuuacuggaggccuuggauuuucuaaggucaucuaagccuccagggcuucuguuccccaucccccacccuccuucccgucgcaggcuuaagaaggucaaagccagacgaccagacauagaaguccauccaacucuuaacuacuuagagaaccaaaggccuuuuccaacccaauaagcuugucacccgugcuagcugccuugggagagccauguccaaacagggucaaagccacagauguccuucuaucucugugacaucugucugagcucuggaguguucucagucauccccaaaucuuggccuaaacacucuccaaggccuuggguggggggacuucaggaaagucauggggugggugggggcuucugagaaggcucuggggggcuuugauggacucugagacucuguguaccucucugaaggucaucuuccuuggcuuguuuagaaggaagaggcucaaacuccucagcaaagggugagcagguucgcuucagaggcagccuguagggcagcagagaggggcgggugaggacagcugcccccacaacccaccccaggucccuuagggcagagcaggaaccaggaaaggcuaacagcguguuaggguagaggugaaguccuaagauugaauacaggucuaacugggucagaccccagcccugccacaugcuggcagcaugccaggcugaguuccuuaaccucaaaugacacauuagagaagccggccauggggagagcugucaugcuauaggagguggcacaaggcgugcguggccuuaaucaaagugaacuguuagcacugcccacauuaugucuucuaaaagaagugagccagggauggguagagccuugggaggaguggggaccguggggccuagagcaagccagcucugguucaguccugucccugugacuuaguagcuggagaauaugaaugagcucugucacucauggugagagaauuuggagaaaagcuccuuaugaaaaacauacauggcuguuuauagggagaaauggauuccagcagacggcuugcaugcaaagccaagccaguuacggccacacacucacgccgucccgcccuucugccucacccucuauaaacauucggggguccccccaggguugcugggacagaggcucugaccggcagagggaggggcacgggugacuguggccucugaaggggacgcgcuggggagagggauguccagcauagcucugguuugugcucccccaaaucuguauccccaucucggaggcuuuucuuugccuuuaguuuuuuuacaagcaggugucucaccagagauuugccaacuuuccauguaagggaagcccauaaaaacccaggugguuucaauguaaagggaggacccaggccuggcuccagggagcaggggaaagacaggaggcaacgugagggguacagaauuaagaaaggacaggaccccuggcugcuguuccuguaccugucagagcugcuguguccugcugaggggacaaccugcaacagagagaauagacauuucuggucagggacaagagcggccuaggaaggaaggggguggguauuacgcuagaguccccuguguucugcacugagggcucccuaagugaguuggggugaaccguccagaucaggcugcuguacuggggacucagggacacaaccgaacugcugcaguauugcuggcaggcuggugacccagcagcaagcccagaggaggcggggagcugcagcuacugggccugcugcuggggaccagugaucaugggaagauggagcugaagcuacgccccugagcacacugcaugccuggcgcuacugcugcugcgcugcccguuggguguccccguguggucccguggggugagcacucagggccagagagggcaggagauggcucagggccauccugugcucucuuccccacuggguacagacacugguuucccacagaauagcugucuacccaguuggggacacuaagugaacaucuuccuuccuggggccucaggcuauaacaggaucaauauagaaaggccaauacuacugcccaggcugcuuccaggagagcagaaaggaugggauaugcuucugggcaugucugagcuacuuugugcuggcggcuguauccagcccugugauguaccuccuaagucagacaccaaggacuuaaucaggcaccauggccuggacuucaaacgcuccugaggagccugggggcugggccuucaagucaagaaagauagugauggaagcagagcagagugaagccggcucuugaccuugucuggccaagggaacacauuggaugggcaugcuagugggagggaacauagcucagucaaggccucgcucgugccuccaggcugcaggugcucuggguuagcaucccuggcuggggagacaggcggagcagccaaugaguggccaagggcaccuggauccugaucgaggcuucagaguggguucacauucuggccaugggauuuuaggagugugccucuauccaacccuuagacccaguauuggugacucauagaggugcagaaagggucaaggugcuguaggguugcugggcucucauaucuguuccccgggaccagcugcccagccuggguguggccucaacucacaucuuucaugugagcccaaagaguuugauggauggagaauccauuucucuuuuccucaugacugguccccgaggcuauauacccacauggucaguggucauuuuuaaacgccuugcuguucaacagaagcaauuuucuuucugcuuuucaauagcagguccaggaaacacccuaauaccaucacggcaguaguaugugaaacccccagcagugugguuagacgggcccuaucuggacccagggcccgccuggucccucucccaccugcccucuccucaccccuccugggcgcuguaggcuggaaaaaugcagauuggggauaaacaacacaggcugggucuccaggucaguuucuggccgcaaguauguggucucauugccccugaagccugacagcaggcagcccuugauuccugcuaaaacaaaagaagccacugagccccaaagucccuucacacaacccccugaccaucuucucugucuuccuucccuuuggccuacccuaccuggcccccuguccacuguuuacugaccauuguuacuggagucugggcacuugaccuuccuucgaaacugcuuccguucaucaucgcgcaucuuccucucagcucccugcaaagagagguggugcucaccaggggccaggggaggggcuugccauguccacagcugcuacuuugcaucuugaauaugggccaggccacagggaaagugggaaaugggcgagucccggccuaaggcccagcuucccugaagugggcucaggucuugagagagaugaagaaggaagcuuauggagauggagccggagggaacggagggaagugggggggggggggagaugagcaggaaugaggaggaccaggggagacaauggagccauagagcccgauuuacagacccugcagaagggugcagaaauacagaugcagagauggauacugagaggagcugggacgagcacacagaggaauugacagacagggacuggcuucccagagaagcaaguagugucuccugcucuuccaaacacacacacacacacacacacacacacacacacacacaccuuaucacagaagaucuugaucuggcagacagcacgguguaccaggcgcucagugccugcuccacagucauaggugucaauuugcaaguucagggggacacccuucacucccuucugcgaggagaagucugugcucagacaguugacaccgauaaacaccuagggacagagcagggagccagauaaguggucuacucagaucucagaguucagugacuacccuucagccaucuugggccccgaggacaggcaucacuaccugccucccuuucacagaugggaaggggugcagcuggagccaggcugguguccccccuguagcucacuggggucaccccacccugggagggcacuaaggauuuuugggggacuguaggucugaagguugauuucucuucaguuuaaagcaugaugggggacacagcuucccugcugauccaggcacacaggaggugacacuucacgcuaaggaccaauuacagccagcauaggaucccaguucuugccuuucaauaguccugugccguuaguggccagcggcuacccagguaaucucuauucuacagccucgcaggcucagcugagacaggauggcugcagcccauucccuaggggucagggcaugagcuuggaccuggaccuccuaaucugccgugggaaaucugccagcuugcagcuugguuagaugcuuugggcuucugcagaccccguuuguuuuaucugcagaugaggacggguaaacgaucccguggggcuaggagaguucacacuucuugucagucagagaugccggggauucuagugaagauuugguuccaagucuacagacagccugcguuuucucaaaagccagccuggggucugucuaagcccuggcaggcucagggucagacucuacugccccagucugggcuuggucucuggaacauuuuccccuuagaaacaaucuugaccugaacagugggggugggauucagggggagcaucuuuacaacuccccccccuggucacaggcuuugugggagcucugcucacacgacccagguaugauaccaccggcucacagcuaguacugagacccaggccugagggcaugaaggccgugagaaaaauccccaccgaaacccaccucucccuucccaugaaacucucccacaucccuggcccaccccucccuucccaagagacucucccaccucccuugacuggcaggcuccuccucuagccccuagcucuguuugaauaacaaccaugccagcugggccugucauccccccccccccauaucuucucuaugucccaccaggggaggcagggguccacagaugccuuugggaugagaggucccaggcucaguggguguggugaaccuguucaggguguagagggacugacuggagagaggucacccagcuccugagggccaagcuggugcuauuuccacaacacagagaagccauaagugcucagcuggugaugggcucaggcaccuggcuagggagaauccucaggguucaaaccgccaugaaggaagccaguggggcucccucuccuuggcuucucccucgaccaaccccauggccuuguucuagccucuuagacauggcaauaggagcucaccacugcucgaagcaucuaagaaaccagugccaagguucaagcccuccccugcuacuucugagcccgugucagcacgcaaucgggaacuuugagccccucccuuccugugaggcucaguuaucugaagaacagggaugcugacaucugccagucaccccaucccuaugacaaccagucauuugggcaauaguuaaacacaguggcauggcuucugaggggacagguugggugcaacccagcuugucagcccagagccugugucucugucgccuaugaauaccaccaccuggacaccaccacccuugggccccucaagccuuucccaggcacaacagccccacccaagcccacacugaccuuggcuuccucguugacauuccacacaaaggacagcgcguuauaggccaccucuucaaugugcuggaccguguugaaguuuuccuuacagucagcuggaaguguaggagaccagagggucagcgcgaaagagacuggggcacugugggaaggagcuaugaaccacaccucaccccaggcaaggacaugcaugcugacccccaagcugugguucagagcuuagccugggagugugacagacggucucugagguaauucagcgaggaccacauagcaagggauguauggugaggcagcagguguagggacagggauccuggcagcugucgucaauacaauacugauaaggggcgagccucagucaaugcccccaacccucugaauagucagucuauauaagagaaaagcguagcuuagagagguuggguuucucacccaaagucacacagcaaaugaaagguggagcaaggagcacacuauuuggcucuuaagcccagucuccuaauugcuccguuguccaacaagucuuugaccagucccaaccugcguacagccaagccgcuggccaccugacauuugacagcuggauaaacugagguacagggaggggaggggacauaagucauaaagguacacaggaaaggauggagccagguuugggcuggaugucuagcugguuggggugguucagggacaagauggcccaggaacacauccccucuccuccuccugcuuuuuuuuuuuuuuuuugguuuuccgagacaggguuucucuguguagcccuagcuguccuggaacucuguagaccaggcuggccucgaacucagaaauccaccugccucugucucccaagugcugggauuaaaggcgugcgccaccaccgcccggcuuuccugcuugcuucuuuuuuaagacagggccuuguguagcccaggcuggcuuugaauucuguguacucaagaugaccuaacggaugccccagccuuuaccucccacgugcaggaauuacaagucugugccaccaugccaguuuuacgaagggcuggggacacaacccagggcuuccugcaucugacucugucaucuguccuccgaguucgguuccaugcugaaucccauggcagccuacauccuggggcccauucacuggcacugccagggcuccacgccccgccuaucccagagcacagcaggaaagauggcugcuguuuccaucagcagaagugaucuucugcccugagcccuacuggguuugaucugggguaggagaggcacgggguucucucuuaccuacgucgaugacgcgcugcuuggcggugggcugccgggaaugccagugccuccagaaacgcagcugcuccacggggaccuugucauuaucgaacacgaccaucaccacgcucuguaaguacaaggucaugucacccuggucuggaggcccaggccccaggcucccucccagagcauggcccagcugccccaccuuacacuccccuccugcuccccccucucaauugacaagcguuccccagcaaagcucaccagugacauccuccccaaacugucccacauaccuugacuuugcuggaggacagagcgaggccuuucccuccugcuggggugcguagggugacgggguagaacugacccuuguugagguaggccaugggugacuccccugcuuugaugugaauggcuuugggggagcccaggguguauucaaagucacuguggggagcgagaggguggugagacaggcuauggguggagguguccugggagcaugggggaggggucugggugugaggugggcuugcugggugaccuaagucaaucuccugaccagggauggucucuguugacacauguuguaacugaacaaaggagucuaaaggaaaccagggagauccaggguaaggacaaagccaugggugguagugauggagggggaggcuuaagacaauugaaccucaguuuuacguuuuuggagagacuaggaggguugagagaugaucuuacuacauagcccagacaggcuaggaacucaguauuuaguccaggcuggccucagacucacuacaaaguccaugcugaccucaaacucaucgcguuucugccucucaaggacugagcucacagguaugugugucucuaacagggugcugagcccacagcccgagucaccacccaggaacaggcuguggauucugcuguguucuuggggagcugagucaccacccaggaacaggcuguggauucugauguguucuuggggggcuguagggcucugucuucagccgccugcccagauggucuaggaaaccaaguuaccucuugaggccuggauaauccucugggcaugggggguccggggaugucuucagaauaucagggaagagcagagacuguagagaaacgcaagcacaggagaauaaguggccauguucaggcugcaggggcucggcccagggcugcacacacagccgcgugacugugcagugcaaauuuggauggcuguacacggcagcccugccucaggucuagaacuuucucccaucugcagcaaagcucugaccuucguacugucauuucuccuucugugcaugcaaacacagauccaggggugcugcgagggguucaggggcaggcccucaccuccugugggucaucuuugaaggugcugucuggcugccagcgcuguguggguggaaccccaugaaugcucucaaauaaugaguugagggagccauugucauauaugucacuggcgggcaagagguagcuguccauggagcuggcuuccaguuuacucggaccuggggggacgguauuggucuugccggggguggguagaacccccuccaagccuagcagauuguuuuucuugagcuggucuguguagucuggacuuccagacacguucucugucaaaaauuucaugagguguguggggcucucgaggggggcaagauccggcucauaguccaugcugugguagaaccugggggagagagaccguaaaagugagcaugugccaucucucuaugcugggcugauggugauuuuguguaagguuuaggcccuccuggcaugugagaagcuagacucuaagcaggacucugcagcaggccaguuggccacacugacaagagagggagaggguaagaaaugguaauucccccaggcccugggcugaggggacagucugcuuuagcuguuacagagcuaguuaacuuagaacacuggaaguuuaaccauuuguuucugagccaaaugucccugugccaaaauguccccacuugaaaacagcuggacugagauauucagugggguguaucugggagguggcugggugcaugggggacgguggaugugugcucagaaaaaggucagcaaaugaauauauuccaaacugcucagggggcagguugaguacugcacaaaagcucugacuuuauauacaacuguagagugugacuauuuugcaagaaucaggcauugcccuugugacuagaagucacugaacuguagcguucauuucagggaggcccaagcaccccaaacucugcaguacaggggaggacccaggccagcuuccggcucacacuggguccauagagagcugcaauagcacccuagacauuuggaucucucuggaagcaacuagcgggccuuaccuaugcagugacuucugugagguccuauuuucuaggagaggaagugcagaaagaggggcaggauucugcccucccaaucccccaguccucaccagacauuaucacuuaagguauggaugauaggcaggggccagaaggcugcaguagaaugcuaggugucaggugacccccuugaaggagggucuggaaacuggacagaaaagccaccccuaaggcuuuccugcuccuguggcuuugaaguguguuugcaguaaaugccaacccacauggcaugagcaacugggaucggaaguguguguguguguguguguguguguguguaugugugaguguguauguguuuauauguguucaagcacagcuuuauuauaacuuagcaaaacucuucuuuugauaucauuaggguuguucuuuuccuuuguuguuguuguuuuggagaugggaucucuuguagcccaggcuagccucaaaaucacuauggagccgaggaugaccuugaauuccugauucuccugccuccaccucucaaaugcugggaugacaggcaugaaggcuggacuagcagaucugggguugguguggugcccgggaucaaacccaggaccucaugcuugguagacaagcacucuaccaacugagcugugccuccagcuggggaucggcuggcuguucugaaaccuccccauugcaccuauugcgccagcauaaagauagggagaacccaggcuggguuguauauacuguuugcuucugaucuuaaaggaaguuaaaauauagaagugcucagaaguacuguggguuccagcaccacaccccuucugcuuaacaggcagguccgccagcauucagggguccccaacagagcagagaagguaagggucuaaagagacagagauggccuugaguagcuuacuucuuuccuuggucauuccggccaccagugcuggaggacaguauccgcuucuccuugggacccugcgagaagaggggaagacugauggguggcucuuggcuggggccagacuauugggacccugcuauccucuagggccugaggccaggcccuggaacgcuugggagaaaagugaguguuucaagcuggcagguccucuggcuaccacagaggcggagccccccagguacaggguggacagcaccucacugugcuuucuaguugagagccugcuagugggcgucagacuaaccuggcugacgugcuucaccaccuaaaagugcuguguggcucuggcuaaacgagugcaccucucugagacccaauuccuucaaacguuaaauaggggauuagaacuccugcuucaaggaaagccuaaagcuauagauucaaaacaaaacaaaacaaaacaaaacaaaacaaaaccagcagcuuuuucaaaaagaacacuucuaacaagugagaccuuguauaaaaugcuucuaauuuaauguuucucauuacccugaacggcuauuacugucacuaguaugaccuagguagggauagcaagggucagaaacucugcuucaaggaguguagacuucacauuuuauuucuacauagacucuaaguccauuucuugacucccuuccuagaucuaccgcauauuggcuguguguccuuggacaaggcacugaccaccucuggcccgaauaccagccucagagagaacuguugguacacugagcaggguugaggggcagaggcacagcccugaaaaugaccucuugcggggauuuuauuuuacagucuagccucuccuggugaacuccaggcugggaucugaagauagauggagaauucuggcuuccaucgugacccugagcuggaguagcugauuaaauuccauucuguuggccugagcuagauaggauccagacacuaacagccugcagguagacaacaggcggggggugggguggugccaagcuacgcugggaugaggaccagagacagccuggggccuucucugucaggagcuguacaccucagucucucuggaccucgaaaaucaugcggagaauucaccucccuucccacauuaggguggacaaacaccccuaccucugaccccuacauaagguuugaauguucacauucaggguccguugucucaacaaauccaggcagauuuauuggugcgacacccccacccccaccccccacccgucccgugcuggacagcauugcucgcuguggcaauucagauacucaaacagguaggccucauggaugcucugugacgaagcaagcugcaaucuauuagcaaugucuggcauaggcacaggcacugcaaggggugguggggguauguugugaguuccuaucugugacugauaaacugauucagaagugaaagggcccuaugcccauccaugccugagaacuaacaguccccagagucaaagccaagaccugcaaauagggacaagaaaagguagccuggaggcagaggcuggaaggagaggaagacauuagggaaaagaaaaggcuguuagaguuggugggauuaggacagcggauggggauagcgggaagcuaggauggccuaagggacaggguagagcagauggcugcuggggacagcugagauacagggugcuuggccaagccaggaauccauucaagcaaugugugcuguacaccagguggcggguuguaugggcugcugggacuucagccauggucaagauguguagccacucuccaggagccaucuuguagggagucggaaauguguaggcacacgguguuugggaggagagggguggaaggaucuggugauacagaacugagacccaggagacucgauggacuuccugugucaugagaaaaugaggguacauuugggcugaggguaggguuuagucaggaaaagaggaauggcccgugcaaaggcccugcguagaggggcugcugagccccgaggccuggcaaugcagacacuuagcagccauguacccggcccgagggggcaagccuaccauauaguagucguagaggaagcucagagcagccacacucuccucguccccguugacucucaucauggcuuugguggcagccgucaaaggguucuccagguaugucuuccaggccucguccucauuacuguagggaaacuucuggaagcucacagggucauucuucagcaaccgcacagaccugaaacugcaggcagauaaggagggucacuuggagacagggaacugguagagugcuggccauuacaaguauaaagaguugacuuuagucccuagguaagaguaccccuggcuaguggcauggucuucugaucccagugcugagguagcagagaaagggaagucccugagacucccuaguggguguggucuagccuacauggugaguuccagguaaguaccucaaaaaauacaagagggagaacaucggaggaacaacagguaagguugucaucuggucuguacauacauguauacauaugcacccauauccacaugcaccugcacauacacacauacacaucuacacacacacacacacacacacacaugaauaagaagugucucuuuuaggcucagaggaagguccccaagacacagcuccugccaucgauaggaguucagaguugccagccugaggaauggagacuucuuccucugccucuugaggcaaaagaaggaauccgauacagaucaaugccagaugcugccacgcaggagcugcagaccugggucugaucccaucaucacccaaacgaggaccauaggguuggucaaccucagaagggcucugagacaacuccacagacuacugcgguggcaccuacuguccaaggggaaccauggcaacaguuuccagaaaaaugaaacagcagagccugacuucagggguuuuccagagaccacguaaaggcccaggggccugcacguuaucaagucaaggaaaaaugcaacacaggacaggauauuagagccagagagccagugggcagagacuggcccuaggaagugguguuuuagacugacauguauuguaggucccugaguggucaggcagaggcagcgaauauaaauacaaggcauuguccccuugcauggcauggucucaagcaagggauagaggcauacagaggauaaugaugauugcaaaauuagccuagcaggggauggugggaggugcaaaccuacaucucaguacucaggaggcugaggcaggaggacugcaauuucaggacagccugugcuaccgagagagacccuguuuccaaaaacaaaagauaaugucauaaugucuuugcucugcccuggacauguuuugggcacugagcuaagcacaccuaagcaugguccuuacaguguccccucaggacacagcugagaaaccaaaagcucagaggcggcagaagagccucccgggguccccguacuaaguggccucauacucccacacuugaaccagagagaaagacggggcacacccccaaagucuuuuuuuuuuuuuuuuuuuuuuuuuuugagaaagagucucacauagcccaggcuggccucaaacuuauauaucuagagaugaccuucaaugucugaucuucuugccugcaccucccaaguguugggauuauagcugugucacugaggauagaacccagggcuucaccuugcuaggcaagccaucaugucacuaacugagcuaccuccucagcucaagacuuucugauuccuucuuuuggaguagcugagaagugaacauacuacaacacccuuguugcugcuguugcuacugccaccagccgggggaccacauuuacagaaugccuggacaugaggaagaggugucgaaugagaaaauggcugcccagcucaaagacagaguggggaguucccuggucugcuggcaucccagagcuucccugucuauaagggucccacgggucugacugaugcaccaugcuauggucacaggaacugcaccagaugccgugaaccacagcaucuggacuguccccacucaguucugccccuuacgagccacuaucuggggaugaccuugucuccccuguauagcuguagagacuggagauuuggagcagaaaagaaaaugccuaugaccaaccagcccgucagcuacucagucaagauuauuacuauuucaagagggcuucguguaacccagguuggccuuaaauuuacuagguagcuggaaacgaccuucaguuucuaauccuccuaagugcugggauugcaggcaugcaccgccacaccuggcuucuguggcacuggggaccgaacccagggccuugugcauggaaggcuaacacccuacuaacugagccacacgcccagcccacaaccaggauuucaccucaggcuuauccagcucccaagccaugugcuuuccacuagccacacuguucugucccgacuccagucuuuucuagagugggaggcuacccuggugaggaaguugcaggcacugggccagacagguagguagguggguggggaccucuggaagcuacuuguaggaagugugccccuugcugccugaggcuggguacaggcuuccacucagagaggaacuggcagccaagcuguguccaggcaguagggacuaaggguacaguucuucaguuucaucuggggacagugucugcugccccacugucugccuucucacugggcuaugagagggaggcagaaggaacugucacacaggaaagagaaaugacagaaaccuuccugcuguaaggagcaagaagagugaaccacaccccaguuucuguugcuauaaaucaagaggucucaagacagaggggugugaagaggccccuccuuacugccccugagccugggguuagaggaacuaagugaacagccccuccccugccaggcuccaggcuaggcaacucccuaacuaaggcggcaugggaaaagcaaggggugucuaagggaccccaccuucccugcuccccuugccgguuagcaaguccuaccagcaaugcuucuaucucugaauaaggaucacaaaaggaagauuauguagccuggguaucuugauucacacuggagaaaaugcuuagaacccaggcuggcuggcacguaacagaugcgcuuaaugcauacacacccugucggcaccuaacaaacgccuaauguaugcauaccauaccaaugcccgagacuggcuuggagcuagaugcugagagucagcugugcuaccagucuggucacacacgucuggacuucugccuuggaucuacugacuaagaaauggccagucucaauuugguuggacuguacauauuuccaucccuuuuagaaaauagaauuuaaaaaacaauagggucauaccccaaaacaaaagaacagaguuuccauaugggggcuuuugggggcuacacgcgucucuaaugcuuccuucuggguacccaagucugauucccagauaaacaauccccuggggcaucuuaagcaucuaccacaggcagauacugugccaacaguuucuggguggcaccucaccugucucccaccgcaguccugagacacagaugugucccuuuuuacaagaaggggaaacugagacucaaacaaucgucaucuacuaagggccacuagaccaggaagugccgguggcuccacuugaacucagaccucggggccucugaaucccaggaucaccuuucuaagugccuuucugagucuggaaauuucccuccucuggaauacacugaaccuguucuccacaagggaggaauuucccacccauacaggcugggggcaugggcagcugaggcagugacaggaggaguuucuggacgggagcugagagccggggagugccugcccucgugcccaggggucuccguucucaugcccgcuuuugccaccguuucucuucaugcuuuaaggcuaaccauuuagcuucuuggaagccuugacuguucauaaaggucggcagaguuccgggucaaauccugaaaucaggaucugggaucuguguucuuugaaagacucaggcagagcuccgugggggaggcagagugagcagcccagaagcuacuacaggcucaauggaaaggcauuccaaggaggaauucggccucuucaugaaugaaugacaacuuagaacagaaaggggugaugucuauccucuuaggucaccuucccuggguucugcccagguucccaguuggugucccugucuaagacagaaccccugagccgucagacgugggaggagagcggagagcuaguuagaaaaggacugggccucgggccacaagugugaugaccucagaucccagucaggacacagcacggagagcccagugcaccaugggaagaaggcacacaagcucaaggguuggggagcugugcguucuugaggugguucccccccuguuaaauggaucgacugaauguuucucacgugccaaucaaggcucuucuaggcccugggaaaucggccaaguucaagggagauaaggcucggcucccauggaacuuucugucuaauuggagcagacagaccauaaacaugccggggaguuaauuuuaguuccugauaagugcugggaagaauauuaaugagagcacaguacuaucacagagucaccagggguggcaacuuuaaggcagaguuaaucucuccuggguuguuaggggaauuacaugcauuaacauaagcaaugugcuuaugagccugccaguaauaacgccacuguaaguaggccgccaucaucaccaucaccaccaccaccaucaucaccauccuccuccucccagcacuccagaaugagaguaaaggggagacucugccugagguuccugacugaucacaccccuccaagccuugggcugugaacaggcucuagucaaaggacaagggagacaguguaauaaccccuugccuugacuuucacaguccuuaucugacagucucccaacacacauggugguuauuauuccuacuuuaaagacccugaaauagacaguggagacaggagcugaccugagaaucuggccugggaauuucaugauaagucaccuuuauaccaagggauggagcggaaaagccagggcccagggaacccaagugguauuccaugucacugugacaaaugcuucucaagugacugccguggucuagccccuguccugggggacaguaagacaggauuguccuugucaucaaggagguugaagacagacaugacccucaccucaaacagacagcuaauaccaaauaggucaugagagugaagaagccagaggccccgugagcggccuuaucccuggagagcuacggguagguguuuauugagaaagagauggagggagaugggcgggaaggccugagaccuuccaacugagagccaaggucaaaggugucagcuugggccuggccuacugugugcugggugugaggcggaugcuuugcacguaucauccggauucagggaaggccagaaggcuggcugaggaggaaccucaaguccaggauuugacaaucccucucauuugcauagugugggauuuugcuuuuguuuuuuccuagcaccuaucugucaucccucugucauaucugaaguccugcaacgugccuguaagggagggagggaagagaugacuguccccauuugauagcaugaaaaccacccacagacaaggcuaccgauuuaccuaaggccaccaguuggaccggacacaucaggccuggaacuggggucgccagcucacaguaucaggagccuucccaaagcugccaucccacugccucccuguguaacaagguauccaccucacaauggaucaauguauccaccucagggaagagacagccuggaagcagaucgagagaguggagcuagaccucugucacuguggagcaggggugugcaaacuucccuggcccgggcggugggcgggagggagcccagacaaacggagccuuucccuggcaugggaggggugcaguaucagcugucucaugcccggucugccucaugucuugacuccagcacaaucgagcacagaggaagcggagagcugagaagcaaagcuuccuccucccagcugugcucugacucacagaggcugcuguacccgggcugagccgcuucaaauucccagugagacuaaggagacgccacccuggcugcuaggucagacuuucucaucucauuuccuccaauuagaauccuggcaauucugagcaucgacagaccuuuguuuagacaugauguccccaaagaagcagugcugagaccuaaaacacagaucccagagcaggagucugggagcauccuacccagcucugaggucaauaacuguccauguuacaagcaucucaguaauacaguguugccuuuagcagagcaggaggaaggccauugccaaagcaggcagccucaagccucgccuaugggcccgggauauauugggcaagcaggguuccaguucccugaagccuaaggaggaagaguuccaggggccaccugaucugggugucgacacccagauacacccagucaaugacuugccaagcccagcugugagccacccagcuucaucagccgugaucaaucacacucgcagucacccacagggacagccuccacggcugcucacagaggaaacauuuuucagccagccccacgcaagguguuucugagcaugacaggggcgccccaggguuuuugggcuugccaguggaccaucugguuuucuggcugccuauguugugaaauguggccugcccccaugaaccagggggcucucuggagaugcucucaauugaagugcgggaccugacugugugguggccccagcuggaaggaggcagcacgcauaucugguuggagggugugccccagugcuacacagaggguuccagccucagaacuugcuacuuccuggcugugugacuuucagcacguccccuuaacaccucugugccuuugugggaagaugaaagugagaaucucucugggaaaggcucauucauucagggaucacuaagcaucaaguacccacuaaauaaucucuacucacagucuuucauuuuuaccuccaucugugaagugucacuagcaacaggauagcguaggucaugcacuaguauggaagcacgcacacuauuguuccgcuguuaucacucugaauacuggcuuugagcagccagcccagccaagggcaugguuaacagccucacuuucucccugucugucaaaaggggccaucccuacccugccuuagcuuggcacuaaguggccagagcccaggcagccuccaccucuggauccaggugggcaagcugaugguggacaggcuccagauaacacugcuggcugcaucugacuuaauuacaugucauuuccuaauuauaccagaaacucacuuucugcccuuuggaaaacugccccccugugugggaauucuucuuuuaugcccuagucccuuggcuguuugucugacuuuuuuuuuucuuucucuaccguucaauagggaugggaaaaauuugagcucuaccucucaaucagggaacugccucucuucaguuacacauugauguguuagcagacagucacauucugugauggacgguaugugcagagcacuggggacauucuguccucugagucuauccuccaguguccccaguucuugguggcucccugagaagacacuagggaguaacucuuuaguuguaaguauauguguguauauacaugugcacaugagcguguguacacacauguguaugcacaugccugccgugcaauaucauguguggucagagggccauggcaggcauucucuuccgcuaucggugcccaggaaucgaacuugggcuugucaggugauccacaccuuagcccguugagcuuuuggugaaggcagauggaauagagcgggaggggaguuaagaaaaaggaaaagaggcgaaugaaugacugacacagccagcccaugccuccucacccacggccugcacccacggccugagaggugggcauucuuaucgcugcuuuaugcaggcauucacugauacgaagcgcucagggaaaacucaccaaccugccaucugugagccgucugggcuuuaacacaggugugacccugccgcagggcucugggucagcugacucagcaaugacacagcaggucagaggccgaccugggagccuucuuuucccauccucuacuuggucucccgggccagcgguuuaaaaacuaagucaggaucaccuggaaggccugucaaaacaaagaauggcagucccgcccucagaguuuagucugauucagucuagggcagggcuaagaauuugcauauccaaguucccacgugaggaccagccagggaccucuuuuauuuacuuacuuuuagugguggggcugggguuugagcucagcgccuguacgugccagguaaaugcucuaacugagcuaacccccccuccucacggcaacuacguuuggagauugguguuauggaugagccaauaauaauuauuucuuacaaauaauaacucucucuucccuugccucauuucaaaaguuacacaggcuuguaaaacucaaguauauaaaauacgagucggguguggcggugcacaccuguaaucccaaccuugaagaagcugaggcaggaggaucgugaguugaaagucggucugaguuaccuacguuccagacagguuacacagaggcaaggucucguauacauacauacauacauacauacauacauagcagggaaccuacaggaaaaacgaaaggcagggucgaucuacaucuuauaccuaauguccaggcuuagaaacuuuagucugguuggauccagaggagagccuggcucuuccaugaaaucuuggcuacucaaugucacugaauacacacccaucccucuugggauuaccaaaagggacaaaauagauaugcugauuaagcgcuagcaagagucugggucucggggaucggggccacugucagucuuuuugugacugcauggggcuagcacgcuucccagaccuugcuuacaggcgcagcugccuccguuaacaccccuccccccgccccucuugcucccgcccccgcuccgccccguuuuacagcccgagcuuaaugagggcuuuuaacuuuucauucaccagccgcguaacuccgacuuuuaauaacacaccuccugcacgacaaaaauuugcuccuggcaaucaugguuucgaccacaaaaccgcagcggggcggcgcuccgaguuaacucuuucagcgcugcgggccuaagggggagggggaggcguugugagcccucuagccuagggccacccucaguggccacucuccagucucuguuaccgauggcagaggguccgggcuguggggaugcagaggccagggcgcugaggcauggugcccccggaauggaccuacuguguaugaaagguagugaaaccuuccauccuucaucaggugucuuagacagccuuguacacaguaggacacugcggagggucugaagaggccaguggucaccaagaaucuggcucucaagagagccacagucuccagucuaggucagggccugugccagaccgcccacuuagccaggcccauggugggcaguguggagguucagguuguuuuuccuggggaguccgaagcuagcgcuccaggaacccuugcagccagcccccgccacuggguacugcuaggcugugggcuggaagcaggguggcugacagaggugccaggcgcugggucugaccacaugaaaggccaggugcucaccacccaccagcugccuggagcugguuucugacuuacauuggccagccuuuccagggccaccucccuguggaggccuaggaccgcgcuggggugggguggggagguggucugccaccacagcucaguguuucccugucagguagguggguucuuaguggacacuucacucaggagaaagccgagagucagcaagggcagacucacucaguuugauuugaagcagaugcggaccugacuuuucacuaaugccccagggcugacaaguuguuuauucucugagggcuggagaugucugcuuguccuaguaggauauuccagccaaggucacaguaagaacaaggccacaacagcagcagcagcagcagcagcagcuuaaaacacacauccacacacacacacucacaggcacuuguuggcaucaggaccucucaaaccuaugacuccacaggcacuuacaacacacucgaacacacacagacacacccauacacauauacgugugugugcacacacacucaagcaugcccacaacauguucucucucucucucucucucucucucucucucucucucacacacacacacacacacacacacacacacacacacacacucacaggcaaccucagacuccccaguucucagaguggcugagcccccaggucaaucacuguaaucuccaaugguagcuucaaaguugaccugcauuacucagcaggcacaggcuuuccugaacggagaagccucuucugucagcccauccgacuuccaacccaaaccauucaggacacuagcagaaaaccuguuccguaagccagcuucuccauagccccugaggagaaaccugaaaagauucucucugcagccuccgcaggcagcuguaauuggcaugcgugagugugcuggagacgugugucucaaguguguguguguguguguguguguguguguguguguguguguaaagcauagaaaaauaaaaagcaagaaagcuucagaaaugcccaauuauuaaugucuccacaaagggagaaaggcauuauuagcauguucccuaacaggcuuuaaaucaaucacugucauaaaacugaacccuguaaggacugccacuuggucacagcacgcacaguccaggagaugcaggcuugggucacucagauaauaaguucagggguuggggcuugaaucugggcccuaacacuguguuucuauuuuuacuuuaauugggguucaacugucaaaacaguguccugagaaucuauuaaaaaagaaaccugaugcuuguaaccauagugguuggacaguagauguggcuguucaagccggacacaccccagagcuagccgguacauggguuccugucugcaguuaggacccaucaauucugccugcaagcguuugaguucuuaaccugcugaggaaaagcuccaaagagagagacagagaaggggaggaaacaacaagagggucacugcuaaagaggggagaaaggggaagucuguuucuuuccugcuagcuccuugcccacaacuuaaagcgacucacacccucgacuucugucuucuccaacaucuguaccugauacugaggcugagagugaggucagcgucagccagucaagggauucuagaucccagaugugggcaggaaugcaccugccucucgccagacaacacagaugaccucaccaaaaucuaguccucggcuuccccagcguuagcacugccucuggauaaaacugaccacaauuuauugaacgcaacuucagaccccuuucucuuugguaagcauuuuuacagcuuucagcacaccuaagaacucuacaaaguucucuuguuccaaauuuccaaaucaggaaaaugaagcucagauaaguccaacgacuuuuuaagaaugaacagcggaggagagacggagccuggguuugaaccuaaggaaagccacuacagagcccauguauacagccauuacacuauaguagccagaucgcuugggacuguuccaacucaacauaaaggaccuuuagagaaacucaacucuuugcauaagacagcucugagaaccaccuccaagacguucccuuuggcaagaggagagaaagcuucccuggggcgggagugucucugauuuccaaggcaccuccagaguaucaaaaagcgaugccaagauucacgguuucaggcagcccggguguuugccuuccucgaaacugcucagcacagagagaaagaaaaacuauuuucccagggaaacagucagcucuagauagagagcugaacgugccucaacacgcuaaggcaggaucgucagcccauucauucacccuuacaaauugccgugugaauccgggcgcccggccucccuugcucuucccucugcagggaaucccagccagccucggugugcuggggaggccgggaggccagacauccguggcuuuacucacucaaguucauucgacaucuuccuucuccgagguuccagcgauccgucucugguuggcucgcaggcgcugcugaccacucgucucuuaauucuccucugacacagacauucccuuccugcccggggaagcguuugcucuacguugcgcuuuggauguugagauuuugcugacagcgguccccggcugcgguggcgcugauuggcuggaagcacaggugccgacug

SEQ ID NO: 2197 - RNA, 710 nt, Mus musculus
caugccuacgacaaaguugcagaguucugauggagagauauuugaaguugcuguagaaacugccaaacaaucugugaccgucaaggccgugccggaagaguugggaauggaugaugauccuguuccuuuaccaaauguuaaugcagcaauucugaaagaggucauucaguggugcucccaccacaaagaggacccuccuccccugaggaugaugaaaacaaagaaaacggacagaugauauuccuguuugggaccaagaauuccugaaaguugaccaaggaauacuuuuugaacuuauucuggcugcaaacuacuuagacaucaaagguuugcuugaugucacaugcaagacuguggccauuaagauuaagggggaaacuccugaggagauucguaaaaccuucaauaucaaaaaugacuuuacugaagaggaggaggcccagguacgcaaagagaaccaaugauguggcgagaagugaacugcugugccuguuaccauaacacuagaaggguuguuccaagugccaguugcacugcucuguuuacaauuguuaauauuagagaucaguagauaaacaucgccuugucuucacugcguguguaguuccagugaagaucagaccuguggugaguuucuucuaugaacagaaguuuccuccccgccacccccauugcucugaauaaaacugaacuauggguucacugcggaa

SEQ ID NO: 2198 - RNA, 18390 nt, Mus musculus
cccagcggaggcccggaagggaccauucgcgcuuccgucuccgccgggcccucacggagggcggaguugcggcccgaggacgcgacgcgagcccaguuccggcgaggaggccgcgccagugacagcgauggcggcggagucggcgcuccaaguuguggagaagcuccaggcgcgccuggcugcgaacccggaccccaagaaggugagcggcgggcgggcgggcggcgcgggcgggcguugggcgcggcgcgggcccuguaacggucgcgggcagggcgcagugggguucuccuccgacccggagccaggccccacggagcggcgcggggcaguggggaguucgcggccggcgggcgcaccccggcugggggcugaggacuggaggggcggccgggccuugcggcucuccccgggguucgggcagccgcgccagcuguuuccccguugcagccgagcgacuccguccgcugcuuggggguccugcggcucgaggaccccugugcuguacccugcccuuuagccgagaaaacggggaacgccuugggguuuuucgagcucugcuccuggagcucggguccuggaugagggcgugagcguguuaacuccgcucugacauacuggaaggugggaccaggcugugaugagcaaccauguuuaauugcacuuaacuacuuuguugcuccuuuuuagaaacuguuacuuuuuaaauacauuguauccccucgcggucccccgggugucuaggcuucucugagcucuacgaagaggguauggugggaauuagaaucguuuucacuguagucucuagccgaaaacaccaaagggugugacauggcuugucagcauucuagccugggccugagguuccuaaaaggugaaguguccagcgagcugaguggaagaggaagugguggagggagacagcgagcggacuuacacaugcaaucuagguuccuagccagcaccagcucgggacuuuggaggaguucucugcucgaccugucccuucucuaguuucuuccugaaauaccagcuagacccaagugcucuuuauaaguguuaaucaccaucagaauuuccagucagggaccccauucacucuucuuguuccuaguugggucacuaccucucaaccuccgggccacuuuuuaacuacccuccuuuagcucagagauacacuucuucagaagcuguuguuauaagucagcgaaaacguaaauguuucaauugucuuguguuuuacuuucuuuggaggccuuggggaccuuuggucagacauauuuacaaguucuuuuuacaauaacccuuugugggcaucuaauaaauggucauuauuuccaagucccagauugucuuucugaacacuauaagauuugugacugaccuuaaaguaaccacccucauuuuguuguuucugccaucagguuaaaaaaaauaaaaauccuccauguaauauaauaucuguaggguuuuuuucccccauuagaauuuaaauuuuggaauggucuauuugugcaugaaaugucaaguuagaaaaagguuaaguaaauuuucuuaaacuccuaauaauuauuuaaaaggguguuuggugguuuuuguuguuguuguguuugguguuauuggcagggacucauaugcuaacacuaguaggcaaggccucuaccucugacagcccuaauuuggcuuuucauuucccagagagaaaauuaccuuggggcuggggauguauuucaguagcagcuaugugagcucuuggcuucuguacccacuggggagggagaacugaauguguugugaagagagaggugaggaaacuguugagagaccccugugcaaaggaccugaaacguugauauucagaaacacgcugacugcaaagagaaaauugcaagccugcacgcuggcuuuccaaccuccuuuuaacauagcaagcucucacagguuugugaaguggcaagaugauuauagagcaguauugaauuugcaaccaaaucuugcuuccagaccauuauuagccaaaaggcugauuccacaccuguguuuuugggauuccugcuauuggauuuugguguuuuaaguguaaauuaacuauguauucacucugccuucaucuagccucuaggcucacuuguuagagaccuuacugggagaugacuuagcuuuugcuccuaucacuggauuggaaacaauuuucaugacagauaaaguuagcaguccuuuaucagguuuugaguguaaaaacuaugaagcccauagauuggugguagguggagaaugagggggucacugcugggaacugguuagcucuaagacuggaaguggagaacccaagauuccuauguaugggacuguguaaacuuuuguuauuucugucaucugcuaccaguuuuugcugggcuacguuggguugacagcgcugguuuccaucuacuugaggauauccauaguccucucugcuuguuguugcuucauucuuggaagucacugacugaaaacuggggauggugaagucuuuuucucuuauauugggcuaaaucagcuugaacaucucaagaguuuucauugugucugcuagaccaaagguaggccacaggcaauacucacuuugccagucuguacaaagccuugagaucaacacauccucuuugacuucugacuccauuucucucucuuggcuauguagugguccuguaauuguguuuugugaccuuugccacaugaacuguaagcugucaaguagcauggugcugagaaagaguaccugcuuucuucuuuccugugaaauacucugggcaugaguuaggugucugugucucuccuuuuaaggacagugauauuaguuucuuggcuuuuuaggcaaguauggaacaacccuagacccagguucaaugucagcaaaauaggagaacaauacccacuagacagggucaaauaagacaaacuuaccaugauuccgggcacaugguggauggcauauaaauguccccuucuugggcugggcagugguggccuacgccuuuaaucccaacacuugggaugcagaggcaggcgaauuucugaguuugaggucagccugguuuacagagugaguucuaggacagccagggcuacacagagaaacccugucucgaaaaaccaaaugggggggggggggaguccccuucuccagggaccaccauuauaggagaaccacccauuuuaacucuuuccaguaacuccagauuucccuuugagaaaauguuauuagccuuaaccuuugcauaauguuuccuaaguuggaucauagaggaaguggagaguuuaaguauaauuuuuacuucauuaaguuucauauuccccagauacaccacugggccucuuauacccagucaaacaagauugucaccugugauucaauugcucugccuagagacaauguuaaguaauuaugggaguaaaaugaccagaaaaacauacuuguugcuccaccuuguaguaauaugaccgauuacagccuggacuauaaaaacaagucuugcugucuaauauuuaaaaaugaagguagagccaggcgugguggcgcaugccuuuaaucccagcacucgggaggcagaggcaggcggauuucugaguucgaggacagccuggucuacagagugaguuccaggacagccagggcuauacagagaaacccugucucgaaaaaccaaaaaaaaaaaaaaaaaaaaaaaaaaggcagauaguuaucuauuuuguuuuaugguuuuucuguuuguuuguuuuuguuuuuuugagacaggguuucucuguguagcccuggcuguccuggaacucacucuguagaccaggcuggccuugaacucagaaauucgccugccucugccucccaagugcugggauuaaaggcgugugccaccacgcccggcuuauguuggguuuuuuuuuuuuuuaagguucauuuuuauuuuuuauguguaugaguuuuaccugcauauauguauguucacaagaugcaugccugaugcccauggaagccagaagagggcacugagucauggagaacugggcuuacagacagcugugaacugccauauggguucugggaacugaacccagguccucugcaagaguagccagugaucuuaaccacugggccaucucuugagcccuguuuuuuugguuuuuuuuuuuuuguuuuuuuuuuuuguuuuuuagaaaaagauuuauuuauuauauguaaguacaguguaucugucuuuagacaaggaagccaggucuuguuauggaugguugugagccacuaugugguugcagggauuugaacucaggacuucuggaagaguagucagugcuuuuuuuucuaaccgcuaagccaucucuccagccccuguuuugacucuuuaaaaauugaaauagccgggcggugguggugcccgccuuuaaucccagcacucgggaggcagaggcaggcagauuucugaguucaaggccaaccuggucuauaaagugaguuccaggacaguagggcuauacagagaaacccugucucgaaaaagaaaacaagaaaauugaaauaguugugcauauauguguucuauaugcauauaaccaaauagguucaaucuccuguugauuuauacacauguaugugggugcccccggaagccagcagagggcaucaggugcucuaaagcuggcguaacagguggcugugacgugccagauggugcugggaacugaacuuggauucucuggaagagcaacaacuguucuuuuuuuuuuuuuuuaaagauuuauuuaugaguucauugucacugucuucagacacaccaggagaggguaucaggucccauuacagaugguugagagccaccaugcgguugcugggaauugaacucaggaugucuggaagagcagccaguguucuuaaaccucuaagccaucuuuccaggccccuguuuuugcuuuugagugaggauuuacucaauauguagcucaggcuagcaucagacuuugugugcuaggguugguuacaaggguauauauacuaccacagcuggcucaguuaucuguuuuacacugguguaccugaccacacucccuguauggaaaguguuuauaugcacuuacccauucuuagaaaaaggcuuagcaauccugauauccauuggaaauuccguaaguagggauugucugagcagugucugguccaggauccaggguaggacauggaaagaguguuggcugaugagugagaugauuagggaggagcauguuuaaccuuuaugguguugcagacaccgugacuaagcacugcacaugguuugucccaaugaauccucacagcuugcagcacauggagacuaguuuugauuugcagaugaaguaauuaagguucagggagguuacugacuugcacaugaucagccaagaagcugagacgaccucucucucucucucucucucucucucucucucucucugucucuugagcuuugcucuaccaguuuugaccuaguuuuagagucuucagaaaggaaaugggcaaacccaaaucuuucugaucuacccagacauguuugaucauuauuaacagcaaagcugagaugccagcaacucagauuggucuuggguucccauuuguguugacacuuguguuaaacacuaucccuuaaggaggucuguagguccucucuuccuucuuguucugcuuuagauauacaagucuguagaugauuucccuaaauuugcugccuuucacaguccucugcaaagucauaauugcugauggcuguguuugauuguuuuuuuuuuuuauuuuguuuuguucuguuuuuguggggaggggcagaaucucucucccucucugaaacccauaugaccuuugaacucuaggugauccgucuaccucaguuuccuaaaugcugagauuauagacauuagucacuauaccaggccaguuagugaggguuuuuuaagucauuauuuaguuucuguauggauguuuugcuugcaugaaugucugugcacuucaugugugcuuggaggcuagaagagagcaucggaacuaggauuagagaugauuugagccuccaugugaguguugggaaucaaacgcagguccucuggaagagcagccaaugagccauuuccccagucccauuuagugaguuuuaauucacuucucugucucuucuuuccccuuggcgaagaaaguaguuaaaaacacauaaucuagccaggcuuggugacauaguccuguauguaacccugcugcuauuccagaggcuaaggcaggaaguucagaagucaacgccaagccugaucucuaaaugugaaaagaaggcuagguuaggggcuggagagaugacucagugguuaggagcacugacugcucuuccagagguccugaguucaaaucccagcaacugagugguggcucccaaucaucuguaaugggaucugaugcccucuuccagggugucugaagacagcuacaguguacuuacauacauaaaauaaauuuuaaaaaaugaugucacuucagcaugccagaacuuaggggaaaaaaagaagguuagguuauagcuuggcgauagaguacuugucagcauaguuaaucaauagguucaaucucuaguauuauaaacaaaaaacccuaaaagccacaagagagggcuuaggagacauaauacauuugguaacaugcuugcuucaggagcuuuucgcucugaguucagucuccuguaccuauauagaaaugcugugcauggugucacacuuuuguaauucuguguuggagaggcagagacagaaggagccccggaacucaaugaucagugaacuuagccuaauugaugagcuccaggccagugauagaccuagcaucaagggagguggcagugauuguugguuuuuugagacugggucccuguuuagacuaggcuguccaccuccccucaccuaaacagugcugggguuaacagcaugcacugccaugccuagcaugaugauuguuguccugcccuccgcagacauauguguguauacagcacccacaauuuuaaaaaccucacagaagaaaccagagacuggaaaaccauauagacuaaaguaaaucuuguacuguuugugucuuggacuagugacaaagcaucucugagccuuucuccacgcucuaagaugcaaauagcauccauaguuguuacuaugaaggacggagcuccgagcaaguaucucaccaccagauaguaucaucuaccucagagaagauccauaugacaauagaaauuaauauuuguuuucuucuuucugcagcuauugaaauauuugaagaaacuuuccaucuuaccuaucacaguagacauucuugugguaagaauuuuuuaauuguaacuauuauguauugcagauguuucccacuauagcauguguaaagggacgcuuacagagguuaggcuuuacaaugaaagaagccagguacaaaccacuguuugcuuuaugauucuguuuauaugaaauguccagaaugggcuaauccauagacagaaaguagauaggugugugauuguuagggcuuagggaacuggaaggaacaguuucucuuuucacauucuagaguuagguugugggaaguaugaggaauuaugaggagguaaguaugaagaaaguucuagaaaucaccauacuuuaauguacuuugucaugugacaaggugggccagcauguuggaagcagcucaggguggugugcaugauagacaagugugcucagccaggcugcaugacuauuuccugguacuugaauguugggucaaaauuuuugguucaaaauuuaaagauuuauucuuuuacuuacauguaugggcuuuaugugugacuuuaugaguguuuacaugcccaaagagaacccaggcccucagauucucucagauuggaguuguaggcaauugggagcuaccugaugugggugcuggaauugaauuucuguccucugcaagagcaguaauuucucuuaacugcagagccaucacucugugucccucaaccugaaauuuaaacacacgggguacaugagagauaggugaggguuugagugcuuacugaucuucuagaggaucccaggucaguugucagcauucauaucaggcagcucgauacuuccuuuaguuaacuccaguuggccucugagggcagcuguucacacaugggguacacuuauacacacacacacacacacacacacacacacacacacacacacagaagcauaaauauuuuuuaaaaauuaaugcaugaaaagaauauuggcuuugggaucuacuacucauagauucuaauucuagaaaacuuuuaggcuggcauggcugugugcaccuuuguaggugauucagaguucaaggccaaccugguguacauacugaacccugucuuuuugaaagagagagagagagagagagagagagagagaaagaaagaaagaaagaaauccaauuuccauugcuuuccgcugauuccuuccuuaaggguugugaugagcacuuucacugucuccaagagagcgagcuggaucaaaccccaccccuccuguuucauucugugccucugggcuguccugauggccuuacauaaaccugugggcuuuguuacuuugugucagacauuugggucuaggcuacagaguaacuuagucuaaggcguaggcauuuuaggagggauguuucuugcuuuucucuauagaaaaccaugcccuugguuucacaauccucauucagucaaucccuguguuacguuuguaggagacugggguagggaaaacagugaacagcuuucggaagcaugagcaaguaggaaacuuugccagagaccugguggcccaguggaagaagcugguuccaguagagcgguaagaacauuucuucucugcuuguuuggcuucacaugucaaauuaacuaugugaccucaauuacaaaaacaacccaggguuauuguaaguuauuguagaauauaugguaaaguauuaagaauaaauuuuucuugcucucuuacccucuuguucuugcucguuugucucucuuacucuugcuucccgcuugcccguucucuccccauucccuuccccacucucuccacauggccauggcuggccucugcuucucuacucuucucccucucucugccuuucgacaagaaacgccuuaaaagcaaaaacaaaacaaaccauaccacacacaccaaacaaaaagcaaaaaccaaaccaaaaagaauaaaauuuuucuugcaaccugugggggaagggagagcucuggcccuaaagguuguccucuggccuccacauguccaugaugcaggcaucucgugggaauaaguacauaaaaaugcaagcaaauauuuuuuucuuaaauucuuuuuuuuuuuuuuuuuuuuuaaagauuuauuuauuuauuauauguaaguacacuguagcuaucuucagacacuccagaagagggcgucagaucuuguuacagaugguugugagccaccaugugguugcugggauuugaacucuggaccuucggaagagcagucgggugcucuuacccacugagccaucucaccagcccccuuaaauucuuuuugguugguugguuuugguuuuugagacagggucucucacuauagccaugguggaacucaagaccaggcuggccuugaacucaagagaucugucugccuaugcuugugagugcuggaauuaaagaaauggggcugacaugccagggcacaauucuuuuuaauguugaacauuaacacuuuguuagguguguuuuguuuucuuuuguugggggcuugaugcugaggacugagcacaggcucucucacauacuaagcauacuaaggguggagguggcugggcacguggucagagauccgaggauagguuuggagagucaguuuuuuuucugccaccaugggauuggacucagguuuucaggcuugcauggcaauaauuaucuguugagccaucaggcugcccucaauaucuucuuuuaacacaccggcucauucuaaucuagccuuggacaugcuauuaacacgaugaccuugaacaucugauucccccaacaauccuauuuuagccuccuugguacugggauuuuagaugugagccagguguggccuggucuuuguuguuuguuuuguuuuguggugagaccaggucuucuguagcccauuggccuugaauuugcuuuguagcagaggauggcuuugaacuugugauuauccugacccaacugugcccuccauggcugagguugaggucugugacuuugucuaagagauuuaugcugaggucuacuucugcuucugcuuuuauuuuagaaauagugaggccgaggaucaggauuuugagaagaacaauucccguaagcgucccagagaugcucuucagagggaggaggaguuggaggggaacuaccaggaaagcuggaaacccucugguagccgguccuacagcccugagcacagacagaaaaaacacaaaaaacuuucugagccugaaaggccucacaaaguggcucacagucacgagaagagagaugaaaggaagaggugucacaaagugucaccaccauauucuucagaccccgagucaucugacuauggccauguucaauccccuccaccuucaaguccucaucaaauguauacagaccucuccagguccccagaggaggaccaggagcccaucaucucacaccagaagccaggaaaaguccacaguaauaccuuucaggacagacuagggguuagucaccugggugaacaaggaaaaggggcuguuagccaccacaagcagcacagaucuucacacaaggagaagcacccugcagaugccagagaggaugagaagaucucugcugugagcagagagaagucacacaaagccucuuccaaagaggaaagccgaagacuacugucaggggacagugccaaggagaagcugcccucuaguguuguuaagaaagacaaggacagagaaggcagcagucucaagaagaaguuuucaccugccuuagauguugcuucagacaaccacuuuaaaaagcccaaacacaaggacuccgagaaagccaaaucugacaaaaacaagcagaguguagauggcguggacucaggacgagggacaggagacccauugcccaaagccaaggagaaaguucccaaccaccugaaggcucaggaggggaaaguaagaacuaacgcagauggaaagucagcaggcccgcuccacccuaaagcggaggagacagauguggacgaugaguuugagcggcccacgauguccuucgaguccuaccucagcuaugaccagccccggaagaaaaagaagaagguugugaaaacguccaguacagcacuuggagaaaaaggacuuaaaaaaaaggacucuaaaagcacuaguaaaaacuugaacucagcucagaaauugcccaaagucaacgaaaacaagucagagaaguugcagccagcuggagccgaacccaccaggccucgaaagguaacucugcuuccugccugccaggcugcuuguccugcuguccuaugacugguugaguucugauuguuauuauuaauauucucgagcuugcuagcacuuagaguggauagugcgcaggauaagauuuguucugggcuagggaggaagcguguguauaguauaguauaguauaguauaguauacagugcucacugagaggguaugagagccuacauuuacuucuuagcaccucaaaauuuuccaagacauuuuuugcccuauugacauuuauuucuuuauguaaauggugucauucgugacuugguuaacuacugcaggggagaaagcugauuacagggugggcucugcacugugucucuugcaggucccuacugaugugcugccagcauugccagacauccccuuaccugccauucaugccaacuaccggccccuuccuucccuugaguugauucccuccuuucagccaaagcgaaaagguaauuuuggacaucuuuuuauugauuuuuaguuuuuugaaacagggucucauuacauagccuuggcuggccugaaacucacuuuguaggcgaggcuggcuuuaaacucagauucaccugucuccgccucccaagugcuagcauuaaagauuauauuuuuauuuugccuguauuaguguuuugcuggcauuugugucuauucaccaagugugugugguacccaaggaggcuggaggagucaauguuggggcccuugggacuagaguuacagaaguggugagcugccgucugggagcucuucaccauguaguguagaccuuuugugacuuggcuuucuucuuucuacagcuuucucuucaccccaggaagaagaagaagcuggguucacaggacgcagaaugaauucuaagaugcagguguauucugguuccaagugugccuaucuccccaaaaugaugacauugcaccagcaguguauccgggugcuuaagaauaauauugacugugaguuaccaaccucgcaagcgcuuugcuccacugggacuuugucacugggagcuuggcugccauucagcacucaccugcccaccucugguuucucugcagcuaucuuugaaguaggaggaguccccuauucuguucuugaaccugucuuggagaggugcacaccugaucagcucuaccggauagaggaaugcaaucaugugaguguccucagugggaacagugcgccuccccggcucuguuuccaaagguggcuuggucucuagaucugcuguggcagaagggcaggucagagggcaaaucacagcucugggcauguuuguuuugcgagucugggccuuuaaacaagcauuuuugugccuguuccugggauccuucuuuguuuugauuguuuggggugggggguuuggcuuuguuuuuuuaagacagagucuggcucuccuggaacucacuguguagaccaggcuagccucaaacucagaaacccaccuuccucugccucuugggugcugggaauaaaggugugagcaacuucuacccugcuaccugcuaucuuuuuuuuuuuuuuuuuuuuuuuuaaagauuuauuuauuuauuauauguaaguacacuguagcugucuucagacacaccagaagagggcaucagaucuuguuacagaugguugugagccaccaugugguugcugggauuugaacuccggaccuuuggaagaguagucgggugcucuuacccacugagccaccucaccagccccuuuuuuuuuuuuuuuaagauuuauuuuuauuauuauacauaaguacacuguagcugacuucagacacaccagaagagggcgucagaucccauuacagaugguugugagccaccaugucauugcugggaauugaacucaugaccuuuggaagagcagucagugcucuuacccccugagccaucucuccagcccccccccccgcccccuuuuuuuuuuuugagacaggguuucucugaguaguccuggcuguccugggacucacucuguagaccaggcuggccucgaacucagaaauccaccugccucugccucccaagugcugggauuaaaagguaaaggcguacaccacugccuggcauuuuuuuuuuuuuuuuuuuuaauuuagugauuugccuucuuccuaguauugugguacugcuacuaagucaaccugccucccccauacuauuaggcaucggguccuguguagguaaaggggagauaggaaggagagcguguacacaagucaugccuugguccugguuucagguauuaauugaagaaacagaucaguuguggaaaguucacugucaccgagacuuuaaggaagaaaggccagaagaguaugaguccuggagggagauguaccugaggcuucaggacgccagagagcagcggcugcgccugcucacaaacaacauccgcucugcucaugccaauaagccaaaggguaaggaagcgcagcugagccuucuguccaggcugcucccgagugcggguucacaggccccgcaaaccuuagaaagcucuagaccaguggccauggguugugacuccuucugggggguucaaaaagucuuucacagggguugccuagaaccauuggaaaacacacauaaacuuacauuaccauucauaacaguagcaaaauuauagucaggaaauaacaguaaaauacuuuuauaguuggggaucaccacacaugaggaacuguauuuuuuaagauuuauuuauuuauuuuuguguaugaguacauuguugcugucuucagacacaccagaagagggcuuuggguuccauuacagaugguuguugugagccaccaugugguugcugggaauugaacucaggaccucuggaagagcagucagugcucuuaaccgcugaggaacuguauuaaaaggucacaacauuaggaaaguugagaaccacugcucuagacccucacauuggcagcaguuccuuugaguaugaagguaaauauugauguuuguauuucuacucaggacgacaagcaaagauggcuuuugucaacucuguggccaagccaccaagagauguccgaagaaggcaggagaaguuuggaaccgggggagcagcuguuccugagaaagucagguaaaaucucucugcugcaagagcauuacccugaaggagagcuggggggcaggaagugacucauuugugguggagucacucaguggagaguguucuugagugguuaccagagcuguaccuuccucuuggccuuugcuuaggugaucauuucugcuacaugcauguguucuuguaggcagagaacaggaccugacucaagaacgggccccuucugcauuaauuuuucucacuuauaccccaaaacuguuuuuauguuugaagauauagcuaugccaauaaaaugcuuaagccuagguugauucucacaccgguguuaccaggcagauggcuggugugcacuugugauccuagugcuggggagcgaguccccggccagccuagccugugcagugagcgcugggucucaguaagacucugucucauagccagguagcuccugagaaauaacagccaaggcugacuuggccuccacaugaacagaugcccugguacccacaucugcauacauauaaaagaaaacaaauuuccagggugacuagauuuuuuagggcacaugagcauuuccaaauuauagacugacauuuuaacaggaaaagcuuagugugacugucacucucaauaaagggcuaacagcuguaucugaaucuucaccagcacucaguguaccaggcccacugcacagagccccagugaagucacccagcaacagcucuguugagauugugugcucccagcuaauugucagcuuugucuguauugcaggauaaagccagcgccauauacaacaggaagcagccauguuccugccagcaacagcagcagcaacuuccacuccaguccugaggagcuggccuaugaugggcccaguacuagcagugcccacuuagcuccuguggccagcaguucuguuuccuaugaucccaggaaaccagcugugaagaguaagcaacuuuggugggaacagggcugugggccaguagggauccugacacagauguuaacugagccaaggacaggcuggcccuccucagguguuucguguuuauuagcucauggugagaccuguugcugcucugggaagcugcagggucuggguacuauugaaugugugaguuggaaaguuaaauugucggcauuguggccucaagagucagcaaagacuucugauuugccucuuaagccgccaugagcacagcggccagucuuggaaagcuguggugucagagguacuggugguucugcaccuacagggucugguagagucugccccauuucauggggauucucugacagcuuuucagacaguuccugcuagucacuucauuuguguguagagugaaguacacagccagggaauacaaacucagucuggcuuugcguggugcaugucugugcuacaucagucugaagccacugacuccuuugucuucacagaaauugcuccgaugauggccaagaccauuaaagcauucaagaacagauucucccggcgauaaacaggacuugccuuggagguugagucuggaagcaggaauacagggacgguggggacaggagaagaggauaucuacagaagacccauaucuuuugcuuuguggaacuuuuggccucuugacuccuguacacuuccaugugucccacugugugccucagcccugcacccugcuuguagcacacuucagauuucugaagacaguaugagccucaguccuacugaggacuuuaagaucaguuauacuuuuguugcuaauuagcaucuuuguaaacuauaagacauaguuuuaauaauaaauauugcccccagauguauuuauaauaaccccaggguuuuuuguuuuuuuuuuuccuuuuuuuuguuuuuuucuuuuuguccucuauauuuagccuuuuacuuuccagguccuuuauuaaaguuagaugagccuagcaaaagccauucuuguccugggucagcucuucugaguagacacuggucaaagggcaccuucagagccaguguguugcuccaagcccauauacagggccaggagugagagugccagaaugccuguccuccagcgagccucccuguuaaacccucagaguuccuugaugggcgcuuuucuuucuucaguaguguuugcuaaagaaggcuguuugcaaagucuauaguccuuugugcaucaucuucaaaucacacuccucuucccuguuuucaggcuugcuggaggacagacccuuaagauaugaauuuauguaggaccucagcaguuuuauaauccuaguuucugguucaguauuuuacauacacaccugcccuuauuuugccuuucccugcacuguggggaaacagacauagcagggcuuuuguagcucugagugugauuuugggggguugaaaugccagcacuuuauucucuuguucucuaugaauuccuaccaggagugaaugauuuaaagcacuguagugcuguggaacuugcuuuuguuugaaaggaaaggugcugaugugcccagaggaacgguauugugcuguggccagcagagaacucugugcagccuccgccuucugaguguuggccuugggaaggguggauggucacccuggucccagccaaccaguucaggaggaagauucccuauuucuaggucgcauaagggcaagguuagagcuaggaggauagugccagcuucuuccuuccugucagaaaacguggaagaggacucaauuggcuaugagccaggugaaagacacuaugaacuugaggggacagacagcacuggcacugugccuauccuguuuuagcacccucaagaccucaggcuagugaagacucccaaggcaguccaggaaaccugcacagauaaagcuaggcccaccuuacugugcauugcuaugcugggucccuguugccaugggacacagguauugcuaaguaaaacauuguuucucuugguugcuuguuucaccauaccaccucucagccugaccucaaacucuaacaucaggucucuuagcugacguuaaagggacauuuguacuaggagccaggccccugcugucuagaacagccuccuuucuagguguugaccaccucagauuuaugccuuagcuguguuucaagacuucccuuugccauuuuuuccuauugcagguucgauuguguaugauuuaauucccuuuaggaauuuguaggccuagggaaagaaaggacaugcauuugcccgucccaaugucagcaucugguuuggcacacaaagauuucugaggcacccaguuuaccuagagccagauuuucuagcccuucaagagugucugugucagggauaggacugcugagaacagugagggcccagugagcagcugucuccacagucccucaccccaugcacaauggccacaaagcagacacagucauguucaacuuuuggucacauuugugaagacucgugcaauguuuucugugcuacacuacauacaggucacacaugauggacuagcccuuuacauacagaugacacauacagaauagcccuuugcgauccuuggcguuccaagggcucucaggggcucacuuucucuguuuuggaggcaggaggagcaggagugagcaccacccugcucugcauuuguauuuuggucccaaaauguaaauacaauuuucuauguuacuuuuuugugguaacuacaagaugaauauuuuaauuagauaaguuauacaaaaaggaaaaucccaugucuaaauaaaaagcaaaaaaauucuaccugc

SEQ ID NO: 2199 - RNA, 3667 nt, Mus musculus
uggguauuggaguguugccuggauguguguuaugucuggauaccugaggaaauaugccugguuccugaggaaaccaaaagaggguguugaauaaucccuuagaacucgaguuauagauggcugugagccaccauaugggugcugggaacugaguucucuuuugaagcagcaagugcucuaaccacugagcaaccucuccagcccugugcuucauucauuccgaguucacucagagagcaacuggcucucauacaguauucuaaggucuuagagaugaaagcaguucucauuaaccccaaggaaugaaaguauuuguccauucagagacuccaaggugaaucccagcacucuugaaacagaggcggaaggaucacaaguucaaggccagccugagcuagggagaccuuguuuccaaacaaaucccaaacacuugaaaguaaagguuuguaggagccgucuuugaaguggucccaccuugaagcgacccaaaaguuccauccacuggauucauacuaauugcuaggaacucuuuaaguauuuuuauacuguuagagaagcagauagcuuugauagaaaacuacuugaacaaaaggaacuguugaucucagguggucuggauagauuucagaaacaguaaucuagggggaaagaugacgauuacaccacacucaaaaaaaaaaaagauuuauuuauuuauuuacuauauguaaguacacuguagcugucuucaaacacuccagaagagggcgucagaucucguuacaaaugguugugagccaccaugugguugcugggauuugaacucaggaccuuuggaagagcagucagugcucuuaccugcugagcuaucucaccagcccuacacugcacuuuuuauauaaacuucuuuaagugaccaagcaugguaacaacagccuuuagucuuugcauucauguggcugaggcaggaggaccacaaguucaaggccagcuugagcuacauauugagacccuguuaaaauuuugagaauacaaagucuagagcuggguggugguggcauacaucuuuaaucuccgcaauugggagacaagaggaggcuugcaagcuucagguacccagcgguaagcuccgcccuauucugaggcagacacaagcugggcagaaagugaagcagggggaaagaugaggggaggugaugguggggugccgcuagccaucuggucuggggccagagccuuucccuucucgaguucuguguguccacaccugucuuugaaccacacaucugucugucugcccaggagcccacagccaucagagagaggcccagggcaacaucugugucucaguguuuuucuugugacuucccacaggaaggggcccuggaccuucugaagaagcugaacaguugccagauguccauccagcugcuacaggugggaggaggggcucuugagguaguugcucugugggagggaaagaccccguggagguuuuggggggugcuccugggggugaggugccaacauggaguugagggugcugagagcgucucuugagaguggguuacuucccagccucaggggucaggguccuugugucuaagauguuuuccuugaaccuuuaucggaagccugugagaugcaaguggcuuaugaccaagggagagagagaugccccccccccugcuuucaaaucuuccuuaaauuucccauaaaccccuaaacuuuacuggagacuucuggucuugaagcaccaguguagaucuaagauguggcagccugagguagguugacuuuuuuucaaagcauccaguggacugagagugguccaggguccuagcugcagccaacacuaaccccaccccagcuuuccaccaacccugccuaucagcguagacuggggucucaggcaggagagcgguuagggccuaguucuaggacagaugaccaagguccuguccucugcugggggucagggcaaggacccuggagaagucagauuggagggaagcgaugguugaaauggggcugcugccuucaguaagaguggcugguccugcgggucagcucccuuaaccauugccucacagaccaccaggaucggaguggcagucaacggaguccgcaagcacugcucagacaaggaagugguguccuuggccaaaguccucauuaaaaacuggaagcggcugcugggugagagggggcaagaccgaugggagauggggcuuccugccagcaugugggagaggccaugccuggcuagugguagguucucagcucacauccuugaguuauuuaauaaguggcauguagucccuggaucauggagcucacgguggugugugugccgguguaagaucuauauguagcauguaacuuuuauuguaugugucuauacguuucuauuugugugcauguauaugcacauugcccgacucugcauagauggguguacugcuauguuccaugugagguguaccuguuuucuauauaucucugaauacaugcacaugugugugcauguguucacaugcaucugcaugcaugcauuccugugugugugcauauaugugugcaugcacauguguaugugcauauguauguuugugcacauguguccacacgcauccacauguaugcaugcaugugugugauaggccugcaugcaacugucccccagucuugauacuuuguucuccagggaccaaaaucacacaggucugugcugugaaggcgcugaguggggacacaaugucacaauuuuauuuucagacucccccagaaccaccaaaggagaaagagaagaaagagaaaaagcgaagaaggagaaaggacuuggcuguucagacuggaaaccagaagcaggccuuucuccaccaaggaagaaaggagggggagagcccaaaacuagguacuucuuucuagggcuggaggugggggggggacggaccaugccugucauaccuuuuuuuuuuuuuuuuuuuuuuuuuuuuuugguuuuuugagacaggguuucucuguauagcccuggcuguccuggaacucacuuuguagaccaggcuggccucgaacucagaaaucugccugacucugccucccaagugcugggauuaaaggcgugcgccaccacgcauggcuaaccuggcacaucuuuuaccagcaaccauuuagagaauuucuugaagcccuggagguagauguuaugucuccuuuggagcucacccuggggguuuuggcuuaaucugaccaacuggcauggccucaguuucacccugaauggagaagggauggggagcaugccaggcaggcaggccuggcauugcucagcuuugagguguucccgggagccaggcccaguggcacacacagccguaaacauagcacucaagugaggggagugggagaccauggguuuguggcuagccugggcuacauagcaaggucacugccucaaaaaaaaagugggguucucucaggaggauacacagcuguucccuggcauauacaaagaaagauggccaccaugggagagaaccccugcuuagagggauccccauguccccagcauugcaccagucccauaagcaaagccuuggcauccaucaagaccagucaccccugucgagagccacggcauaaagcuguggcucuccacuaauuaucuguagccgguucucagccu

SEQ ID NO: 2200 - RNA, 2009 nt, Mus musculus
cuugcuaggugggguucgcuggggaccauaaccaguggaauuguugguaagaacuuuuuuuuucuauuucuuuuucuuucuguuuuucuguuuuuauuuuuguuuuuguuuuuaguuuauuuacaagugggacauuaguugugggaaaauguugcccauuaucuuguaagcaggaaauuauguuggcuuuaaggaaaaauaagugucuaaguagaauuuguauucucaacaggaacauauaauaaauaccuaacucauuuucaaauuaguagaucagcagaauauuaagauaugaaauuuuccaguuacaauuuaucaaaccauaccuuacaaucuagaauaucuguugaagcaauaaugauauuuuacugugauuuuagucucucugguaucaucuauuacauuuuuauaggauauuaguguauaaguauuuuaagagauuuauuguacacuaauguuuaaugaaaaugagaagguauugccuagauuggaggguuuaaauaguauauauauuuuuuaauucuauaaaauuuuaauauugcaaaauuaaacuugagaauucuggcaguuuaauaaaauaguaguauugguuuuaaagauccguuuauauaguaacuuaggauccagaggaaguuuacguggcugcagucuugagaccuagagcauaaguagaaacaaagguggggcugaggacguggguuagugagagcuuguauuuaacaauguuagaggcacuaaguucaguccucagcaccccguacuagguaaaaauaaaacaauuaguaaauacugcuagagucaacagucuagauuccuagacauggaaauggugaacuaacugccugaggugugcuuaccuggaaucccagcacugggggaguaugagccccaggcuggcacacaauggaaacuugccucaaaaaagaccaaggcucaggauguaguucagugguagagcgcuugccugacauacauaaagcucuaggucaaugccuaguagcacaaaaaaauuaaacagcuaaaaacaaaaauccucccagcuuauacucaggguauaucaugaugauugaguauaaauugagggaaaccaauuuaacaacuaggcaaaaauaauuauaauuugugacacugaauaaaaguaauugcaaguguugauguuugaagagcugccucaguauucuuguggaccuuugcguucugguggcagugucagucuagaaccugguaggcauuacacaugugcuagucagcacugggacugacgugcuuagcucuuggugucacagugaagucacgugcuuagcucuuggugucacagugaagucgugcagaaucacuagcaguuucaggguugaguuaagguuuuguuccuuuguccacauuuuauugugcgugcaucagugccagaaaaagugagguguagaacuugguugcuugcacuaaacagcuucuugggaauaaaguuaaugguguuagggacauucaauuuggaugaguuuguguaaauuaagagaaauaacaguacaauuuauuaaccauaugcauuugcaacaaaauacacuugaugggaccagaaaggaagugggcgcuauggaagaacucuuaaauugcuccaauaaggggcuuccaguccauguagcagcugugucaggaucucagaacauuacuuacugugguuuuucacagguaaagauuuggcuaaagaggugcuucuggccugcuaaagaaaauagguggaauuguacuuuaaagagucacugcaguauuuagaguuauguucucuggcuauuucuagaauuggacagaaaaugccuacaaaacacuaaaaaacuuucugguguacuacaguacaguaacaugagauauauccaaauugggacaguuacaugacauguccauuuaaucauuucaagaaaaaccugcuuuugguacaguguucauguaccauaccuguauuggaauauuuguaugauguuaauauuuuuaauaaaauuuaacauguucaaaau

SEQ ID NO: 2201 - RNA, 1225 nt, Mus musculus
uuuuuuuuuuuuuuuuuuuuuuuuuuacuaagagucuucccaugucugcugccucucaagugcugggacuaaaagcuugugccaccaugcuucugggaaccauuagggucuaguuguuagcagagcagaagucuguggaaauaguuuaguagcacuuacuccugugcacaaagaauagcguuuagcuucccaccaugaugcuaauaaguuaauucauaaaaucguacaguuagacucauggccgaggccagcuugagcaagguagucaguuuauauaaaaauuauuuaaacuaugcagcagcauccuucaaaaaucacauagaaguucauuagccuaaaacucagcuucacagcugugcaugugagaacugcagcaucgucugagaaagucauucugcaguugucagcugugcagagaagaaagcauuuccuugaacggaaagggacugcguuauuucaggucucauauuccacugaggccuuggucacugccauguguucuugggagguuaauuuuaugcucgagccaagaauccuuuaagucuugcuuuugguucccuggauuuuaaaauagguuaaauaaaaaauaauauacuuuaaaagcuauuuuuagucaguguuuaaaauuucaggcuuaaaaggaagugugcuuuauauugaucaaaauguuaccaaacaaauccuguuauugaaccugauaaguaucaugggauuuauucauuuagcuguuguuagaauaccucaguugguuuggucagaacuuaaaugucuuuccagcacaucaugguugaaguaagccaggcacugguggugcacacuccuuaaucucagcacugaggaggcagaggcaggcagaucucugaguucaaggccagccuuuucuacagagugaguuccaggauagccaggacuauacagagaaacccugucucaaaaaacaaauaauaacaacaaaaacaaaagaaaaaccacucagauuuugguuacauuguguguguuuaguuuugaugugccuccuguuagcccauaaaguccuguuggagcaguguucuggaggcagccgcaggaggaaagucugaggcuauacagggagacuauccuucaaauauaagcaagaguaaaaauuguugcugaaacucauucuuaugcuguggagagcaauguaguuauguucauucauuguaacaauuucuauuugacuucucuaaaugaaaaaaaaaaaaag

SEQ ID NO: 2202 - RNA, 1733 nt, Mus musculus
ucuugcccuguuccaaggacugucucacacacacacacccucaacacacacacacgcgcacaugcacacacacacacacacacacacacacacacacacacacacacacccgcgcguucccggcagaggaggaccccgaguucacaagacgcggcuuccuggccgcauuccggagaaggagcuuugcgccgcaagucccaucccccggucguccggcucaggaaacgcagagaaagccaggaacccggccugccaggccccggggcccuccgccccguccuucggcuucaggaagcgcgcuggcgggaacgcccugcccgugggugggaaaagcucgagccgcugcaucgcggcgucccugggugcagcgagcugucaccgccgccgccgcacgccccugccgcagccccaucccugcgccagugcggcagccgcguggccgggauccugcaggcgccaccgcgcgggggugcaggcagggaaggcguggacccagagcucgcuuugagggggcgaccugcuuagggugugugggugagugcuccacugggucgcuaggacauugcuagaccgguuggcauuagacuccgggugucucuuugagucucaacuugugcuuggcucccggaaauuuaguuucuuaaugguggagaucucaaaaacuguuccggaccuagagacuacugugaugggcagaccgugaucccuuuucaccaaugagagucaaggaagaaaaagauggaggacaugaaagggcggugcuuucgaguauagccugagcguuggaaccagucauucccgggcucaggacccagcuuucccccuuacugugugaucuuaaguagguuccuuaacuucucugagcuuccgggccauguccuuuuuaaagagucuuucaacucuaaacccaguuagguuuccccacugcacccuucuagcccacauggccugauuccuugagacacuuagugucaauaguauuaaacaauuguuaaucggugccuugucuuuccacuucagaagcacacaaaguucaggaagauagggaccuucgcuaaaguaagacuguguagcgcugacacgcguuaaacauccaggcauuuguugcgaagugaagagcgaagggaugcagagaugcgcgccagaugccgcuuuaagggcggaaaagcaccagaaaugaauaaacaccauuccuaucgucaaggaggucccagacuggcuaggaaggggaaugaaacggacuugugcaaagaagaugguccuaagugugugcuaacagggcuuaaacaggccuggagagaaacacuaaugggggagcagccggaaagacagaguugagagacaccgggucccuagagugcugggauaauggaucucacuuccaucacaauguacaaaguacuuaguuugcauaaaguauggacguaccuuuuuuauccuaaggaagugggggaauugauggagacuaccgacuuguucaaguccuccuccccuuuuggaggcggggagcugcgcugaagaugaauucccaaagccuugugcacgcugaugaccauugagauagauacauacauccucagcuuuaaggccucagcuacucaugcgcaccacuuuugguuuagguccaaauaaacuggugauuuuagguaaggagcauugcuucucugacuugcuuuaccucuaagccuguuugccaaaacuagaaagaguaauaaaggcuuccuauaacauga

SEQ ID NO: 2203 - RNA, 1733 nt, Mus musculus
ucauguuauaggaagccuuuauuacucuuucuaguuuuggcaaacaggcuuagagguaaagcaagucagagaagcaaugcuccuuaccuaaaaucaccaguuuauuuggaccuaaaccaaaaguggugcgcaugaguagcugaggccuuaaagcugaggauguauguaucuaucucaauggucaucagcgugcacaaggcuuugggaauucaucuucagcgcagcuccccgccuccaaaaggggaggaggacuugaacaagucgguagucuccaucaauucccccacuuccuuaggauaaaaaagguacguccauacuuuaugcaaacuaaguacuuuguacauugugauggaagugagauccauuaucccagcacucuagggacccggugucucucaacucugucuuuccggcugcucccccauuaguguuucucuccaggccuguuuaagcccuguuagcacacacuuaggaccaucuucuuugcacaaguccguuucauuccccuuccuagccagucugggaccuccuugacgauaggaaugguguuuauucauuucuggugcuuuuccgcccuuaaagcggcaucuggcgcgcaucucugcaucccuucgcucuucacuucgcaacaaaugccuggauguuuaacgcgugucagcgcuacacagucuuacuuuagcgaaggucccuaucuuccugaacuuugugugcuucugaaguggaaagacaaggcaccgauuaacaauuguuuaauacuauugacacuaagugucucaaggaaucaggccaugugggcuagaagggugcaguggggaaaccuaacuggguuuagaguugaaagacucuuuaaaaaggacauggcccggaagcucagagaaguuaaggaaccuacuuaagaucacacaguaagggggaaagcuggguccugagcccgggaaugacugguuccaacgcucaggcuauacucgaaagcaccgcccuuucauguccuccaucuuuuucuuccuugacucucauuggugaaaagggaucacggucugcccaucacaguagucucuagguccggaacaguuuuugagaucuccaccauuaagaaacuaaauuuccgggagccaagcacaaguugagacucaaagagacacccggagucuaaugccaaccggucuagcaauguccuagcgacccaguggagcacucacccacacacccuaagcaggucgcccccucaaagcgagcucuggguccacgccuucccugccugcacccccgcgcgguggcgccugcaggaucccggccacgcggcugccgcacuggcgcagggauggggcugcggcaggggcgugcggcggcggcggugacagcucgcugcacccagggacgccgcgaugcagcggcucgagcuuuucccacccacgggcagggcguucccgccagcgcgcuuccugaagccgaaggacggggcggagggccccggggccuggcaggccggguuccuggcuuucucugcguuuccugagccggacgaccgggggaugggacuugcggcgcaaagcuccuucuccggaaugcggccaggaagccgcgucuugugaacucgggguccuccucugccgggaacgcgcgggugugugugugugugugugugugugugugugugugugugugugugcaugugcgcguguguguguguugagggugugugugugugagacaguccuuggaacagggcaaga

SEQ ID NO: 2204 - RNA, 85024 nt, Mus musculus
ugcuuguuggugcucagucuuacaguuuauucugauuuuacucuuguuaaucuguguguuuuuuuuuuaaauacauauuggguaaaauaauagugacagaauucuaaugucaacuuagagaucaauuagcacuauaguguaucucacaguuugaggcuauguaucagucuucgaguugucauccuuagugagcagguaaccacuucacuccaggauuuaucaagugugagugaggguuuaaagccuggcaaccuuagguucaccucuucuguuuucuugucuggaaagugaaagaaauagcauguugaaccuguuggcugccauauucaguuucuuaauuggugcuauccuuguuaccauuaaaguuuucccacuuucucuaggaugugaagugauugcugugaacacacguuccacaagucaaaccuuuauuuauaagugugaugcaguucucuguacacuuccuuugggaguguugaagcagcagccaccagcuguucaguuugugccaccucuuccugaguggaaaacaucugcaguccaaaggaugggauuuggcaaccuuaacaaggugcuuugcuuuccucucuccugucgcuuaguauuugguguccgguagcaucagugaagaaugggcucugcauguagccauguuugccuguucccucagcugucugauuccaggccugaggccuggcagugccuggcuguauuauauauaauauucaagcacacuuuauaaucccaaaccuacuugggauucuccuaggaguaguuaguacguuguaagaacuauggcucuggaaggggacagugaugcuuacagagagcaguugcucugaggccagcugacaugcucccuuccucugcuaggugguguuaugcuuugaccguguguucugggacccaagugucaauuuguuugggcacguuggcaguacaacugcuagcaggggugagcucuuccucuucuggaaccuauauaaagguaacuguuugcuauuuuauuuuuucauacucuuauagagacagaauuaggaauauugaaguuuucuaauauagauaugacuuuuuuuauuaacuuaauaaaagcccuucaaaguguuacauguaaaagaaugcauguaaaaaugaagaaacauccugagacuuagauccuauuugcccaaacgccucagaucacuuccuuaaaauguguuuauguuccuaucucccauccuguuuauuuuacaaucaguugguuaacuagagcuaaauaaguauauuuaauccccucuuccaagagagugaagaacagguguuuccuauguagcaguuguaggccacugcuuagcagcacagacaaguuuuugaccugucacucaaucccuggugaagaggcauucauacacugagggcacgaugcuuuucccugguuacauccaggccaucugguccugucacugccaguaucauggaauaucucccacacccccuuagcauuccuuacccaccaccacccauguccuuguccaggccauugacaccuccuguaacagcugcugauaguuacuagugucccuguuuguugauugcuaaugggaaagaaggguuucuuaccaaggauuuacugaggcccuccccuuguuccccaucuauccucccucccagcucuaagaacuuggaacuguuuucaaauccugguugcuuuguuguucagagcuucuguguguaguccuucucuuuucacugucuggcuagcuuugccuuuacagcuugaucaaauguauauaauugagggcauacauuccuguugccuagaaucugaauuaaaucucuguauucuguucucuuuacuaugucuugugucacguuucugugcacauaugguuacuugccuauuaacaguaguauauuuuguaucuuucacgaccacaggaacuagguagcccugggguugucaugcaauucuguuaaauacucaccaaauggaugacuguggguaguaauggguaugaacuagguaaaagggauauugcuugccauugccauggagcccuuuaagugaucaggacuaaaaauucuaggggguggugaaagcccaccagucaguuucuagggacagagcugagaacaguaguuuccagcuuugugugguauauggcuuguugacuuuguucucuuaagaaaacccuggaauuguucuguuuccccagcuccaauacuauuggcccugguagcaggagaagcugcuggcauuauggagaacauuagugaugaugugauugucggccggugccuggccauucucaaagggauuuuuggcagcagugcagucccacagguaugggagggagcgaguggacgagcagggauucagcuugcaaccgaacuaggguuuuggcuuaguugcuguuugcagcuuaaguucuugaccaggauauuccuuccaugucaggaugaagauaugugcugaguggacaugaauuuuaaugugugaaacuaaagaauaauacucuagggugugucccagaaaaucaaagcugcuagcuuuugauucucuuuuguauguggggucacaucccaaguagcuuaauucaucaaauacauugggaaguccuaagaauuucuugguagcuuauuuuucaggccaauugcaauacuuuuagcccccuaugaaagaguaagcaacaugguucuucucacauaaauaaggucuuaccuaguuuucagagauggcugauuugucccgguauuaguaaugacuaacucacauuucucuguagcccaaggaaacugugguaucucguuggcgugcugauccgugggcccggggcuccuauucuuauguggcugcaggauccucuggaaaugacuaugauuuaauggcucagccgaucacuccuggccccucaauuccaggugccccacagguaagaaacuaggaaucugugucugagccuauuuggggaaagaccacaagcuuagggaagaaaugauaucucugacaauuuuagacuuuuauuuauucuacccuuaagauacuuuuggaauaaaguacuauuucucauacaugagcuuuguaaauguagccgagauuagaaaugaaucuagaguguauacaaagucgcuaauuuuucuugcucacuuuuucccuuuaaaaaguccuauuugaggauuaggaaaacagcuaagcauuuaagaguggcugcuagucuuccagaagaccugaguucagcccccaguaccuauauuggaugguuuaccacgucuuggaaugauagcuucaggguaucugacauucucuucuaucucccuaggcauacaaacuuuuugaagccuuauuuuuaauuguaccuaauuuucuggcagcuuguaagguugcaaagguccaaguuacuagggcguuguagguccugcucuuuauauagacuaugguauauauauauuguuacaguauuucucaauaucauaaccccaaggcuugguaucugcuccgaacuagaaagucaaguacauuccuaucccuaagaaggcucucccccuugugguucagagguuaggaugccuugccaaucuuagccagcagguauuacaugaaauaaaacuagaauauugugcaucaauaaacugaucaagagacacuuugguaaacugacaaacuagugaugguagcagauaggucuucaaaagucaacaggaauuuagcgauuugaacacaauaaaguuauguuugcaacuuggugauuccccuaccucuauccccacuagccaaucccaagacucuucuuugcuggagaacacacaauccggaacuacccagcuacaguccauggugcucuguugagugggcuucgagaagcaggaaggauugccgaccaguuuuugggagccauguacacuuugccucgucaggccacaccaggugucccugcacagcaguccccaaguaugugagacagaugguucugaacagagagauccaacggcaugucaucugccacguaagcaagcucuucuagcaauacuagauccuacugagaaacuccaugucaucagcuacugggacuccuaguuugacagcagaggcuggcuccuuuggcugacagcaacuuacccauugauuuggaaguacagcuccauaaagacugcucgagaagcaaguggugugagauaaccucuuagucuaugguguuuguuuguuuuuguuuuuuuuuaauauauuuugagaauaaaacuuuaaaauaauuuuauaugaaaauuuauuuuuaauugugugugugugugucuauguuggaaugcacauuuaaagugggugccuguggaggccaaaggcgcuggugcuggucacaggugguucuaaaccauccaaaccaccauaguuguugggaaccaaacucagguccucugcaagaagagugugguuuuauuuaaccauugaaccaucucucuaacuuuuggaucuuuuggauuaaaguuguauauacacaguacacaagugcugcucccuuggaaaugcaaaauccuaccucuggcaauagcucaucuguucucucccugucugugaggaggguccgagggcucuccuacacaugcagcaccuuuuuuaaagcuucuuuuuuaaagcuuuuuguguaucaguguuugccuauguggguuuggugcccaugagccuucauuugggugcuaggaaccaaacguguucucuccaagagcugcaacugcucuuaaccauggagcucucucuccagccccacuauaguucuuaauggcagucuauuaaaugaaagguuacaugggaauguuucuuugcacuucucaugugcuggugaucauguguuggcauagagcaccuuguaauugaacugucuccucuauagcugcuauaauaguaccuauaccccaaauauaaucuccccaucucuaaauauaguaucuguaaagucuucacugcuauagugguguguguggggugugugugugugugugugugcgcgugcauacucagaucuugugccuugaacucaagaucuuuuugccuccauguacugggauuauuggucugcaucacuauaccuagcucuaaaugaagcugaguuaaggaacauuauucuggguuugguuagacgaugaaaauggagugggggcuuuucuccuaaucuccccgugugacagcaauagaaaaaugauguuagagauggaagggugauuucuggcacaguaaauggcagaugcuuuuaagacaaggucucacuguguagaccuggcuauccuaaaacuguugggauuaaaggcauauaauuucagagaaauucucuuugacaacagacaaggcuaaaaagaaaauagagcaaagaguuagcugcuaguuuuaacucuguauuuugccuaaauuugugaaaugcuauaccagcaguaccaauucagagauaacagcuguuuccagaaauuauauugacaaaauuggcaucacugacucaaaggagcauauagaaacaagggagcuuuauugguuacaauauugugcugcagagccaacagagagcauuacagccaaaggauacaugcagacaggcagcuucaacuauacacaugcacccaaggagcccugagccacugccuguggcugugcccugcuuuccagaggcagguucuggccucucuggucccgugcuuggagcaggaauguagaagcugcugcaccuagacuccaaggggcagaggugaagccagagccaccugccugggcagguguagaccaacagcugaggccccagcaaaggaccuaucaugcguaaguuuauuuaagggcuaucuaccuuucuagcccucucaaucuuuaaaauacaaaaaaauagacuuuauucucuuaaaaauacauuccauucaauacauguucugagcugugaagcagcaggaaaauaggaccucuuuccuaugacucugguugaggugguagaggagaacccuguuccccauucaggguguuuaaaagauaaucccuaaaaagcagcucuuacaaagcauucuuugucagaauagaaacccaugccaacaaagguggccaugggccagccucugagucccuguuccuuuacugacccauuaaaucuaaacaacuaacacagcccaggacaagaaauccacuauugcucuaggcaccggccccugccacuugagagggauggcuggugugcaagcuugccuguagccuuggucccacacagaucucuucaacucauuugaacugucucacugccucagaguugucuuagcuuccuggccugccacccugcagccuuuucugauuguuucaauaccagaguagcugguaacagcagcaaguggaagauagcaguuccuggcauguagccagcucuucauccuccaaccaagcauauccaggaccagguuccuguacucagaacucucauagacuccugaccugcuggcucaauuuagccaccuacccaaacuuuagagaagcacugucaggaaagugggucuuuuaguggggaauauuuggcuugauuagacaaugguuugaauaccagucucccuucuauguggaggcuuccugcagcuucuggcuugggcccaaagguuacaucuugguguuuucagaagugauaugucuuucgaccuugaaaucagagucagucuagccauccauaugaggcccaaggggacuugaacccucuagccuccauuugcuugguauaaacauuugcaaugcugaagguauuuaaaaauaaaaucuacuuuauggcaggacuacaaagugugcagacuaaagaaacaaaauauccugaaauaauuguuacaaucaaaugcuauugcacucagauuuucaaaauggcaucccacagcugucccuuuuccacagaacauuucaaauagcagcagguguuggugcugcuaaaauguggaaagauccagacuuuggcaccaggagcuacagcaccagaagaauccagggcucaacacccaaagacaaaaauuauugacgagauauuuugaggcagggcuuggugccccucuguuuuuaucagcagagaagagccacagacuuaauuuccuauacucuucaguggaccaccacaggggucuguuuccuuuuaacucucagggcugccaauugguacaggagaguggcagggggcacugcaagugagagguugcagccuugaauuaaggaguuucuggccaguaaccuaaaagcagcagcaggaacagaucuugaaaacacuaucuuaguugucuaucaaguugggauguggaggcaagacacauggcaaugcccucagguuagcaaaacuccauuaaaacagaagugcuaguuauuccugucccuugggggcugggggaagcaaacaaacaaaacaugguagaucuccccacacccuggcaggauggcugagucugaugcagacaagggcagauaagugccagugugugugugcuaagaagggugaagggagacuacucaguccuccugaggauguccugugucuucccuguggccaggaaauucacaggaaaggcacgggaacaggaaucaaacagacuuacguuauaaaaagcaccuagcuugaaagccaggaaauguggcacugggcaagagccacauaaaccugagaccacccaauccaaucccuuuaccucauugaaaacaggccuuacagacucauccccaugacagacacaugaggaaaagagaaaaaagacccagaaacaacugaaggcagaaagauguuccccagacucauguggacaucaccuuccaaaaccaagagucagcucacacugaugggugaaacaaguguagaacacaaaguuaaggccuuaagaggucauccacucuauagaacucauucugagcugggaagcagcaguggcagaacaccugccuugcacaccagguccuaugcucaauccccagcaugcaucugcaggugacacauggguacacaugcacgcaaccaacaaagaacucauuuuaaagauagggaaaacugaggcuucaagaagacuugccaaagaucacagagcaaggaaugacaaagccaggagggguggggaaaaguggcuuuccaaauuccuagucuagugauaaggcaaugacaucuacuucacaaagguagccaaagaggaucccuuugaguugaaacaaugcuucagaagauucagcaacaagcaaacaguucuuaacuccccguguggucagugucaguguaaggagauaaaaguuuauuaucugccuuccuaaaaggcuuaaugcacuuugaacugcauaaaucugaggcccucaacaggcagguauuggcuuuccuccaaugaaaucucugaaauggucuacucguagauacugagggcuugccuuugcaucagcagucagcaugguaaagugcaagguuucccccacaggggauggaggagcaaagggagggaagcagucuguccaugccuuucauggagcuauugcuuguggagugacuagaggaauuuuuguuugcuuucccauuugcugggcacuuccuaaaagacaggcugugccgggucugucuacucaguguggggauuuccuaagaggagaaugaugaagucagcugaaguuuccagcccccagagaggaaaggugaugccagcagcaguguuggugcccaggaaaagagauguaccagaucugucuguuucugaugccuuuggaaggugagcugaaagcuggcguuggaggaugaugucauuccauuugguagcuggcucugucuccaugaaacugguuauccaaaagucaggucagggaagcuucaacauaaggaugguccccauaauuacuuaggggcagcagacccuuuuucgguuuccaaauucucaagaacucaaagacaaaggaauguaagccucuuaggauagaaaugauggcugauaauucuuaguguguucuugguggggguagaggugucucuuacagcaaacaaagagccaacuggauauagugaggagacaaaucaggguaucaaacacagcaaaagggacugggcuuugauauacaaacugcuuaccauggagcagaggagagggcuuuggcuaccucuauaugguaguggguuucuguagcuucccauuugggagucaaagaaugguccaugcuaccuuggggacagagauaggagagaggacuacucaugcaucagggaaagcugggccugagugacugguuuguagucucugauccuaucuggacaacugacaaaaauuaccugagccauagccuggcucucuacagucucccagccaaggccuuugugucuagccugguuaacuggccuuggguccuucacaggccaggauuggggaggagcugagaagcaggaggagagaagaagcagcagacuucaccuagcuggcucagucuuccucagcauaaggcuuugcugggugcagccgcuccucaguccaaacuggcucaggcucuggcagucccugcuuuccaggcaguucagaaugcuccagcggguuguguauucgccugcugguaacaaaugugcuguccuccccuuccuccugugccaaugaguaacaaguaaaaagugagcugcaaagaguacagggaggaaugagacccucaccuuccacccugggaaguucucccaccuggcauaagacaccgcacuacacaguaacugcagagauauucuuggggaguggggguggggagcaggagucaguaugaagccccuuggaaauagagaacaacugaggagaccaagagacucauaacuggggcuggagagauggcucagcaguuaagagcauuggcuauucuucuagagguccugaguucaauucccagcaaccacaugguggcucacaaccaucuguaaugggauccgaggcccucuucuggugcgucugaaggacagcuacaguguacuuauauaaauaaauaaaucuuuaaaaaagagagagacagagacucauaacugaacagaagacugccuauaguccagagcuuagaacagaaguaugagagcagacccccaaguggcaugugugaaagccacuugaugcauggcaggacuaugcugaauugggcagcucuuuacuucuuacauaucgaugaaaaagcacaugccuucccccuuauaucauucugucccuuggcuugguucucccuggaaacucagauagccaaaccuucaaaacccuagauauccaucuuucucagcacucuuggaauucugcuuggcaauauucuuugucaaagaauaaugaguagagcagaaaagccaggugaucaggguagagaggcacuggaucuaccgaggaaucuuagguuccagucugaggucuuuuguuauuuuaugcaucuggaugaccaugaauagagcauuuugucuuaccuucauuuuaagcgccugaaagacaggcuugcccaguuaacccagucacuugccuuuuaaaauaaauacuacuguaggcuagagauggcucagugguuuaaaagcacagacuaugcuuccagaagaucuggguucaauuccccgcacccacaaggcaacucacaaccaucuguaacuccaguagcaggggaucugacagucucuuggccucugugaguaccaggcacaaacuuggugcacagacauacaugcccacaaaauacacaugcacacuaaauaaauaaaacaauauaaaauguaaaagguacuaguagugagucuagaggcaagacauuuucauggucacaaguuccugguccaagacgcuccuagagccuucuccauacuguuuucacucugguucucaagucaguugguucuguauucaucuguucuuuaaugagccauacugaacuagucucagagaauacaauggaucaggccuaucuagaacuaaacaaaguaacacuuggguauaaaguuuauaaaguagauccagggucagaccucauucucccuaucugucagcugcccacagaggccuccugaccaacugaggcagcaggacaagaagaaccuguucacugccauccuacgggcaccuaagagcuuccuguugacuacccuggagaucucaggcaaaccagggaauaaaugccacuuuguuugccuccccucugugugagagcaaaauggagaagacaaagcuaugagagagagguucuggaagucgugcugcuuucucccaagucuaccugagacacagcaucucucaaccuucuggauucccuaaguccucagucaaacagaucaaggccaaaggaaggaaagugagacucaccaugcuugaugagugguugcaggaggcagcagugauggcaccucccauccggucccugcgggugagcaccucugaugcggugaggcuacuuuggguccuccucggggagagcucaggagcauccccugaauuuccuacucuucgagcgcccuguucagauggcugugaccugggcugcucaaguucuaagaagucugugcagggccucugcguauaggcguuaguagcuuccauguuccuaccuauuccagucggggggucuucugaacauuucaagucucucuuacucuuccaggcauuccgcacugugaugugucugcugucugaagaggcacuauggcuuuuccaccugauugucucggcugggggcacaugacuauucuucuccacagacucugauggcuugauuagaaugcuacuccuagagaccaccaucucugcucuauucuuuggagacccaucucccacucuuucagcuucugugagcugcaaggugaugucauguuuaugaauagagagcucaagaggggagcugacaugguugcuaauugcugugagcucugggggccccaccuggauguugcugguggauguaugccucucccuuggggccucgcucgggacggcucuaggcccacugcugucagagggguagaugguaaugcugcuugucacuuugcuugucacagauuuagagguggauuucugcuucuccaauacaaccucaguuccagauccacccaugauuuuuuucacauccuuaucaaugauaacggguuuuauaauugcucuagaccgcagggccucucuagggcugaagggccuuugauuuuucaccccagcacaguuggcaucugggaauucuauagcauuggaggaaggccugguagguuucacagagucauuuucuauugcagcauuuuuaucauuuucaaauagggcaguucuaguucccccucuggacuuaaccuuuucucuugaguuuggcugugguuugggcucuggcucuggagugauaguuguguucaccaacuuggcaguaacaaaagacucuauguccaggucaucaucugagucuggcuucucucugccacuggauuugaugacacggcaccucagggcuucaugcugacugcugucuuccaucacaacugcuacaggcugaucaacuccuucuuuauuuggcaaugaaaagcccugaaguauauuuucuuggcuucuugaacuauaaggauauuuugauaaaauuggagcuuuagaauuugaaaaauuggcaucagccgcuaggccauuggcagucuuuuuacccuuagaaaguccuucugaggaggcuuuuugagaugaggagagagcuccgauggccuuagagcagcuagacucuacagccuguguucccugacuugcauggccaggcaccuguccucucuucccacagugugccucagaggagaggucagaagucuuaucaccuuuccccacuauaucauugggcacagauacaugaguggaaucacuaaauguucguguugucuucucuacuuuucccuuaaguccacucucagugccuggcuugggagcuccuuuccaaacuuuagugugcuccugggcagcagggggguaacggcuaagcacugauggcugcucccuaccccuuuucccuucacugugagaggacccaggugcaaaucggucuucaguucucuuugucuccugagucccacugucuguacccauucccauguuggaggcuuuugcugcccuuuuguuugugaaaacuggagaagaagccuguuugcugcuuagagaauaguguucguuacugagagcaaacucccuguuccggagccuuucccgcuuaugcuggggagacaguucccgugauguaugcuuggacacagaggccucacucccauggccuuugagcuuaguccucucgugccugccucugcccaaaaggaaagcaucuucaccuucuaugucuccauuuccuaacucuuuuuguuuccugaccugcagcuuuaucuccucuagcuggcuggcuaagcuucuguuucuauucagcucaguuagguaauuauccugaaggucauuguuuuuagcccucauuuucuuaagcuccucuuccaaagauucaaaauguuugauuugugucuuaaguuucucaaucucuugguuaaggucuuucacuuuguugucuuccugauuccgguucuuuucauuuucugauuugucucugguuucauucucgaccugcuuuagguagucuagacugcccuuccuuuuugacucuuuggaugacaguguagaggaaaugccguccucuauccguaggucauuccuuuccagaaaaguggaagcauuucucauguggucucgguucauuuucuuguucugcuccaguuuuugaguaagcucuuuuauuauuuucucauuuucuuucuccuuuucauucaaguauuuucucucauuuacaaagcucaggguuaaugauuuuagcuuuucuaauucugacacuaaacucugcucaguuuuaucuaagcgguccucugaagauucuagcucuuucacuuugacucugagcauuuccaacucagaagagauuuucuuggucagauuucucucuucauugaggcucaaacaaagcugggaacauucauucuuacuccugcucaaagccuccucuagcuucucuaaaucaaccauucguuucugaagccgcucaauuucagauuuuagcucucgcguaagguuuucuuccucuucaaguuucuccuucaucguaugacauagauccucugcucucuuaauuuccucaucuuuaccuucaaucuucaguacccgcuggcgcagcaccucgaucucagccagcgugcuggagucgcugcccucugccuggaucaccuuguccuggagguccaggagcucauccuccgcucucuggagguuuuuuguagcuuccucuaacucaucgaggcggcggcucaggcucuguaacuuaaaucgcagguggcgguuggaggcagcauccuuguaguuagugaguucugccaugucuacagccagucacgaugggcugcuagagacauccaacugcacuggagaaacugguuaccuuucucuuggcauccacaaccuucuuuggcaacugaagaccauuaucagucuacagaauaaaagcagaaagcaugacuguaaaaagagcuccaaccugcaguccuuguagaggacauaguagcuacauacaauuuuaauggcucaacuugaguaaaccugcaaaacaaaccuguucuuuacagcugacaaugaacuguagcacauaagcacagcauggcauagaagugccagggaacaauacucauggcagagcauaaggaccucuaccacgcacacaaucuccacccuuucuguauccauuuaaaaaucgagccuuucucucuuagcuauaaaaugagcaucgcccucuuuccccagugcccuugagaaaacauguggugagcucuugguaagaacacacuaaauaauccugagguaggaggagggauagggagguucacggaccaaaggagggaagauuaucugaaacaaguuggugaaagaaccguauguaaaagaaauccugccugaacagaauaaaguuaaaucugccuacagacacaaguuauacaaaagaaaaacacaauuauaaaaguaacaggauuuuaaaaguugucucaauccaucgagcuguugggacaagagauacaacacuggaucuuuauaagggcaagaugagguucuggaagcuugaaaaugcaaauugaggccaccgguagguuuuucucugccagguacaggccugguaucuucugcuaagagaguaccuuaaaucuuuggacuugaaaguggaaggacaaaaagguuaagauacuaauucuguaugggugacaaaccuaaucaccucuuaaaggccccaccucuuaauuauauugugggggauuaagcuugaacaugaguuuuguggggcgcacaacauucaaaucauagcaacaaucucugaagagucaucaauugaacauuaaguggcaaguagaagacaaauaauacuuauauaaacugucagacucgaguuuuauacccccacuaaacuaccaaaccaaauggguucaugaacucaugagcaccgucaugaacuggacagagagccacgugcacaguauaugccagcaccagcagaugacacguucucaagcucauguucaaggcuguaauaacacagcucuaauggcuggcguuaacugucuauuggacagaaccuagccuuaccugggagaugggcccugagcauggaguggggaaguugacuauguucauugcugccugcugugcguggccccuuucuugacaaggauccuguccuauauaaauggagaaaggaaggugagcagcagugugcauucauugcucucuguuccugaucguggaugugacaggaccagcugcuuaagaugauggacugugcccuuaaaccguaagcugaaauaaacccuuucucccuugaguugaguuuauuuagcaagguauuuuaucacaucaacagaaaaagaaacaaaugcucaccugaacaauucuaaaagaaaucuuaaauuagcccacaaaggaaucaaacaaaucaguaacagaagaugacuggaaauagacauauuuugaaagaaaaauacaacuuucuaaaaucuguaagauaaacuuggaacaacgcaaaagagaagauggaaagauuuuuaagagccagaagacugugaguuggugucuucuauggaugacagggagcugcacccacaaaaucuuaacagugagguugccaaaacaaucugaacaacugaugcaucccaacaggggcuggagggaugugucacaaagcccaacccccagaagaacaacuacaggcaacugguagcugcuaauuccaaguggucaacccuaaauacacauuuacucaguagggagggagggagggagggagggagggagggagggagggagggagggagggagggaguguguguguguguguguguguguguguguguguguguguguguguaacaauaauaauuaaagaggccaugaaucugaaggagaaggggguagcauauaggcuagaggaggagagaguggguguaaaugauggaaauucaguauuuauguaugauauccucuaaagaauuguaggagcauucguagaugaccugcuucugggucgggguuuugugcguagcagagcagcucccacgcuucgaucuauugaaagucagcccucgacacaaggguuugaaaauuuuagauuuaaaaaaaaaaaaagaauuguaggaggaagucacacuguggcuaagagauauuuauggcacuuagugcacacaguugaugaaguuuaacaauaaucucaaagguaagaaacaaaccgacaaacaggcaaaguaaaccggauaugauggcagucccacagccaagcaaaguaaaacaggaugauugcuuaaacaaaggagguuagccucgagaccacucacuacgagcuaacauaaauaauguuaaaucauuaaacaguaaaaaaagaguggaaaucaaguugaaacaagaaaacaaguguguguguguguuuggggauguuaaccaaagacaaagcugucucuagaaagauaauaaaaacaugacagagaugacacuauagaucucagagacauuaaagaguaauuuaugaacaauucuguagccaaaauuugauaauccagaugaaacagaccaauuaccugaaagccacaauuuauccaaauaguagacacuguugaauaggccuauucuguucaccaauaacuuuguaaaauauauauuaaagcccaaauggacuuacugguaaguacuucaagcauuuagaagaguaugccaauuuuccagaagacagaaucacagcaaauuauuucccaguuuauucuguaaggccaacaaaauccucauaagaccaaagauaucacaagaaaauaaaaucuacagaccaguaucuccuguacacaaauacaucuaaggcucuuccacaaaauacuaguauaugaaaacuagcaauguagaggaagaauuaaaugcuacaaccaacuggauuuauagaagaaaugcaaggcugcgucagcuuuugaaaacugauauaagucaucauaccaauagguucaagaaaaaccaacaagaaucacauauggaagcucaaagccuccugugugaugagggacaaggcaagaauucuugccaccuauuuucaacauuguacuagaagcuuagauaauacauuaggcaaaaaaauaaaaagauaugcugauagggaggaaagaaaaagagaaagacaugccucucuauguugaaaauucaacagaaugaucaaaaaaauaaaggccacuuuaaaacaacuagugauuacaagaugguugcacgguagacaauauauauaaaaaucaaaaaauuucccaauauaccaucagugagcaaauagaauuugaaauuaaaguacaguaucauuuuuauuaacacuauaaaaaugaaauuuaaauguaaacucaaaaccuauaugcauuuuucauaguuuuacagauuguaaaacaggagaccuaaguaaacggggagagucuccauguuuacugguaggaagacucaauacaguuccgaaugucaguucuauaggcucaaucaaaaucaaaaucucuagcaacuauuguguggauacugacaaacugguaaaguuuugguagaguuggaugaccagaagaacuaacauaacauuaaaaauuaacaaaauugaugcuauccaucuaagaaaguuaucagucacagcaguaaguaugaaaagaauagauagauaaaggaacaaaacagcccagauuaaaagcuguccugugaucucugagaaaagagcaaaggcaaaaaacacaacaaaaaucaucuucucuauagauggggcuauaaccagacuauaugcacagacuuaaguauaaaaugcaaaacuaucaacuccuaaaaaaaaaucaaaaggagaaaaaccagaugacccugaguacaguaguaaccucagguacuguucaaaaaguacaauccauggaggaaagaaccaauaaucuaagcuuguuaaggugaaagacaucuaggcaaaacaaauaucaggggaaaaaaaauaacuaaaauacuuuuagcaauaauacuaggaacagugguauacaacuuuaauuccagcacacaggaagcagaagcaaacuguuagagcugcauacauauagagaccuugucuuuaaaaaaaaaaaauuuccgggcagugguggcgcgcaccuuuaaucccagcacuugggaagcagaggcagguggauuucugaguucaagaccagccuggucuacaaagugaguuccaggacagccaagguacacagagaaacccugucucgaaaaaaacaaaaaaacaaaaagcaaacaacaacaaaaacccaaaagggggggggguauagucauauauauaaaaucucaguaagaaaaacaugagucaacaugaguccuuaacaaaggauauaugcagauuacaaauaagugcauggaaaaauuagguugauuuagaacugaaaaaaauacaauagaccaaaagcaguccugguggcucaugcucauuaucccggcacucagaagcugagucaggagaacugcaccuucaacuugaggccagcuugaucaacagccagaccuugucucaaaaaacaaagacccucagcaccacuacauaucuauuaaaauguccaaaucacugcuaacauggaggauacagagcaacaggaauucucaaguccauaccagugguaaugcaaaaugguagcaccacuuuugaagauaguuucuagcaaaaccaagcaugcucuuaccauauguucuagcaguuuaacuccuugcuuaccaaaaaugguugaaaaacuauguuuauauaaaagcaggcacacaaauaucuauaguaauugcauuuauaauugguuaaaccuagaagcagggaaauaaguaagcagagggauaaacugugacauccagacaguggaguauuauucaucuuuaaaaugaaaugaguuaucaaguuuaaaaagccucacaugguaugacuaacugaauggcaucuggagaaagccaaacuauagaaacaggaagggugacuagugcacagggagcccagcaaugacauacucuguguacuuuaauuauggauccauggcauucuaccucucuuuaaaccuauaaaauauauaagaucaagaguaaaaccuauguugucauggcagcacauaccuuuaaucacagcaccugaggcagagacagguggaucucugaauuuugaggucggcccacccuuaugggcauauuauuuuuaugugcuauguuaaguuuacccuuguguuauucaaaugcugauuuuucuacccucauaucuuguuucaauccagacacggcuuuguaauguuuaugucaagaaucucaaguuuguguaaacaauuuuuaccauuuauucucugccguguuaauagauauugaucauccaauggcuggaaaaacagagaagucagggaaagaggaugagaaagagaaauccuccaggagugaggaggagagaauucgugagaguuuagcagaaacacgaaagucccaaugacaagaauuauugggauuuuggcugguagguagccagauuaguuuaaugguuaagauaaaacugcccagauauugaggaggggccuugaaauaaauauaaaucuuggucucccuguguuguuauugggaacuagcuaggauaaaguuauauagcugguguauuaauuuaauaauauuuauauuaaauaauccauuuugcauuuggugcucaauacggagaaauauucacacuuuuuuuuuugggggggggguugucgagacaggguuucucucuguagcccuggcuguccuggaacucacuuuguagaccaggcuguccuggaacucagaaauccgccugccucugccucccgagugcugggauuaaaggugugcaccaccacgcccgacucaguauucacaccuuuaaaauucauauuuaguuauuagauagaaaguuccaggugaaaagcagaaaaggcaaagcucuauuagagcucugagucucuaaaccacuugaaagaauucugcucuccuccaggagaguccugcugugcacacagcauugguuaauuaacaaaggcuaugccuaaaguaggggcuuggaaugaaaucuugaaugaauccccuuggggcggugggggguggggugggagagacaaagaaaagcaauacuuuuuuuccuauugacuaucaauagauagauacccaauuucaaugacuuagaaguuuaucccagguaaaagaaaguauuaaauggcuuaaauguaaagccaaaaggucaaauaggaaauuuaaggccauaugugguugauauagccauaaauuaaugggaagacauggguuaucauuccucaaagcuucaaggacaagccauaaaauaggagauguucuugacgacacuauuaaaacuuuuaucaagaacagucauagacuguccacauuauccauaaacgagacaacagcagcugacuauccagagagagagagacugcuaaaagaacacaaauggccuugccacuaaggaccauccccacuaggauagaacaauggccuaugacagacaaaaaacaaacaaacaaaaaaauaaaaacaacaacaacaacaaaaaacagcuguaggcucaacauauagaagaguccaccagcccuuggaauucuccuguauuugugauuaaaaaaaaaaaaaaaaucuagcaaauggaggauauugacagaucugagagcaauuaauaaaaucauucagccaauggcuucuuuacagucuagaauccugucaucuuccuuguuaccuaaggaauggccuauuauagugauugauuuaaaugauugccuuuuuuaugauuccuuuacaagaacaauauaaagaaaguuuuacuuuuucaauacccacuuauaauaauagcuguccaauagaaggucuugccucaaggaauguugaacaguccuacuuuaugccaauauuuuguacaacagccauucgaaauaauccuuaaaccauuuccucaauccauaauuuaccauuauauggaugauauuuuguuggccgauucaaauggagauaccuuagaaaaaagguuuaauaaaacaaaaaaauucuuuugcuuucuuggggauuacaaauuacucaugaaaaaacacuaagagguuuuucuauuauuuaucuaggacauaagucugcagaaaauucagccacaaaagacacaaaucaggagagacagaacucuuagugauuuuuaaaaguugcugggugauauuaacuggcuacagacaacaauuggucucacaauucaagagcuaaguaauucauuucaaacuuuauaaggugauaaagaauuaaauaguccaagaaacuuaacagcugaagcugaaaggggacugacucugguagaaaagaaacuagaagaugcacauacaggucauacugacccaacgauggucuguauuuuaguuaucucgccuucuacucauucucccauaggaauucuuguuuucuuuuuuuuuguuguuuuggauuuuuuggauuuuuuuuuggggggggaggggguugagacaggauuucucuguaucguccuggcuguccuggaacucacuuuuguagaccaggcuggccucgaacucagaaauccaccugccucugccucccaagugcugggauuaaaggcgugcaccaccaccgcccucccauaggaauucuuaugcagagcaauuauaucuuagaauggauauuauuagcucacaaauggaauaaaaaauuaaaaacauauagaaaagguuucugcauuuauucuaaaaggaaaaacgagacuuugucaauuagcuggaauaaaagcaucugagauuuugauacguuuuacuaauaauauugauauuaccucauuaugggcacaagaugaacauuggcaaagaguuugaaguaaugugggggaggauauuaacaacaaauacccaaaagcaagagacuucaauuuauaaaaacuaauuggauucucccuuguauaauaaaagaaacaccaauuucuagaggcccuacauucucuauugaugcaaaaaaaaucugaaaauguagguuauaaaucaggaaaaaaauaguaaagugguugagaguccuuaugauccaguuaaaaaaaucagaguuauacacaauucuuacaguauuauuagacuuuucagagucucuuaauauaguuaguuacuaagucucaauaugcagaaagaguugucuguauauaaaaccugcugaauuaauucaggaugauucagaauuaauuucaaauacaacaaguaaucagaaauggaaaucauccacuguguguaacacuaucagaucccauaugggucuaccaggucuucuagcacaagguaaugcuaaaacugaucaacuauuaauaagaaauguacuagaagccucaguauuucauuaaaaacuaccaugugaacaacaaagguuuucuaucauuuagcaacuagucaaggaaauuauauauauaaaaaaauguccuauacuuguucuuuauauaaccacuucauuaccugcugggaguaaccuaaaagguacccagagaaauaaaauuuggcaaauggauauauuuuauuuugcagagcuugcaaaauuaaaauaugugcaccauaccauagauaaauauucaagauuucaaugggcaacugcuuuaacuucugaaaaggcugauuugguaauuacacaucuacuagacgguauggcaauuaugggaauaccuguacaaauuaagauugacaaugcucuagcaugugucccuaguaaaaugaaacauuuuuuacauauuucaauauaaagcauauuacagauauaccacauaauucuaugggacaagcaguuguacagagauccaaucauacuuuaaaagaaaugcuuaacaaacaaagggguaacaaagaccuucaauaauaaauuacauaaugcuuuauugaccuuaaaaacucuugaaugcuaaugaauaaaaucaacugcuuagagacaaugaacuaugaggaaaaacugaacuaaaucagccuguauauauuagggaugucuuaacaucuaaauggaggguaagagccaggcgugguggcacacuuuaauuccagcacucaggaggcagaggcaggcauauuucugaguucgaggccagcauggucuacaaagugaguuccagggcagccagggcuauacagagaaacccugucucgaaaaaccaaucaauaaaugcaauaauaagugagugagugaauaaauaaauaaauaaauaaauaaauaaauaaauaaauaaauaaauaaauaaauggaggggaaaaaagaggguaugcccaugucuccagaguagaagaaaaacuauggauuccauccaaauugauaauaaucagauaugaccagggagcauuccugaagaucuuggcugcagacaggaagaaagaaaucaagaaaaucaaacaggacggguaacauaauuugcugaucccuccauaugcaaacagcucugagauuggcuaagacauaaaaacgucuccagccagaacuucggcuugcuuagccaauaauccuuuggcuacaaaguccucaggacuaucaugccaacuuauaaagaaagacuaaugucuuucaucugcucaaacaagaacaaagaaucuucauuaacuaauuugugcaccuugcacauuccauaaauauguuaacacagaacuauguauuacuugugagaguuuauauauuuacagaugccaaugaaguuacaacccugacaagauucacccucagggauguugagaugcucaggcuuucugagccggcuuccugccugauccuaccucagacuacuccaaugcuguuucuucuaaagacuugcuuucaggacaacuucaaaacauccuacuuacuugguccacccuuucagacuguuucaaucaggacuuuguuuaagacuguacuuucccaacauacagagacugaacaacaaaugcuacagcuaacuuucuuaagacuaacaauuuucacaauuuucuugggcucccaaaaggaauacuauaucuaaaaucagcaggaagcaauuauacgagaagcaggacccauuccaaagaaguggaguagaugauuuuugguccuucaauggguguuggauguuugucaucauuaaaagagggaugguuagagcuggagagauggcucaaugguuaagagcacugucugcucuuccagagguccugaguucaauucccagcaaccacauggugucuuccaaccagcuguaaugggaucugaugcccucuucuggugugucugaagauagcuacaguuacucauauacauaaaauaaauaaaucuuaaaaaaaaaaaaagagggaugguuacaguaguuauggucuuagacagggaagaaacaaaauacgguauuuagauucagggauuuuuuuuucuuuuuuuuuuucuuuuucuuuccucuauuauucuuucucuccuagcuagggguuagggaggaggggacagaggaggagagagggagaaaagagaaagggggaauauagaaauauuauaagaauaauaggaaaaagggauagagaucacugaauuuacuuuaaaaaaaaaaacaacuuuuuuuuuaagccauaaucuuacauugguauagaucuuuguauauugauauaaaaguuaagguuauauuuuguuacacuggcauaacguuuuguauauuuauacaaauuuaaaguuuuuaaugcacauaauguauauguuuucaacauuugggauauuguaccaauauaauucuuaaagauacaaugaaaguucuauuccuuuuaagccugcuauuacaaacuguuaaggauaauuaaguaauaugaauuaaaagucaggcaaucaaacuuguggucauaauagauacuaguugaguuaauuacaguaagauguuuucacaguuauucaaauaguaaauagaauaaacagugggugacaauucagauauucaauagauagauggucuucaaaaaccucagagauccacagaauaugacauuuagaaugauuucauuauuaagagaucuuuucuaacaaugagaaagaucugcuccuggaaguuaucucuaauccacuucaaagaagauaaaagagcaucaaagaaccuccauauggaguucaucucaaaugugacaagcugccacugggcagaaagcugcccaugcuacaucugcagacaaaaugcuauccagaaagaacaaacaggaugcagggaaguugacugccaagcucugccaaguuaggguaagcaguccuucauacuucuugcuucacaaaaggucugucagauauucugggcaugaaggcugaagauagaauccuagagaauuucugggggacuucccagacaaccugcuccucugucauuucuauaguuucagaagcugcuggccuguacuuccuacauacucaaguaauauuuauuccuucucaggucugugauaggggaaaagacuagauaaaguuucagaauaaaucuuaaauuauauaggauuuaagaaaauguuuuaugucuuagaagaugcuuuaggucaauaagacaaguuaugauagaaaaugauuuagguacaaaacucuaaauucaccaaguuaggauggacaauagaauauaacuacaaaauuggcaaauaguuauggacuagauauaacaugaaucuuaccugauuagucauaauaauuguuaucacuguauauagauuauuaugagucuucugucuaauauuuguuuuuuauuagacaaaaaagguggaauguagacauaaugcacuguguaaagguuauccuuguauuauucaaacgcugacuucuccgcccucguauuuuauuucaauccagacauggcauuguaauacuugugucaagaaucuccucucucaagucuguguaaacaauucuuaccauuuauucucugcuuugucaauaaaugcugauuacccaauggcugggcaaaacagagaauagggcaggacuucugccagccaggggaaggaggaagagaucagucagguugaguaagguggaaagaauucuugagaguuuagcagaaauauggaagucccaaguugcaaguauuauugggauuuugacuaguagguagccaaacuaguugagggguuagaauagauaagauagacugccuagauauugagguggagccuugaaauauuuauauuaaauaauuuuguagacccugucucaaaaaacuuuuuuaaaaaguuaaaguuaguauauaaauaaguugggugauaguaauuauuaggacuagcucaugaugaaaaucaauauaaaugcccugguuuuuucaaaagacuacuaaagaaucugacuaggaagaccaaacaggaagcacugugauacuccaagcaaaagccaguguggcugauaacagagacacuaagaaguggucagaacucuggccaggugaagggagaaccccaugcuuuuguuccuagacugcacaugauguauaagacaggcaagaaauuaaggaugcuucagaccaagguugcuggccugaauuuguaggacagugcuguccuaaguccaaugaaauuaaguauagauggaacaguaagaaaaggaagauaaguuuaaaacauuaucugugagggguuaauggucaaucaaagacaauagagcccauaaacacacaagcagggucagagcucagaagagagguauucuuacaauauaaaucugugagucaacaaaaacagauggcuuagaaaaauauagagaaaauaagacaccaacugucuaaaccccaaugcucacagggaugaaaauauagcaaaggggacaaagcaucugugaggcaaguggaaaaucacaagagugcauagcacauaguguaauggaagcuuccaaaaaguaagacuaacacagguggaucuaucaagacaauuaugccacaaguauugccagcacgacaccaguagggcugaggagaugucucaguuguaaggcauuuuguccagcauaugugaagacugguguuucaucuccaguaccacaugugcagggucgcagggguucagcacuauuuaacagaauagugcuggaaacagcaacagaaucaggauuugaaauuaggggcaguccaucccauaaucagccaccaaacacagacacuaucgcauaugccagcaagauugugcugaaaagacccugguaaacagcugucucuugugaggcuaugccagugccuggcuaauacagaaguggaugcucacagugaucuauaggauggaacacagggcccccaauggaggagcuagagaaaguacccaaaggagcuaagggggucugcaacccuauagguggaacaacaauaugaacuaaucaguaccccccagagcucgugucucuagcugcauauguagcuaugggaagagaggccccuuggucuugcaaacuuuauaugccccaguacaggggaacaccagggccaagaagugggaguggguggguaggggagcagggcggggagaggguauaggggacuuuugggauagcauuugaaauguaaaugaagaaaauaucuaauaaaaaauuaaaaaacacagucuaaccuauaagagaacagccagcaucuuauaguaaaacugacucccaacaauucaacugcaacugaggcuugaaauaccaaaugccuucuggagcugugcacgggcuccaucugguggcugcacuacauggucugagccaucagauggagcccgugcacagcucuuauagaacagcaaugcuugggagaaauugcuaccaucaaacauggaucauccaucacucugccccgucuaugguacagcucucuucucuccucuaaguucuucuagacucuuucccaucucuccauagccuacaugcuuccacauucuccaaaacugaagggaacaagucgcuuuccuuuggcuauuuguccacuggcacagcaaaagccuuaacuauuuuuacacuaguugggggauuagggacuccacaaauuucauauguucaguaauagaaaggauaaagaauuauuaaaggauuuauacuaacuuaacaguuaccagaagacaaauaacaccauguuucuacgagaagcuuuaaaagcaaugcaucauugucgauaugcuuaaaaccauuaaauuguacaauguagaggugaacuccaugauauacaacaucacaauaauaauuuguuugcuuucauuuuucgagacagggucucucugugugguccuggcuguccuggaacucucucuguagaucaagcuggucucaaacuaacagagauccacccaccucugccucccaaguauuggauuacaaguguguaccaccauaccagguucaauagugaaaaaaaaaauuuaaaacccacacaccuaggcaugauaguauuucuguaguuccagcuacucagaagucuaaagcaaggggauucuuuaaacuaaggagcuuaagaccagccuaggaaacauagugaggaccccauacaaaaccaaaacagaacagaagggccucggccuacccucaacugacauucuccaaacauucccuuuuaccacuuuacacugaacuuuucaugaacaaauaucuuaagaggaaauuauaauaguuaauauuuauucgucaacuugauaacaauuugguauccaacaaaucuccaggcagaccugugagaacugucuugauuauaugauuauauuaacugaaaggggaagacccacacuagaggugaauggaacaauuccccgggauuagcucuguagauucagugugaccagccuugacuucuucaccauaagggaacauucuaaguguaagccagaauaauccuuucucaacuuuuuuuaagaaucagaauauuuuauucuggaaacaggaaaagaacuaauauagauaugaaacuuuagcacuucuccaucuauaaauuaccacuauucugaauuauaaaaaguucaggaaccugacuacuguuuucauguggauuaaauuuuucuuuuuagauguuuuuaguuauguguauaucucuuugugagugugcgugucugugaggguaccuagaaggccagaggagggaacuggaccuccuggagcuggaguuacaugcagcuauggugucacagcccagcauggguaccaagaaaugaacucuaguccucuacaagugcacuuagccaucuugccagucccuccauuuggauuuuaguguuaauuuucuaucuucuguucaaaauugaguguggagacucaaccaguauagcacaggaaugaaaaagcuaaacucaguuaacaaccaacaaguacuuaauugacacuaaaaagagagcauuacauuuccuaucugaaaucuuuucaaggcucuuauucuucuuagguuaaaguccaaauucuccaauuaaaccaagaagcccugcauguucuggccuugccugcccaccucucucuagccuugucuucagccugcauguuaagucucauuuuuagcugguuguagugguagaaguacuggagauugaacccagggccuugagcaugucagacaaaugcucacaacacuguauauguaugaguuuuauuuacucaguauauuccucccuacuugcuuucuuauuuguauucugaauucucaguacucagcaaggagccuagcacacaauaaaugcuuuaaacuuagugacugugaguggcugaaugaacuuccuaaugauucagugucuggccagacacuggccuuuaacagacaacacuaaguaauaccaaggaacuaacuguucauggguuacaacggaggaaaugaguggaucagauggaacagguuaucagguccuggacacauguucuaaaagaucacacccaagcccuguacccacuugcucaguggcuuaaccaucauauugugccccuucaagacugcaggucugcgccauggaaacugggacaaacugcugaaaccacuccuuauaggcugcccaaauauuaucacugggcugguaagaacaaaaaguauuucugaaucuuccucuacuccuuagaauaguuuuauacauuuauuuuucuguuuuuguuuuuuguuacagggucucucuaaauaguccuggcuguccuggaacucacuauugaccaggcuggccucaaacuacauaccuuuaauuucuuuaauacacaucuccuaucuggagaaagcaguggaggugcuguauccugggcugucuacaaaagagaaaagauuccuuucuuccuaauguuucccugcucucugcagaugauucauuauucaguaaauauuuauggcacaucuaugauguacccagacuucugugaagugcaagaauaaaaaaauuaagagcuucuccuuugucuuugaaaaaauaagacagacauagccaaagguaaaacaaugguuuuuuaaaaaaauaaaaccaucccuacugggcauaaugucacucuacugugauccaagcacuugggaaacuggggcaagaagaucaagaacucacagagagggcuggagagauggcucagcaguuaagagcaugcugcucuuccagagguccugagaucaauucucagcaaccacaugguggcucacaaccaucuguagugggaucugaugcccucuucuguauacauaaguaaauaaauaaaggguuucauuuccacacuuucacucuagaguccaagugcuccuggaacuuaccauguagcccacacuagccucaaauucauaaugcuccugccaugugccugggucaugggcauguaccaaccaucaguuccaucuuuuacagccaaugucucucacaucaauaucuaccucaguucugauuaauauuagaaagauaucaauuguauuuccauuuggcagaucauuuuugccaaacuucuuaagccucuuuaaaacaaaacaaaacaaaacaaaacaaaacaaaacaaaacacaaaaccaagaacagggccuuguuuauuucaugcuguccuugaacucaguauguaaccaaggauggccuagaauuuuuuagacccucugccucuacuucccaagugcuaagacuauauagguauauaucauagcaccuggcuuaugugguacuggggaccugaaccugggcaugcuaaacaagcauuucaccaacugagcuacauccuaagccccuuaaaccuauuucuaagugaaccuagcuagcccuuuagaaacuagcucuucuuccugcccuugcagaucaggaagaucugaaauagaacauaaaaaauccugcccugccccuucucccaacauaguugccaugauucauuuccuguucccaacagucauuuauagcaggggucagcaaacuucuuugcaguuugauauauaaccaaccauacagacuuagguugguccuggggacuaaaccugggcaugauaaacaaacauucuaccaacugagcagcuugccugauuuuauaaauaauuuaguugaaauauggcuauguuuauucacuucuaugucuuacgugucugcuucacacuauagaguuguugggacaggcacuuuucaaaguggaaagaauucaauguacaaguugucuuaguaacucaucaucaauucuugucuaagcacuucuuucuuucuuucuuuacuucuuucuuucuuucuuucuuucuuucuuucuuucuuucuuucuuuuuuuuuuuuuuuuuuuuuugagacaggguuucucuguauagcccuggcuguucuggaacucacuuuguagaccaggcuggccucgaacucagaaauccaccugccucugucugccucugccucugccucugccucugccucugccucugccucugccucugccucccaagugcugggauuaaaggcaugcaccaccacgcccggcgucuaagcacuucuaaugacaagaaggacagacacuuccccaccagaaaacucauuccaucuuugaaggcucuacaggaauucacuauuugucagccucgaauguuaaccacauuauaugaaaacucaauaccaucggacuuauaccagacugagauccacaggguaaagaacauguuuauauguuauccacuaccucaugacaaguuccuccuuguccuuacaauguccuuuucaugcguggauugacuugaguaguguuaccaagauuucucucuguauccaggcauuuccaugaccacugcacauuuuccaagcuuucccccaguccuuucucuauccacaguacaccagaagugacgaggaccacgaaaccccuuagcuguccccccuccucaguucucguccucacaguccuaguucauuguuauucuccacagccuuccugugccaauaaagacgggcucacaaaacccagagagcaaaggaauagcuguuagucuaaguuucucuaauguuuauucuggugugcuucugaaagguaagugagccaccaucucaacccagaaaguaacauucucaaaagguggaugugauacaaugaaaaggaccuaguuuaaaaacuuaauucugccucuuguugccuguguaaacuugauaaguuauuuaaccucucaccucacuuucuggcaaugauaaaagcacuagccuuaaagaguuggaauagguauuaagaaagaaaacguaugacagacaggccugacacacaguaaauacucaguaagugacagguuagcccugcuccuuaaaguuuuuggcuuccugaguagacucuaacccuaucaggcuguggacacaacagagaaaacauguaaagcacuuagcuaagcuuagccacauauaugguucaaaaacaagguaucaaccaacacugacuuuccucccugggguagaaaguugucaagaacucagaaaacacccaauucuauuggucugccagacaucacugugcaguauacuuaccauuuagguaaugggagcuuucugugggaacuuaugguugcccuccccacuguccgcugucuuguaaacaguuacugccuuucacggguagcugcuuguugaccuagacagaauauaaaagaagaaauaaguauagcaugaaucaugccaaggcucagaugacccaaagacuuucacauauagcucagcaucagaaaaaggcaaggaagagcuauaccuauagccugacuguaaagaaagcuaccuaugucucugaaggggaaugaggcuccgugcuaccuccccuccuaucagauaauaugauuccaggccagauugucuuaaauuaaaaaucuauuauuucccaauauucuaaagauuuaugacaucuugcaucugggaagcaccucagaaaucaacuaaacgcccaagugaaagaggaaacuggaucuuggaaaagguaagucaugcaaugacauagggguaaagcuggaauuauacuaauaauguuugggaagacaaguagaaaaucuauuacauccugggcaguauauuuuagauaaaauaucagugugauaauguugcauauagauaaucuaaaucuuaagaagugacuuuguccaaaauccuauaacuuaguaaacucagucaauacuuaaacucauuuauuugauaaaaagccauuucacaauacuaacucucauuuuaucaccuuuuugacucaaucaucaaaaguggucuuuaccaccuauuaauuuuagcuuaauuagagcuaagguagaguuucuacaaaccucucucuaguuuuauuuauuuauuuuuaguuuuucgaggcaggguuucucuguauagcccuggcuguccuggaacucacuuuguagaccaggcuggccucgaacucagaaauccgccugccucugccucccgagugcugggacuaaaggcgugugggaccaugcccggcuucuaguuuuauuuaaaaaaaaucaccccguaaaagaaaggugauaaagcuaaucaauccaaaacuuacugcuaagauuagagaaaaguuaugggguggaggacuugggucaaaucuuccugucuacucucaaagaaugaaaauggcauauaggugagugcuaaccuaaagcuuuuggacacaaucucacauucaaacauguccuuccuugaaccauaacuuaccaacccuacagaccaacuuuuagcuuccuuccaagacugcuggucccuuuagucugaacucuacaacccuaaaauguuugcaugccacagaacuaacugucucuauucucuuagagaauacaucaccacagacuucaaacacacaucucuacacugcuagcaacugugccaugcuuuucccuaaguucccuuucaugccuuuacuucccuuuucaauuaaccucuaaagccaugagcugauaacaugucaccaagaagcaauaucuagaccuuaauuuuccaaaucuacuacuaugccugcuguucuuuguauacacauuacucucacucucuucucauagcauuacuuuuucucugugcagccaucagcauacaacacucacuagaaggugccuacuuggaguaaacugcacaauucaacacuggcccuuccaauagagccaaagaagugaaagugaauacuuagacacuugcauaacaacuugucaaagaaagagagagagagagagagagagagagagagagagagagagagagagagagauccuggucucaacucacagauaauuugagaagucauguucuuagaacagaaaaauaaugugauacaagaugacuagagggacucacuaaaaugagauucuagggacaggaaauauugcuuagcaguuaagaacacuuguucuugcagaggacuugaauucgggucccagcaauccauauggaggcccccaacuguccauaauuccaauaccaggagauccaaauccuucuuuuaacuuguaagagugcauggugcacagauauauaugcaggcuaaacagucauauaaauaaaaugagauaaucuaaaaaaauaaaauaaaauaaaaauaaaaccaaugagauucuagguuucuaaaggauugucacauugauccagagagcauauuugggaaguaagauucuacaauuuccuauuuagaaaaaaacaaaacaaaacaagaaacucuccuuugaucucucucuaccuaaaugucuaauugacagcuagccuccacaaacucauauucuucaugaauccugccuuccacucuucucacuauaaacacauccccuucagugccugccuaccucagucacagcagaacuacucaucaagcugugcagaucaagcaccuagacucacucuggacuuuucuuugccuuaaaaaaugucaaucagcagguccugucaauccuacuucccaggguacuugguucugucccuguucuccacauuccuugcuguacuuacucucacuugcugcuguaaaaaucccauuaagcuucccugauuccaguuguucccauauaaaccacucucgaaacauuacauuuccaaaauuuuaauuuuggaucaaaacucuaaacuaucaagcaaacaaaaaacuccaguggcuuuccauuucacuuaucuacagccuucagccacagccuaugggggcuguacaagcuccaguccuacucuaacuuucugaugucaaggcuuacccuccucucuucacuucccguuucacauauaugcugucuucauuucuaccuagagccuuugcacuaccaguucccucuucccuuuguauagcuagcuccuuuuagucauucaaaauucaacauaaauuuuacuaccucaguaaaguuaggaucagccaaaauaaaauaacucucacccucuacuauaucaccauacuuugugcucaucuuagcacaucccuaccugcuauuuuauuauucauuccuccucuguauaaauaaccauaacuuuucugucuaguucaucacuauauccccagugccuagaacaguacuugguagauaacagaugggucuauauacccagaggagugguguggguuggagacacaaagguaugacucauauccauaaagccaaugggguggauggagauuacucagggagaaugucuacuaugugaagagaggagggcauggaagcauaagcauuuaauagccacagaaaggaggaucagccuguaaaaacaccagagacguaggaggaagauuagggcagugaguauuacaccacuggagucaaaagaagaguccuagcaggaaugagugguaacaguucacuagccaagaaaacuacggacaacauuuuuguaaaauuaaguuugguagaagauacuggugaccucaauaaggauguuacugugaaauguaagggacagaagccaaauggacugaguggagagucaguaaauauagacagcuguggugguuuauauaugcugggcccauggaguggcacuauuaggaaauguccuuguuggaguagaugugucacuguggaaguggacuuuaagacccuaguccuagcugccuuuggaacaagaugcgaaacucuaagcuccuccagcaccauaccaugucugccuggacacugccaugcucuuaccuugaugauaauggacugaaccucuaaaccuguaagccagcccccaauuaaauguuguccuuauaagaguugccuuggacauggugucaguucacagcaguaaaacccuaagacaacagcuauguagaagcauuuauacguguaaaaguaaaggugguuaagaauagggaaaguugaggaguggcuucuguuugguuuugucuaaaccaaggagguauccaaguucuauccuaucagccacaggaugaacuccaagucuuaacagguauuagucacucaaaaguuucaaauuguuuuuaaucacacuaaacuuagaaugugaucuuuuuuuuuuuuuugaugaauuucuaagugccuaaaaaucaaugugcaagucuuuugcuuacaacaaacaucucaucucucuauuacaauguaagauuaaaaaacagcuucuauauacaaccuugguacuauaaaagcaacaacugucuuucguuuuauauugucuagagaacagccuuuagucucuauuucacacuuuuuccucccuguuuccugccagggcaauauacuacaguggaaagagcagacagucaaaagucagaggagcugggucccaacuuuaauucaguuauauagcaauguugaugacuaaacuuuaccacauguaguuuuucaacuguauagaagucauaucuaaacaucaugaaaccaccauuaaguucuauuuaacaguagacugccuagccauguaccaccuggaacaguuuccuuuacacugacauuguaauuaaaucuuauguauuuuaauugucaaucccuuugucuagguguaucaggaagucuuuggaaaaagaaacuuugaaaaacacaggugugguuccaacagagagaauuuuaaagauauacuaagaguggugguugggcaagaccggaaguauaaccaagcaacauccaaaaggacagggaggaugcccaagucagagaaacaggcucuucucccucccaaguuccuuccugaacuuaugaaugucuuuuguguacauguacauuucugugugaacauauaccaugugugugcaaguagccacaaguaccucccaaucccucaacagaaacauaccaaaaaacuucuagugguguacuacagcuuccugccacuucagugaacucaggcugauuggaugcauaugcugaggcaaggcaugugcaucauguggaagacacaugauaucuggaggguauaaauaggacucuauggagugauggagacagagcuuggcuugcugguacagcuagcuauucgaugcuugugggucucuugucuccgcugaucuucgcuucccugagagagacacagcugagaacuucucgugguguuccuauuggucccucaugcuaacucaagucaaggcugaggccuggcugucucugcuagguuguguuaccacuguugcuauccugacucuacugaacuggacuggugguguaucuguggaguguuugugaguggauugagcugcugcugccugcuaaccugugaacugaacugccaauuuccagacaacacagaugggaguuguucuaaagaacuuuucuaaacagguccacuuugcacaccacccccauccuuuccuuuucacuaccucuggugggugguacgcuacaagagagguuaaaguguuuaagaaccaucauuaaaaauaaaguuugaaaaaaguuacacuaauaacagcucuuauacagggguaaaugaaacacaaguacugaaggaucauuuguccucucuagcaucaauuguauaguaaaaaggcaaauacauacgugauguuaaguuuucuaaaaaugguuuccaguggugacuacuaucauaaucaggauuuuuuuuuuuuuuuuuugguuuuuuuuuuuccaagacaggguuucucuguauaguccuggcuguccuggaacucacuuuguagaccaggcuggccuugaacucagaaauccgccugccucugucucccaagugcaggaaucaaagguaugugccaccaacaaucagugaaguucuucauuaaaaaacaaaacaaaaaaacaaaaaaaacaaaaaaacuaauacaaccacaaaaauguuuggaaguaucaaccaaaguagaauaaaugacuuaccaauuuuauuccucgguauauaaaaccaagaguaaugaggucauauaucuaccaagacauauacacuagagugaaaauguucauggcaacuuucucacagagccgaaguggguaugaucccaaguguccaucaacaguaaaaccaguaacuuuggccuggccauacaauucaauaucaauaggauguuggggaguugggggagagccagaaccaaaagaaugcauacuaucgacucuguaugaaauucaauaggcaaaacagccaggccuacugaagagcacuuauaaaagccauucaagagguugagacaggaucucuggcucaccccccccccccaacccccagcuacagagggaguucaaguuagccuaggcaauuuagugacacugucucaaaauauguaaaaaaguaacagaagggcugguggguauacucagugacacagggcugcaccagcaugcucaaggccacaggcucaauccuaguacugcaacaacaaagacaaagcuaauuaacaaagacggugcaauagccaacugggccacacaacugggcuacaaacauaucaagacccugucucaaacaaacaaaaacaaacccagacauggcggugcacaccuaugaucucagcacuuaggaaggaagcaggagaaacuaaaguucaaggcacagugaguuggaacccaguuuggcuacaagauaccugguuucaaaagaaacauaaaaguuaauuaauuaauuuaauuaaugucgacuuacugagggagccaguaaugaugaagaauuaugagggaaugaauguucuggaguucugcauauagucuguguuuugaucugcuaugcaccuuaauauaagucauuuuuauauuauauacacauaaaaauuuauugaacaauuugggucgauuacuacagauauauaauauaaucauaagaaaacaaauauaaaaauaaaaucaaaacuuuagacauuguuauuuuguaaaagucauauaagcaauucuaauauauauuauguuaaaaaacucaaacucaugauucccuggucuucuauuauaauaucaacugugagggagaaaaaauagaugaaaagauggggggggggugcagaaugaggagggaaggacuuaacugaaaaaggaaauggucagagcaaagagaaaaacaaaggucaguucugaugugccuagggacacacacagcuaacagcagcaguuuuugcaucuuaguucagcucuguaauuaaacauuggcugugacccuuaggcaaacugcuccauuucccuuaggauuucuuacagcuuuaguaacaaagaauccaguaagaaccaggucucuugacagauccuagauuuauucaguauuguaagugccuauuuguuuauuuccuguuccaaacccuacucuuacucucugaauaauauaccuuucagcuauucagaaaauugaggcaagaauucaaaacuugcguggcuaacauaccaagacucuguuucagaaaacaaaacaaaagaaauaauauaccuccuacugcccaugcuuacacaguacuucauggcucagaugaccuacacucauacacacucucaguccucaaaacaauccucucagauuacaagauugccaaaacuauuuuauauauuaagaagaaaagcugaggcucaacuuuuaaauaauuuccuaucgggagugguuaagagcacugacugcucuuccagagguccugaguucaaaucccagcaccuacaugguagcuuacaaccaucuguaaugggauccuaaccucuucuggugugucugaagacagcuaccuauacucauauaaaauaaauauacauaaaucuuuuuaaaaggaaaagaaaaaaaauuguuagccggagguaaacaacugaagaaggguuuucacugcaguuuccucaggccuaggagagagaaauuuaucacugcugccaccccucuggccuccccaaauagaguaacccucuagcugugacugcaagcuuuucuuaucccccacccccacccuccacccccgacuaucagcuucaccagcuauuuuuuguuuuaacuuuuuauugauucuuugugaguuucacaucaugcaccccaguucugcucaccuccccaaccccucauauccacuggcacucuugcaaaccuccccccacaaaacacacagaggaaaauaucauggaagcuguaguauguuagagugugucccacaauguaucccucugucuacacaucuuuacuugcaaacgagucauuggucugguucaaguucucuggcuuccgugacaccaucaauacuggauguucaccaggacuccuccugauuauauuguuguugcccugugucauggagaucuugcagcuuugggucagcagggcuggcccuuucacacaucccaaucauucucagaugauacagaucugggccugggugguagcugaacuagucaguguaccagcucuccccuauccaagccaccagggcaaauucuccagcacugcuccagcuaggccacccaaugcugccacuggcaggagacagggucagcucuccugcucucaugcccuuggggcugcuuacccacacccacaacuccugagccagcuccacugugcagcccaaucauggcaccuggccuacucucccaagugcugcagcuggccagggacagggacagcucaccuucucucaugaugggggaugggagaaagcaguucuuccucacucuugcccuaagggcuggcucaccugcacccucuugacaagagccagcccuacuauggugcaugcacagaugaggagcaaguuauuuuauuauaguuuuguuuaguuguuuuugucacuuuugugacagacacugagagcaggacugugcacaugcuaggcaagugcucuaccacuaagccacaaucccagccuucauuuuuacucuuuuaagaaaaaauaaggccaguccaggaaggaaaaaucuccaagacuucaaacagucauacucauaagcuucuauuauguauaaagcuggagaaauuagggcaagacaugucccagcaggaagauauccucccaccagcccucauucagucaacuguuuauaggacauuguuuuacuuaagucuacugcuuucuccucaccauucuagcuucuucaaagaguugaaaugacaucuucuugagucuacauucuccuguacaaugaucaaaguaccuaaaucaaaacuaagccacaaacuacauuuuucugacuuaguaauuuaaacagucuuuuccaaauuuuaaaauuaaaauuguuuaaauacuuagccagauauucuucaaugaauaauauaagaaacacuaaagaaaaaaaauaaccaagaacacuaacaccuacauugggcacauauauuuauggaagugcgauacaugaaugauagcugggaacuuaaaauccauuaaaaaccacuugugggaaauaaaauaucuagggugagaaccaagagacugggcaacugagucaagcaaacuggguuuuaaaacaguuuuaccaaaauaugccuagcaugcacagguuuuacgcaccauacacagcaccuauggcagccaguguagcccaagugaauacaauggagcugagcacagcaugcguguucucugcucaggccagcaucuaaaccagcagcagcucacccuugucauccaugacacccccuaacaaugccccgcagcccagccauagcacugcaggaguuaagccaagcaguccucaaacucaggaggaaacgagcaugccaccugacacuucucuggcacauaagccgauuaguuugaguuacaaacauaacugcaagauuccaguaugaugaugaaaccacucuuuuucuacaaacuaaaaauaacuucuuuaucaaaauggaagcuucuccaaauauuucugcccugucagcaacccaaaauucuauuuccccaaauaguugaucuauacauauauuguuacugaaccuuagaauccacauuccccuaugcucacauuacucauccuaaugcucccuucaaacagaacaaaagcccuaaugccuucccaccucuugcauuuuaaguuucucuuccaauaaccaaccauguaccaaguuguggcucacgcuuuguguugagccacaaguggaagagcugagcuguagcaaaccagaaugaaaugcaaagaaaaaaugagagacaagacagggcaugauugaaaaucagcuaaauguuuuuuauuaagaaaggaauggaaagcucuccacccaccuagaagaauaugaagcccuguccagcauagagccagaguauccuauauaacuuuagagcauagccauuacauuuguucuagagucagauguauccaaguagcugaguguucuacaagaauuaugaagcuauccugaguugaagugacuucuguguugaaaauaaacucccauaguuaaagccaaacaaguuugaauugcagauuuuuccagucacaaggagaggggcucugcaaagaacuagaaagcuauguccuuuguaucuuaggcucaguaguaagucaccacuccuucccaaagcaaaagcugacuugacuuccuugcucuuugcaacuggcaucagaaaaugccacagugcugggccacccuauaaaggcccaacaaggcauuuguuauuagaacagucacuugggauacacauuaaugcacuuccuacagauccaaguuucaaauagucuuuuaauauccuucuguuuuauggugguuuuguuuguuuguuuguuuucuguuuuguuuuguuuuguuuuagauagggucucauauagcucaagcaagccucaaacucacuaugaaggcaagaaugaccugaacuucuaaucuuccugccucuccuugagugcuggauuacaggugagcauaccauacccaguuuauguauggugggauaaaucuggggccacauuaauauuaggcaagcucucuaccaacuagcuccuauggcucuuuuaacauuuuaccaucucuuuaaaaaaacaaaacuaaaacuagauuagcuauaaaaccuauacucauggaaacauuucucaaaaaaaaaaaauuaucuuagccugagaccacccaagaagcacaacacaggaucuguagccucccagucuacagucuauccaccaaacugcagagccauggaggccagagaauggaugguacagaaguugaaagcuaucacagaucucggcaugaccaaaaaaaaguaaaaggcauauagagaggcaaggugaaacuacuggaaguaaugaagugaagaagaaaaguggacuuggacauucaguggaaaaucacaaagaaguauccaacauacacaagcagaguacaaaggacuugaaggcaccuggauccacuuacagaacacuaccauauccuccaagguaggaccaguugcugcacaggguacggcuauauggcagcauaaggagaaacacgagucaaaaucaggaucagacugggucccuuugguauucuguagaaacauucuucaauacauguuuguugaaaaaaaaugagauuuaucuauuuuauguguaugaguggccuaacauacaugucuguguaucauguacaugcagugcccacagaggacagaagagggcaucuguuccccuggaacugaauacagaacagcuguaagaugccauguuggugcuggacacuaaccugggucuucugcaggaacaccaaaccaagugcucuuaaccacugagcuaguuuuccacucaguuuuaucugcugagucuguaguuuucaaaacucucccucaaucuggaaccugacuaaaaacuguucuuguacucaaucuugguuucuagguaacacuaaaagauaacuuuuuaauuugaaaugaaaagcucuggauuuauacuaaacaaggccaucuuuacuccugaguuacaucuaaaauucccuggccaaucacaguagugauuccagaagaugggaaaauaagucccagaggaaaugagcuuaaaguuagaccuaaguaucuagaacuucaacuguaguaccuuugccacaucagaccucuucacaagacuaucauuggcaaaugacugaagaaagaaggcaaaagaaaguaaauacagcaaaugguaaaagaaaaaugaauuuacucuucaguacuaagcagaaaaaccagucuuucuuugugaacucuccauagaacuucgacccaagaccaguuauuccuuaauuuaaugaccuuuucucuuacacaucacaucauuuuuacuaaaaagcaaauuguaaauuacuacccacuucaaugagcuaaucacuggacugguaaaaucagaaacaaccaacugcaaggauggaaagacaugaaaacucuuagauuaauaacaggguagggagauauauucaggguaauaagacacuuauauuuuauuugcaggguuuuguugguuuauuuggcuuauuuguuuuaagacaggcuucauuaggcaccucuggcuuuccuggaacucucuauguagauagaccugacuagccucaaacucagagaucugccugccucugccuccugaacauuugggauuaaagguuuacacacagagacuugaggguacuuuucuaaagaauuagaaaacuagauaacuccaccaaagaaaaccugacuucauuaucuauauuccaguacuuagaucuuggaggaaaauuccuuuucuuugacucucagcuucuuugauagaagagagguuuauauuuauuccaaaaagcccaaccacaagaggagcugacugcacaagaaaagauaugaaagucagacuugcucauagguauggcauagcccuaacagagaaucaucuuagcuauuaggucucccacaacaugacauuaacaguagugccauuaaagcugggguaaccauacacauccuucaacagugugccugcccacuagaauaguggcugugacauucucgcauccaauucaacaucuacaaacagcuuacauuugccauugaugacugcaaucuccuccuuuaaaaccaaacuacacauuauacaucuucucagugccuucauuuuguucacuuucacuaagauauuuucaugguagagacuuaauacugugugaaaacuauaacaucuuuuuagaggggguacaggggguuggguuuuuuucaaaauagggucucacuauguagcucaggcugucuugaaacauucuguaaaucagacaagacucaaacaugaagagauugaugugucucuaccuuccaagugcuaagauuagagguaugugucacuacaucugaugaaaauuuaaucauagguaaguaacuuuaauuuucaagauuugguuguuuauuuuuguuuguuuguuuguuuguuuguuuauuauauguaaguacccuguagcugucuucagauacuccagaagagggcaucagcucucauggaugguugugagccaccaugugguuucugggaucugaacucaggaccuucagaagagcagucagugcucuuaacugcugagccaucucuccaguccuugaauuuucaaugagcagaaaauucccaagguauugaaugugagcaagguuuugcuuuguuucauuuuugguuuuuguuguagaacauaaguguauagcugaauuggccuucucuauucagagguuucuccuucccagguuuauggcuaaggugaaaauuaagaacacuaauaggaaagaagauaaaggcuccuuuucuuuuuccugcuguggcaucaauacaucuuaggguaggcaauagagacuaaagccagacuuaaagcucuguggcacagaccuuuaaucccagcacccaggaggcagaggcaggcagauuucugaguucgaggccagccuggucuacaaagugaguuccaggacagccagggcuacacagagaaacccugucucgaaaaaccaaaaaaaaaaaaaaaaaaaguaaauacaagauccacuggacauuauacaagaaugggucuuaaguaggcaggugcuagccugcacagccacuaagcucaggguaaagaugacgacgucuaaugacaagaauagagaaaauaaauuucaaacccugguuucaaacuuugguauuuguuaauauugcaaacuuccugauacuguccucagauguccauaaguggauaugugguagagccaauuaauuuuuaauuugcacucugguaguggacuacuuuuuuuauguuuuuuaaauuacacuugugggagucacaucucuccaccauguagaucuuucaggaaucaaacucaaguggcaagugcuuuuacccacuaagccaucucaucaauccaaaacuacuuuauacaggcuguuaaugacuugaaucuggacuauucuccccuacagauguauucaguacucuuugucucaguugguggcacuguuuuauggagcuaugaguuuuaagaggugaggcacuaaaaugagccuuugaagguuauacagccuaaucuaugcuucauaaucagacaagauaugagauaucaccucagccccugccaucacagacagaaauguuacuguggccaugaauuucugaccaugauguacuguaucaucuaaaucauaagcuaaaauaaaucuuuucuccucuaaacuguuucugccagauauuuuauuauaaugucaagauaaguaaaaaugaauucuaagccagccuggacuuaaauagcaaaauccuucucaaauauuaauaaucauaauaacaaaaagaaucuuuuuuaaaauuaaauguaaauacacuguagcugucuucagacaccccagaagaggucaccagaucccauuaugggugguuguaagccaccgugugguugcugggauuugaacuugggaccuuaggaagagcagucagucaguauucuuacaggcugagccaucucuccaacccccacaaaaacaaucuuuaacuugaugcuugcucuuuuccuguuuuuuuuucccuucaugguucuuagcacuuccuaagacuuaauacuuaccuuccucacuagaauguaacuccauuaggaaaggggcuucccuaccacuaccacuguaucccuaggacccucaaacaauaccuggaauauaauagguauccuuuauaaauguuuauaaauauggagcuacuucggccgggcagugguggcacauagauuucugaguucaaggccagccuggucuacaaagugaguuccaggauagccaggguuagacagagaaacccugucucgaacagccaaaaauaaauaaauaaauaaaauaaaauauauauauauggaacuacuucagaaagcaaaauauggucuuauuagccucacucauuugcuggcuaaccucuaggcagucacuuuccuguuuugauggugaccacauucagcaaagugaaucuagggacuauccuagagagucucugccaccugacuuucacuaugauaauacaauuuucucccuagcugaacuacaacugaagcuuaaagauccaaucuauagcuguuuucaaaugacuuacauuccacaggaaugaccuggcuccuacuauaugagaagccaaauucagugcugggaacaccaaugugagagcugcaaguuucaacagcacaauacagcauaccacacaaagauugcuacauucuguucugcaaugggucagccagacacuuccugcccagacauaacuaauuaaccacauguccuagauuaggauuacuauugcugugaugaaacaccaugaccaaagcaaucuggggaagaaaggguuuauuuagcuaauucuuccacauugcuguuuaucacugaaggaagucaagacaggaacucaaacagggcuggaaccugaaagcaagagcugaugaaaaggccauggaguaguacuguuuacuggcuugcuccucauaguauguuuagccugcuuucuuauugaauccgggaccaccaggcaccacccacaaugggcugugcccuucuccaucaaucacuuaaaaaaaaaaaaaaaaaaaaaaaaaaaagccuuacagccagaucuacagaggcauuuucucaauugagguuccuccuuucagauaacucuagcugugucaagcugacauauaacuagccagcacaccauguaugugucuauauucaucuguggucagaaauaccuuggacagcacauacuaaggucuauguaucacuuuauuccucaaaacaacccuggggcuggagagauagcucagugacuaacaguguguacucucaaaaccgaaacaagaaaaaggaaggaaggaaaggaagaagggagggaaguagaaaagacucaaacucacaaacucacucccuuugaauaguaagaaacaacagaaaacagcuuccaaaauugaauuuaacauaauccauuuuugcaaaauugggagaggguggguuuuuguuuuguuuuguuuuguuuuuaaugguuuuguugcuuaagauacagucuggaauauguuagccaggauaguccugaacuuguggacuuaagcaaucaauccugucaccucaaugucuuaagugcugggagguacagguauacgccaccaagccagaagagaauuuggauauaaauuaagccaauccagguacuguacuaaaggggagauauaaaauaaaaaucuaaguuuaaauuauuaaauagugauaaauucucuugcuuuuccaucuaacaaugguauccuaaaauucaaauuugacaaaaccaaaacaaacaaacaaacaaacaaaccacuauuacaguauuaugugaaaauaacaagugcgcaaugaaccuugauaguagagcaauaccacucaacccacaaagaacuacauuacagccucaccacaguggaaauacugacauaagauucuuaaauuccaacuaguuuguccuucagaaaggaugugcuuuacuuaucaucuuuuuuccgggggcggagggagcggucgauauuaccucucuaacaacaccacagagucucucaauagucaagacugggauauagaucuaaucauauacuguuugguuuuaagaagaauuuucaacaauagccuuaccacauacuguggcgggaggaugauggggacugcauuucucuauauccagucaauaauucccuccuuucauguuaugguuugacccacuugagacaucuguugucaguucuauuaaaucaaauucagggggaggaggagaacaauacaacuccagaagacuucuucuaaggacucuccauaggggaggccaauaaacaccaucagcacaugccuaaugucgggcuuauucuucuauagcaaauuauaaaaaagcaagccagccagucauaaaaagacacucaauaaucucaaauuuuagacaacauucagaaaaugccuucuaccagccaaauuaucucuuuaccacuugcuuugccucucucggcacucacugcugguagcuccuguaccugcaugggcuccagaagcagagugcuaauguaccuccuaugggagggcccugggcuacaucugcaaugagcacccaggaaguacagcccacaucugaugugggaaagcccugcuccaacaaauaaacaguaacauuuacaaaacuggauuuguucuaaacacuuauuuuucuauaaaguaugugaauacagucacugacaugaaaagaaaggaucaguucuaauuaaugccacaaaguacuuuuuccuauugauaacacuguugaggaugguauuaagcaauaaaaggguuuuuuaaagucagaguuaagguagggaaaagagaaauuguacaggagcuguuaugauuguguuaugugugugauuacucuaaaaaagacuaauauuuuaaauauuauuaagcccaccauucucauuucuagcccucaaauauaaaagacuaugacucuaucaaaugucaacuauagugaggauaguaaaucuugcaauacauuucaacaacuacauucaacauuuccccauccaucccuaaacaaaaaaaccucaacuacacagcaccuauuaauaauaugaauucuauccuaaguaggagcucuuuccuaaagauacauaacuuaaaaaauccugggcuggagagauggcucaggggucaagagcacugacuguucuuaugaagguccugaguucaaaucccagaaaccacaugguggcucacaaccaucuguaaugacaucugacacccucuacugguaugucugaagacagcuacaguguacuuacauauaaauaaaaauaaaaaaaauccuucccauuaauuuccagaaugugucgcuauaucuauguauaaaccacaugacauaagugacagaauccaauuagaguuggauuuaucuaugucugugugugggguguguggguguggguguguacauauaugaaagcuauacgguuucuuacucaaaagcuccuuguguuuacaccacaauuuuacuaacuccaacucaaacuuaaaacuguagaacuauaauuucuuuguaauucuacuaauaagacaauuaauauaauauuauuuaguaggauacgcugaaagaaaaagugaaagucaaugaaaccggaggcucuucggguuucagcaaguuaaaggcuuuuguaauuagucugcugguuugguuuuauuugguuuucuuugaaacaacaucucccuauuuaacccaaacuagcuucuaucuggucuccuccuaccccagccuccuaagugcuaaaauugcaagcauaaggcuaaaaauaaacaguuucuuaaaaucaagccucuucacacaggugugguggugcauguaucuguacuccaggcacuuggaagcugaaacaagaggaucuugaagucaagacuauuuaaacaucaccaacaucagacucuaucaauggauugaauauuuugguugucuuauggaauauaacuuggauuccuccaugucuuuccaccacacaaaguaacucuaugagucugguuauuaccuucuccuaccuugcaaccucucccaccauuccuaauaucauggugucuaucacuuuguaauucaagucacaggucaaaaguaauuuccucagaaaugccuuaccugaugaucugggcuaaagcugcacuccucuccuaacaugucuccccaacugggaaucuauauccaaaauuauacuacuacuauguuuguuuguuuguuuguuuguuugagacgggguuuuucuguguaguucuggccauccugaaacuuagagaucugacugccucuguaugcugaaugugggacuaaaguaaucugccacugcagccuggacuacugcuaugucuuuuuuuuuuucccuaaaaauaagcugcuuucuuucccaaauaauuuguaaacucuacaaagauaaagacuuuguuaguguuguuuaaucacuauauccaauacccagaauacuguacagcauacaaaagguagucaauaaauauuaaccaaagacuguauuugcucacucuuacacaacacuauagguuuucucaagagcauuaacauuguuuucuauuuauuucccacagcaucauacugauuaaauguauaaacgugaccaaauaaaaguuuuaacuacugagcaaagaaagaguuuccuuuucuguuauagucuuccaaucuguuggcgucuuuuuuuuuuuuuuuccgagacaggguuucucuguguagcccuggcuguccuggaacucacuuuguagaccaggcuggccucgaacucagaaauucaccugccucugccuuccaagugcugagauuaaaggcaugcgccaccacgcccugcacuguuggcaucucuaagucaacaaauuacucauuaacuaccuucuaaaauuauuaacuaaguauuauuaacuaaguaucuaccauaagccaaguuaggcugcauucuaggcuuuuuugcuuugcuuugguuugcuuugguuugcuuugguuugcuuugcuuuguuuguuuucaagugaucucacucaucauugauugauuuuguuguuguuuuguuuuguuuuguuuuaauuuugcagagcuaggaaucaaauacagagacucaccacuuagcucucaguccugauauucugaacaaucuaauacuugaacaugagccaaaaaagcccuugaaccuucuccugcuuucauucuggugaucucauauuuuauugaccaaaggaauucaagugguuauugcuaccugcagggcaucacuuaaauacagugguauuuuuuucuaugucaaaagagaccaucucucuuuaguuacuguaaaccuuuuuaaaguuuuauguuauguauaugaguguuuggacugccauguaugucugugcaccauauacauauggugaauacagaggccagaaaaggacaucugaucaccuggaacuggaguuacaaacaauuguaagcuaccauguggaugcuaagaacugacagagcaacaacugcugagccaucaucucuacagcccccaauuauuauacuuucaaagaauauuucuuaaaaagccaaaagcgauauuccuaagagaucaggaggcaucuggacugagaaacuauuuuucuaggugugauaauauugugguugugguagaugguacuccuucauucacaccugcauuucaucaaguaguggggggggggcauuuuagguuguuuuuuuuuuucccagugcuggaaaucaaaccuaagucuucacacauaguaggcaaauacucuacacugcugagcugcauccccagccuggggguaaucauagucaaacaguuacuuacaaaaacacauacuauagaggguuauuaugugcauuuuucuaguuauaacuaccuggugaacuuucaguacaggcuuaauaguaaauugaccauaauugauucagagacuacuaagaggacacagaaaccaaaccacuaaaacauauaaaauauuggcaaaggaauaaagaauuaaaaaaaaaaaaaacuuaucaaggccaaaacaacuaacaggaucaagccccuucuuccugagcagaaaaacuaaccacagaacugcagugacaacguaucugaaaaggguuuuguuaagcucaugaggauuugaaaauacaaauuuucaaauuuguuguuacuuaaguauauguuaaaacuuuaguuuagggcugaaacaauggauggcucaguaguuaagagcacauacuacucuuccugaggaccugaguucaauuccuagcacccauaucaaguagcuuaucacugucccuaaccccagcuccagaaggaucauauaccacaucccucugaccucuguggacacuugcauucaugugcacauaccuuucccaccaaauuaaaauaacaaauaaauuuuggagaaaaaaaaacuuuaguuaaguucaucacagccuccaaaguaauaacucauucaggcaaagaugaucacuauguuauggauacuaaaaccacuugguuaaaagaacaguauuguuuccaagucacuccgcagauuucauacaaagauggcucagagguaccuuuacaaugcaaagaucaaauauucugacauugcuugcauuuauaugacaaagugcacagcaucaccaugccauaauacaucauaauuuacuuaucccaaacuuuucuguuaucuaaacaugagaaaaaaaaugagcuauccaauuuauggauaacuaaccuggccucuuaaaaacaaaaugccacuaaagauacauacgcaaauuugggaagguuguucuagaucaaggaucuauaaacagaaguuuuaccagagcacaaccacucgcauguacucauguagugauuaugguugugauuccuaauaagcaagagacucuagagcccacaaagcugaaaauccuucuaacuuuagguaaaguccuaaaaguacauuuagagaacaaggaguuauguuagauaugaacaaaaauuaaauacuguaugaaugcuaaugcuaaaguauauuaaguauugaugaauaauguaugcagcuuucuuccaaauauuucagaugagaaaguauaagaaaaauaaauaaauaaagcaaauguguauuaacaaguguagaaucuaggccagcaguucucaauuuuucagacgugucuccuuuaaagcauuaaugaaggucucaaagggcuuuuuauauguagauagcuauauuaacuauauaaaacuuaaaacaaaaccuugaaaacaggcuggagagauggcucagugguuaagagcacuggcuacucuuucagaggaccuggguucaauucccagaauccacauggcaguuuacagcuaucuguaacuccagcucaagggaucuggcacccucacagacagauaugcaggcaaaacaccaauacacauaaaagaaaaaguuuuuaaaaaaauuuuuuugaaggauggcaauggcgcacaccuuuaaucccagcacucuucaagagacagaggcagguggaucucugaagccagccuaguuuaaagaauaaguuucaggacagccagguuauaaaaagaaacuuugucucaaaaaaccaaaaggaaaaaaaaagaaaaccuuaaaaacauauuuuaguuuuaguaacauucaauaaaauaacaaauuuuaacaauaacuucuccaaaaacaaaauaaaaucugaugaaaagaguaaaaugagucucacugcagucccagggcccuucuugguguuugcuguagcucucuaaaacuuacuuugauaugcaaucauuuuaacaugguguucuguuugaaauggauaaagaaauacccugcugagcagugguggcgcacaccuuuaaucccagcacuugggaggcagguggauuucugaguucaaggccagccuagucuacagacugaguuccagaacagccagggcuacauagagaaacccugucucaaaaaacagaaaacaaaaagaaaaaaagaagaaagaaauauccccuacuucacaaaguauguauacuuuaagguauuuuaauaaccuuuaaaaauaauuaagagauauuuuucuuuacuauuguaccagaauuugacagguagaaguuuuuaaagguuaacuguaauguagauucuuacaaacucucuuauauaaaauucuuuggccaguuuuucacuuugaacgcaucuuuuaccucuguaaaugcccacacuggucauuuaaaaaugcugugucacuaaagugacaacaaacaaucaaauaaacagaacuuucacaguguauuccauugucagugucaaaaacaguuaguauugccaaugucauuuaaaaacaagucuaaguuggauauaaugccaagcgcccagaaauaagucaccuuuaauucuauuuuuuccuuggaagcucaaguuguauccuugaaaauaaauuccaucaguuuccuuuacagugacaagcuacauuucauuuauuuucaagaugauguuagccaaagguuuagcuaucaaucacccuucaaaugaaacuagugauuccugaaaaagaaaaauguuacuguagcuugaaauucaaacugcagcaauguuuuucuugauguauuaacuggacauaggcagaaaggcuucacaugaacuucccaucauaccaaauacaacaguauguacucaaggaucaauauauuaauaaaacugaugguuuuggugcuucuucaauuacuuuugaaagugaaacuaguauucuugcuuuuaaacaugugucaugagcauaauucucaucaacacaauuaaaugcuguucccccacccaccaccacacccgagacaggguuucucugugcagcccuggcuguccuggaacucacuuuguagaccaggcuggccuugaacucagaaauccaccugccucugacucccaagugcugggacuaaagacaugugccaccaccaccuggcaaaaugcugcuuucuuuaugucggcuaagacauaaauaagcaacauuauuggcuauuagcuuuuguaacacuaguacaaauaguaauguauuggcauuaauaaaauaguuuugauucuucuuuuaggaccuuaagaauuuuauaaauccaugaguacuaacuaauguguauaaaggguuaugaacauucauaacacuauuuauccaacugcuucacuuuaggaaauuucaaaauauaugauuggaagccauauuaauauaugaauguuguaagucugaagccugccugaguaagcuaaauaggaagauuuugcaaggaagcaagcaagcuagcuagcuagcuagcuaaauaucauuaguaauaaguauaugcaaaucaaaaucuuuuuaccuccacuaguguaacuaaaaaauaaaaaaagacaugcauuaauaaagcaauauggaaacaauuuccauccauguacuauuaggaguguaaaauaaaaaugacacaaauaccaggaagguuggcagcaagucuucaaaacauuaagcagagugacuauaugacccuguaucuacucgagguauuuacccaagggauggaaaguuccuaauagacuagaaguaaaaacagcccaaauguccacaaaugaaugagaaacaaagcuggaauuuucaccaggcaugccuauaaucucagaacucaggaaagagagaugggaggauuacaaauuugagguugacauaauuacauaguucuaggccaaauagugcuauacuauauagcaagacucuauccaaaggacaggggguggaggagaccucuaaaaagaaguaccaauacauacugcaauaugaaagaaaauccuuuaaagcauuacaguagugucaaguuuaguggcccgcccuuguaagcccaguacuagacgguaaaaggaagguggaucaggaguucaagaucaucuucaguaacacaucaaguuuucagaccagccuggccuauguaaaacccuaucacaaaccaacuaaaaauuaaaaacaccccaaaauuaaaauaaaacacuggggcuggugagauggcucagagguuaagagcacugacugcucuuccagagguccugaguucaaaucccugcaaccacaagguagcucacaaccaccuguaaugagaucugaugcccucuucuggugcaucugaagacuuuagacagcuacaguauacuuauguauaauaauaaauaaaucuuuuuuuuuguuuuuuuguuuuuugagacaggguuucucuguguagcccuggcuguccuggaacucacucuguagaccaggcuggccucgaacucagaaauccgccugccucugccucccgagugcugggauuaaaggcgugcgccaccacgcccagccuauaaguaaaucuuuuuaaaaaaagguuuuuuuucucagauuuaaaaagaaaacacuacaccuaguaaaagaggucagacacuaucaagccugaguugacaagaaggaaaaaaagcagacauuuauaugaaauguucaauauaggcaaauucauagagacagaaagugauuuauagcucaacagugagucacagaauggagugacugcuaguaggcaugugacuucuuuuugaggugauagaaauguucugacauuaaacaguagagaugguugcacaacucugagaauauauuuucaaagaccacugcaacaagaccugcucuagcugcugagaaggcuuagggcaagaagauuccaaguucaaguccuauuugggcuauagaguagucuggggccagacaagaucauaccucaagaagaaaaggggauguagcucaaugguagaacauuugccuaacaugaggcccuggauuugaugccuggcacaaggggacuggcagaguggaaaagggagaaaagaaaggggagggggagggggaaauaagggggaagcugggcacuguagcacauaccuuuaaaccuagcacucaggaagcagagguggcagguaaaucucugaguuuuaggccagccuggucuacagagcaaauugggacagccagagccacauagugagauccugucucaagcgcgggaaguugggggguggggggaccagacauagugacauggguagcacacaccuucaaucccagcacuugcaaagcagaaacgggagaacaggaggaucccugaguucuaagacagcuaggacuacacagagagaccauaucucaaaaaaaaaaaaaaaaaaaggaugagaaaaaaaaaagaagagaaggaaagaaaacaggcuacuccaccucgcugagggaaagcuggcucugaaggccugagagugagaaagcaugccuagcacccugccugggcaguacaguagagcugacccugguggugaggaucgaaggugagccagccucuggguggugugaucgagggagagauggcauucucagccuccucuuccuccucuuccucccccucccucuucccuuugccucccacugccuguggcaugcaggugagcucgccccaaggucaugagagaggaaaagcuggccccaucccucaccgacuacaaaacucaagagagagagacccugcaccccaccccugccuguacagaacagcagaguuggugcuaauggugaagguaugggccaugaaagcagaagaacugacccugccccaagccagcuucagcauugagugagcuagacagacagcccuggaaagagcucgcccugguagugcaagcacaggaaaacuaguggauugaccaacucagcuaccucccaagccuuugaguuggcccgccggaacaucuaucucauuuaugaacuucuggagcacaugaaagaggugguccugcagauucaaaguuacaggaucucuaugacacaggacaacaugauaucagaaagaagugccugugaggauacaguauugauagccuagcagagucaaagaccaaugacucacugcaaugaauguuugcaaguagagauuugcaaugaauguuugcaauguaugacucuggcacacuacagcuuccacaacaagaugguuuggaauuuuucuuguuuuguuuuguuuguuuuaauucuuucuuuuggcugggagguugcaagaauacaaaggcacagggagaugagugggauuggggugcauuauaugaaauucacaaaaaaaaucaauaaaaagcuuuaaaauaaaaaugcaggcuaagcuuuaaaauaaaaaugcaggcuaagcuagucaucaggagcaagccaauauuauaguucuaaggaguugcaaaaaauugacaaaacauaguaagaguggaauucaguucaagccauccaagaguuaaagccaagaaccacacaacagcauucuagcgguagguagcucucaucucccacucauuuuacccuuuucuccagggaagcuguuuucccaguucccagaaaauucaauauccuucgaauacuccuuugcaguucacuagaauaagacauaggaaugacacagcaacauccuccucacacccacacuuccuaaguaggaaaagaaucaaauaguaggaauagcuggaaugaucuucccucucauugaaaauagcacaaauucaaacuggggacauagcucuauugguagagugcugaccuagcaugcaugaagcccuugguuccauucucuacaguccauaaacugaucauagaggcacacacuguacuugccacauaaguagagauagaaggaucagaaguucaaggucauugugcuucaggggggagggggcaguaauagauuacucuugcuuauacaagaggaagaacuaccuacuacugaacucauccuaaacuucccccaaccaacauucagaguuuaagaaucauuuaaaauuuaguccuuuucauuuuguucuucuguccuuucauggauuuuuuuuuuuuuuuuuugcaaaauagaacuagauucuagacccuaccucuuucacagaaugcuaaaguacucugaaagcuaaaaagcacaauaacucuaauauuuacucuuuacuguuaaacuuuugcauaaacauguuaauuccucacacuaagccuaugagacagauacuacuguccuccuuuucccaguaaauaaacuaaaguccaaagaaauagaauuauuuucccaaguuuacaaaaacauuacuuggcaaagcuggaauucaacuucaacccaucagauuaauacauuuggguaugcuauuaaauuaauacacaugagauauaaaucauguuagaauauuauggcacauggauuugggcucaauaaccuaauuaaacauccaaccacuauuugaaaucuaugcuuuauuuucuaagccuggucuguagcccaggcuggucuagaauuugaaauggacuccagacugguuucaaacucacugcuauccuccuguaucagcuucucaaauacuauuuuacagggaugagucaccaugccuagcugaauucuacuuuauucccacugcccuauacuuuuuuuuuucuuuuuccuuuuucuuuuuuuuuuccagucugcaauuaaaauaagaucgauaaauuauauagaucaguggcucuggagucauaaaaagccagguauacaguauaucauuuaguaacaacauguucaaguuacuucagugcacuugaauauaaaauaaggauaauaacuaaacuuaagaacuaaguucggggcuggugagauggcucaguggguaagagcacccgacugcucuuccgaagguccaaaguucaaaucccagcaaccacaugguggcucacaaccacccguaaugagaucugaugcccucuucuggagugucugaagacagcuacaguguacuuacauauaauaaauaaauaaaucuaaaaaaaaaaaaaaagaacuaaguucauggggcuggagagauggcucagcggguaagagcacugacugcuccuccagagguccugaguucaaaucccagcaaccacaugguggcucacaaccaucuguacccucuucuggugugucugaagacagcuacagcguacuuacauauaauaaauaaauaaaucuuaaaaaaaaaaaaacuaaguucauuacaaacucagcacaguggcuaacacaugcuaaguaauaagcaaaucccuccaguaauuguuuuacucuuggucaucuuacccauuagccaaguuaacaagucucuaaaaacuuuugcuccaaagcaaucuagucauccugaaugggcguguaauauacacacuggguuucaaauacuagacucucaguccauggugcuauuuucaguuuuguuuguuuguuuguuuguuuguuuguuuguuuguuuguuuugaucagugauggggaugaaacccagggcuucguguagguuaaacaaauaucacugagcuucacaucaucuccuuauaaauugauuggcugucuauaugcuacggacucugguuauacaauuucccucgugacauuacaauacacaccauacugcugcugauaugugugucuuccacucauauuuuuuaauaucuuuuuuacuuuucuuagauuuauuuacauaaguguuugucuauaugaauaucuguauaucauguauaugccuugugcuugaagaggccagaagagggugucagaucccuagcaacuggauuuauaaacaguuacaagcugucauauggaugcugggaacugaaccuggaucuucugcaagagcaauaagugcuuuuaacgacuaagccaucuguccaaccccuuucuuauauuuccuuuauguaacaauacuacugcaaacucaucucuuagaucagugguuuucagggcucacaacugccaauaacugcaguucuaauaaaucuaaugcacuccucuggcuuccacuggcaccaaauacacaucagauacacacacauauaugcagccaaaacauucauucaaauaaaaucagauagauagauagauagauagauagauagauagauagauagauagauagauagauagauagauuagaagaguuguuucacucuguggguaucaaccccuuugggagucauauaucagauauucugaauguuagacauucacauuauaauucauaacacuaucaaaauuaccguuaugaaauagcaacaaaauaauuuuauggccgggaucaccacaacaugaagaacuguguaauaaaaggguugaagcuuuaggaauguugagaaccacugucuuagaacaaacugucaguuuuuaauuuuucauuauguauuuugagagaguggcuaagaacccaauucagagccuuauauaugcuagagagacuuugaccaaagacuucauagucccagccacaugcuuacacuucugauuugauugguaaagcaacauugcaagucacuguauucagcucaacaaaacaaacucaagugauaauuaucuucuuagaaacuauuuacucaccaggcaugguggguaugucuuugauccuagcacugagaaagcagaggcagguggaucacuguaaauucuagcccagugugaccuacaaggcaaguuccaagccagucagggcuacacagggacucccaucucaaaaacaacaacaaaaaagaaaaaggggggggggggaagaaaaacaucuuuuuaacgagccuauuuacaccuucucuuagaacaugugcuuaauuuuaugauaucagaaacaaaaguuauauagaaaaauaaaaaucauauaccagacuuucauuuaguuagugggugcaacacuuaucaaauggaaugauacaaucauuaaacugcauagaaugaauauuuggagcuuuuaaacaguucuaggggucaacaagacuagaaagacagaacaaccccuucccaugccagacguuucagaguauucaacuagcaaaagcaggauaaucacccagaaaagggcucagugugcauuaugagugaaaagauggagagaguguugaaggaaagauuaagauucugggaauugaggcuggagaaauggcaccaacuacucuuccaaaagaccugaauucaauucgcaacacucagcaggugguucacagucaccuguaacuccugcuccaguggacucguacucuucugccuucucugcacaccuguacucacacacacaccugcacauaucucucucucucucacacacacacacacacacacacacacacacaaauauaguaauaaugaaugaaguguaaagaaauggagcuuagcuuucucaugcuaagacaauuuugauaaacagaauuuguaauuuuagaugguaaaaaaugaagacaguuaaguuaaagaacugugugacuacagaguacagcuuaaauggagaaacaacaggcagguucuggacaccacaaacauuacaucuucagcacuacacagugcaaugucuccaagaggaucuucaaaaaccaguuucccagaaauuggacccuaaaacauccuuuaauuucauuuaccaaaaacagaauuugcuagacuaucaucaacaguuuguuuguguccauuuguuuguugaaguagacauuuguuuuuuguuucuuuuggggggguuguuuuuguuuuagagggggguuggguuuuuuuuuguuuguuuguuucuuuguuuuguuuuuugguuuuuugaaacaggguuucucuguauagcucuggcuguccuggaacucacucuguagaccaggcuggccucaaacucagaaauccgucugccucugccuccugagagcugggauuaaaggcauacaccaccacugcccgguuagacauuuguuuuuaaucaagauuuguucaaaguccuacaaaaagacagaagggacacuacccaaaagauaguuaaaggcuauaugacaagaauuagacuuacagaucagacuuaauuuuguaagccccccauuuauaaaaauauagcagugguucucaaccuuccuaaugcugagaccccugaauacauuuucucauguucuggugucccccaaccauaaaauuauuucauugcuacuucauaacuauaauucugcuacuguuauaaauuguaauauaaauaucuaauaugcagauagucuuagaugaccuuaaaaggaucacaaaucacagguugagaaccacugacauagauaggaugaaaaagcacagaugaguuacuauagcauaucaccaacuugaaauacugucuaaccugcuaccucaaccaacccacucuuuauuccuauuugcauaugucuaauccaaaguugguuuaaaaaaaaaaaaaagaaagaaaaagaauaggggcuuugaaacagcaauccaaaagccuaacucuauggguuccuccagggacauauccuaagccucuaccagcuucacuucccuuaucuggacagcagggacaaugguguuuaguucauaaagcaguuuuaaaauucaaaucuuaaacaugcggaguagcuauuauaaagcaaguucuaaaguagugguagauauuuaacauacugcaguggcaaaagugaagauuacuuaaauaaauauaagccaagcagucaagcugaacccaacuuauugcuacgcugcuguuuauauucaugggacaaauucugggaaaugaaaagagaccaccccacccaggucuagagggaugauucagcaauuaacagugcuuguugcucuuccagaggaccugaguuugauuccugacaccuacauggaagcucacaacagucugcauaacuucaguuccggagcauccuaugaucucuuuuggccuccaugggcacauggcauacaugcaggcaaaauaucuauauacauaaaagaaauauaauuuaaacauaaaaaaaucuaaaauaaaaaaugcauccccaaaauuacuaauugacaacuuaacaagaugguauuaagguauucccauaucuacacauauaguguuuagaaauuuaaaaugaauuuuuagaaaacauaucuccaaaauaaacaaagcuacccagacuuaguauuccuuguccuuuuguaauauuaacuaauugagaggcugagacagaagaauccauaaauuugaggccuugcccagcuacagagagagaucaacuuagcaagacaguauuucaaaauaaaaacaugccaggcgggguauauauuaaaaauuaaaggaaacagggcuggagagagaacucagcuguuaagagcacauacugcuuuuacagagacaugaguuuugggucccagcacgcacaucagauggcucacucccaccucuaacuccagcuccggggacccaaugccuucuucugaucuccaaggauaugcacauucaugugcauacccugacacacagauaaacauacauauaauuuuuaaagaaaauaaaucucuuuuuaagcugaggauauagcucaaugguagagcacuuaccuagcaacugugagcccuagguucaauuucuaaaaucacaaauaacaacaaaaugaacaaauauaaacaaaaccuuguuuccagauuaaccccagggcaauuuuaaauaaccuaaauauucuauaguggaguuaagggggcggagggaggaagccaaguguugugguucuaccuuacaaugccagucaugaggaaagggaggaagaaagaucauggauacauagugagaauccuggcaaagaauaugaaauaauaauaacuucaacuaaguaauguagggggagguuuugaugcuuugauuuaaucggggaaucuguguugcugaagguccucacccucaacugguuuuugaucuaucaauaaaguugccaauagccaauggcugagcaccggguggaacaccgagaguaggacaggcaggguaggacagagagagaaugagggcuaggggagaggagaaggggaugcaguugcaagagaagguuuaggagugcccaguuguugaguuagcuaaggaauuuaagaauaaguggugugugugugcgcgcgcacgccaagacgcacacaggcgacccgucaggagccuaaagcagauagccaaaauuacccaccacaaaguaacaaucacaaauaauucucaguuuuaccaaccucaaauuuuuauuuuauccuuucuuauuuaugucauuuaguucuaucucuacucucaacaaaaccucuucaauacaucccuguguuuaugugcacguccucacacauaagcacaugcacacauguaaaugaacaagcaguaaugcacagagaccagagggacaugcuggguguccugcucuaucacucucugccuucauuucuucacacacugucucucacugaaccuagcuugcuaguuuuuuauuagccuugugccuucugcucuguuguaguucuuuuugucacauggguacucacucagguccucuuauccacugauuccucuaauauaucccuuuuuuuuuauuuuuccacucaaccacuaaguucaugccucaguaguauuauugcuuaaauuuuuuaauauaauuauuaaauauguaaguauaaauacaucauuuacucuaucuaccuccccaauucuuccauaacucccugcccauaccuugcucucuuauauuacaauuucuuucaaacaaacaaaaacaacaacaaaaccuuuaacuggaacugagcaugguggcaugugcuuguaaucccagcacuuacaagguuagagcaaaaauauugcugcaaguuuggguccagccuaugaaacagcaggccaccaaggacuaaacaguaaaacugucagagagaaggugguguguguaguuggggggcagggggaagagacugaagagacggcucagaaguuaagacuacuggcugucccuccagaguaccuagguuugguucccagcgucuaccugauggcucacaaccaucugucacucuaauuccaggggauccuacgcccucuucuuuuuuuguuuuuuguuuuuuguuuuguuuaaagauuuauuuauuuuauuauguguaaguacacuguugcugauuucagacaccccagaagagggcaucagauugcauuacggauaguugugagccacuaugugguugcugggauuugaagucaggaccuuuggaagggcagucagugcucuuaacugcugagucaucucucuagcccccuaugcccucuucuuaccacaaggcacauaagagauccacagacagacaugcaagcaaagcauucauacacauaaaauauacaacaguaggauuuauuuaaaaagaaacaaaaacuccuuucuaacccucuacuucauuaauaaaucuacaauuccaaauauaucaugucauuaccuaauuuauaaacuuucaauggcucccaaaaguugacaagaucaagucuaaauuccucagugugacuacugaugguuguuaaucuuaaucuuaccuccuuaacaguccauacuauaucaggcccaucaagcacauaagugugucccaaucucaguaucuucaguuugccuuguccuagacuagaaaaucauccucucuuccuuccugccaauucaaauccagcaaaacuugaucugucuucaugacguucucagacuaaacuuagcaaagcacaaacucguuuccagacaaaucaguagcauaacaaauuuuacuguagucacuguacuuaauggcacuuccaaaggauacuaauguacauuuuccacaaagggaauuauguaguacuuaaaccuguuuuccuccaagauaccuuuuucucuugucugcuuuuaaggcucugucuuuuguagugguauuugauguuucucaucuucauguccucauuuggaaaaauaagcucuugaaaugagccugguuuuugaaccaguagucuauaucccuuguaucagcucacuacaauuaaggaacucuuucaaaaguaaacacugucuucccaauuagaauuuuaagagcuguauguggcacuccuuuguuuuuuuguuuguccugcauuaacuacucugggguuggacacaaaaccagcacuauaagcaaaacauauauauaaauccuugcuuuuaaaaucugaugugacaguagccacacuuguacaugaagucaguucaguguucucauuuucucuccuccccugaacacuaacugcacauuucuacauuacuccuguuacuucaaaugaucacuaguugcacuccacuaacuuuuauuuaugacuugaaauuuuauccuucauuucuuuagcaucuccucagucucucucugauccuuuaccugccucacuaucuuccuauuuuuuuuaaaucgcacuuuucacuuuuucuuucuauauuggagacugaaccucagcuaugauaugcaaacacuccgcaccccagcgccauauuuguguguguguguguguguguguguguguguguguguguguguguguguguguguuugugugucuuauuuaggguuacuauugcugugacaaaacaccacaaccaaaaguaacuuaaagaagaaaagguuuauuucacuuacauauccugaaucacaguccagaggaaacuaagauaggaauuuaaacuuggcaggaaccuaggggcaugaguaauggagggaugcugcuuacuggcuugcuccuuauggcuugcucagccugcuuuccuagagaaaccaggaccugaccaguucagggguggccacauuuaaaaugggcuggggcugaggcuggucccucccauaucaaauccuaagaaaacacccucagacuuaccuacagcccagucuuauggagaaauuucucaauuaaggucuccuccucaaccgggcagagguggugcaugccuuuaaucccagcacuugggaggcagaggcaggaagaugucugaguuugaggccagccuggucuacagagugaguuccuggacagccagggcuauacaaacaaacaaacaaaccaauuuaaaaaaaaaaaaaaaaaaagguuuccuccucugagcuaacuaucgcuugugucaaauuggcauaaaacuagccugaacaguaugugugcauguguuacugagaaaccuaacuaauaagcacgacccuccagcauguuaaacaagcacucuacuacugagcuacauccaaucucaaaauuuuuaugcuuacugucaaacuguuuuagagucuaaccucaaaaguguuuguuaaucuagucgucagacaaguuccuacaaaaaaagacauugauaaugucuaaucuuaucaaaguacauuaagaauaucucauguacaacuguggcacaaagcacaagaauuaaguauuccuacaaggccugguggcacccaccuguguaaucacagaaagggaaggaggagagaagagaaggaacagugaagaucugaggagauggcucaguggaucuaagcacuugucauucgagccuuacaaccugaguucggaaccccagaaccuucauaaagccagauguugucucacgugcuucuguaacccucaugcacccuuaaggggaaauagaugguugagacugaagaauucccagaggcucgcaggccagccaccuggugugcauagcagugaauaagagauucugucucaaacaagguggaagaucaacauccaaaguccucugaucucuauauguaucauguaccugguauguacauacauguaaacacacacaccaaacaaaaacaacaaccccaugguacaaaagacuugccuagcauguauaaagcccuagguuuaaucaccaguauuccaaaaaauaaaaaaauuaaagauuuuaaaacauagcauuccuuacuuaaaccuacaagacaccauuacagucagauacagguaacgaucuacuaacaguaguuugugagucuaacuuaauuuuuaaguaucuuaccaauagcuacugucacucucccauauagacauuuaugaaucucuacaaccaucaaaaucuaaaugagauuaugcugguuuaguaaaguggaaguuguaaguucucccuccaagacacaugacuucauuagucccggguagucaucuagauuucugguaccagguaugauuucuuuuugauugaauggguuuuaaguacuauuggagagcugcuacuugccacuaucaagguauuuguguggaagaggaagcaaaaagauuguaaaugcgagaggauaagagaauuugcuaugaaauuuuguuuccuagcaauaucaaaagcuacacacccauaaagucucaccaacaugacugccuuaaacaagaacugaacaaagacaacauuagacacacuaaaucaacagagaaacauaggaagccucaauccucacaaagaacuaugggcaacuaaggaaugcugagauccagagaaauagucuucuccaaggaagaacacaacugguuauucaaugccaaaugguagccccaaaaacauacauauaaggaacauuauacagacugagcagucauauuuaugcauuuaggaacauauacauacauacacauauccauauguguguauguguaacaacaauuaaugagaaaaagagaccaugaaucugaaaaagaacaagaaggaauauauagaaggguuuaggagaagaaaagggaagcgggaaaugauguaauuauaucucaaaauguaaaugaaaauuuuaaaucuaaaaauauucuuccuaucagcaugacaaaguaucgguuguacuucuuagggaaaaaugauauuucauauacauaguugauaaaaugauccagugugcuggcuugaacaguagaguucuacgggaaguuuaagaaccuugcuugacacugacauccggggcuaacugaccuuucaaaucuaaaaaguagaaacaauuuaaucuauaccaaagcgcucauauauaaauagaguuuaagaugaguuauauuuuucuauuucaacuuuucaucuucugcagaaaacuuaaacaaauaacccuugguaaguaggucucuggaaaacagauuuuuacccuugugauuaaaaacuaaaguuuaggacuugagagauggcucagugguuaagagcacugacugcucuucgcucuuccagagguccugaguucaauucccagcaaccacaugguggcuacaaccaacuguaaugggaucagacauucucuucuggugugucugaagacagcuacagcguacuuauauaccuacauaaauaaaucuuaaaaaaaaaaaacuauaaaguuuaaucuguuacucuauagacuuggauaacaacagaccauaaaauauuuccuuuucauuuuuauuugagaaaggaucucccuauauagcccagucuggucuccaacuuacaacccuccugccucaaucuccuguugggauuacaguccugugcugccauaccuaguucggccuaacacuuuuuuuuuuuuuuugguuuuuucgagacaggguuucucuguguagcccuggcuguccuggaacucacuuuguagaccaggcuggccucgaacucagaaauccgccugccucugccucccgagugcugggauuaaaggcgugcgccaccacgccgggccauuauuauuuuuuuaagguaacaaauaaaaaucacacauauuaauacaagcuaacaguucaucaagagaauuccaaauucaaucguaauacaagucuaacaaguuauauuuaagcaauaauuuuaaaagaaauccaaaacaaggauguuuuucaaaggaaucauuuuaggaaacaagacucucuucuuuucauauaaucaagacucaaaaccuuugaaacaccacuuguaggauucucaaaggcaagccucacacauaaagaaaccccauucuucucuucaccuuuuagaauuacauggcuucucauuugagaccaaaaacaauuaaucacucacuucacucgacagacuugccuaacugccaaagguuaaacauaaaccucuuaaaaaugaagauuuaucagguuuaggaaauguacaacaugcucugaaaacaaauucaaagaaaguacaacagcccuuccuuacauacaggauauucaucccaagacccuaagggauaccugaaagcugagguaagaaacuuggauauacuauguguugugcuauacaaaucuaugauacagcuuaacuuauaaauuaggcacauaaggagauuaauaggaaauuggauaauuaaaauauuguaauaaaacuuuugaaggcaaaaaaugagagggaaauaaaauuuuaaaaugucaggcauaaugguauacaucuguaaucucagaacuuagaaggcuaaggcaggaagaucgugaguucaagggcagcuucagauaugagaccuugucaaaaaaaaauuaaagcugaauuauauuuuaaauugggaaugggagcuuuguguauggcuuuacauauacccaggcaaaguauauagcuuuaaucccagcacucagaaggcaaagaaaaguggaucucugaguuugaggcuagccuggucuacagagagaauucuaggacaaaaauccucucucaaaaaagcuuaaaugagggcuggugagauggcucagcaguuaagagcacugacugcucuucuggagguccugaguucaaaucccagcaaccacaugguggcucacaaccacccguaaugagaucugaagacagcuacaguguacuuacauauaauaaauaaauaaaaucuuuaaaaaaaaaaaaaaaaaaaagcuuaaaugaggccggggaggggguucuugcuagaaaugaaaccuaggcccuugcacacacuaagcaaguuccaccacuuaucuacuuucauaaacccaagucaagaguuaucuuuuuuuguuucuuuguuuuuuguuuuuuguuuuucgagacaggguuucucuguauagcccuggcuguccuggaacucacucuguagaccagacuggucuggaacucagaaauccgccugccucugccucccaagugcuaggauuaaaggcgugcacccggcuaagaauuaucuuuagaccaaagaugauugacuauagguaacaaacuauaaaaaaauaaagccagauaaggaaggggucacuauauagcaaguucaguuuagaauuccaucaaauaaauauuaaaaccucccauuuuaggaaguucagacauuaguauuugaaaagcuauucuacuaccuuucagauagcucaaagaggaguaucugaucauaaaauuacacagcaacaaaucuagaaccccaaaauaccacaacugauauauguaaaagcaaggaaaauuauacuaaaaagucacaaaaaaaaaagaaaagugaaauucucuaauuucaacuuccauacuuucuuaaauauuugcuuacaaaagggcuucugaagacacaguauuucuuuauauauccacuccuuaugucaggaccuccauaugacucugugugugugugugugugugugugugucugugugucugugugugugugugucucugugugugugugugugugugugugucugugugucuguguguuugucugugugucuguguguguguguguguguguguguguguguguguguguguguguguguguuguuuucuucagaacagugcuugggacauaauuauuauaacugauguaaaauuuacuuuagaucuauaccuggaauaagaaaaagacaauggccaacaguauaaucacuaucccaaaaugauuaaauauuuaacuaaaaauaauuuuaagcaguucaauaguuugaaguauuuauauucucuuaccaggaauuuccauuucuaguugcauagcugaucuguaaguaaugaacucuaaagauuuuuuuaauggaugguccaaaguuuaucauuugucuccuuacauuaaaauuaaaagucaauuuacugaaguuuucuacuggcuuggcauaccuaugcaugugaauuauuuuuaacugaucuauuaguuguaaugaaaaagguaaaaaccaaauaaucuuuguuuuuaaagauuuguuuacuuuaucuaugugaguacacugauggauguaagccuucaugugguuguugggaauuaaauuuuuaggaccucugcucgcucugguagaccucacuccagucggccccgcugucaacuaugcucgcucagucccugcuugcucuggcccaaugauugauuuauuuauuauuauacauaaguauacuguagcugucuucagacacaccagaagagggugucagaucucauuacgggugguugugagccaccaugugguugcugggauuugaaccuaggaccuucagaagaucagucagugcucuuacccgcugagccaucucacuaacccaaaagcaaauaauccuauuucauaaaauauuucagaauuuauaaagaaagagacaauagugauauuacaaaaauuaacaaaauuacucucagaaauuucacaaacaauuugcuuaauaaaacaauuacuagaucacucuggaaucuuaugguauaauuccaucaggaagguaaaaauaaucacugauuuaaaauaaauaguaggccucucuuuuuguuguuguuguuguuguuugguuuuuugguuuuuucgagacaagguuucucucuguccuggauguguaguccuugcuguccuggaacucacucuguagaccaggcuggacucaaacucagaaauccaccuacucugccucccaagugcugggauuaaagacaugcgccaccacugcccagcuaggacucucuuaaaauggggguuucuauuuaucacucauuauaagaugucuacuaaauuaaucugcacucacacugacucaaaguacacguuauuaugccuuuaauacagaaaggaagaauaacugccaagaaaguuuaccaacaguguacagguuuaagauuuaucuauguaugugcauuuguguuuugccugcaauugucugugugagggugccaggucccauauaacugcaguuacagaaaguucugagcugcaauguaggugcuagggacugaaaccaggucuucuggaaaagcagcauguguucucaagaguuaagccaucucuccaguccccuugcuuuaaauagaucugacugguugaaguuuuccuuuuucucuucuuucuuuuuaggggggagauagggagugugaaucuguucauguaugugcaaaugugcaugcagguguguaaacaauguuugugcaaguaaagaccagaggccagcauugucuuuccucaauugcucaccuuucucucauuuuagagacagucucucacuaugauauauagcucuuagcuagucuggaauucaguacacagaccaagcugaccuccaucucacagagauaaaccugccucugccucccagguaucaggauugaugaugaguaucacauguccaacucacuucauuuuuugagacagugucucuuacugaaucuggaacucacugauucagcuuauccaaugagcuucagagauccauuuuaucuccaccaccccugugcugggguuagccacuguacaugcugcauuuuuacauggguguugaggauccaaccucaaauguuugcaugacaagcacuuuaccaagucaucucuucagcccauacuuugauucuuguuuuaucuguguauguguauucuucuggguauacauauuccacagcauguguauggaggucagagggcaaccucagguuuaagacaucaccuucuacuuguucaagacaugguaucauuugcuccuacagacuccaugcuggcuagccugagagcauucagggauuuuccuaucucugucuucugucuuguagaagaaacacuggaaucacacauacauguuauccugccagguuuuguauagguucuggggaucugaacuuagguccucgugcuugugugacaggugcuuuacccauugagauauccauauuuuguuucuguuuuugagacacaaccucaccauacaacccaagcuagcuguagucacaccaaucucgguuuugagauuacaggcaugugacacaaaauuuucagaauuuucauuaucaacagaaccaauaaaauauuaaucaaaaauaauucaaaugagauacuacuagcugauaucucacuucgguuaaugacuccaauccuaggucuuacagacuuguacagagcaaguaccuuucccaguggaaacgcugcuuaguucuucacuagcgauagguuucaaaggaacaauugcuuuguggcaccaagacugaacuucuaaacucucauaccauaucagucuacuacuaccugaagcacuuagugcauuccuacuuucuagauuaaagaaaauauuaugcagaauuccagucuuuaaaaaaaaggaaucuggggcuggagagauggcucagcaguuaagagcacugacugcucuuccagagguccugaguucaaaucccagcaaccacaugguggcucacaaccaucuguaaugagaucugacgcccucuucuggugagucugaagacagcuacaauauacuuauaauaaauaaauaaaucuuuaaaaaaaaaagaauccauauugauaagccuaagaaguuaaaauugauaccuauacauaaguaguuuugaugaugcucaaucuacugaagacaaauguggugguaaaugcaguaaagcaugccugugacaucucagcauuuagaaggcagggaacacuaaaggccagccuaaauaaaaaagaaagaaaggggggagggggaggugcagagaacgcuagugagaugucucagugggcuguugcuaugugagcuuggguucagguccccagcacccauauaaaaguugagaaaguaaccccaccacaagugggagaaaaagacaagcagaucccaaaagucugcugaccagcuagucuagucaguccacuguucacuauuaccaaguucacuaaaagaacuugucucaaaauaugagggagauggguagaggaagacacccacccgaugcugugcuuguuaaaugcacacaaaauacccucuacugaggaccuacuaugugcaguguucagugaaaugauuagagaauuacuaaauaauauaaauaacuucugaauucaaauuccuuaucaaauuaugcaauuaggacauaagcuaguaugggaguugaagcaauggcucagcaguuaggaaucuuagcugcucuucuaaaggaucagaguauggcuaccaguucugauaauggaaaacaaaacugacuaacuccagcucuaggggauucccauacccuccucuggcccccaagaucaccuguacacauguugcaacacugacacauuaaaaaauaaaauaauuucuuaaagauauaagcuauuaaacuaacaacaacaacaaaaacauggcaaguauaauaaauuguaagauuauaaagaggggagagccagcaaggugaguaaauggguaaaggugcgugccugcugucaagcuuggugaccugaauuaggucucagaggcccacauaaagcuggaaaagaaagccaacuccacaacuacauaaaguuguccucugaccucaucacacaagcauacagaacacacacaguaaauaguugguuuuuuuguuuguuuguuguuugagagagagaacaaaauggcucaguggauacaggcacuuacugcuaagccugacaaccugaguuuuauccccaggagucaaagggagaaauauacccaaguuguucucuggccuccaaacauauacuguggugugcaaacacauacacaauaaauguaauuuguuuuguuuuuugagacugggucucaccauguaacucugguuguccuagaacucauuauguagaccagccagccucaaacucacauagauccacuugccucugcaugccaaauacugggguuaaacacaugcaccacuauacccaccuaaacauuuuuuaauauuuuugauaaagcuuuugauccaacaagauaaauuaggauuaagacaagccaauauuauuugucaagaacauaaggaauaucaauaaaaauaccacauagaagagguacuuuacuuuuauuacauuucuauuuauuuacuuuguaugcauguaugugugugcaugcauguauaugccugcauggcacggcauacauguagaagucaaggacaacuuauaagaauuguugcucucugggucucagaccagauucaggcuguuuagacuuggugguaaacacuuuuaucugcugaaccaucucaacagcacacggagacaauaaauuuacuauggcaaagucaggaugacagcaaugaaaaacagcugauucuugaagaauggaaccacuuagagaguaaagcagcgccaguuggugaugguggugguaaugcacaccuuuaaucccagcacucgggaggcagaggcagaggcagguggaucuccaaguucaaggccagccuaaccuacaaagugaguuccagaacagccagggcuacacagagaacccugucuagaaaaacuaaaagaaagagggagggagagugggagggccaaaaaagaugauacaaacaaagguguuagcuuuugaauauaauuauuaaauauuuauuaaauauaauaugccauacugugauagguauuagggauacauacacucaagaacaaaauaaaugacuucuuugcuccuacaaaguauaguaggaagacagauaauaaucauggaagcagguguaucauuauaaaucauaaugaauaaaucauaauagguccuacgaagaaaagcaacaaaagccaguaauagggaauaacggaaaaggacuaacaagacaggguagugagaaguaucucugauacgcagcauaaacuuaggcacucgggaggcaaaggcaggugggucucugaguucaaugccagcaaaguuaguuccaggauagcuguuuaaaucccugucuggaaugaagaagaaaaaaaaaaacacaacaaaaaacaaaaaccucucccagagcagagacaggaugaaguccacuauuaaaaaaauaauaauuuaaagggauuuuuaaaaagaacuguuucuauacaaaucugaggaccagaguucagaucccagcaccaacuuaaaaaucuagagguuucacaaaugccacaauccucguacugcucagcucuuccucccuuucuuuuucucccuccuuuuccaagucuccuccuguuucuucccacccugccuacacaaaggagcccacauacagaauuuucccucucaaacacaaagauaaaucuuuacaaaagagaaguucaaggucacccggguugacagaguaaguuuaaacccaggcaacuuaguuaacaacuaucucaaaacacaagguaagaacaggcuggggauacaguucuguaaaagagcacuuacccaucauaugugagaaagagaagaaagaaaaacuuggcaaaacacuuacucagaauauguaauccccuacaacacacauauaaacauacuuucucccccaccccccacuacguccuuagcuauacagugagucugagaucacccugggcuauaugagacccugucucaaaacuaaaauuaaauaauuaaauaagacuguccagauaaaacaaagcgagggcccaggccaaguaugaaguuccuggauaacaaacuacagagaugggaacuuuggaucauguguaaagggaaggaguggcucaaacaguaaaugaauacaaaguacuauacuuaaaaauaauaaaugcugaguaugagaaggaauugugcaauaaaagaugagcuacaaauucguuagcacagcagcaucaggccuacuauacugcaccuccaauuuuaacaucuuaaaaucuuaaaagugugccaggcguuguggcacaugucuuuaaucccggcacuugagaggcagaggcaggcaaauuacugaguucgaggccagccuaguucuacagagugaguuccaggacagccaggacuacacagagaaacccuaucucgaaaccccgcccccccaaaaaaaaucuuaaaguguguucuuugagcuacccccaccacuacacuagaguagaaugucugccccucacagggucuagaaguaacugaucugagcucagcuccuugauguauaaaaugaggauaacuacuucauaacuaugaaguaagcuacuauaauuuucucccuacagucacccaaaauguugaguagucuggaggguauuuuaauuuaauuauuauuuucuaauagucuaaggaagaaaggacaauaguugaugcuaacaagaguuuucauccucagacaaacucacagauggaaauggagggcuaaacaauauaaauaaaaacgagagagaacagagaaaaauagaauuguggcuacuucuagacucuggcaucuaaaagcucugcagguaagguuuuagcauuuccuaagacagacuugagcaacacagcaacuugagucaaguuuagugacucaagaaaaauauaaggaaagaaaagucuuccuagcaagccacaaguucugccuaauauauccucuccuuugaaaaauauuggcuaaaguaagucagagaucaaucuguuacaagugggaaggcaagacauucaaacaucucacagccucucuacccuuaagcauuauuaugugaacguguuaacauuucaagaggcuggagaagagcuguuaagagcacuggcugcucuuccagaggacucugguucaauuuccaacacccauauggcagcucacaacugucuguaauuccaguuccagaagaaccaaacccucacacagacauacaugcaggccaaacaccagugcacauaaaaguaaaucauuaaaaaacaacaacaagaaggaacuacagccagauggugguggcacagcacuugggaggcagacagaucucugggaguuugaggcuagcuuggucuacagaauuccaggauagccagugcuacacagagaaacccugucuucaaaaaacaaaacaaauaaaauaaaaugaagcuuuaacuaggguuacuuuuagcaaaaauauauccuuugaccuugaaguaaccaaaaucuacuucuuuccaaauauaaucauuacuucaucucuuaugcucagcauuaaauauuuaagguuucccuauuuccuaccaaccuggcauacagacacccuaguguuuauucugauuucacaguauaaaaucuaagcgcagaaaccuaaccuuccuugggaucaaucuguuaccaauuccuuaaaauuuaaaagaauaaagguaaucacuucacaacuguacaacucuauaacuuuagcaaagcucaaacuauacaccuaacacuggcuaauuauaucuuauauaaauuauauaucaauaacauacauucauucacucagcaaauaaauuuugucgauuaugugcaucaaaauuuguagcaaauccugcagguuggauuaucugagucacacaagcagugugcuuuacugaguuauuacugucccaaaacuguuacaugaaaauguuuuaauuucuggauccugaaugucaccuuaaugguggccucuacuguaggaucauuacaacuuucuaccaaguuccauuauauagaugaaauuaugagcaacguaauacauucauuguuuuaauccaacauaagcaaaacauuaagcaucuacuauauaaaguauauauuuuuauauagucuuuguaccaaaaaacaugccaccaaagcauacugacaacacucuggaagaaggcuacuuauuguaaaauacuugagugacuuacucuaaggaccucagugacccagugggcugacuuaaaaaugcagaaacuaaguuccucaguucccaaggcagcaugguggagagaacugugggcuuuccaagcugacuugacuuuugaauuccaguaccacuacuuacugauuauaugcaugagcuugggauagucacuuuuacauucugaccuucaauuugcucaacuagcacuucacaggcuugcaaugacuacguaauauacucaauacucaguauuauugaaugacaacucaacaguaugaguuuccuuucuuggucuucaggcuuuaaaaaaaaauauggaggaaggcuaauuaacaaacaauccauguuaugggaacuagagagagggcaaaauguuuaagaacccuucuugcucuccagaagaccaaaguucaguuuccagcacacaugucaggcaucucccaaccauagcugccuauaacaaaaacuugagagggaucuggccucagaaacaccugaacucaugugagcauucccauacacaggaagacaaaucuuuuuuaaacuccauguuauuaguggauggucagcugugaaccuauacuuccugccuucauaguccaauccaucccuuacccaucccacuauuucuaguuuuucaaacuuuagcugcuauguuuagaaaagugauuuaauuuuagaaaccuggaaaauucuuccgaguaaauugagcaaaaccuuaaucugccccaaggggaaauucugugcaaaacaauuauuucuaacaagagaagaauuuucuaaggggguuauagaauuuaaccacacaaaugccaccaaagcugcacacaaagugacagaaggcaaucuggaacauacuguacagauuuucccagaggaaauagccuccccucaucugggguugcuaaaucuuccuaggugaucugaauucuucccggcucugucacuaguccagauccuuaagccagaaccacagacagcaguuggaaaaaaaaauaaaauaaaaaggacaaaaagaaauacccugaacaaaccccaaaucucaaaaauaucuuccaaaaggcacugagguccagagaguuauuuucuccugaauggacagaaaagccaccacgaggcgcucagaagcacaauccuuucccccaaggucauucaagucaucgaaggugcgacagagaaucugcaagcugcucgguuaaagaacacugcggagauuuuuuuuuuuuuuuuggaggugugugaagggggaugggggggggggcugccugcucucuuccccucucccaccccgaagugugagcacccgccucggcauuuccgaaacaagccacaacaagcucugcaguguuaggaaaggggcugacgcgaugaagaaacagaugcuccauagcaagaugggucuuucucggccggcugaggcuccugcgagguaauuagcagaaaccgcaggcaccucggagagguccccaccgggcugcggaacccaccagccccgccgugccagugcccgugcccgggacgccggcuuccaccucgcuagucgccuggccagccgcaggccaaaagcggcucccgaaaccgcacuucauuccugcgcuucgggaagccauggcucccuucccugccgggccgcggggcggggugcgcgcugcggaaaguucaccgcggcggcgggagggggccggcggcuacccgagugccccugcagauuccaccauuaauuaguccucgggacugucgacuggcaacuuaaacaaagcgaaugccucgaauuccuucccgggccgcggcggucuggcccgcgagacgggagcagcgcgccggcgggagccgcgcgggcgggcgggcgggccgcagccccggggccgacagcugcggacgccccggggccgccgcgggccucuccccggccccccgcgcgucgcgucccgcacaccggccgcggcccuuccuguccgcucacuuccuuccucccggcucgccgccccgcggagcccggcgaggaccccgacgccucccucccuggccgccacagccgcgcucgcccucacucggcgucuccccagucuccucagaaacgucccucccccuccucaggaagaaaaaaaaaucucugagucucucccuccaacuccagccacacucucuccggcuggcccaccggagaccuccccuucccggcuccgcuuccagaacccgcgcgcacuccccgccguccccgggacaccccggccgagacccccucacccccggcacacaagccggacucccaggccgcccgccucgccacacucccgccgccgccucaccucagcggcugcggcccgcgcucccgccgccggaggauccggcgcuccgcucccagcggccggcgccugcucaggcucccccagacugaca

SEQ ID NO: 2205 - RNA, 52260 nt, Mus musculus
cgucgcucucuggucuugagccggggacaagcggcugcuuuuuuguccuggugcggcgggagcgcgcagggcgcgugcgcacgcggggguguuuggcuucgcacggagcgugagaggugcggggcggagaggcgcgaggcggcugcggacccacggagcggcagaccgaucggccccugcggcccgcggcggccaggcggcccgagauguugucugggaagaaggcggcggcggcggcagcggcagcggcggcggcggcggcugcugggaccgaggccggguccggggcggcgggcggugccgagaacggcucugagguggccgcgccgcccgcgggccugacgggccccaccgacauggcuacgggggcggcgggcgagcgcacuccccgaaagaaggagccuccgcgggccucgccgcccgggggccuagccgagccgccggggucugcugggccccaggcggggcccacagccgggcccggcuccgcgacgcccauggagaccggaauagccgagaccccggagggccgacggaccagccggcgcaagcgggccaaggugaggccgugaucgaaccgcuggucccggggaccggaguggggccgggggaggggaggcccggccuuugugcggggacccgguguaucgggcgcuggagggugugacccugauggucugacugggaaagauggcuucccgacgcguuugucuaccugugugucugaugugugcggacggcggacggcuucuggguuguguacaccggggagaugggugugaugcucuaagagucaagcugcaugaaaagaaagagacuuuuucuuuguuuuugaaaggucuugcuguacgccagguacgcguagacucuuauuucuuucuuucuuuuuuuuaaagauaaaauaauaaaauauacaaaaaccaaucguuuauugugcgugugcgaguuggggucauaggauagcucgccugaguccuuccugucuuuccgccaugcuaaggaaucgaacugagguugucaggccuggaggccagcgcuuucuuggggcccggguagacuuuuucaaauuguggaagcgaaugaagaauaccaguuggacacggggcgaauauaaagauaaagauuuggcaucaaauccaacacuauccacagauaaccucugucucacaccccaguaugccagauggugcauuuggcacagggccagcguuuuucguuuucccaaacaccacuggacugguauuguuagcuucauuuuaagaaugaguaaaaagagguuugcaguuucagaguuugguguuuugacaagguguaauucgauauugaaacaaacaaacaaacaaacaaacaacccucugggucaguaaccuugcuaagcauugguguggcuuuauugcacaguauuagccuuaaccagagaugcuuaaucugauggggaaauuggaaauacauauggguuuguaauaaauacaagaaguagucuaaggggcuggagagguggcucagugguuaagacugcugacugcucuuccagggguccugaguucaauucccagcaaccacaaccaucucacaucuguaaugggaucugaugcccucuucuggugugucugaagacagcuacaguguacucagauaaauaaaucuuuaaaaaagaaaguagucuaaggauauggcugaauggcacaggacuggccaagcagaauugagaauuuguguuucuguuuguagcacugcaagauaaauacaaguguuaaguagugugacuuagguagcuucuuguacauuguucucuccugcugugcuggggaguugacucucuuaugugcuagacagguucucuacuauagccccaguccuccuuuuuauuuugaaacuauauuggcccuaaauuuaucuuguggcuuaaacagugcuugaacuugugaaccuccugggucagccucccaagugacugggauucuagaccugccucaguaggccugguuuguuuuguuuuugauuaacaaauaucuuguuauguugcucguaagaucucagauuccuaugcucaacacauagucugaccuaggcuuccagaguggucccuacacugugccaggcugcuggguaucauuuuccagggcggugggauguguuacuggagagccuucagcuuccugcuugagaccuucauacucacugcucagucauuuggauuugggggaaaggccuguugggggaggagggauuaucagacaugcauuagaaaggaggaguauuggggauacuggaauaguuuuagcagagauggagaggaagggucaaccaaaaccaaugauguaugaaaaugcuauaaggaaaccuaccaaacauguucuuaaaauccacaaaacuagaauccucuuaaaacugaagaaagugcaugugggaaggcaaaggcacacagugacgcccugcccccaagauaaucugaauacauuucaaaccgccugcguuaguuuguuuguuugauuuuauuaaaggcauuagaaaagcacagagguugacuucaaccuuggacaugaaggaaggcagaguccaguaggaacccguuuuaucaagucauguccagaaacagauaacuuaaaaacagauuugaggucuggagagauggcucagaaguuaagauugcuggcuguucuuccagagguccugagcuuaauucccagcaaccacaugguggcacagaaccaucuauaaugagauguggugcccucuucuggcaugcaagcauacaugcagucagaacacuguauacauaaugagugaaugaaugaaugaaucaaucucaaaacagauuugagauaaugugucaauguugcuuuuaaauuauguaaucuggggcuagagagauggcucagcgguuaagagcagugacugcucuuccgaagauccugaguuccaaaucccagcaaccauaugguggcucacaaccauccauaaugagaucugacacccucuucuggaggucugaagacagcuacaguguacuuacauauaauaaauaaauacaucuuuaaaaaacucauuaaaaauaaaauaaauuauguaaucauaagauaaaaacaccaccacagucaguuuagaacauuucauuguuucccagagacaccuggguuuuuuuguuugauuguuuuuuuuuuuuuuuuuuuuuuugagacaggguuucucuguauagcccuggcuguccuggaacuuacuuuguagaccaggcuggccucgaacucagaaaucugucuaccucugccuccugagugcucugauuaaagguaugugccaccacugccuggcuucuacagagguacuuguauucuaguugucuuuucucaucucccuaccuccagcuccuggcaaucacuggucuacagucugacuguauggaguuaccuguucugaacauucucuaugcagucucaguauauguggcucuuugauuuuuauuuauuuguuuguuuguuuauuuauugccuuuaguauggaccuuuuuuugggggugucucucucucucuuuuuuuuuuuuucaagacaggguuucucuguguagcccuggcuguccuggaacucacuuuguagaccaggcuggccuugaacucagaaauccgccugccucugccucccaagugcugggauuaaaggggugcgccacuacagcccaguuuuuuuuuccuguuauguauaagguagcugugaacaguaauguaaaacaugcaaccauguguuuucaagucucuuguaagacuguagaggaauuuuuuuuaaagauuuauuuauuuauuuauuucauguaugugaguacacugucacuaucuucagacacaccagaagagggcauuggaucccauuacagaugguugugagccacuaugugguugcugggauugaacuuagaaccucuggaagaguagucaguacucuuaaccacugggccaucucuccagcccuguagaggaauuuuaaucuagcaauaugacugcucuggcaagggaucacauucagagaccuucuaggucugugugagucagcuggaaagacaucacucugucugaaauaagacauuccccuuaguacacaccaugaaucccaaacaguguguaaagucaguuuguagaaggaagagccgucuuugagaaugacaucuaauugcgagucagaaagacucaacagaaugagucagagauaggaugugcccaacacucacuagaacagcacaggaaagcaugguaacucaggagagcagcccagggggagggagcgaggcaguuuuacagagacaggcugcaggugaacauagacaagcuccggcuuguccggcaugagaaggagccagguuagaacagauugccagaauuaguuugagguuaagcagagcaauuuagugagaggccaagaagccaguuugaaucaguuagcuuggagaggaguuugggcgggacauggguuaaaccagccagcuguagucgagcaugcacuagaaagggugaguucacuuaguaagccucugagacacaaugacaucugaggaaauaaaguuuacucuuacauaauaccugauuauaaucugugaaccacaugugaauucugcuuuucucuuguggggaauugcuaccaaguguuuuucuaaaauagcagcuacaguuucaccuuuuccuuagcaauguaugugggugcuaucucuccauaucuuugucugugcuuaccauugucugucuuuuuauagccaucuuuguaaaguugaaaugcucuuucauuguagacauguucauuuucauaauggcuaaugauguugaacaugguuuuuguuuuuuuuauauuuguaugcaagagagcuauuuuuaaaaguuuguaguguccccccccuuuaaaggacaaaccaagcuggucuuaaacucauuauuucccuguguacuugaggauaaccuuaaguuucugaucacuugcacccaccuuuuguuuguuuuguuuuguugacauaggguuuugguuucucaguagaacagcccuggcugucuuagaauucaauuuguagacuaggcuagccucaaacucaacagagaucuaccugccucuaccugagugcugggacuaaaggccauauucagcccugcauccaccacguaauugcagugcugggauuacuggugugugucacuuauacccauucuuaucuggcucuggggaucaaauccagggcauccacugugguaggcaggcgcuauacuagcugagcuauaucuauauccccagcucuacuuagucacauucuuggcucguuuuuuuuuuuuuuuuaauggguuuaaaagaucguuuuaaaguaagauuuauuuuuuauucuaguuucaaaacuuuuaaacuuuaauuagguccaauuuauauauuugacuuauucuguuacucccaggguugcauguaaggaauauuuuuuggucccaaccauguguuuuccuguaaugccacuaccgcuguuuugguuacuguguuuuuauauaagaugugugaacucuucaacucuuguugaagaucauguugauugaucuuuucauaggaauuauaaaacuauguuauacuuaaaaaaaaagcgcaaauggcauguuuuggggguuguuuguuagggcaccuauguacacauguuugugugcaugucaguaguacauauguauauauguauguguuuauguuuguauagaagcagaggugucuuccucaaucauuucuccaaauuauuuuuuaguccaagauuuuucuuugagccugaugacagcaagucccagggauucuccaggcugugaauuuuacugacuucuuaggcucagcacagggaguuuuguugaaacuauaucaaaucuguugaucaguugggaaaauucuauaagauugaugccuuuguaacucucuuggguuuaauuccuguuuuuccaucuugauuugcccuuuuguuuuuuuggugugugcuguguaugugugugugugcuuauguuugcaugcauguggaagccaggggugauaaugcgugucuuccuuaacuacuuuauacuuuuuuuuguguguuuuuuuguuuuguuuugguuuuugguuuuuuuuuuuguuuuuugagucaggguuucucuguauaguccuggcugcccuggaacucacuuuguagaccaggcuggccuggaacucagaaauccgccugccucugccucccaagugcugggauuaaaggcaugcgccaccacgcccggcuguauauuuuauuuucugaaccccagacaucuugcauuuuugauuuugcgugcccugucucgucagcuuacuccaaggauccccuguguaucuugagcauugggauuacaugugggcauucauucuugaccaccuuuuauaugggugcuggggagucuggucuucauuucuaucucuauuguuugugcuuuuaucccaggagccauuuccuaacucuauggucaguucuuaaacuuucuaacuuccuuccuuccuuccuuccuuccuuccuuccuuccuuccuuccuuccuuccuuucuuucuuucuuucuuucuuucuuucuuucuuucuuucuuucuuucuuucuuucuagauuuauuuauuauuauaucuaaguacacuguagcugucuucagaugcaccagaagagggugccagaucucauuaugggugguugugagccaccaugugguugcugggauuugaacucaggaccuuuggaggagcagucagugcucuuaaccacugagccaucucuccagcccaguucuuaaaacuuucaaaagaaacauaagauauguguuuauuuugggacagcuagaagcaaggauguggagcuagagagauggcucaguaguuaguacccaaaugguggcacacagcccuccuguaacuccagcucaggagacccagugccuaagugaacaaugcauguauggugcacaaaaauaauuggacagccaggcugugguggcgcacgccuuuaaucccagcacuugggagucagaggcaggcggauuucuaaguuugaggacaaccuggucuacagagugaguuauaggacagcuagggcuguacagagaaacucugucucaaaaauccccccuccccaaauaaauaaaaauaauacuuggaugaaaaauaaauuaaaacaaaaaaaugcagcaguaggaaagaggugagaaauuucaucccuucauagccgacuuagagcuaaugugaccuguaacuugaguggaaugguguguauccauuuaagaaguagaaagcaaacugguggaugugggucccacgccggcguguaggggaguggaggcagcaggaagcuaguagaagugugccaaguuucagguucagugagaggccuguagggaagagagcagagaguaauggagcagggcacccaguguccuccuuuggccuuagcuuguguaagaguacuuaauuaacaccugugcauauacaccacacagagaaguucuuaaaaaggaagcugaggcguauuauugggggugggguuuugggggaccugcuugagguuuaauaauaauaaagacgcaggaacauuuguauaguaaguauaaagcuguugaccuuuuccucuuagcuacaaucuaaccuaaccuaacuuuucugccauugcauccccacuaaguuacucuuuuuuuuuuuaauuuuaaauauuuguuuauauuccaguuguuucucuccccuccuguccugcuucccacaauuccucaucccauucuuccucccucuugccuuugaaaaggugcucccuccccccaggccaucccccuuuccuuggacuucaagucucuugaggaucaagcacaucuucucccauugaagccagacgggacagaccucugcuauuuaugugccagggccgcguaugcuugagguugguggcucagucucugggagcuccccuggggucuggguuaguugagacugcuagucuuccucuggggcacccucccuuucagcuucaauccuucaccuaauucaaccauaggagcccccuauuucaguccagugguuggguauaaguauuugcuuuugucucagcugcugguaggaccucuuagaggacagccaugccagccagauucccaucugggagcacaucauagcaucaguaauagugucaggccuuggugccccuccuaaccccuucuccuucagccccccaugagauggaucccauguugggccugucacuggaccaucuuuccuucagucucuucuccauuuuugucccugcaguucuuuuuagauaggaacaauucugggucagaaauuuuaacugagguuuaguaacucagucccucuacuugaggcccugucuaucuacuggaggugggcucuucaguucccucucccuaaggagauuggggcauuuuggcuaaggucacccccauuuaguccugagagucucuaaguuacucuuaaucucuuaaacucccugcuucauucccucaguacucugucuacuuuugcccagucaucugccccucuccuuccccagcucuuuuuuucuccaaaaagccacauuccagucugaaccagucagcugcugggcaacucuagauccaucucuuugaguugcucauuggccuuguugauuguugcuuuuggccgcuugcuuuuuaacuuaaucucagagaucaggugaggaaggauaaacauuuacauauagaaagcugguaaugggcuguagagaggacaaugccaaauauucagcuagcaccuaagucuggggagcaggggggggggcgagcaauuaaaauuggaaaugcaggggcaccuacaagcuauuugguacaauguguggggguaggucuuccuacacuguagacuggcuuuaagaauuuugagguauauauagauacuguuuuauugccuaaagauugucuaguaugggggccucucacuuaaaaauaucaugaaauugcauaaucaaaauuaguuugagguuuuauaaagguguuacugaagaugucagcauuaaggccugggcccuggcaggucuaacaagcuagguugggccaucuguccucaguauaucaauuaaagagacaaauaauagcaaaaggcagagaaaagauagccaaaguaaccacagcaggaauagaaacuaauaccugaacuaauacauucucaguccaugguauuuuaagaccagggucucuuuauguaggcuauguaggcuggccaugagauuguguagcucagguugguaacguaaaagucaccugggugcuggaauuacaggaacguaccaccauaucuggcucacuaguuaacuguauuuuuggaugagggccauuuuaauugauacuuaugugaacaugauaauauacauacugggaaaaaaaacaaaacaaaacuacaggaggagcucuugagucagagaggugaccaguauugggauggaaaaguuacacacagaccgggcugagccucaacugacacaguguguuuuucuugaggcuuuauucuuuaguaacuauuauaaauugauuugaucauuguuauuucuuuaaaauuugaagucugaaagcaauuaguugggccauuaaugguuccaaacagaaccccugauugagguucucaguguauuuaguuuuuuuuucugguauaaucuccauguagguagaauacagagaaauggaugaaagcuuggccaaccucucagaagaugaauauuauucggaagaagaaagaaaugcuaaagcagagaaggaaaagaagcuucccccaccaccuccucaagccccaccugaggaagaaaaugaaagugagccggaagagccgucuggugaguuguaauggccagccauaguuugcuuguuuuagaaauaagaaucaguuguucuguccuuauauugcaguguuauuuaugucuccaucucugguuuauucugauucuggggcucuuugcugugacucucuaugugguuguauacaugaaugugugcacaucuauacauagcgcugcugaccaucuuuuuguuuaugucugaaggaaguaagggauggugauagauaauugcaauguaaguugguuagaauuagaagaaaauaaaugguuagagaaaacaaagaaugucagauccacagagccagucaguccugccaacgacaacuugaguucacagcuuaaaguuuuguuuuuuuacuguuguuuuuguuuuuauauacacauacucauuauuaguaaaaacuuuuucuugguaaacuuacaucaaaacauucugaaguuaaaaggaucaggccuuuuaauuuaauuuuguaauuuuaguuacagggcuuucuaaucaaaggagcgguauaaggagagacugugggguggggguguucagucaagaguuggugcagcucacaaggacccaaguuccuucucuaacaccgaguaaaagcugagugugguggcaggaguguggagucucagugcuaggaggcggagacaugauuaaugauugcugcugaggucugauggcuagacaaccuagcugaaucugccagcuccagguucagugagacugcucaaaagauaagagugaucaaagaagauagccacuguugaacucuggcaucuauaugugugcuugcucgauucuacccccaacccccccccaaucucuuucucuaucucuccucugucucugucuuucuuaugugcauuugcacaaacucacacacaaaaagaaaaggauacagacaugaagagaaucugaucucacauaaacuuccuuauaccaugaaaagauuauuggauuuauauuugugucagaacuucauauagcuuuuuuuuuuuuuuuuuuuuuuuuugguuuuucgagacaggguuucucuauauagcucuggcuguccuggaacucacucucacucuguagaccaggcuggccuuaaacucaggaauccccuugccucugccucacaagugcugggauuaaaggcgugcgccaccacugcccggucuucauauagcuuuuaaagaacucauuaaauagccuggcuguggugguacacacauuuaaucccagcacucaggaggcaggggcugggggaucucugaguuugaggacagagcuaugcagagaaaccgugucucaaaaaaaaaaaaaaaaaauccuagcuuuuuguggcuauccucaguuguuuuguuuuggaaaaacaguguaaaacaugagucuuaauuaguuuuuuguguuuuuugcucuaaauaacaucucauuaacucauuuuuacuuugaauacucacaguguuuguucuccuugaaaugacuuuuuaaauuucuguuagcuacaggccccauaccuuaccaauccuuuggaugcagauuuuaggccuccucugcugucuuuugcauuacuuucccuguuacccagaucaaacuuauuuugacaaguucuagcuuuugacccaggaucuucagcaucuuuuuauuuacuuuauccacaccaaaaaucaugcucuuugauguuacuguaaauuaccagaacuuacuuauuucuuuaaaagcccgccauuaaugcuguuacuccauuugggagaauuaaacgucaacuguuaauguaaacuuagguuuagguuuugacuaaagcucuuacaaauaucuuguacaguugaaauaaaauauuauaaaaauacuuucugaaaaaaaagaaagauuaaauucuggacucaauucaucccagcguccaggcguuugcuugaccuaagacugucuuaaaauucuuuaucagacaacucggaacuggaagccuuccaguccugggggugcaccuuugcacucgugucuggagguagcagagccuucuccgccacaccuucucagugcacuggcuuccuucccaucccacguuuuguauuuagcuuucuugccuuuguucaaucugugucucccucucucucuuuaucucuaauauaaucuuuuugauucucugucuucugcuuuugcuggguacuugcuauuugaaauggcuguuguaacucaucaggcuguagagcccucaacuuaagaguuaaguauuguacaguggucauaugauauguuagaacuuguuuuuuggugugguauuuugugauccuacuguaagggucggagaauugcugaaaagaucccaaacucacaaguaugcaaagacaaagagcauuuauuuugcagaaacagccggcaggaggucagcuaucaaagaauaaugguggcaaccacgagagaagcucacaggcccuagagccagguauugguuuuccaguugugguuaggucaccauuaggauuguuugcgcuuacaggauauuuguacacgucugauugguuuguaccuggagggagggagggcuaccucguagguaccuuuucauauuuguucuaagccccuggccagaugucagggcaguugaugacuggcugcucuuugucugugguuuuuuccaagaagccugggcugcccuucugggaaauugaaacuuaagaccuaacauggcugccuguucuaaaauggagugaguuagguccucccagaagcuagaaaacagauugaagccauauuguagaaagccuagcuugacugguuggagguagaaacuauccagguuguuuuguuuuggggaccuaacgaagggccuucaccuauaccugcauucuaccaguuguaugcuagcacuuacccagucugucugagguucuguagacugaaaggauggcacugagguauuugguguagaaaaggcaaucucuaaaguauagagagauuaaaguguuaugagaguugauuugucaugggugccuuucuuaugcuaagugauauuccauccagcccccaguuaacuuuucaaaaugaaaauaagagguuuuauuuguuucauguugguggucuagacuugcuuuauuaggaugaagcucucucugggcuuaacaacccuccccccccuuuuuugaccauugcauuguggcauuauagaccuauuaagagucacgaguaauacacaaaauuuuaaauagcuguugcuuauguuuaaacuuguauuguuuuguuuucuuaaaauuuucauguugguuauauuugguuuaacaaguuucauuuuggaaguaucuuuugugugaagauuaaacguuguuugauccuggggacgguugggaacauccggacuuugggcugcguggacugcauguauugguuaguggaggagccucuguaagagaggacucauuccgcugaccuuaacuggguuagaguaacugccccuugguugaaggaauccguuggaaauacacuuuauuuggagcuugccucagcuugucucguacuucauaucaucccuuaauaguuucugugagcugcucugcuguugcuaaaccguuaaugcacagagcaucacuugugcugguccuaccgccuugcugaauaggugcugauuuuacaguuucacuauuggacucuacuuuaggaagauaauauuuugaguaauaaguagcuuuguugugcguaacuugaaacauuuaugaaaacuuaguaaaagcacaggaguuuaaucccagcacucaggaggcagaggcaguuggaucucuuugacuuucaggccagucuggucuacagagugaauuccaggacagucaaggcaacagagaaaccuguaucaaaaaauuccuccaaguguaauaauuccuuauucacuguauucagcacaccacaacaacucuuuguacaguuuuaauccuuuguugcaaguguaguucuguagucuaagaauuauuaaaaaaauaagacuaagaacuauucaaaaacuaagacaagauccuccaccauaauauucagucugaaagggcuacagauauuagcagcuaguagguuguaggcaugaagcaccauaauaaauguauuuaaagaaaacuguagugagaauugagaaguuaguuuaauuuuuuuaaagugguagauaaaauuguaugacuuugcuguauauaaucugcuuuaaagaaauguauauuugaagaguguuauaaucuagugagguuaccuugauaagaucauugguuuuuguuuuuguuuuuguuuuuuuugauaaggcuacuuaacauauacucuuggcauuuuucuaaagaacacagcuuauugguuguuguuuacuauagucacuguguuguaucauagauuuuuuuuuuuagagaauuguuugcaggcuaauguuuccguccuagauuggauuuugaaaauuuuauguuaaacaugaagaacugauguuagguuuuuauaaagugguuuuaaauucuugauuuugaacuguuaauugcuuuugacugguaagaggaaccauugaauacuguguuuggucuuagagagauuacccugcuucucuucgcuuugcuucuuuuuuuuuuuuuugaauugugaaagguaauauauuuuacucuacaugauuuacaguuuuauuguggacaaaacaagugaaaugaguucuacaaaguggugccuuaaauugcaaucuguagagaaauugucuuuuuuuuuuuaaacuucuuauugugugcgugaauuucacauugugcacccagucccucuuaucuccucucuccuaguaucuacccuccacccuugcagcuucccccgaaacugaaaagcagucucuguccuuguagaagccuuagugugucagugucccacaguguacacuuuucuccacaagguuuugcuucuaaauguugauuguggugacucgauggcucugcugcuuaucaaugcuggagccucgcuguguauucuguuguugcucugagucauggagauccuguaguuuugaacuagcuccuucauguucaguucaucaaugggguagguguugaggugggucaauucaaaucccaggaucugggccugagaaguaucugagcuauccgcuggccaacuuugcagagugcugcaguaggugaggggaugggccaacucuccuacucugaugagcucugaugacuuggggacagcucuucugccuauuauagguggcaaggggcaugcgugugugggugcauugacugcagggaagacaccugguagggucagcucucuuacacucaugcccuuggggcuggcucauggucaccccuacuguuuugcucgggugaggugcaggacccucucuccugagugcuguagcuggugaggggaagggccggcuugcccaggaugcccaggugagggguggggccaguucugcacaugcccccagguggcagcccagacuaggggcuucugccuggccuuugaugguaacugaccccugcuacugcagggccagggacccagaugugugcccucucccuccacacccuaccccauccaccccccauggcagcacaggccaggaccccaccacucuccuagguggcaucaccagcugcucacaucaggcuguuccucacuacccucaaguauccaauucugucucucuuuagugugaccacauccuucugcuucucuuucucuuccauuucuccauuacuuacuugcucuucuuagugagugguaaccgggaucucuaagagucuggggucaucucaggagugcugugcucagcuuaugcauuauggcacccggcaggggucauuuugggcauggucugcuccccagaucagugugagcacuagacuggugaucaucucaggcccccucccucuugggagccccauagcacuggugguugucucagggucuucugucuuggacucacucccacacagccugugguccuaggcaggauuccggcucccuaagguggagcucugaguugcuuccaggguggcgagcgcaguugccuccggcucuuucuccagagauuguuagacuacuaaucacucagauauccacagugcugaacaauaaaguggaacuaggaauaggagagauuaauauuuuagucagauuauaacuacauagaucauuuuggaaacuggaaauucauuuuaguaccuuauugucaaauacaugcaacuaugaaguauaauaguaacaugugguaugaaauguuacaaugguacuuugaauagugguaccaggauaaaguuugauauuguccauguuuaaaacagguaaauaaaaaaagaaagcuuuuuuuuuuaacugcucagacaccuuaaucagaauuaggaaucagaauuauauauuuccuuugaagcauugugaaaccuacacuaugagucaagacuuugcauaaaaguaaggaucaagaaaauuucuacuguugaauaugggaagauagugugugaaaguagucuuugugauuucuagaagguuuguguuccuuccuucccuacuguguugcuuccuugucugugguuccugcuguuucugacuucugcuccucuggaaugcugaaggaggagggccugcuguuagcagaccccuuucgaguccgaguucuagacaggaugaagguggccugguugaguccguuuuucaguggugcuguaacucuaggauugcuguuuccauugaaacguguggauuuuauguagagugguacuguugcucaaauacugaccaucaggagcagccuuaaaggccuguuagucagugugcuugaagaaucuucugguuaguuuuugcuaccucugugagccucauuuacuucauuuugcauuuauuguaacagacauagaucuuuuauccuacacaaaacugggucaaauagguaguagacguuuacuuaguuuauuuuaauucugcccuaguuuuuuugguuuuguuuuuuauuuaaauguaugaguguaaucuccugaaacaggaauuacagccaguuuuaagucacuuaaugugggagcagguauccaccucagguccugccagaaaaacaggaaucuuuauuuccagccccuugaauuuuguuuuguuuuuuuguuuuuuugauuguuuugguguuuguuauuguugauuuucuuuauuguuuuuuuuuaaggucaggcgguucuauauguccuggaacuuacuauguagaucaagcuggcuugggauucaaagagauccaucugccucugacuccccaguggugggaaaaggcaggccagcuuuuuaaugguguuuuuaaagccacuucuuaauauggagauaggagaaagguagugcaaaguagugauguuuuuguuccauuuuuuaaaaaagauuuuaaauuuauuuuacauauauuaguauucuaucagcauguaccuccaugccagaagagggcaucgggucccagauggaagugguugcugggaauugaacucaggaccuccagaagaauagucagugcucuuaaccacugagccaucucucuagccccauucucaauuuuuauuugcaugugccuguguggcacagaauaggacgaaugugcaggagucaguucuuuuuaaccaccauguaggucccuugaaucaucugcucaucacuucuggcagcaagugccuuuagcggucuuccugcccuaagaucaccuaagaucaaucauauauuuauuuacaagcuugaacuugcauagccucuuucuaccuccaugcaguuuuaaaaucuugagauuuauuguuccuuuuauguucuauaguuucuagacaucuuuagaaugcuguuccagcuucucucuucccaguguaucuauugcauuaccacgcccuaaacuaaaauggaacaguauuuaccuuacccacuuauacccucacuugcacagccuuucugauuuacuaagucuuguuuacuuacucauuucauuccgaguuauuacacuucacauauaaauuauuuuguagcccuaucauuaauaguguuagggauugguguuugcccaugggguggugggccuguaagaguaucuuuuuuuuucuuuccucagaaauccgccugccucugccucccaagugcugggauuaaaagcaugcgcccccacugcccggccaagaguauuuuuuaaaaaaacaguuuuguuauguaggcuagguuagaccugaauuugguccccacuugagccucccaaguagcugggguuuuaggcauacauuauucaacuuggcucugugucuuuuuaagaauuuuuaaaauguaauuuuaaaagcagaagcgaggcaaaagccauggguuacuguguagacauggccaaguccaagaaccacaccacacacaaccagucccgcaaauggcacagaaauggcaucaagaaacccuggucgcaaagauaccaaucccuuaaggggguugaccccaaguuccugaggagcaugcgcuuugccaagaagcauaauaagaaaggccugaagaagacgcaggccagcaaugcaaaggcagugagugugcgcagaggccauugaggcccuugugaagccuaaggccaucaagcccaagaugccaaagggcccagccacaagcucagccgucuggcuuucaucgcucaccccaagcuugggaagcggauucgaagcuacauggccaagggucagaggcucugccaaccaaagcccaggguucagaccaaggcaggggccaaagcuccagcuaaggcccaggcuucaguuccagcccaggcucccaaaggugcccaggccccugugaaggccccacagaaaaggcuccugccugugugaagacaguuguacugcugugacacaccuacccacacacuguuugcagaugaccagugccuuaugcugucuuuacaaauaaacucgaggcaagaaaaaaaaaaaaagcagaagcaagaaaaaacugccuuaccuuggucuugucauauuauuuguaguacaauaaucaugaauaagaaauauaucucuugauauaauaauauauauguaucagugaccauagaaaaacaagagucuuguagcugaaacaaguuugguuauugaaugacaugcauuguaguuggagaaagggaaaugauaagaauagaaagaguagaauaauugaguuucagugguguguuggcucaggccuuuaaacaaaccuagcacuugggagacagucacggguucucuguaaguucagguguaagaccguucuggucuauaaagcgaguuccaggauugcaagagcuacaugcauagugaaacccuaucucaaaaaacaaaaaaggcuacuuuuucuuuucuuuucuuuuuuuaaaguaguaaaaugucucugagauaagaaaccuucauuuaugccaagucaggaacaucauuugagagagaacagcuaguguuccgauguuaauuaaguuggauuuguuuacuauuacaagcucauagcucuguugagaaacaaacgaacaaugucuuuucuuuuuuuaaauuuacaacacuuucuaggaauaaaugaugauaccaagaugaacauuucugauuucaacuguagggccuguggucucaagguuaguuuguacauugcguuagcaguucagucuucccaucaugcuuaggugcuguuuccuagggccucuaaacaagucauacaguguagcuuaucuaagcugaagaaccuucuagaaccuauggguccuuuagacaagagcauaggaaaauccuuaagcuguccgccauaugccagcauguucuguuaguauugucaaaaacccuugcuuguauuucuuuaggauggagauaucauuuaaaauuucauagaccuuggaacauuuuuauaagggcuuuuauuguuugacuuuacugcugcuucaacccugguggaacaaucaaucugcuguccugugggaacacuuuaagauaaacuguguaaugaagcuugucucaaguucagaucacuggagauuguuuuccugcuuucauaggccacacuguggucccuacagugcaccagggggcuggaagcuuaaugucauggugucugccuuggugaucgauuguguaagauugugugauuauauuuuuagauugaauuuaaagcuucgauucuugaaguucuacaaaguaccauugaagagauuuuuuuuuucuuuuuuaaauaucaaggcuuaguauauagcuuaagguguaaguuccccuaguguguugccugaguguuuccauccucccacagacaugugugucugcagccuggccucucaucauaugaugucuuuacugaggaaacacugggauauucaguccaguccugucuauuguguacggaaggaaagcaaaacuacuuuggguagcugaaucuuuuccuuacauccccugcugucauaagggcaggauuuccccuuuuuuaauuuuauuuuaauuuuuauuuuuauuuuucuaagauugucagucauuugcuuguugccuuuuuagauaggaaauuaagagacuugaauugaugcugaauuguugcaguuucagguccuguagcccauuucagacacaacucaguguagcaacaguucauuaaaggauacuagaacccaucucccauccccacccagauuuacuaaauaagaguggcagcaaaaauguagggauuagaaauacugugugcuuuguccuacugccuuucaauaaggaucagcaugugaaguugcaaugucagaccagagucugaaagaugauguaauucccugggccuugguuacaggaggagcuuucugauggguuuacuaguuggugguaaauucuugagucaccagcuauuaggccuuuauguccagauauuauuuaauuuauggaguaaggucccugaguucuccucuuuccuuccacagggcaagcaggaggacuucaagacgacaguucuggaggguauggagacggccaagcaucaggugaggguggcauuagaugcuugccacuuuagcaaggucagggagugauugaugcuugcaaguguuuuuggcuaugguauucucauuguagccagaaccgcaggggugauguaacccacaggacagaguaguguaaggagagaguguagccagagcaaaggcaagcagacuguugaaguccucaggccgaucucaacccuccauucuucauguuuuugaggagauggcggguacuucucuugggaauaaugggaccuuuaaagagaaacagaaguagucacagacaggaaaccauggacucaagucuuuacaaggcuaagguauuuuaguucuagacugcaggugacaccuuacauagguaugauuguuggugcugggcacuuuuuccaauuaaucauauguagucacuuuacaguugaauuauuagcauaaaaguugccuuuuaaaaaaaguauauucaaaggguuuucucuuuucagaccaaacuauggauuuugacuucuaggaaaaaaguaaagaauuuauagggcuaucauuuggaacaguuaagcuuguucccagaaucugaaauaacauguuuguguuucauccuuucgucguugaaguaaguguaugagugugugcgugccagggcuaaaagcugguuucuuuagacacuuggagaaaauuggaauacauauuacuuaauauuaaagacugucaacucucauuuaaguauagauuaaagauacuuaucuguagcaguuugucuagcagguucaggacauauuuguguuuuaauuuggaucagauguaguuccuuggagauagagcaguugguagacagacggacaugugaaaccauagugcauaguucugguuguugccgggaaagccaugaauguugggaacccuuuagcccucucuuguauacauaugugacacugaguuuaaaacauaccugaguggucagcauucuucuccaaaugaaggcagauaaucuugaggguuucuuauagccaggauugugucuugguuucuuaaaauccguguugcugcguguuccuagagcuagaagggagcuugaggucaucuugucuagcguccugccuucaaaccaauauagagcuaugucuccuguguaugaguuaggcccaaagcaacagccgugaagugagaacucaggaccucacuccuugacguauagacuguucugcauccugaugacaggcaucugccgcaaacacaaaaucuaaucugagaacucaugacuuugcuuuucuccuccugucuuuacucuuuuuuguuuuaaacuuguuguaggaccugcuacaucugcugauuuuuaagaaaagauuuuguauguagauccagaucccaucaggcuuuuguuuucacuuucagucugaaaucuuguaauuuaccuuuuuuauuuaaccaaaaguaaaugguacuggaggccuccuuucucuaacuucuccguugcuuacacaagucagaauaucauuuacaucuuauaaaaaucagggaaaaauaauuuguggcauaaaauacuuauuuccuugcuuuagucuuuccuaguuaacccacccugcaaaaucuaugaccucuucucuuuucucuuuucucuucucuucucuucucuucucuucucuucucuucucuucucuucucuucucuucucuucucuucucuucucuucucuucucuucucuucucuucucuucucuucucuucucuucucuucucuucucuucucuucucuucucuucucuucucuucucucuuuuuguuuuuugagacaggguuucucuguguagcccuggcuguccuggaacucacuuuguagaccaggcuggccuggaacucagagaucugccugccucugccucccaagugcugggauuaaaggcgugugccaccacugcccagcacauuguuucuuuaaaaggaagguuuuauguuuucagagauggcaucagguuagaaagggcauuguaguucagugugauugcagacuggaaggaagaccauucuagaacuuaacuguaugaggguuugggagacaggacugaagcuaggcaggcugagugaggcuuuuuaaaaauuuaggcaacaaugaagaaaauaucuaauuaaaaaugccuaaaaaaauuugaggcaacaucuuuguaauguucuaaaauacucgaauaauagauuguaucaagugugcccaaauauaaaagugaaaacuguauuccagagucaaguguaacuuacuucugaauucuguguacuguugguuacuuaaaaacaaaaagaaaaagaaaaguuguuacccagguagacagguuuccuguagagaagauuggugugaguuguuggguugguuauccagggcagucucugcuucauucuggaaacuaaaucaaaacaccuaagggagauguuuugauuucauuucuggacaguuugugccaaauuaaccuuuuguuuucuuugaaaaaaagcuagaguuuuucagucuugucacccaauuuucauaauggccuucauucuuugaaauaaaaaucuaucucuaaagaaagaaaagaucaugacugagaguuuugauuuguuagccaggccugcagaugucugugccgggccuguucucugagccgucggcacucucugaguguccuagaggcugucucaccuugagaaccugcugucccagugucagagcaggaagauggaccuggaaagcaguguuguuccugauguaguaauaccaucuuuuuagcuccuuaauugcauuuguguaguauuuuugaauucugguuuagagaaguacuuuguaguugcgggaugaaguaaauaacuuauccuaguuguuacauagccccgaugcccagagucacccaagugucugaguuuuuuguuuguuuuucccaaagaacacuugcaucuuggaaccaaaugucauaaguaauuuugaagggauuuuuuucuauauaccuuuucuugcugucauuugaaaaacaaucuguuguaguaaaagucucuuaagccaggguacaauacaguauuagcuaggaaagaaaaugauuuuuagcaagccaaagaauucuguuaauguuauguuggguuuacagugggguuuggucauauagcccagguuggcguuacaauaugcaccaucauggucagcugagaaauggaguuuaaugcagauuuaauagugaucauuauuuucauguuaauaguaaacacaugaacauuaaguauuuggccuagacaguuuauauuugucauuauaaggauuugagauaugucauuauaaggauuugagauauuuuagaguuugauuuuuguuuuuuguucguuuguuuugguuuggggauaggagacagggacaucaaagcuguauaauuuuagaaaaauucuguccucgcuagcaccuucuccaccacuauuuccuccucaaguaauaucacaugcuaccagcaaaaauauagcucuuauuuuuaucccuuaaggcauauuuaguuaucugacaaucuuugguuuuuagauuggaguuaguuaaauuaggauugaguauugauuuuauuuaguaauguagaacacagggcuuuugcccuuagaucuagugguggauggugcuucucuuuuagaauagcuauuuaaaauggguggccucuggcagcaugggcaguuucacuuggccuuuuucuuaacuacuaauuucucuaaguggugacuguuguuugauugucgguggaaacaggucccuuaggagaguagcuacagucuucaagguaaaguuguaccugcuguguucuuuacuacaaauaaaucgucuuuacuaaacucacucuuccagcacugcuucuaacuucaugacauuuacuauucuauguaggagcuuugguuuuguguuguuacuguuuuacuuuugauacugaaucuagaaagucuaagauuguaccuuuucuugucccuuuccuguguccagaguggaaguuggcuagggcuugguuccuagggccagcuaagcacgcgcacucuucccaagcugcaccgggccugucuggcugcucagaugcugcuguaguguuaagauauuugaguuauaaccccagcgugugccugacuaacagacaugaguuuaucgacuagcuuaucaaauauuuaaaagccaauuuaaauaauuucagaauaacucauuuuauuuguaguauauguguacacucauacaguguguguagcagcaagucuuguauauagugaaguguuucugauguugcuggcagaaauaaauuccuggacuucuucugacaacuauuacggucugcuuaauuucucugcccccuugccaacacuagauagugaggacuaauaaauacauccugcucuugauacauuguguaauuuuguuuuugaguuuugaaccuuuaacuuuccauauccugcugcaaucacaaacgaaggccugugcuuaaauguuuccuccgggccucuguuagugcgcuuuccuuucauuuguuucuucucuaaguuguaugcuaucugugguauucauuuuaauuagaauauaauccacucuuacaugauugauggaugaaaauauucuaauuggcuuguuguaaaguaauaauucauugauaaacucuaaacuuugagauguuaagcuugaaauaguaccugaaauuuuaacuuuugaggcaaaauuuaaaaaacaaaacaaaacagcuuuuaacaggcaguaucagucugugaauucggcaaagcuuuauaacucuucucaggcagaaaaggauuugagguuucaucauugcuggucucugcucauuugcacuguucuagugguccucugcuuccuuugcuagguguggagggugcagcuuuucaaagccgacuuccccaugaccgaaugaccucucaggaagcagccuguuucccagacaucaucagugggccucagcagacacagaagguuuuucuguucaucaggaaucgcacaguaagugucuaugccucuguuuuucgcuuggauuuugaaaagugccuaugaauuuuaucaggaauauggaaaacaaauagaagggaagaaaaaauuaaauugugauauauuuuuuacagaauuuauugcagagauaaauugucuuuuccuuuaggugcuuaacucuauugguuuugguuuugugcgugugugcuuguguguguacgugcaugugaaugcauaggugucuggaagccaaaggaaucaucagauguccuagaacaggagcuacaggcaguugugaggcauccaguggguacuggagcuucuguguauaaaguuucauuucuguaugcaugcauuuuuagggauccuucucauacuucauaaauauauuaagaaucuacacugaaaaaaaauuugucgcaacucuuuuugggguggaaugggaagaagugcagagaugggcuguuuauaugcuaggcaaguguucuaacacugagccauaucccagccagaccccagcggauauaaauuacuuuaagcagucacugccuuucccuucaaaccugcauccucagucaggcuguauuggcacacacuuuucaucccagcacuggggggggcagaggcaggcugaucucugugaguucaaggucagccuaguuuaugagauugaguucaggacagucaggguuacccugucucagggaaacaaacagaaagcaaggcugcacuccuaacccuguuuugucaccugguuuacuuucuuccucuagauuuaaugauuaaugucuuuauaauauuucccuugauaguugaaccauaauuuaauuaauauaaacuuccauuuuuacuuuguuguaauuaaacucagauuaguuuuagugcauucugguucuguguauggaauauccuuacugugugcaugauuccuaguguauguaaguagaaucuccauuuguaaaaaucaaaacuuaguguacauauuuuucaauaacuaaagaaaagacucauuuuaauagugguuauacuaggauuaaaacccucaacuguagccaggcaugguggggcacgccuuuaauaccagcacucgggaggcagaggcaggcggauuucugaguucgaggccagccuggucuacaaagugaguuccaggacagccagggcuacacagagaaacccugucucgaaaaaccaaaaacaaacaaacaaacaaacaaaaaaaaacccucaacuguuagaaacauuuuuaacauuuugguacagauagucuacuggaauauauacucugaucguccugcccucauuugugugaauaaauaguugugugccacuguaagcaaacacacccuauuuugauuucuuagguuacuguugcugacuguuguuuuuguauuuauuaguccuuuauauggucuuuucuucucuuuuaaauguucuuugccaaaaauucuuuagcuaucaggcauaguagccuugccuuuaacugcagcagucaggaggcugcagcaggagaagcucauucaagguuaguguaggcuacagaauaggaaucugucucagaacaaaacaaaauucaucagcuauuggggaaggcaagauguuauuuguuaacauauccaucauuuucucaaaguaucugugaaguuucuccugcuuugaauaugucucugcgcauguuuacuuucuaggccccgcuucuuuaauuugguuacuagguuguacaaccacugcuaaauuuguauuacaaaauacuauauauaguuaagaugacaggucaguuauacuggaauuuugaaacacaggaaauuugggcuaaaguaagugaacggaaaugucuuguuuuauaaauugugaaguuucucuggcuagugauugcuuuuuucugcagugauggugucuguucccugauucaguuaggucuuagccuugugacuugagcacaacugaaauaaaaccgugacugaguuuuauuuccuaggauggaaagagaaagcagcugugaggagguugaagggcuugagccauggcugugggagaaacugcauucuuuucugauuagcucuccacaacguggggucgcucuagucacaccuuuuguaauugguguaucuaaccaaacuaacuccuugguuaagaacuuaaucuacaaaagaggacuuguuaauuuuuuaauaagacuuuaaauaugaugcuauuuauccugcuuuguauuuucuaaguguguguguguauuuuagagagaaauuucuguuaaaacucauguugacuaugaguuuuaacauugacuguguuguaaucuuuucauucuuuaucugcaagcuuugaaaauuauucacuggcucuuuuuuucuuucuuaaacauaauacuuucuuggcuugaguaacauaauauucugauuuucuccuguaucuaccauguagucagaugcuuuucaacucauuguuaugaggucuucuccuccauucuaggagucuuguauacauucacuccacuaucacacugcagaccuuaucuccuccgagcuuccuaucuucucuugucucagaacuagaaucauaguauaaucugccugugguuuuucacuuacgccauuuaucaacucauuuacuuguucaacccaaaacggaggggcugucauugacacuuuucagccccuguaaaccugcaugauuauagccaugugauuuuuuuuuuuaaaucugaucaguaucuggaauuauguaauccccaguuuaaaugcuagcuauuccuuacugguuauuuagauuuuuuuuuuccuuuuuuaggucaaauagccuccagcuucaauaauucauugguguaguuuuacauaauaccuuucuugucaguauucuaacccccacugugugugaaaauagaaaacucauaguugaagucuuagauuuaagagauaauuuucuggcugaucagguggcguguuucuguggauguguaauacaacuuaugucaucuaaaaacaguugcaguuauggcuggacaacccaaagauccagcugacguuugaagccacucuccagcagcuggaagcgccuuacaacaguaaguccuguguuuaugggagaaggucccuugggaaccuuguggcuucugauggcauuuuauuucaucuugugcugugcagaaaugaccuuuaugauucuuguuuucuuggccuauaaauuguauugaugcacguguuuaagagguuucuaaauguuuucucagaucuauugucucacuuugaccuauggaguacuuuaauauuugauuagcuaauuaucugguuuucuuucuguuuaccaccaacaaagucuuagaaagguuuugcuaaaauauaugaauauuguucauaucuuuaucuguaauguaguaucuuuuaaaaagauuugcuuauguauuugaguuuuuaguucauauaucuaucugcacaccagaagaugucaucagauuccauuauaggcacuuugaagccaccgugugagugcuagguauugaaccugggaaccuuggaagcacagucagugcucuuacugcugagccaucucuccagcccauaauaucuuuacaaugccaauuuagccagguaugugagcacauagccaugaccucagcauucuagggccgaagcaggaggauuauuaguucuaggucagccucagcuacauagcaaguuugaagccagccucaacuucuugaaacugucuccaaauagcacucucucucuccaguccccauuuguugaacacuuugaacuauguuacagccugauaguacugugccuuuguuugcuaaaggcaucacuuguccaagggucacaugaguuguguguaugaaggcuucacacuagagagagaagaauuaguauagcuuauuguuuaaacuguuggaaauaugaacauguuuuuaaugugcucuacaggcgauacugugcuuguccaccgaguucacaguuacuuagagcgccauggucuuaucaacuucggcaucuacaagaggauaaaacccuuaccaaguaaggacuucccuaccaaaugaaauaaguggcuuuuaguuauacuuuuaggucuguguuuaauauuuguggugcuggugacauuuuacuuucauuaauguuagugaaaauaaucucaagauuauaagucaaaaguuaaaugaaugaaugaauuaaugaaugaaugaaugaaugaauguacauuucuucgaauuuccuguuugagaagguuuuaggaagagaauaauuccaguuuuuaaaacuuugaauuaaagaguuguuagaaaugggagaaguuaguuaggcaggcagcagguuugaggcuuuccucugugguuccucuugcuuucuaaguauuugcccuauucgugcuguuugagcaaugucugcugccagggaucugagagauaaagauauucuggaaaaaaauuaauauuuucagacaggaauacuaacuuaaacagaagugagacucuuaaagaggauggcucacauugguacaguugugaaggccuuccugagugguuaggccacagaacuucaaauuacuaauaauggcucagaccuguacguucaguuacaaguuuacaguauugaauuaauuucuacaaguuucugacauuuauaauuuccacagucucuacaguuugaaaguaacugaauuguuuaagacauuacauuaaaaagccaaaaguuuucaugagaagaaaaacaugcaaacucagaauuauaaaauauuauaauuuuuguucucuuuucucccuuucaguuaaaaagacaggaaaggugauuauuauagguucagguguuucuggcuuggcagcagcucgacagcuacagaguuuugggauggaugucacacuucuggaagccaggguaagaguuagauuuugggauuagaggccugaucuaauggaaacaugguagagaauuaccaugugcuugcccaggcugguuucugugguguuacagaauauucuugggauacucuuuaguguuggugcuguagcuuuuauuuauauuaugauuauuuggugcugggaaucaaacccaagagccuugcacacaguaguuaaauaaaugcucuaccauugagcuauauuuuugcuaaauuauuuuugacaguagaucuuuagaaggugaucaaugacuguggaguucauaaaggauccgucaguccuugggguggauaauuucagauagguuuuuaccuuuagcacucugucugcuuuaaggguuauaauuguguguuuuaugcauauaucugggugugacuaugugcacaugugaguguaggcucccagaagagggcaucacaucucuugagcuggauugaguugguugugagucacucggggcugcugggaauugagcucagauccucuacgagagcauccaguacucuuaaccagugaguucucucuccagcucuaaaguuagcgcuuuaauuugggguggucauaaacuuuguaggaggugauauuucaguuauuaaauuauaucccuuguuugcuagauagggaaagggaauuauguucgguagagcaggucuuucaggagcagcuaaagcuaggagaaguaguucaucauucccagaucuggaaguagaaacugagguggagagggugagagcaggucacuucagggagcuguuagaaaagugguuuguauacauccuuuuuuuuuuuuucuuccauauuuugccuuccagugacugauuuuuuuauuuaaaaaaaugaaagaaacuuucuuaguaaccuaaacauuuaagcauuuuauaaaaucuuuaaaauacuauauguaguuaauuuaaaauggcuuuuuaugaaguuuuaauuuuuuaaauaauauuuaaauagagcauggggacaugaaaaugguuuuccugauaggcuguugcuuuuguauguacucuguacuguguguuaagaguaaaggaaggaaggcuuagcaggucauugugauccuucccacguuauagcucguaaaguuuugcucugcaguuuuuguaguguaucucaaguuuacaggguguuuugauauuuucaguaauuuuaaguuaccacuguaacucaguaagguuuuucuauccccgaaaccuuaaucaguagacauaagccuggaccuguuuaggacuaaaaucuauuguuaccaguuuguguuccugggcaucagguuccuuggcagaggacauuugucagagaaguuauugaucuaaagauacaguuacaacaaccagugacugucucuguggcccagacugcuuggccuucugggagaucaucagucuaacacuggcuggggcagcuugauguaauucucauccucacugcaaaggacugugguaaccaaaggaugagcaucaguucacgguggcagagagucgucuaguguuggaauuuauaagcauauaguuuuugagugggccuugugaguccugugcacugagaacagcugagugucagguaugguagaguagaguagcggcucugcugugcuuaguuaugguuaaaacagccuagaugacucggaccguuucaucucuaacaaacaggaucgaguagguggacgaguugcuacauuucgaaaaggaaacuauguagcugaucuuggcgccaugguuguaacaggucuugguaaguaguuuaauuugauacugcauuacacaaucuaaaaugagaaagcgcuuacauuuaaaccaauaguuacucuuauaauauacuaacuggggacucauagacaguaagucauagugacuuaccacagacagagagugaaucauagggacacaccauagacagacaggagucauagacacacaccacagacagacagacagacagacagacagacagucauaggaacauaccacagacagugagugagucauagggacacaccacagacagacagugagugagucauagggacacaccacagacagauagugagugagucauagggacacacuacagacagacagacagucauagggacacagcacagacagagucauaaugagaguuuacuuaauuuccuuauaguugugguucuaggccauaggagcagugaucuguuaggcuucuugcuaauagucucugggaguucagaucacauggcaagaaaccguaugugagugccuuuauguuucacccuccuaaggcuaauaagagucagucaaucaaguucaccuaucauaucaucuccaaagcguuuaccuuuugaauaggaggauuaagugggaauucucagagugggaauuaaacuccagccugaguuuguuguuuugguucugaguguguuuuguuuuaaugagacaggguuucucucaguagcucuggaaguccuggaacucaauccaggcugaccuggagcucacagagauccaauugcuucuguguccccaccccccaagugcuaggauugaaggcgugugccacuacaaccugguccaaccuguguuuugagggggcaaaguauauucaaaucacagcagguccuuauucuauuaguggaaggcaccuugccaauuauccuuucugaaggcggaaaaaugggaauuguacaaggcuuuugacacuagggcgucuuuuuauaguuuaaagaauuuauccugagcaaacagaccagugaaugaugcuguguuuggaucauuuccaacacaacauuguuucuaauggcacagcauuagaaaccacauuagaagauuaaauuauuauauggugagacaugaauauccacuaagaauuauagcuucauagcauaacauguuugcaauguauugcuaaauuauaacuaucacagaauggguuauaacccuuuuaugugaagccuguaacuguacacagaaagcucuguauuaaaacauuaacuuaaaggauuaugagcaauauaaaccccccgcgccccccccccauuuuuuucugaacaggguuucucuguguagcccuggcuguccuagaacucgcucuguagacuagguuggccucaaaugcagagauucaccugccucugccucccaagugcugagauuaaaagcgccuggcuuauuuaauuuuuuuaccuuggucuacguuuuccccaugagcuuuagaauagaagauauaauuaacauccugcauugucagcugcuuacucaguuuuuuggcagugcugcuggggauccagcucagugccuugaaaaugggagaccagcucuaguacugaguucuaugccugcccuugcuuauucugcagggugucucauugcauagcuggcuggccuuggacaccacucugccuuccugucucucaccuugaaagggcugcaguaccggcauaggccaccaaggcugaauuuagcaaguuuuuguuuugaguaaagaaaauuugacuuugagguuuuccuuuucaaggguaggcugacuuuguuugaguuuuuuccuaggagggaaucccauggcugucgucagcaaacaaguaaauauggaacuggccaagaucaagcaaaaaugcccacuuuaugaagccaauggacaagcuguaaguugaugacaaacagcuuuucaaaauuucuuugguucgguuggaaaucauuuuagggaacuguaugacugagcaugcuaugaguauacagaccgagaagagagaugagcauggugugacuauacagacuuagaaacaauugcuguuuuucuagcuguuuucuuaacucugaguuauuuaggaagagaugaugguauaugugcaaauuuacaugucugccuaggcauuuugucuguaggaauugacugaaggcuggccacacagcuaauuggcccuagccaauuuuuuucaauagaccuauggaauugaaccugagucuuccuauuucugugcugucccuccaucaugugcuuuagcucugugugcucugucacuucccuuuguguauagauagaggcuucugacaggagggcuagcaaacagccggggacacuuauccagagguagaguaaguuagugcuuaugguuagaggccuaggagcuucuuguccuuggugugagauuagcagcaacauggugauugguuugagaugugagagcucgggccuuggucagacaugccuaggcugccccuggcaauccugauuuugcagguaugaguaaaauucagaaguuuguguuuagcagaaauuugaccagcuccccugucaggaugagaaacacugucugagaauguaaacauauggcuaacuuuguauuuugagaaagaaaguuugcuauguauuguauauguauagcuuaguuauuguuaccagagugauaagauucccugcucuuaaguuuuacaggaugaugaucucaggggacaucugucucugggcuuugugggcuucagaucagaaagaggcugauguuaaggaaacgccuuggguuaugucuaccagaugugcagauuucuuuccagggcuuauuugugagagacaucuaacaaaauaagaauggaaugagagagaagggauauaauugaugcuaacuuauuaguaacuuauaaaaaguuacuaauaauuuacugacaaaagucaguaaaaaaaaauaaaguugaagacagguucccugcugcaaucuauuguuacuuauaugggaguagcaccccuccaguuuuuauuauggaauuuuuuuaaaaacuacagaaguaggaagaguauuauaauguacucccauuuucccaguuuguuuaauuuuuccuguuucuucuucagggaaagagagucuaaaaaauaacugcuacccagaaguguugcaguugcuaauuaaugucuacucaaaccaaccugguuugcgacucagguccuaguuccccgccccaguguucuggguuccggagugaaagaacaugcacaaagccugucagcaagaucaagcugaggcagauuugccaaggguuagagacauugcuacagaagagacagggcaugaggguguguggaaguggcuggcgggacagggucacagagggagggaacacauuugugaguugcaguuuaggacuucagccgugguugcacacuggggcugaggaaggugaguagguggagagagcucugugggacagggugaggucauccuggugaggcaagaagacaagcugcaguggagcccugcuguggggugcugggagcaggguuuggcccaggagaagugacuucgacaaggcaggaaagagccuggcugugugaggggaacgagcagcaaguaaagaucuaggcagagaaguguguucagugcuuauacacuccgucugggacugcuggcuccugagcccuccagcggcugagcaucaggccucuguacuaacugagcacagcuuagcuaagcucauaaaauaagcuuuuagcuuuguguuuguuggguggggaaugggauccagccccucacgcuucucuaggcgauugcucuaucggugauucuaagugcuggauuguuuuguuuuuguuuguguggggguuuuuuggggggugguuguuguuauugauuuuauuucuguguagcacauuuuuaaaaaacauguuuuaacaauauacccacuagcacguucccccgaagcauagucaccaaucucuccuguuacagugugggauaugauaaacagcugguauaagaaccgcuucugcugaccauacuauagaaacuugucuauuauguccuggcuuaagcucccuaucugaggacuaggccuuuggagaaacauucaguaguuugaacaagggauaugguuuuucuuuccuuuucucccuuuuagaguuaauuauuuuauguauuuggguguuuuccguacaugaucucugugcauaaugcgugccugcugcccauggaagacagaagaggguuuuggagccccagguacuggaauuacaguugguugugaaauaccacguggguguuggguauugaaccuggguccucugcaaaagcaacaggugcucuuuacugcugagccaucuuuccugccgauguuguguuuuuuuuucccuaagucuauuuguauuuggugcuauagccaagugaugguucuucaggcauuuuaguuuuagaaagaauucuuuguagccuugaguuccucuugccuuuugcauagcuauauguuagaaaccacauuaauguuuuucugucuccaauggucuggcucaguaagaaugcagaacuguugaccuguaggcuaguuuuucauuuaaaggacagguacagagaaccuuguuugcauaugaagaaagaugagaaguugaguaggucaguaguuucauuuuguagaauggaaaacuuuauuucucauguauuucccuaaagccacugugaucagcacuuaagaaucaguuuguuuccugggguucuagcucagauucucguuuuguucuguuacgccugccuguauuuucaggagaauagguggggcagggcgagcgauucccugugugacugcgucagccaagucuccucuuaaagaguuuaaaaauaguucccuaaggccuagcuccauggaguauccuuuaaucccagcacucgggaggcagaggcacgaggaguucugugaguuugaagccagcuuggucuacauagcaaguuccaggacagacaaggcuauauaauagagagacccuguuucaaaacaaaacaaacaaaauaguuucccuuggagccagcaaggcccacccagaguagaaauuacucaaccauuaagauuucuuacuguuuaaaaaaugagauucuauguucucuuaugugcaaccuuagucaaaauuuacccagcacaguucuguaauuccagcuauuuaggaagcuaaagcaggaagaucaaaagaaauaagaaguaacaacaaacaccaccuauuacauuuucuuccuauagcaaggguggccagguauagagcuguguuguguccuuaaacaagcaccacccgugauaucuauagccuucucuccuuugucuuuuugguuuuuguuuuucuuuugagaucggguuucccuguguagcccuggccauucuggaacucacaaagacugagugaacccagucaucugggguucaguccuuaguaucacaaaggagggagggaagcaauuugaugguucuguuguuagugcauagagacuuauuuucccauguuuaauaaggccagcauuacugaaaguuacagauagcaccggauauggagguacacaccuucaaucccggcacuuaggaggcagguacagguggcucuuugugaguuccaggauagccaggguuacacagagaaacccugucuccaaaaaccccaaaaaagagagguuguagauaucacagguggugcuugcuuaaggacacagcuccuuaccuagccacuuuuugcuaggaaaaaaauguaaauagaugguguuuguuguuacuauucauuuuuuguguacguguacuucuguguacguguaugucugguguguauuguguuuggaguguaaauguacauaaguugaugucuuucauucuuugucuuauuucugagacagggucucucacagaaccuggagcucacugguugaguucuuuggcuggccagcaggcucuagggauccuugugucccugcuucuccugcacuggguuaccuucuuaugugaaggcuggggagcugaacucagcugugugguggcacucugacugacuuaauuaagaaucuuauugucccggugccuacuguuaaaacuacuaaaaucacaaugaucccuaaggcaguaccucaccauucucugcgguccucuaugggcagcaaggguguugagcuucaguguuccuugggguuggggaugcacgaugauccauccugcaugucuagaguuuuccuuuggagaaacaucuccauaauuauuuguagaaguaguggaguccaaagauuuuaagcaaagggaaugaaauauagaacacuggucauuuugaaguccuuagucauuuacuagaucuuuaaauugucggauauguaaaacagagugucuauaacuggcuuuuuggcaguggauucaguauuuaaaugcauucaaaacacauuugaguuucuccugaucacuacuguauaguauuccgaauacuccuuucauuuacaacugaaauguuagcauuaauguagaacagcucgacuucuccugguugcccuggcaaaaucagcauugcuguaauugcucaccugggcagagaauggaugggccugguugcugacugccucacauaccucauaacucggagacuugggucuaaguggguacuggacaugcagucuuucaucugguaucaaaugugguaguacuucuuugguuugagucuuauuuguuugguuuuguguuacuguucuguguuuucuguuuuuuaguugaguuuugcuuuuguucuucagugcuuucucacucccacccccaccugccuuuguuaaauugccccgaccccuggccauuucuaugccuugacucucccauuuuggucucuguauagucuguuccuuauuucuccagugguugcagcuucuaagcuaacagaaugcuucugucaugcuauguguuuaaagccuugauuuuacugcugucauacaaaacuaaacucuacguggcuguugggcuguuauuuacaguuuauuucucccucugcugcacugauuaaaaggacacugucaagguauuuuuucauaauuuuucaaaucauuuucuucacuguuuacaguaacccauuaaaagcuuaacacuuaaaucuuuuccuuucaaugauccucuccaucacacauucacacugguuuguuguuguagaguugcgccuauauguugggcuggugcguuuaguuuuugucauugaaagcgcauguaaaacaucaguuuuguuuuguuuuguuuuuugguggggaguguggaugggaaagggggaaguguaaugaaucaaguaggcugcucagaaaauagagggaagaaacaaaggucaauuuggucccucuaaccuugacagugucccuuuaaauauuucucuaccacacacccuaggcccaguuccugaaccgggaugcuggguguuucucaguugaacucuuuuaugugacugucacccuaaccacaaagauuaaagcuugccugaagcaagccauccaguuggcacuggaagagcuuuaaucugccccauugcgcucuuguguuuuggcacaucccgccccgugguagagaaggcauaugugguuuaguagcuccucuugguagagcauccucuugugaggcauuuucgaaaccugcauagaaacacuccaggaaagcagucuugcuguuaccauuggggagucauggagauuuuuauauugagccgugauugucucccuucugagaggagagcucagugccgagugcucgagccaucuuuuauagcaccauugcaggcuugcuugcaccagaaauaauagcaaguucccagcaggauuucauuuuaaguuacugaauacauggccaucacaucuuugagagaaaguaacugaugagaauguggaugaaauuucaugagagggucucugaauaacucuaguggugcagucagagcaagcaggaccaucagcaggagcucuucuuucacuguggaaguggggcaccagcuauucugacccaccagcuccugagaccacgguaaugcauaaacagcaccaagcaucugaagccuggcucucuaucucguuuucuacacaaacgagauuauuagaguuuagauuuccuuuaggcugggaguagcuaauuccuugaggcguuaaguaugacugucacuuguaucuguuguguucacagauccaaagcagagcugcuuuggcgcucuuccccuucucuuuuagaggcagucacccuuuuuugauaggucaucugucuuugccauaggagugacccaucucaugggaugguauaguugagugcuugcaaguauaaaauugaaggguuuccauugagagguagcuucuuacuguggugaucuugucccauccuaccaaacacuucaggcuugguagcuugguagcugcuagagccuauuuuacugcuugguuuucuuguucccuauuguagauuguuugcaaaguggagucuauauuuuaaaucucauuucuuacacagugccuagcccuggcaaaagaugcuuaucuuaggccuuggugucacucacuauugccaugacuccagcauuggggcugcagauaguuuacauugggacaaaacuaagauguaaccaaggaaugguacuaaugaacuaaugcugcuguccguagagccuguagaauggucuaggucagcuagaggacugcuuggcuguauguucccuuucucugccacagcaaggcaccagaccuucugguaacugaauuauucauagucuaagaccuuuggcauugaacucugaagcugagacuccauuaguaauuacuauguaaaaguaugguuaugacguguuauugucggcaccaugaauuuuacuuccguauuuucuccuguccuucgaaauucuuucauccuugagcagguaacuugagcugcuucuuuucccauuuuguucuuauucuuuaaggccuugaggugugugaucacaguuuuuguucucugggacuuuucuaguguguccuuugcaugucagcacagcguagcucaguguacuucaguuuaacuucagcuagugccagugcaggucuucuagcucuuauaguagucccagagucccaguucugaaggaaaagugggagagaaggaaauauuucaggccugaaacauuucauaucucauuuaaauggacuuaccacuucauagaaaaagucaaaucauuguccucaaagguuuuccuuugaaaugcauauuuuggccucuaaacuguagaacauuuuuguguguucauggaugacugcuuauagucuuauaaggaccaacucugcuauauucauauuugcagguuccaaaagaaaaagaugaaaugguagaacaagaauuuaaccgguugcuagaagccacuucuuaccuuagucaccaguuagacuucaacguccucaauaauaaaccuguaucccuuggccaggcauuggagguugucauucaguaaguacuuugaaacuguuuauugcauagugaauuccauuuacagauuguuauuuaugucuuauuugagcuaauuuuuacauauuuucaugugagacuuuaaguuccaaaaucagggcuggagagaugacucagugguuaaagaggagcacgggcugcucauccagagggccuggguuccguucccagcgcuccuacagccacuccuaagggcugucuguauaguaacagaagagcugacacucccuugccccucccucugacguaacugcaugcauacaaugcauagacaagacaggcaaacacucaaaauaaaacuaaauaaauuuuuuuuaaaaaagaugaauuucaaaguaacacauuuuuaaaaauuauagaauccccaaggccacuuuuuaaaauguaccaguucuaaaacguaccauuuuaaugcguauuauuuuauuuaucuuguagucuagguaacaaauagaacaagcuaacuuccuugucugaauauuugacauuuguugggcuuuggcccuuggauuuuuggcuggguuccaauuuuaugcuauagagccgguucugcagcugggccauauauauguguugucucuuacaggcugcaagaaaagcaugucaaagaugagcagauugaacauuggaagaagauagugaaaacucaggaggaguugaaagagcuucuuaauaagguagagcuuugcauucaguguucuaaaaaacuaaaacggggauuccuuuaacuuaaaacgcuaaaggccuuuuuggagcagccuggcugggucuccuuauacuuaccaacugcaguugauugguacagcgccugugcugaggucuggggcuagagcaagaugagcugaggccagcuacucauugaagacaacaaccaagucagcccauucauugccauaauuaucucagaugccaacauucccaccuccauucccaaacugaggacucugucaccaccaaguuucagguucuagguguuucaaauauaguuguauuuucccuuuuauucuaccaacugcaaaaaauaucaguuuauggagaaaugguuccuuagcugggggcauggccucacauugucaggcuuccuguuacauaagaacuccagcccagcucucuauggacuguggcaaggauugaggaguagcuggagaauugccaguugguagacaucugcgggccagguuucaauaccuuguugagaacugaaaaacuaacauuaggaaugaucgcauaagguucuuuuuguagugaucugacuuuuacauguaaguuuaauaaaaggaucaaagcugggcaugguggugaaccugugagauuccaacacccaagaggcuaaagcaagagggauugugaaguuaagaucugggcuacauagugagaccucgucucaaagcuaagcagugacagcuagcugcuuucucaaaguuuaaacugaugguagguuauuucacauauuuuuaaaaauggaauauucauuucccucuuuauuguuuuggaagacaaaaauccaucuuaguuaccugauaauguuaaacucuguuuuuuuuccccaaauggcaugacauaaaacugguauucagaauuuccaaggaucuuucauaacaguguacaggaagacucacugugaaggguauguuauuugggaaugaauugcuuugcuaucgaguaugaaaauuuuuuacuuuuccaucuuagaugguaaauuugaaggagaaaauuaaagagcuccaucagcaauacaaagaagcuucagaagugaagccgcccagagauaucacagccgaguuccuggugaagagcaagcacagggaccugacugcccucugcaaggucagugucggccugcccucaacagucagggagagguagggagccugagcugagccacagccaauggcaaccgucuguacuaggagaagggguuuggugccuuaggagccauggaaagucaguauugugugagaauguuuccugcaggauucuuauccugacgguugagauugguaaugcaugugaaguuugaagucagacugugguuuaaauaacccaccuggugucccuaacaccguggccuccuuagucaccuugucuguggcaggcaugguauuagucacacauagcuuggaggguccuugugaagcuuaaaugaacuguaucuaaggaguccuguccuaaggccccgagaggugcugagagcaugguagcugcuuugcucuacauccuugcuuggaacacacugcuagugcuuuuaccauuucuccuccugcccugucucaccccagacucauagcuuguuuccagauaaagaaccccagccuuaaauugaaucacacuuuauaagcauggucugagcaggaaguguguuacauaugaauuagguaaauaucuauuuaagauuaagccacacucauuuauuuuuuuuauaugucaggaauaugaugaauuagcugaaacacaaggaaagcuagaagaaaaacuucaagaauuggaagccaaucccccaagguaaggagagaaacucagacauuaagaauuucagcuucgcuuuccuugaguucaguuuggaagauaauaaaacagugaucuuuuuuuuuucaugagcguauugaauuaugugaugaaugggaaguauguguggauguggggcugcuucucagguuuguagucuccuccucuuacauguuagugugacgauauuuucaguaucuacaguuagcccuucuccacaaguccugguauugagaugaccucucauagguggaaauugucuuugagugugauuuaaaaguacuguugcuuuauacuggaaagauugggagcaggagacagaacuguucuuguuauuuccacuggggucaggcagugacugcaugcuaauaaaauacuccacaugcaucugcccuguuuuccugcagacagagaugcugucuguccuuggaguaaauuagccuguggguuugagacgaagcuuacacuuuugugauguaugaagacuuaguaugaggaaauuuuuucacacaaaggugaccccacuguaauuugcuaagccgaauuugacauugcucucuagaaauuagggacagaguuuaauaacagaggugagagccuguucugugcuuuagauauaaagcagaguccccaccccaguuuaaaguccagauuggcuuacacuauccauggagcucauugagacuaguagugaugacuuuuguauuuuuguuaacccuguacucccugauuuuuuuucagugauguauaccucucaucaagagacagacaaauacuugacuggcauuuugcaaaucuugaauuugccaacgccacaccucucucuacccucucucuuaaacauugggaucagguaggacuucuucauuauugaguugaacauauuugagaacugcgugugugugugugugugugugugucugucuguauguauguaugucuuguagacagcuucaggaggagauggcauaugcuuacagugaaaucuguauaagcaaucagcuugaugauuugccaagcuuguuucacaaugagcuaccaccacaacuaggauauagagcauuuuacccuggugucaccgugcacuccugucaucccagugcuuuggaggcuaggacagaaaaaaauuaaugaguucaaggucaguauagccuagauugucucuuuaaaaacuaaaagauacagaaaauuuacauuauccugaguuuucuucugcccuuugcaauuaauugcuccgccugauacugcuucagcuugucuuguuuucuuguaaguugucuuuaugaaugacuucacuuaccaugauguuguuuaucucuuuauuacagcucuaccguagagauacauagguuguuaauuuaucacugguguacugauguauguguguaucaugugguaauauuagugaaguuucucugaauauuauuuuuaucagauaaaaauguaagaguggagcugagcauggugguucaugccuuuaauccuagcacuugcaauuuaggcagaggcagguagauuucugaauucauagccagccugguagacauaaugaguuccaggacagccagugagacacacagugagauccugucucugacugcucccccacccuccaaagaaaguaggaauggaauugcuaagaucuuagggaaaguaguuucuggcuuuggugguacuagggaucggguucagggccuguaccuaucagguaauugcucugccacuucacugugcuuacaccccuagcccuguuuuuaaccauguaacaaacuuccgaacugcauacuaggugacuuugcccuuuuaagucagcgacaauccauguguuucacaucuccagagaugccaccauuccagugacugucaggauaggaccuucauguuuaucagcugcucuaugucuucuuucagugaagucugguugucuuuaaagucagaagagcucauuugucagauacauauuuuacacuauuuucuucuagucuuuggcuuguccuuuuuguuacugauucuacaugacccuagggugcaugcucuaucauuguuaucccucuaguucugucuguacuuuuuacauucugaaaaauugucauucucacaccugagcuuaucuuugcugcuagaucaguuuuaacaucuaauuacuaaaaaucaugauuccucgccccccgccccccaccccuuaguuucuagaccguuaguauacucuuagcuuccaggucagacccuggcuugauaacuucagauguccagaacuuaagccucugggcugccuuugccuaacuugaccaacuaguuuuggaaaucuuccucaacuuuagucugucaauuuaagaacuaaaagugauuuugcucuuaaguaaaaauguaauuauggcaguggaucugauaccuugaacaucuauaaugcuguaaggauuuuauucauaugaauaaaauauauauauugcuuugugcuuccugaucaucugucucuaucccaucacauauggauggauggccuauaccuggucauauaggacuguguuaacuaucuagggacaaaagaaacuucuuacuggagauuaggagcaagaucagccagugguuccucccacccaccccuggguaguuuaacuuuugaauacugaguaacuguuuguggucuuaaaauacuguuuggggcaggagaggugggacagagggcaggcagucaaguauguuggcugcucuugcagaggaucuggguuugaaugccagcaccaacaugacaguuguucauucuggucccagaguauccaacacccucuucuggcuucuaugcaggaaaacauccauacacauaaaauauaaagauuuuaaaaauugauuuguauaagcuuguggucuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcaagcuuguggucuuuaacacuauccuauagaacucaaugcaaauggcauagcauaaauuauguuuuaaaaguguaacaacaggccuuucuuuuaccuuguuaggaugaugacuuugaguuuacuggaagccaccugacaguaaggaauggcuacucaugugugccuguggcuuuagcugaaggcuuggacauuaaacugaacacagcagugcggcagguucgcuacacagccucagguacgugccugcucuauaggaagguagagcaccuuuccugaaugaaacagggcuaauuuuuauauuaucuuugguaacucguuugcaugauucauauguacacuuuguagauaccuuuugcaaucagauggcaaagugacagaaaacauaauaccaucuucauucuguguccacagaaaguggguguagguuaucauacuuaugaugugccauguucucaaaaaauucauaauuauauuuacagugaauugaucaaaaaagauacaugcauaucuuuuguaugugaauauucaugaacagucauacaacuacaugugcauagauacacacacacacacacacacacacacacacguucauaaaaaccacccuagggcucaucagccagcugcuuguuggugcucagucuuacaguuuauucugauuuuacucuuguuaaucuguguguuuuuuuuuuaaauacauauuggguaaaauaauagugacagaauucuaaugucaacuuagagaucaauuagcacuauaguguaucucacaguuugaggcuauguaucagucuucgaguugucauccuuagugagcagguaaccacuucacuccaggauuuaucaagugugagugaggguuuaaagccuggcaaccuuagguucaccucuucuguuuucuugucuggaaagugaaagaaauagcauguugaaccuguuggcugccauauucaguuucuuaauuggugcuauccuuguuaccauuaaaguuuucccacuuucucuaggaugugaagugauugcugugaacacacguuccacaagucaaaccuuuauuuauaagugugaugcaguucucuguacacuuccuuugggaguguugaagcagcagccaccagcuguucaguuugugccaccucuuccugaguggaaaacaucugcaguccaaaggaugggauuuggcaaccuuaacaaggugcuuugcuuuccucucuccugucgcuuaguauuugguguccgguagcaucagugaagaaugggcucugcauguagccauguuugccuguucccucagcugucugauuccaggccugaggccuggcagugccuggcuguauuauauauaauauucaagcacacuuuauaaucccaaaccuacuugggauucuccuaggaguaguuaguacguuguaagaacuauggcucuggaaggggacagugaugcuuacagagagcaguugcucugaggccagcugacaugcucccuuccucugcuaggugguguuaugcuuugaccguguguucugggacccaagugucaauuuguuugggcacguuggcaguacaacugcuagcaggggugagcucuuccucuucuggaaccuauauaaagguaacuguuugcuauuuuauuuuuucauacucuuauagagacagaauuaggaauauugaaguuuucuaauauagauaugacuuuuuuuauuaacuuaauaaaagcccuucaaaguguuacauguaaaagaaugcauguaaaaaugaagaaacauccugagacuuagauccuauuugcccaaacgccucagaucacuuccuuaaaauguguuuauguuccuaucucccauccuguuuauuuuacaaucaguugguuaacuagagcuaaauaaguauauuuaauccccucuuccaagagagugaagaacagguguuuccuauguagcaguuguaggccacugcuuagcagcacagacaaguuuuugaccugucacucaaucccuggugaagaggcauucauacacugagggcacgaugcuuuucccugguuacauccaggccaucugguccugucacugccaguaucauggaauaucucccacacccccuuagcauuccuuacccaccaccacccauguccuuguccaggccauugacaccuccuguaacagcugcugauaguuacuagugucccuguuuguugauugcuaaugggaaagaaggguuucuuaccaaggauuuacugaggcccuccccuuguuccccaucuauccucccucccagcucuaagaacuuggaacuguuuucaaauccugguugcuuuguuguucagagcuucuguguguaguccuucucuuuucacugucuggcuagcuuugccuuuacagcuugaucaaauguauauaauugagggcauacauuccuguugccuagaaucugaauuaaaucucuguauucuguucucuuuacuaugucuugugucacguuucugugcacauaugguuacuugccuauuaacaguaguauauuuuguaucuuucacgaccacaggaacuagguagcccugggguugucaugcaauucuguuaaauacucaccaaauggaugacuguggguaguaauggguaugaacuagguaaaagggauauugcuugccauugccauggagcccuuuaagugaucaggacuaaaaauucuaggggguggugaaagcccaccagucaguuucuagggacagagcugagaacaguaguuuccagcuuugugugguauauggcuuguugacuuuguucucuuaagaaaacccuggaauuguucuguuuccccagcuccaauacuauuggcccugguagcaggagaagcugcuggcauuauggagaacauuagugaugaugugauugucggccggugccuggccauucucaaagggauuuuuggcagcagugcagucccacagguaugggagggagcgaguggacgagcagggauucagcuugcaaccgaacuaggguuuuggcuuaguugcuguuugcagcuuaaguucuugaccaggauauuccuuccaugucaggaugaagauaugugcugaguggacaugaauuuuaaugugugaaacuaaagaauaauacucuagggugugucccagaaaaucaaagcugcuagcuuuugauucucuuuuguauguggggucacaucccaaguagcuuaauucaucaaauacauugggaaguccuaagaauuucuugguagcuuauuuuucaggccaauugcaauacuuuuagcccccuaugaaagaguaagcaacaugguucuucucacauaaauaaggucuuaccuaguuuucagagauggcugauuugucccgguauuaguaaugacuaacucacauuucucuguagcccaaggaaacugugguaucucguuggcgugcugauccgugggcccggggcuccuauucuuauguggcugcaggauccucuggaaaugacuaugauuuaauggcucagccgaucacuccuggccccucaauuccaggugccccacagguaagaaacuaggaaucugugucugagccuauuuggggaaagaccacaagcuuagggaagaaaugauaucucugacaauuuuagacuuuuauuuauucuacccuuaagauacuuuuggaauaaaguacuauuucucauacaugagcuuuguaaauguagccgagauuagaaaugaaucuagaguguauacaaagucgcuaauuuuucuugcucacuuuuucccuuuaaaaaguccuauuugaggauuaggaaaacagcuaagcauuuaagaguggcugcuagucuuccagaagaccugaguucagcccccaguaccuauauuggaugguuuaccacgucuuggaaugauagcuucaggguaucugacauucucuucuaucucccuaggcauacaaacuuuuugaagccuuauuuuuaauuguaccuaauuuucuggcagcuuguaagguugcaaagguccaaguuacuagggcguuguagguccugcucuuuauauagacuaugguauauauauauuguuacaguauuucucaauaucauaaccccaaggcuugguaucugcuccgaacuagaaagucaaguacauuccuaucccuaagaaggcucucccccuugugguucagagguuaggaugccuugccaaucuuagccagcagguauuacaugaaauaaaacuagaauauugugcaucaauaaacugaucaagagacacuuugguaaacugacaaacuagugaugguagcagauaggucuucaaaagucaacaggaauuuagcgauuugaacacaauaaaguuauguuugcaacuuggugauuccccuaccucuauccccacuagccaaucccaagacucuucuuugcuggagaacacacaauccggaacuacccagcuacaguccauggugcucuguugagugggcuucgagaagcaggaaggauugccgaccaguuuuugggagccauguacacuuugccucgucaggccacaccaggugucccugcacagcaguccccaaguaugugagacagaugguucugaacagagagauccaacggcaugucaucugccacguaagcaagcucuucuagcaauacuagauccuacugagaaacuccaugucaucagcuacugggacuccuaguuugacagcagaggcuggcuccuuuggcugacagcaacuuacccauugauuuggaaguacagcuccauaaagacugcucgagaagcaaguggugugagauaaccucuuagucuaugguguuuguuuguuuuuguuuuuuuuuaauauauuuugagaauaaaacuuuaaaauaauuuuauaugaaaauuuauuuuuaau

SEQ ID NO: 2206 - RNA, 306 nt, Mus musculus
gguuguccagccauaacugcaacuguuuuuagaugacauaaguuguauuacacauccacagaaacacgccaccugaucagccagaaaauuaucucuuaaaucuaagacuucaacuaugaguuuucuauuuucacacacaguggggguuagaauacugacaagaaagguauuauguaaaacuacaccaaugaauuauugaagcuggaggcuauuugaccuaaaaaaggaaaaaaaaaaucuaaauaaccaguaaggaauagcuagcauuuaaacuggggauuacauaauuccagauacugaucagau

SEQ ID NO: 2207 - RNA, 1137 nt, Mus musculus
gauaaagagcuggcgucccuuuuccggacucgguagcggacuguggucuugggcuccugguucguauuaacucggacgacgacgugggcccugcggagguagaugcuccgcuccuuccuuccgucugcuuccuccguguccuggccugggcgaggaccauguguuauauuugcuccgugccccgccccgccuugaccuccacuggcgggaaguccacuuccgcugcuccugggcggcucccggccucacuccgggcgucuuuugcugaguuggagccuagcugcaccuccuaucuuugaacccuugagcaggucuccuccagcuuauugcagguccaugaggguggaugaccgggucugagggcagccagaguacagcggauaacagggcgugguggcgcaccucggucaucgcaccccucgaagggcagaggcagaacaauugcuccaaguuagaggccgguuugaguuaccuggcgagucccacgccagccaaggcuauuuugaaggaaccugucuccaaaacaaaacaacagcaaaacaaaauaaguaaauuauaacuuggagcuagcgagagaauugggagagggaacgcugguugacuucuaacauucaacaacugcugguguggguaacggggcuugccguugcauuaagggcugagguugaggauaguaacggggaggguggauguaacgugcucgggacaauggaaaaggaaaaacuaacuugaguguuuacuugaggagaagagcuuugugcugagcaagugguuuccagaaacugauagcguuuauaaggcaggucgguuguggaacugggcugucgcucagaaguaaccuuggaaauuaacccccuaauaacuuaaaguuuauuucuagaugccagucaugugaagauccuggguacugugagaaggugcuuuccuaaguggguuugggaucuucucucagaaagguuuuggccagaggggaaaaccugaaaaguaucuaucuuccucuuggcuucuugugaaaauaacaaauuuuuaaaaauaacaaaccagaaagauacacagugaaaauuauuuccuuccucggucguguguucagaagcacaguuaauuuaauaaacuuccagguaugguuuguggaugugu

SEQ ID NO: 2208 - RNA, 529 nt, Mus musculus
uauggcugcggggucgcggcuccgaaauccggcgccauccgcgcccggcgcgggcaggcucgauggcucccgcaaagaaggguggcgagaagaagaagggccguucugccaucaacgagguggugacccaagaauacaccaucaacauucacaagcguauccauggagugggcuucaagaagagugcuccuugggcacucaaagaaauucggaaguuugccaugaaggaaauggggacaccagaugugcucauugacaccaggcucaauaaagccgucugggccaagggaauaaggaacguuccauaucccauccgaguacgcuuguccagaaaacguaaugaggaugaggauuccccaaacaagcucuacacgcugguaacuuacgugccuguuaccacauucaaaaaucuacagacggucaauguggaugagaacuaaccugcucaugucaaauaaaguugcagaacugccaaaaaaaaaaaaaaaaaaaaaagaagagaaaagagaaaaugaaaaucucuuaaagc

SEQ ID NO: 2209 - RNA, 2183 nt, Mus musculus
ucuggagcggcagaaagaggguguccccaguggagagccagggaggucuaugucaucuaccuccuaagaaagggugagagaggcgcuggcccaugacagccaaauggggucccacagacaaggaaaggaaaggggcuugagcuggggcagcucugagucgucucuuguuuuucuagaguagggguugaggugugguugggccagacaggggagaggccaggacauuccagccauuuuagacccaaaagacaagggcagcugaggggccguggcaggagagggcucugcagcuguuuuuuggguggggcaggcucaaacacugcccuguugguacagaauaaauaucagaagccaggcggagcuggcaguagucagggagacucucaggagagguggugaacugaccaguaugggagaccaagucucgaauaaaaugucuacuuuaggaccaaaaagagcgggcacuccaccgcucucuguucaaauggggcaggggaagaaaucccauccugucagggaagauuagaaccaaacaaucuggcagaaagguuugagacuuuccucuagccuaggauggcuuugaacucacuauggggcuaagguggcccuuuugaacucucuuuugugcugggaguagagguggcugccaacuggcaauggaaggcuauuucccaccuuaugccucauuguggcaagaauaaaugagucguguaggacaugaggugacaaaggacagagugcagaggacuagucuauaguggaagauggugggggugggggaggggcggugagguaacgcuaguuaccacugugggcuagcuguugggugucaucuagggccugucucuaucucauuagagacugcuacuuuggccacuguggggucccugcuuuggaaucugagaaauguggccucaaagaggcugcccuauguuuucuguagggcagccccccucuauguccccucccacgguccucuugaggucucagucacuuugauggccauuccuuucuccuuaucucucaccccucuuuuguacuuucuggagguccugagcuuggaagaagaggggaaagggaagcagaggaaacaggggaggggaagaucagagagggaggugacaaggagugggagcugaucucucucucucucucucucucucucucucucucucucucucucucucucucucucucuggcagguaaccagccaaacgcugucacaccuccgaaacuugacccggccagaaagaugucuggacgccagguaagccgguccaacacuuacaaccacuugagccaacccaacaacguguccuucccuccucgaacuccaggcuggacccaguaucccaauaugaacaacggcaagggucugcgaagccgccuuccaagcggcuccgaguuaagcaccuccagcggccaaucuggccacuccgagcaauccuucaacuccaccaccuccucagaacuucccuuggggaagaucugcaugggccgccccuauaccuccaaguguguagagacgagucaccugacgagaggccccaagguggucaaaaagcccaccugucaacgcagcagcccucacugccugaucugcacagaccaaccaucgugccccuccaguccuaccuuccuagaccagcucaucaaaggcauuagcuaccuggacagauccaccaauguuuucaacaacagcagcuaccccaaagcccugagcuuaccucagcuggcggcuaccuaucuggaaagagcugcuaacucccucuaccuggaccaaacggaacgccccccaccccgaagcuauuccacucccagcacuagcacagccgcugccaaucagcccccagccaacaacugcuuggucccuuccacucgggacaccaagagccugcagugccuggguuccacugguuugaacuaucaacaacggccuaacagccagacuuucaaugucgagacaccucagaggcccgggguaaaacugccagagauuccccuguucggcaacggguucuucuccuuaggucgucugcccaaguucugggaagcaauccguuccggauggaaugcuccugugcccaccccuaagcccgagggcugguggugacauggaugccaccuuuguccagugggcacauggccaccguguggaaaauaaauuaucauaagaugaaac

SEQ ID NO: 2210 - RNA, 54653 nt, Mus musculus
cucuggccucagaaauauuugggauguuuuauuuaaaugucuuguguucccuuuuaaccaacaccaaaaagagaaauuaaaaauuuuuuuucuuucuuucuuucuucucccccaccccaccccgcuauuccaaacaggagagccacuucagugaaggguuggcgagucucugcaauuggguggggaguguguguguguguccuguccggcuggaguguucuucccagcuuggcaacccuggguagacagccaaccccggagguggcuuccugggagucucauccugagcagaccuggucuuccccccagggaggguugggcuugaggacuggccgugacuauggggcccaguguuccagagggaagggaagggauggaggagagaaggucagaucuggaauguuccauggagguugcagggucuggagaauauauuugguagaaaaauaaggugcuuugggaaucugugcagucugugucuugccugcccaagagagaaaccugcuggccaaagggcaauaacuagggaauaaaggcagagccaggaaucuggcccauggaggauuccagauacaggcaaggcagauagcgaacuucuguuccugcuggaaguugccuggaccucucccuugagugugggcugcccgguggugggccacaaaaggaggggagcuggcuguccauugcgggcuugugggaccugcacccucagaacagggugcguagggagagcacagccaguggaagcagcagggccccuggggagggugcgcucccagagccggcccaggcacaguggucaagguuggccccaaugcaggaggcauacgccaucacauggggaauguaguucugcucauggacgccgugaagcaggugugccaucgggcccuuggcaaagaccgccacgucuucuccaccgugggucucauggcgcaggggaacagcggacugggccugguaguuguugugagcuguaggucagaaauaucuuuugagugccuaucugaaccccagagcugugagagaggaaaccuuuuccucacccucaggguggcuuggaggcccuuuuuacaggagagggaagccaggguucagcaaccagggggagacauuucaccaaacgcaacuggcuucaaaccaagacugccucacccaggagaccacgcucucagccccuuacagaggauuuaucgaauaaagcacaugugguaccuacacaaggcaggcaucaagcuaggcucaccagacccauggcaucuuccaggguaaaguccccagaagguaaaaguuguucaauggagaaaucaggugugcaaggucagaguuacucaaguacaggagagagcccaaacugagguucugacucaaaucuggacuccuccaggaccccgucagcccagccucgagggauaaagacccuuuccccucccagcccuggccucugcagucucaccguaaucuaccauggagacauuuucccguucaccguccaccaccuuguagccaggcccguuaccauauaggauggccgugaagggcuucuuguccgugucgcucaccaugggagccagaccugcguagggaaggggcccaaggucacaauggagaaguggcagccuggcccuaacccagcuccccggggucuguggcuugguauuucuugugauccuccuuaggagucagagcuaccuccaugaagacagcacacaaaugccaggucuuucauccuuccaaugaucuccuuccuccccaugccccucccccauguucucuuugcugcacacccacccaucgcccagguguucagcucucuuggauucuccccuccccuuccaguaucucaacugucaucaguucucaugggacaggcugcuucgcuguaucccagggacaggcuacucaccaaagauggaguugccccgggggguguauccaccgaaugugaaaacgugggaaugaucagcaguaaccacagucaaggugucuuucugggaugucauggcgccugccuugccaauggccugguccaucuccacugcuucaugcagagccugcuuggccuuacccucaugauguccguggucaauccugccuccuagggacaucaagacaaaggccucccaugaggcgacaggggagggagcccugcccucacaggccccaggacacugucaucagauuaacaucuccuugauaugggaugacagcgaccuucaccagggacucccugugccaggucuaccucaggcaucucauggccaaguggccuucagagggugagcaaggagaauguagggggcggggcauguggggaaagcagagccacagagaagggagaaccacgggauccaagccuggaucucucccacaagccucggcuccuggcucagcauccuuagcuguuuuaaggggucgcugaagccuucagcagaggggaagggagggaagggcaggggagcaugccuaagucccuauugugugcuuggcacgauaaagaagcaucguguuugauuuuacaacaacucuggguauggggugucuuagauggagugacuaaggaagcguggggggggcaggaagaauucccuugggaguacuggauaggggcucagguccaacccauuccaaagcccaguuucauuucgucaugaacauaucacuauaagcagaaagcauggagacgucaccccagcacaaguccccagugccggggcaguguuacaguggccuugcagaaaggcuuguggaagguugaauuccaugaugcuagaccccuggagaaggaauaugcaggccugaacuuucugcaggacgccaccuaguggucacucgcaguucugagggucgugagcuggggugcuagguggugcucccucuccacuaacuucauucacccucaccgcggccuggccaguggguuggcagggcgggcaggcuggccuucccuuuguugugguugugggagcagcuggccuggcaggcugaccuggcccuguucacaaagaggaccacucccaggggacccgugcucaccaccacugguuccuggcgcuuccucagaucagaggccugcuuggggccaggccgagaccgcugugcuggugggaaccccagggcuuggcaagaaggcagccuagcugggcaggcggccacuggccucuggaggguggaggggcccaagcggcuauguguauauuggggacccgugguguguguguguguguguguguguagacaugcccauaugucuucauggaguaagaauaugcauaucucagcagggccacccaagggaccauggagggcaagggcuguagaaauucuggaagauucuggaaacucuguuaccuccuauuguugcuuuggcuacuauguaauuacaauggucgcaauggaaacacugauggguaagguuuacucucugcucccccagggcuuauggaguugcuggcuacucugugcccugugcgcauggccccacgugggugugugcgugucuucucucaaccacuuucccccuuuauuuaguuuuaagcauuuuauuauuuaauauuuauuguuuuuuguuuguuuguuguuuuguuuugagacaggauuucucuccuguagccuugguuguuuuagaacucacuauguaggcuggccucaaauucagauauaucugccuuccaaacgcugggauugaagacuugcaccaccaccaccuggcuugguuuuauucuucucucuguuucugucugucuuuauucugugucucugucucucucuaucucucucugccuguguguauggggugccuguaagggccagaagagggugucugauacccuagauuggauuuuuggccaaaaauuuaugcccaguauuuucacaauuuuuaaccacacuucugugcccagauaauuuacauaaccuuuaucccaggcucucucgccuggacagagcucgacguggucgugaacugucugauaugggugcugggaacugaacuugggucuucugcaagaacuggaucuuaacugcugagccaucuccccugccccuccaccuuuucuuuuugaggcagggucucucacugaaguuagcuaggcuggcuggccaucaagucucagggauccagcuguguccacgccccauaaccccgugccugacuuuuucacaaagguucuaggaucugaacugaaguccugauguguguguggcaggcaccagggagaugacugagccuccucccucaauccuuugugcucgcuucugagcaagauggggccaagucaccgcucuaggacaggggacaaguuuuggucucauuuuuacaaaaaugcuuagugauggucccacggccauggaugguagcauguggacaagaacccaaugucaucucccuggccggugacagccacagugcauguggaacuucuuuugcaugggugacgcuuacaggcuggaugguccuccacagccaggacugagagaaagacgucucaaaggaagauggcuucuccucugccaggaagccccccucuccucugaauucccaccaucuuugccaggagcauccuccgcauccacucuucaacccgaagcuggcaguucccuguaccguuccaucgccuaacccacgucauguuucuggaaggguugucuccaccacuuccuaccuuccaccagcaagaagaagccuuugagguuuuuggucaggauccggagggccaccuccaccaucucggagagcgaagggucagucagguuguuccgauucaauucauacugcauguccccgggcucaaagagaccuguggacauggcaagaauaugggugccaagagcuccccgagccuacugugaggaccccaagaaacccagggugucacagaggauacaagaccccuacacucaacuuggaguagauacuuaccugggaagcucuguggauccagaaauggacucaaaguuuucauucucuucacagccuacuuccccaggagcauggggccuucaaccccaccccuaccaucagggcuacagggucugcagcucaccucaccaguagcacggggucuaaagaacaccuuuaccaggggcauggggggcauagccuaccucaccaggggcacaaggccuacagcucaccuuggcaagggcauggggaccuagagcucaccucaucaugggcacagggaccuagaauucaccucaucaggaacaugaggccuacaggccaucacacaggggcacaggaucuauagcauaccucaccagggccacaggggccuagagcccaccucacaggggccuagggcaggggugccuauggcccaauuugcagaggaagaggaaaaauaggagaaggagguaauggugguggaggaggaggaggaggcuccaagggacccaacaacuugcuguuuucagcgggugaaagggcagaucugugacucaaccccaagagaccgcagcaccacaucucugaggcagugaacucuggacugggcucagugggggacaacauaagcaaugugcauauuuacacgugaggucugaggguacaguggccugugcagugaagcggcagaaacccaggggucacugucucuucugcucucugucucucaucucgucaccaugcagcggccaaacagcagcuccaaagagcccagcgaacccucugugccaugccaccuugcaccagcaggagcugaccuccaaggcgaugugagccaccaggcuccgaagugccccucccuuugcuggccccuacucucuagggaacagggguuacucaaggaccagcagaagcuugccuggcugguuucacccuggugugcugugugcucucccuucuccgaacuuguuggguuuuuuuguuuuuguuuuuguuuuuguuuuuuaugacaacuggggcucaucugcugcacagcuuaacuccacaaaccaaaccuuuccucccuccacacccuggaaggucucgcaauuggagacuaucuccuacaacugcagccgagggcucgccccuucucuacuuaccuaagagguaguccacccuggaggggucaagggccagcaguucagugcgguuccagacauagugggaaugcugagggguggaaggggcugugucagcagaggcccagaaggccaaggaaaagccccagcuggccucagagucaggguggucccauucuccugcaucguuuaacauccugcccugagcaccuagcaucucuguacucaagaaaugacagauaugcagagguuguuggauacaacccagguauauguggguccuggagaguggaucaaggagagcuuccugguggaggugacacccuuucggagguucuggaggcaaaguaggaacugaucuaucugggaucagagaauugcuuuuccugugaggguguuacagcauaggucacagagaacaugaauaccuacaaaaaggaauugagugguguuugggggucucuggagagccaggagggagugaaggccacuggcugugucuggagaaccccaucuaggaggggauaaaggaggcacugccucccccaggacauagaaugagacagccuggauuauccagggcacaauguaugggcccagcaucgcgaggaauuugcugugugucuucaagacagcucuugccuucucugggcaguggccuuagaggugguuuuuuuuuuucaauccucuagguugcucugggggggggggaggaggaagggaagaauccagcucagauccccagggcccugcuaugacauccaguauucacaguagucucucaagacuguccccauuucacagauaaggacacugaggcacguacacaucaggguuauugagaaacacuucuagccccucuacugauguccagaaucugggacccaacagugacccuaccggguagggcucauggcaguaguacgggacccucccugugccaggagucuauacagagucccggggcaagaggauggcuuccugguccugaucacagcaacugaagccaagaggaggaugucccuuuggugugccuauccaagcugccccaggaggggaaagaaagagaagcgagucccucacucccacacuccuauacagccacggggcuguccccagcccugcccaucuuacucuuagcucagccucucaugccacugagccucccuggggaaccauggaacccugagaaacccaaccccagagugacaucaaagcggcugccaggcuucuccccacugucuucaagccugaccacagucauuuccagacccagcugcccggcuggcccacaguggcacauuuaaagggccagaggccucacagaggaaccagagcuuggccuaacccugcuccugccucccucucagcccacuggugcucuggcccagggguguacucugagggcuuuacaccuccggccucagccagcacacuuuugcugagccauguucucccaucaucugcucagcgcugccugcccacacccucccauuccauucguucaggucuucuguuguauccccucugcgugccuccaggucccaacuuccugccguccaggcacacgacauucccugugucagguacccagccugucucggguccauccaggugacucccugacucugucaccauccccacgugugcccuuccuacagggagcaggagugucugucagucacaggucaguacgguagagcaaacagaggaacaucuggacucucacuggcagagaacauuugaugcguggaugggggugucccacggcccacagaaccauagccgaguccaccugcagccuugguuaccuugugucuggguuuaaagcucuuccaaauacugaugagauccaggccaucuagccuuguaccccuggccuucucauccaguucguauuccacaucaguucuguucuucggguacauguauuuccggccgccacccaugaucaccugagggacaaaggagccaucacacccaggguucuaaauuguccagaagccccagggguuccgacuuggaaaguagacaugagagucuggguggagguguggacgguuguccagcuaggcaagggcugggccagggcucccucucugaacgauuuauucagauuggaaagauaaaaucgcugaccuagcaggacuguggcuuggggcuucuggguggaaucuuaguguucucgaauagcuaacauccccuacccccauaggaaagcccauuugcuguguguccugagccaguaagaccgaguaacucacucaaucucccaaccaagccgccaggaaagugaucuacgcucucucgcuauagacacagaaaagggauuuccugccccucagccacacagcagugcauggcacagauacgauucaaacccagaaacccacugucucucuaccagaagccccccugagugcucugcuguaugggugaagccaggaauggggccuccggagugucuucuacagugaguggccucagacagggaggucuuggggcagcccagcugggaaccagcccacugccugggcaaacaccggccgccucacgucuauguaaucacugccaggcuaauuuuagccacuguggcuggcaugcaaggguggacggauggacgcgggguuguuuguuuuccuaggaaauccauguuugaaguccuaacuauuuuuaaagcaggggccaagaacauaacagccauagcccauggugaccaccauacuguguccuucugucaccgugggcaccagcucgacuugcugccccuggcugacaccugagauccacugucuccagaugggccaaaguucucucucuauucuauuucccauggcaaaaaucaggguucgaggggguaaggggagagccggcgguggacaugggaaagguacccaggaauagccacggguacccaggaaggccaaggacacugaaguaaagaucuaauucuacugcuuaguaaccaugggucuauuucuuugaucauacaggacuucaguuuccuagucuauaaaaugguaaugacuauccagagaagaaaagcagucauccaauguugcugcuggucccuacaauggaagaugucccucuggaagggaacaaugaagacagacaggaggggagggucuuacucccaucauguggcaaucagcuuggauaguucagacugggucugggagaaaggacuccaggucacuggcgccuucuccuguucccauagaaccugaccccuuggcauuuucagcauggaacugaagcccccaaucuuccugcccggauagcaugguucccagcccagcggagacuucacacgggcucauuaaacucccaaauaacagacuugcuguuugccuuugggguuuggguuucucucucucucucuaaagcggaacauauuuauuuucugaguggacaccagaauuuuugauucauggacggucuggggaguuuuggggguagccgugacagaggggcaaauggaauugggagagugagggcagagggggcuuugggagguccccuuugcacuccuuggcucaugcccucaugacucuaggagaccccagccccccucacugccgccaaagcuuuuuccuccaaagugccucucccugccucagccaauccugccucagcuggcuaaagaguuacuguaaucaccucaucucccaccucuugugcuacaggacccauguucuccacaugaccucaucugggccucccgcagccuguggguggggcacaggggugggaaaugggagggcgaaggagggggagagcugccuggcagguggagauaaagccagauggguggcugugucccggguggcucucaccuaagaggcaucaacagggcccagugauccugaaagcagcgcucaccggcuacuugggcuacuuguaaaagagccacgggguuggagacauagagcagagagcuauggaaccugcgucugagcucucucucagccucacuggccccauacuucagggucagggauucuaagucacggucaacccucauagcagagaaagagcaauucagaaauucuccccaagagcugagaagccugcguguaagaaccugccuggguguugaggugucagcacugaggacggggacggggacggacggcuuacauaucacgcugcugcuugagugcucccgggggccaggcucugugccaaacucaacugggauuuucuuacuuaguucuuccagugagcuguuggagcagguccagugggcagaaggcuuguccaaggggaggcucagagagguuaaguaacagcccaaggucacacagcuagcaaaaggcagagcacggaugggaaagggagagcaugaucuagcucuuuucuggacaugucagcucugugugcaggcaugugccacucugugcaagugucaauacauagggccgggcagccccuaagaacauacugugagugcgugugugugugugugugugugugugggguauuacugcaugcuguguguguguguguguguguguguguguguguguguguguguguguguaucaguguacacuguguguggagggugcaccaucagguucuaauuuacagaauaaucucugagcauuuggggcauggcagccacaugagacuugaccucauagcuccacugcagagaaaccuuacaagggcugccuguuccaaccacaaaucccuuaauggguugggagcucuuccaggugugugggguacccgggccuuccuaggccacccuggggcuaagaccccucccccacccuaucacauccuaugccugcugcuccacucacgucgauauccuugauauugugcauuagcugauaugcgauguccuugcagcccuggcucagagccucugguggcaucucguuauccgaguaccagucccgaucggccgagugugcguaggcugcacuggguguggcgugguucacccgagugguagucacaaugcccacggacuucccugaagugaggacaggagagguuagcaccccugguagauaaggaagucccugcacacguaccucucccucccugccauagguaaucucccgucaaucaguuccucugguugccugggccucaguuucccuagguuacaugaagacagaugcagcugaacgccuuuccuuguacucagggugggcuaggguccucuccuccuuccaugacuuauggagccuaugccuguaagaagcccuagguggccccgaagggacgucaaguggagagaagagcucugucaaccugccuucaaagugccugaggcagaaggaguguuagggauugguucuaaugcuuugaauuaauccagccccccaaaauugggaauccacguguccaaauguugaagguccuuguccccaguuggcuuuuuuuuuuuaauuuuuuuuuaucuuuuuugcucccucccucccucccucccucccuccggcaaccgcccgccugccccccaguuggcuuuugauagaucaauaaagagccaacagccaguggcugggcagauagacugaggugggacuuggggauuugugagggcuagggacuuggagagaggaggauccgucaugccucggagggagacugaucagauuuagaguugcagaagaaaauccauccgaaauguagguggaaagggaaagccgcccuaugggaggggcugcccagaagguaacagggcagcaaagauaaaacauagauuuagaagcuguugagccagaggaguacuggagggaaauguaugcuaggaggaggaggaauagaacuguccagccuuugagccuuuaaaguuaacggguguguguggugugugugugugugugugugugugugugugugugugugugugugugugugugugcuauaaaggaacaccacucugaaccucugcaggcuggcccuggcuugguccuuugaccuucucucaaaaccgugcaugggcuucacguccugcacucuguagugaagcgcacgaacccaggugcuccacgcagucucuguucagcaggagucccccugguuccuuggccugauuccacccugccaugcacgaacgaggagacugcaauccagacaacccaggagucugccuucgauggcucaccagcauccuuggcccagcgcaggauggaugugaccucauugcccugagugguguugcaucgcgugcgcucuguggcugcgcucacucccacugugcccucguuggccuucacgccacacaaguaggcaguggcagugcccgcgcugucagggaccugagcguugguguuauaugucugcaaguggaagagucaggggaugaguacccaccgaggcaaccccacuuccauuuccaucaagggagcagggucuaagggacccugcugcccauggaggguccccagaaccacaaggucaccugacugagcuguuugcuuccuauacccuggcagaacucaagguuucucuccgaguauuggaacuacggaaccagcaagggugggccaagcagguagauccagcagagggaaguguaugucucugaggaaaacagacugggaggggaggguggaccugagaguccagccuggcuuuucugaugccccugaaaauggucaucacuauguccagacuucccagggaaaucgcacaggcaggccuaccucccuggcccugaugagccugacagcucaucaaagauccagaaacuacacuccccucccacuccacuauaagaagcuggaaucugacacuggguggcuaggaggugcuuguuacauacacacacacacacacacacacacacacucacuccagaaaccucuccucacuacccacauguaggguaaugaaugauucacacugggaaucuaaccugggaggugugaacuaagcugacucuuguuuacaggaaacacaagaguaagcacaagccauccauggugugggggggucaggacgguggcugcugucagugcaggaagagacaaagacaagacauggcucaggggacagccaguccaugugcagcuacaacagccaggcgcugguuacacagacaccagcagcuugggaaggauucaugcuguccugugugcacucuuucuuggguauguuacacacacacacacacacacacacacacacacacacacacacacacacacgcaaguacacacaugcacgcgcacacacacacacacacauacacaagagguucuacaucgaugaacuaaaugcuugggaauggcuccugguuucacccugggaccacgggaccaggaggucugauggccuugcaguuccccaggucaagaguggaccuggugcagggcucaccuuggagagggccacaaaggggaauuuguccaucuccagccgggucuccucgcccguguugugguguagcuggcccuuaaggauucgggcagcgguuacuguggagacgcccauaccugugggagggacagagaacucaggcucucagacccuucagucagcuuucccaggcucccagagccccucucuucagugcuaagacacaggcaagggcaguggguagcagacagaaggacaugacaugucgccgcacggucucucuguucuuucauauucucagggcgguagguuagucccuuucuccuaaucuaucucucagagcccucuuccacaaaguccuuuuaccugauaccaggagucaugcuuuccagccacccauggccucaggcuccaaaggccucaggcuccaaaggccccagcggcaaggcccccagcucgacugcucccagccucccuaaccccagcuucccauuccuagccuugcugcccccaucucccuccauuccaagccacacugcccucagccccuccauucccagccucaccaucucccaggaacaugaugacauucuuggcuacauugguguugagcuuuuggaguuucagggcauuuuucaaggucucuugggcuugcugucgccaguaacuggggucucucucuuucucugcagagacaggugguuauuuggcaaggugggggaugggcuauccauccccagaauuacagacaccccaguaguucauugcuggggggcugagaugaucuaaaccuggagggcggagugaagguuugugaacagguuccaggcaaaccccguaagccagcccgaggacaucuucacacaucgcaacaggaggacaccaaagaccagggacacuaagugacucuccccaagacacaaagcacgaacagacucagacuuuggcagagcuggauuucccuggaaaucccacacgugcccuucacccgcggggagcagccauugccagcaagcagguagcagggaaaucuuuaaccucuucacaggcauuccuagagguauucagcuauagccaugauaaacuccaccuggcuuguucaucacagcugguucagcaggcuagggccuucuuggugagaacacugcaggcagagcuagaaagcaagccuagcccuuggcugggauacauuacccaaggagcccuuguuaggguaguggggaaggcaagggcugaggcuccaucaccaccucucuaacacucacugccccuacucagaccagccucuuagaguaaaauaagaccuggaguuccuccucuuccuccaucucucucccugucucugucuuaaguaguaaucaauccacagccuugguacccuggguaaaccacuuccccaggccucaguuuccucaccugucaaaugggacuuuuuaaagaccacacuaauuccagaaguggcuggauucacagagagggcccagagaugcccuucaccuuuuuccaucccugaacuccaaggagauggcuaggguuccaucucuggagcugacaauggggcuccacuguuuuacaaagcuuccucucuguggaucucuggccacaguagaccugcccacagaaccggaagcccaaggcugaaggcucccuguagaugccuccuucaaagaccucucucucuugggacagggugagguagagacagagguccaaagaggugaaggguccaguguaaggccacaguguacgucugugggcuaaagauauggucacgggcuccagccuggucagaucuacucuugccccucaggacaaugugcugagaagccucucaguccaagcauggagcccagccugugugccgagaguucugaacacaugaagcuucuguggcuugugugaggggcaaaacuuccuccccgcaggaagggaagagagcaaaauugagcagccgaggaggagaugagagcauccaaacaaccaggcaauggccauuacagacagccuaggcaggggaaccacacugaucucaaaucguggguccgccaggccucuagcccuccugcaccccaaacaccugccugcugucuucaccccuaagcuccaggcccuccucuuuuagaagugucuucuggaacccccaguuucagacuccacaguauagccugcgcucccagaggaagcuggaggccugggccuugcuguccaccucuguccauugaguaagugcuuuguucuaguuucuggccuaggugaauagaggggggggggagcuggugauggaagucauaaggcuuuaacagagagacccacuugguguuugagacagggucucucauuggaccuggagaucacuaacuuggcuaagcugaacagcaagccccaggaauuacaagaaucugcccccuacaacgagcuuugucacacacccagauccuuaccaacagagcccucgucuccccagccccugggucgaugguuuaaaugacugguucuguaaaccuggcugguucuaaccucuccagaauguccugggucaggaagcauuugcuugugugccaguuggggguugaagaacuucagcccauccuaaccacaugcccauuacccccagcagucaggcagacaccaggccugacugacgccagucugccccaucuuucucaauacccacucugcugccauucuaaccggucucugcuagauggagaaucugcugaggauucagagucuguuccuaagagggucugagucaguaccaaaccgaccuccuuaucugguaguguuaagcaauaaugguuuggacaaugaaauaccaggagaccauuauuccaggggguaaacggcagggaccaaugcccaggauguaacauguccuaagguacugauuaguaccuacggcacaaauccacucccaugcuuccagaacauacagaaugacacccagcaucaggauggcaauguugggaaaggcacugagaaacuggccuggccugugccuaggaauguccuucugaucuggguggugacuuuacaaaaacaaguguguguguauguguguguguguguguguuguguguuucuggacaucucgccuagaauuaguggaugaccugaggcaugaaaaggguuaaacacaguaaaacauuguagaaaugcuucccuauaggaacauggaccagcaguuaagaacguguauugcucuuacggaggaccagagcgauucccagcacccaugugggguggcuuacaacagccuuuaacuccagcuccaggagaccugggacaggcauucgugcaugcaugcucgcaugcacacacacacacucacucaugcaucuaacucuucccacugaagaccaguucgaaagcaagcuaagagaucuugcuuugagcaccuggcuuccagcucuuaacuacuuuguuuggguccacaaucucgagcccagaccacacucucaucugaccuugcccacccucuccuuccaccugaguccagcaguccuaccuggcacaaaagaguugguaaggcaggugccgauggccaguacuaaaaauggugagaucaugguguacccugagauucgucccucgcuggagcccagauggugggaagaggggggggggggcagcgucagauguuaauugacguuaauugacguuccgauccuagaaguuagaaaagaauaaaaaagagguaugugagcgcagcucuggggcaguuuguuccuccccgccuuuguuccuugauucuuugagcaagaacuuguugaguaccaaaaagccauuguugggccaccacccugggaagaaaaccccaaaaacaguuguguaagcauaaacgcgucuguacugcaaacagauaccaccccacuugcuggugugcccgaccugcccugaggcaggcuucucaggcugaacuguuuugacagaggacagaauuggcgucucuuggagggcugugcuccagccagcccuaggcucagcccagagucucuuagaauucuaaaagcucucaggugccacucgcuccuggacaacacauuaagaaguaaagccuacaacugaguccacagccuccugacccaccccugugccucacaagccagggauaaaacagccuugaauuucuucacaagaauacuuguacccaggacaccaauauuugcccacucuuuccaaugccuuaccaguuuuugguaagcgauuauaaacaaaaguaucuauguagcccaggguggcugagaauaaccuugaaccccugauccuccugccuauguccuucacauccugggaucacagggcaaagccucagcagcugacuuccuuugauauauauauauacauauacguguauauaucauacauauauauauauguaugguguauauguauauaucuucacuucauuuuccccaaaauuauuuccauuuuuguuuguuuguuuuuguucuguuuguuuguuuguuuguuuuuguuuuggucauugcuaggaucaaacccaggaccucacacaagcuggacaaacuuuggcucaaauucuugaucugagcuugcaugacuaacacgcuaagcaucuucccaggggcuccuuggccaugugucucuucugcgcuggcauaucuguugagauauucugccuuggagcugggagguagcuuagcaaugaaaaacguuugccagacaggccuggggaccugaguuugaugccuggaacugacucugaaaguuguccccugagacuguggaggugacccagaggguaaaggcacuuggcucaagccugauuucaugguucaaucccugaacagaacccacaagguagaagguggcaauuaauucucacauuguccccaaccucccuacaugcaccgugacacuccugaacucauacacaacaacaacaacaacaacaacaacaacaacaacagcagcagcaacagcaacacauuugaaggaugaugcucccccucccccaugcuggggaugacacccagggcaccuccuaccgcugugcuauauacccucagccuacuuuaaaaauauuuuuuaggggcuggugagauggcucaguggguaagagcacccgacugcucuuccgaagguccggaguucaaaucccagcaaccacaugguggcucacaaccaucuguaacaagaucugacgcccucuucuggagugucugaagacagcuauaguguacuuacauauaauaaauaaauaaaucuuuaaaaaaaauauuuuuuaaaagaaggaaucuuuuuuuuuaaaggacugaaggaaacacggcaaacauuaauuggugguuugcuuuggguggcaagaccaggaauaauuauuuccccuuauaaauguguuuccaaguugccuaaaaucaguguaugaauaccuuaagccuguuuuuaacugggcucauguuguugcaagcacaccgggacagccgcgcccccccccccaggcgacuaguuagcuacaagauguccaaacguccaaacgucaggguagagauguuaccgaaggagaugcgguuuucaauauggagaguuuuauuagaaauaauguuaccagcugggcgugguggcacaugccuuugaucccagcacucgggaggcagaggcagguggauuucugaguucgaggccagccuggucuacagagugaguuccaggacagccagggcuacacagagaaacccugucucaaaaaaaaaaaaaaaaaaaaaaaaaaaagaaagaaagaaagaaagaaagaaagaaagaaagaaagaaagaaagaaagaaagaaagaaagaaagaaauaauauuacccagcuagaaguaauguuaugggaaacagaaaugacuccgcggugaggaaggacagauaagccaccaaucuaccaccugcauaaggaacuuuaaaagaaaguuuuaaaggcucuguugaaggaaggguggguagggauugggaggcaaugugcucuaucuagugucuaacugaacuuaaugcugaggucuguuucaggugauugugagguagcucagcagguaaaggcucuggcugccaagauugaugcuagccccgaguucgaucccugggucccacauaguggaaggagagaacccgacucuugaaaauuguucuuugaccuccagacagguaaagcagcaggucauccaugauccucuuccucuuaccacccccccacacacacucguaagcacacacaguaaaagcacugugugcauaccaugugugcguguucguauacacacguauauggauggcgcguaucuauagaggccagaggucgacauggaguggguacuucuauggcucuccauaaugguuuccggaagggucucucaacugaagauggcauucacugguugacuagacugucugggugccaagccccagggauccuccugucuccauccaugcuccccaccagugucaaugccaugccuggccuugcacauuugcccacuggaugcuccguguccaggcuuccauucucacccguuacacagcaugagcuuugcccacugagaaaaaaaaaucuauuuuuguuuuguuuugguuuuuuuugagacaguuucuccauguagcccuggcuauccuggaacuugcucuguagaccaggcuggccuggaacucagagagauccaccugccucugccucccaaguacugggaucaaaggugugcgccgccgccaccgccaccaccaccaccggugucuacauuuuucauucuaccuuggaagccaaauaguuuuguagcaaauuguaagaucagaaagucacgaaguugacauaaacuauaacugcauuguaauacuauccacaauauauauaaaauauaaagucacuucuuucagaugaacuauaacacguuucccccaacuucacauggccucaaugguuggcgcgcacuucucuguuuucaaaauaguucuuuccuggcccuucccagucacuacacuagcaaccuccaaccuuccuaaugcugagacccuuaauauaguuccuuguguugugguacacccccaacuauaaaauuauuucuguugcuacuucaaaacuguaaguaucuacuguuaugaauguaauauaaauaaaucucugauacaugauccccaaagggaccaagacccacagguugacaacugauggccuaagguuuccccucccuuaucugugcuccuacaggggacuggggugcucauucccugucagaagagcguccccggauacaacuuugggcaccugacgacacccaccacagccgagcaccaugcggcugccgugagaccccguuuacuccagccagcccuuguuuccuaucuccaucccgacacacacaguugagaacucauggcuggcagugccucgagugccccuccccacguguggcggagccagaaaagccagacccaugggcacacauggaagacaauggcacccagccacguaggcugcagcaucccuugggcagacccccucuucccuuuguuuuggguacuagguacagagagaguggaauaagacaggacaggggugucaaugggacuucugaggugugggagcuuagcuucaaaauggaacagucuccccccccccccccguauggggacuucucugcauguggguuacuaucucuaaggucagagcugacauuugggaacacagucaaccugaggcugggugggauuuccacugggguucuugcuaauaacuucugcagcaaggaaagaggaaaaaaccgucucccaugacagacgagaagaccaugguguagagaggagacauaauuagccugugcuugcgaacaagcaggcggcaaagcugaaucuugaccacagggcuuuugauuccagaaauaacggcaagauuacuaugguaaccccaaccccuccauuuccucaacuguaaagcaaggcuuugaagucugacacaagaauagaguccuccaaugcugccacgauuaggggagacccgccuugccacccaagccuguauggucuccuuguaaucaagcaguccccacugcuaaacccggcuucccugauugguccucuaucaccaugugacgagcaccguauauucagcuagugagaacucagcggauacggguacuugccaccacaccugacgaucugaguuuaauaccuagaacccaccacccaccagcaaguuguccccugaucucacacaugcacugugacaugugugcacccacgcugucucacacacaaaaucaauauaaguaaguuuaaaugaauagaggggcuggagagaugacucagugguuaagagcacuggcugcuccuacagaggaccugaguucgagucccagcacccacggcaguucacaaccaucugcaacucuaaggacaucaaacgaacauguggugcacagaaauaugugcagacaaagcacucauauacauaaaauaaaaucuuaauauauauaaagaaaguuagcgggguggggugggguagcgcacacguuuaagcacuugggaggcagaaaaagauggaucuccuaauuugaggcuagccuggucuacagaguaaguuccagggccuugucucagaaaaaccaagccccauaaaaagagccauugauuaguaggaagagucguugucuguacagugcugacucuccugguccuuugacugaucggcagacagaacuuagacagguuuugugacacuuauacauaugcuuuucucucaugugugugugugugugguuaccauacaugccuugguuuuuuuaaugcuacuguaaagaaauauuguuuguuuguuuguuuguuuacgcuuugacccuauaugcuuagcucacuuaaacucaaaauguuguguguacaugugggaauuccuuggcauuuucuauguagacaagcacauaauuuaccaagagcuuaaguaagggcagcaaaaaaguucuguggguaaaggcgcuugccaccgaggccugacaaccugaguuccaucccagggaaccacaggauggaagaagagaacugauacccgaaagguuccucugaccucugcacaagcauguguacaugagcagacacacacacacacauacacacacacacacacacacacacacacacacacacacacacacacacacacacacacacacacacaggcacacacaacacugaguaaauaagauguaaggacuuaaguuuuacuuucucuuuuccagcccugugacuuuuuccagucucccccgccccucccccaucuugcuuuacuccacuggccggaacuucuagugugagagggacagaaaggacaaaauaaaggucucuuccuuguuucugauugcagggugaaagagcucaucuuucugcacugaggugacauuuggaagcgugagguggaauggguuuugugggggcgacucggggacuuugauuugaugcagcaaguuugaggugucauugggaaggacagacagcugcaguggagacuggcaggucuuggcuaaagguagaaaauuugggaucaaggguaucugguggcgguuauaaccuugaugagacucgacagguucaccaggcauaggagacacggugacagcacuuagaaagccaggcugaaaagaccuuagggguuuucuuucuuuuuuuccucccucccucccucccucuucccccaucuccuaccuucuuucuugcuucuagaaagaacccaaggccucacuuuggcuaggcaacuacucuggcccccaaaagaauuuuuuacguuggcagaauggcaaaagccuuaugccaaaaaccuugcagaaagccuagagagauggcucagcgguuaagagcacuggcuguccuuccagagguccugaguucaauucccagcaaccagaugguggcucacaaccaucuggaauggaaucugauucacucuucugaggugcaggaaaacugagcacucauauacaucauauacauuaaauaaacagacaaucuuaaaaaaaauuacagaaaccauuguggauaaacgcgcaaauucuccauaagacuuaauucauuacccagcaagcucuugcccacaauaaggaucaaucaugucaguaacaugacguucagucuaugguugugauguaucaguccuagcaaaaguagcugucaaacaugccacguggacagagcuugaggaaggaacacaaaggaucaaacacuguggggugaugcagggcacagggacgggaaaggcaaggggugaaaacugaggugugacacauguggccugagaaauggaauucaguccacucucucugcaccuagcacccaaaacaaagguauaaggagggggccuacuaagagggcuccugcagccugcaugguuugucugaggcucccgggucucuggaaacugaagacccagacugugaaagucuugcacccugagccuagagccuacaauagaugcucaggcugggaugcugagcucuggccucagggcccugcacugagacggccuaacugggagauaaaucuaugaggcacugggagagggaaaauccuucagccuccugccucugcucagacuccucccuucccccaccccagaggcuucaggcagcucgggugagaggcucuggugggcccagucugggggagcccuggcuucccaccacccauuguuggaguggaugcugguucacaguccccucccacugcuuagccuggccuuucugccaggcucccagcuacgugaucugauuauuuaggacaagaacgcaaugguuccagcugggcuguggcuuugggugagggaacagcuacuuggcaggccagaagagaggcuucgaggcugggccugggccuugacaauggcauuggggcagcggcuccagaguuugggagaacgccagucucuggcuggcgucaauagagucaggacaaucugaaagacaggaccgaagaugcccgugacccggcacucugucauguccaccugggaacccacacgcccccccccacccccagucacagguucuccugaccucacaagacaguucagagaacugagcugggguccagcuagcuggccagcacuuacauacccagacaggcuccgccugcuucuccagggaggggauggcucucuucuggccucaguuuccccaccagagacaagagagagacuagugcccaucuucuuucuguccuacaugaacagucauuugggggcagggcacuuggaaggggcagagguuagggucuccuaccugaguggccuggccaggcgacaggugaagaaacagagcaggcccagggccagcacgaacagaaggaagcuaccaacugcugugaccaccaaguccagagugggcgacaggagggccaucuuggagugaagagagccuucagaugugauugucacacaaacccacuagcucugcagccuggggucaguggcugugaccuggccuuacuccugaguuaaucuccugggauuaggcaggaaggaugaguuccccucccccaccccggccccgggagagguuuggggggagggcugacgcuguucacuaaacuuuguccuuucacuccucccuccagaacauuugcugagcaccugcuauaaacccaacuccguucuagguucuagagagaugacugaccagccaguguagacaaagcaccuaccaugggccaggcacuuggugagguaaaagcuaaaagggccagagguagggcucacaugccuagaaugcagaaagcucugggcuccgucaacaucacagcauaagucaggcgugauggcauuugccugccauuccaguacuugggagcuggaggcagaaggguccaggaguucaaggacauccugagcuacuguguugucaacagacuccagaaucacccaggagaugggccuuugagugugccugugggggauuauuaagauuaaacuuaauuucagagaucuggugacagcauucccaggccagaguacaggguaaggagaaagaacuucuugccuggggguucaacguaauuggcugcuuccagcucccugcggucuucacuuccccaccuuaaagcucugugcuuggaacugugagccaaaaugaacccuucuguuuguuuguuuucugagacaggguuucucuguguagcccuggaugaccuggaacucgcucuguagaccaggcuggccucgaacucagagauucgccugccucugccuccagagugcugggaucggcugugugugccacgacugcccagcucaacgcuuccuuucuugagcugcuuuuguggagauauuuuaucacagcgacagcaaaagaagcuaagacugcuacacagcgaggcagccuggacuacgugagacccuuucucagaaacccccaaguuagaaaauuaauaaucaguaaaguucagaaaggaaggagcucgaaugaggccugacaccagcuguugccaccuuuaccccauccacaagccagggagacaucuagaacaaaguaccuacuguguggccaacaccaugugaaccagguauuagcaccuccauuggcagacaaggaaacagguacggcgguagggauggaauuucggccuaggaaccagaauagcaccaggccagucaggcucaaagcuggcagucaccuaggaaucccucaggcuggaggccgccuaucugagggccugccggucuccuaucuagccucuuaugguaucuuguacugucagcaaagugaaaauggucccaucucacagacugaaaaauggagacucucaguccccgugugcacauguugagugcgcguacacacaccacacacacacacacacacacacacaacauaaauaaaaaaauauaaugaacauuuaaaagaaucaccuugcucugccuccccuuacuguuggggccuguguauuggcuuccagacaauuccacuagacucuucccuggaaccuagcaacagcuuacaucaucaccugcugccaggugcgagccaaccuggcauaugagagggacugcucaucuccccgccuccccccuugccaucucuguccuucccuuuuccagaucccccucccuuuacuucuccugcaauaaaucuuuauucuaggcuugucagugggugugauuccugggggugggggugggggcaucuuggcagggccuucugaggugcucccucccccuccugcugcaauauaccacguuacacagcauaacacugugagcacuuaguggacaggauuaaagggacacuggggaagauggguuuacuggagagauggccaaccucaaguugaaauagacgggauagauacaguaacacacaccuauugucccagcauucaggaaguuagugacucuagccaccucccaggcccccaggaagaacagaagugcagcuagagacagcucccuugucagcugguucagagcucucucugaggcuaaggcuggagaaaaccuagcagagacaguagcuuacagccacugugccaagcggcucugcggaaggccauggcuuuagcugcagugccugggagaggaucuggaccugucucacaaccaagccaagugucuuugauaguccuuuuuggccagggcauuauucagucacuggcggaaguuauuuagggucacccgcugugaagggcuggggaaaggacgugggcuguggucagaucccaaaggaacuucuguagaugaagguuaagccagacccuggagggacagaacauacuucaggucuccaggagcugacaucccuucuugguaggaaacggacuuaggagaacaagguugagagggugcauugagucuucaggccucugagagaacaccagccaucugggaacacccucagccccaggacagcuguagacugcccucccuguucuggaaaguucucugaaguccacccaaagacucuucuuguucccuccgcacuuuccccucagcuccccugccagcuuuccucaccccagccccagccaggcaucaccuccuaacauggcaugaaugucucugcccuugggcagucuguggcuggagaggccggggcagcagccaggaaaggucugccaggccaacaguggguguuggaagaggcagcccggcagcccgagggcaacaccgggccaggcugcaggggugaaccuugucucugccccucaagcuagauaaccuggggugagaaaucucacccuuucugcaccgggccacucccuuguggaguugagagucugagagagacuugggguugccauaaagauuccggccauuuuaucuguagcaaaggcucaaccugaacguggggcaggcaggugugaguguagggaagugggaagggagaaugaaggagacagaggagagcuggguagacacacacagacacacacagacacacagacacacagacacacacacacacacacacacacacacacacacagagcuugcccacggaccugcucaccugaggcugaaauggucuuuccugcucuauaaugcucaacguucagcaucuggaucgaggcaggucacaggucccuguccccuauguccccuuucccaucucauucucacuggguucuucucacaagccccaggcagugugaggcucuugccuguuuuagagaacagacuaguguaaucuaaaaggucaccggggagccuggcaguguagcuacguuagaggagcagccaggaugaugggaagccgagagacaggaugugaggaauuucagucaggggcaauggccaagcagagagcaguugucugacgacagagcagccuggagcaaccccaaaagagccaaagcaggagcuggcuugcgucuucacucacccuugucaccagucaggguguggcugccagagcuggaaaucagaaggcacugggcaugaggucuggggcuaucggaggcucacucaccgggacaccagacagccucauggguuggagccuaagccuaggaucucagugggaggagagacggggccaggagggagguggaaggcccagggcaucacuuuauagguacacaggcuuccuuccacccauggagaggacacauccugccuaugggcuggaggcugagcaugggagggagagguugaaaggggccaugcaucacugagggguguuucaguccccugcuccuuccugugcuguacccagucucugucccacucccuagccuccccaucccccaccaggaaacacagcagucccauccuaacaucaaaaacugaaaggcacagagagggugcacgaccuuccagagucacacagcacccugacacaucuucuucccaugggaggcgaugguuagaggccuaaggugacgacggucugcaaggcugggcggcgaugcugguguuuagaaacugugcauuaaggacacugacugaggagaacaugucaaccauagcauuagaggacauuccuuccacacccugucccgaacuuacagggucuggcuugggaagcccaggcuagcccagagagagcuuugcgggcggagugugacggugcaugcaugucuuuuaucccgggacuuggagccagaggcagguugaucucucugauuucaaagcuauccuggucuacauaaugacuucuaggcuagccagggcuacuuuuaccuuuauuaacucauuuaauccuacaaugcccagcaggauaaacacuccagcuuuucccauuccacaaaugggaaaacugaguacagagagguuaaguagcuugcccagagucuagcagcaagucacccugucagaauucagucuuccauguggguguuuugggcuuuuggaaguccucucaggaugccggcguaaccucugauaggagcacccugacugacuggaacuguucggcacaucacauacgcaauagggaccggacgauaccaugacucaggauccuugcuccccaaaucccaguuuuggaguguuucccuuggauuccuuggggaggggcuccccuuaccccagagagagaugaggucugccaaugucacacguugggaaauggguagagucacuucuuggauaggcuggguuuaggucacugacccagcaacuauagccagcugggcuguggaaauccuugugagacuugggcaggauauugacccuagauacacccuacuucucccacaaucuccagcuucaguccauccuccuaggacucugagacacccuccccacccccagcucuguccuggcuguguucccccugggaggaccugguuaguccugagacaacccuggggaggaggcugaggcagcccuggcuauggaaacuggccuugaacuuguaacgcgcugggugggccccgacacaagcagagucccagcuagcacacacagggagugcacagaugcugguagcuggcagcggggccuccacagcauccuucccacauuccgaucgagcuugugaccagcugucgggcucucagcagcuggggugugugaggcucuuaguagugggggcgagagaggcaggaacaugggcugguaaugagcuaauccagcagggcguggugucuuaggucugucggccccagcgcuugcugucucuccagucaguucaaagccaaccuggacuacaugagcuccugacucaaaaacugaaacccacgguggugugcuagaccaauggucacaaugugccuugacauugugccuuagaaugggaauucaacaggacaagggacgaugagagaaaccaccaucacccuucguggcagaggcaggaagucagccagcagaguucugauugguggaugcucuccuugcucccagggcacagggcaaggccacacagcaacuaauaggaugaggaggaugucuccacagggcaccuacuaugugcuaaaagcacagggcaccuacuaugugcuagaagcuuucugugcuaucucccaaggauccaaugugggcagaacucucaggaccaagagcacaggagcucauggcuuguacugcaaggugugggagagccaguagccacccaagccugguggacuccucaugcgaugccuuugccacccuagcaucuagcaggacugccuccacauggacuggggcugugacacgggcugugacucaugaccacugaguucccugguucagccuaggcugggggucuggcagaaagcacaucuccgaccacgcaggcucuccuccagcuccuccugccuugaauauuuauuaccuguguucugggggcuggggggacuaucucaccuaagagucugguagcacucccagacuucccucccacccugguccacuccucugugauuaccauucugcagagagagggagccacgggggcugucucaggcugcccucuccaucccuuguaucagggaugaucacuccacgaagcuuccaaugucaguuucugagacaggaccucuuuaguguucucuguugccaccacagugacauggugacacccgcugucauaucuggcuacucugaguccauuccccuccccaacaggggaagcccucuuccuuuugguggcugcaggucgggugacuggcagaggcugggacgguuuccaucuggauaccagagcauugugggugugaagugaggaagccccaggggggaacacggccugggugauggacuagaaaccuacagaaaaacccaugaguaggacgcuggauccagacccuggccgcaggcaugccugaagcucaccucugaguggaagccaguacauucuccuauuguuugcuuugguuuguucuguugcuuagagcccaaacucugcccucagaacuccaguccagaggguuucccucagcucucacacuguaaacaaucacaccgggucggucaugcccagggaagaaacgggacaaacucgucaaaggugggcagacacacugugugcgaauucacacagguggaauccguggcugugcauggcggugcgagucugcgaccccaaguucucuggaagcagaggcaggaggauugcucaaguucaaggcuagcaugggcuucaaagcaaguuccaggccagccagggcuauauaaugagaccaugucagaaaagaaagacagauggauggaaggaaggauguauguauagaaggaagaaagcaggcaggcaaggaagugggggagagggaggggaaaagaauuagaggaaauuccugaauuccuggguaggauugccuagaauagagacacacaccuucccacggguugguaugggcuccauuuaacauuaguauuaacaggcccggugccugaaagcguccuugucugcccacugggcccuucagucaaguggucagucagucccugggaagucaccaguacagaacuguaagaaauccaucucagaggagaagucagaugcacaggagugacaugagucaagugacaugcccaaggucccugaacugaagaggggcagaaccagcuauguccuagauguuccuggccccaagcccagggccuuugccccuggucccuggguagcaggggcagggcuaagcuggcuguccucugaggcuguuuguuccaccugacagccuucaaaacuguuuaaaaguuaaaaggaacagaccugcacagcaggaacagucccccagcgcccagggacaucagcagccuccuguguccuagggcuuuaaugguauuuaaacaauggcuccuagcugcuguucauugagcagcuaaugcccaccaggggccaauaggucaaagcccugacaggguugaggugaugaacaaccuugcugaagugaaguccucugcgaugcaggaagagacagaagaggcagggagggaaggcaggcucagagaagggcuggcccgggacccauauuccagagcccuacaguucacacugcggcccucagaggcugcuguacucacaccuacagaagaggaaacuaaagagggaggcagagccacaagcccaggcaauccagagcaagcagcgggagugaggucccuggcauugcuucugggcucuacccauccuuccagcccaggcugggggccuccuuuccuggggccucuucugccccucuccacagccucaaaaccccuuaggcucuauccgagaucaugugagcccuaaacugccaacccacucuuguucugucuccaccauuaacuucuggcccaucaccaaaguguauuugcauaaagccuaccaugcacagcuggacugcacaugugcggggaugugugugugugugugugugugugugugugguguguggggggggggggacuuccaaccggcuuccccuaccgggcucaagugauagucuucccaguacuggugugggugaaagagaaucuuggucuuagagcugguagaccuggggccccgugugauacccgccccaucccacagacgugaugcagagguauacacucuaaggcucaguccauaggauguagguggaaagugcaugccagguuuuauuauuuccugaauucuacaguguuagacugaaacccagggccuagcccagauaggagaacacucugccacugaguuauaccaccacuggugcuuugaggcagguacucauguggucguccucaucuuaggguacacagagcggugaaaggacuaagaucacgcacaggagcagcagagcuagguccaaaguuuucaacuccaaaguucaaaaacuguuugccauugugcugggcugaaacggcugagguuuuaggagacgccacucaacacaggccagcaagggggcagaccaagacuuucggguuuuuccccaaagagguuaugggaccuuuacacauagucacauaagucacacagaaugggggcaaguacucagggucucuguugccaggguguugaagucagcaggcaagacugagugaaccagaggcaggcagcugguacaaaagccuggaggccacgaaagacuggaaggacugugagugacccagugugugucauggcugaggaggagacugugugugucuucuucuaugguuauuauuauuaagacaggcucucuauauuauuauuaauaauauaggaucucucuaucuauaucccuggcugcccugaaacucacagucacucucuucagacacaccagaagagggcaucagaucccauuacagaugguugugagccaccaugugguugcugggaauugaacucagcaccucuggaagagcagucagugcaccuaaccacugagccaucucuccagcccugucuuacucuaucucccaccuugggcucucaaaugugggauuacagaugugaaccucuguacucacagguguuaggauuacagagaaaacuaggcuuuccuccagguuuaauuugcuaaccuucuuuucugguguugucucauuuguaauguuucuaaugucaaaaauucaaggcaaggggcuggagagauggcucaacgguuuaagagcacugacugcucuuccagagguccugaguucaaauuccagcaaccacaugguggcuucacaaccaucuguaaugggaccugaugcccucuucuggugugucugaagacagcgacaguguacucauauacauaaaacaaauaaacuuaaaaaaaaaaaaaaccagcagggcagugguggcguaugccuuugaucccagcacuugggaggcagaggcaggcggauuucugaguucgaggccagccuggucuacagagugaguuccaggacagccagggcuacacagagaaacccugucuuggaaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagagagagagagagagagagagagaaagagagagagagagagagagagagagaaagaaagaaagaaagaaagaaagaaagaaagaaagaaagagaaagaaggagagagagagaaagaaagagagagaaaagaaaagaaaagaaaagaaaagaaaagaaaagaaaagaaaagaaaagaaaagaaaagaaaagaaaagaaaagaaaaagaaaaaaucuacaaagugaguuccaggacagccagggcuauacagagaaacaacccugucuuggaaaacuaaaaaaaaaaaaaaaggaaaaagaaaaaagaaaaagaaaaagucaaggucuggauucgaggcacagcucagugguggagcacuggcccuggguuccauccuggcacugaaaaaguaaauuuguuaagggcacaggucugucucuucuagacugagcuagauuucagggcugaugguuccgagugcuugugacucuacucuggaggucaggucacugugcucagagugugacaggacacaccugggccugcucaccuucaucaaaagugaacaguguggccuaagugugucucgguugguagagugcugaccuagcauguagcaggcucugagcuggauccucagcaccacacaagcacagcacagugguccaugccaugccuguaaucucagcacucaggacaaucauggguuccaggucauccuuagcuauagagugaucugaaagugagcaugagaccagacugggucauaucagacccugccucuaagauagauagauagauagauagauagauagauagauagauagauagauagauagauagauagauuuauaaauagauaaacaaauuuacaaauagagaaauagauaaauaaauaaggcagggcuuagacaacucuuuuuuuucuuuuuucuuucuuuuuuuugggggggggguuacgagacaggguuucucuguguagcccuggcuguccuagaacucacucuguagaccaggcuggccucgaacucagaaauccgccugccucugccucccgagugcugggauuaaaggugugcgccaucaugcccggcuagacaacucuugagaagacagaagcucucugcagauggagcugggccuguguguucucagaguggaggacacagaugcauggaaaccagacugacuucucagcucuccuuuugccaagaugcccauauucuugagcaugcacgcacugccccuggaccaccauagccagcacccuuaggaaugaauagccuagacauuugucaaagaugugcagggucacaaggagaagggaacccacagacacagacacccuacacaucccuuaucagacaagugaggauucugaccuuggugaauggcuccucccuggggagaaagcgaugcucagaccugagguaucagcagagggaacugaccugaccaagccugaguauagucuguccuuuucuuggggcuaaagacaggauuuaagccuaucccuuacccuaaaacaguacccacaaaacagguggaccccaaauaauacauauuggucacaggaacauacaacaacacugucaguuuuuguauguggguguaagaaacggguuuuugaaacaggauucuucuguguagcccugacuguccuggaacucacucuguagaccagucugccucaugccucuagaguguuggaacuaaaggccugccccaccacuacccacccuguaacuuuucuuagauugggucucuuuauguagcccuggcuggucuggaagucucuguguagacuagguagaccuuaacucugcugggauugcacauuuguacauuacacauggccagcaccaguguguguguguguguguguguguauaggacagugacagccucagguguuugggacaguguuccccugugaacaccaggcuagcuggccugugagccaaggcuucuucuguucaagcuucaugucacccugcaggaguacuggagauggaugcuacuguaaccaacuuuaccugcuuucuggggaggguuugcccuuccucgugagcuagacagguguguaucaauuguguaucacaauguagcaauucuacccuaaguacucaaaaggaugaaagucuaucugcaugagaaucccuauaggagcauugaaaggcuaauuuguaacagcccaaacuggacaggagaaacacccaagagcaagugaaggaauggacaaagauguguuguugccaucuggaccaacugcacaauagaagaaggagcuucugacccaacgggcgggaaugcauuucagaaacauaaaagaguggcagaguuugcgcaggcagacagacagacagacugccaucauagacaagagaaaauguucaacuuuuaugugaauaaauguucaaauguagauuaaaugcacacauuccuaaaacuagaauuugccgacgcugacaaaggcagauguaaaagaaccugaacggagaccacgugaaaaaucucuccacaaggcaaaugccugcugaagaugaucucaucuguaaaugcuaccaaguuucaagaaacaacuguucuugauuuuacucgaacuugggcagagggaggguaaaaaacaaccauccagggugaugaccaccaucaccacaacccucaagcccagagggauggaccauccuagacaauaugucaccggcgcaagcggaaugcacacucagcaaaaccagucaggucccccagcuagguccgucccgggagcgugcauguucagggcuucaugggaaagucuuuuauacgacgggugacauuaacagaucaaaugagaaaagccauguaauuaucgcgagcaucucaaaaugauuuuuaaaagcauuuaaugcacuccaaacacaaauuaagauucuuuuaaaagcucccaguagaggcugcugggguagcgggguagcucaguugcuagagcaacugccuagcaggcacagagcccuggguucugugccagcaccacauuagccaggggauagggagagugcucacuggggucccagcacgugggagaggagggcaggaaggccagaaucucagucaaggucacuaaucccauaugcauaugaguucaagaaccuaguagcugggugugguggcgcaugccuuuaaucccagcacuugggagguggaggcaggcggauuucugaguuugaggccagccuggucuacaaagugaguuccaggacagccaaggcuuuacagagaaacccugucucaaaaaaacaaacaaacaaacaaacaaacaaaaaagaaccuaguuauaaccacugugccacugugugcauucaugcaugcaccucucucucccucucucucucucucucucucucucucucucucucucucucucacucuguguguguguguguguguauacacaagcaugugaguauguggaggacaccgguucucuccuuccacaaugugaguccugaagauugaaaacucuucauucaggcuugguggcaaaugccuuucccagcuggcccuucucucacccccuccaccuuucucuuuugaggcagggucucucccugugaccugggaucacugacuaggcuggccagcaagccccagacucaaccugucucuauccucacaacauuggauuacacaugugucaccaagccccacuuucuucaagggcucuccgacugaacucagaggcucaaacuugcguggcaagcacuuuaccacccgagccaucuucccagccccguguucaucaggaguuccuuccacaucagcagcagucugagaaccaaagccaaggaucauaaauagagguugggaguguagcucugggaaggaguguuugcaagcuugagauguugcauuccauccuuagcgcaagauaaacuaaauaaaugcuguggaaauagucauccacgggagguuuuaagcagaagagaaggaaugagucacagauacaugcaaaaauauggcugagccucagcaauggaagacugagagagagcaguuagaauuuacaugugguagcuauggcacuccuucauaaagcugaaugaguauuuuguagaugcauaccacugcgcauaugauucuaaacacuaaccccucaaacaaagcagugcaugggaggaaacucagugaguaaggugcccgccugcacagcauggggaccugagcucagauccccagaacucucugcaaagcaagccaaccaaccacaggaaguggcagcgugugcugcaaccccagaggagaggauacagagaugggaaaauuccugaagccuaccggccagccagucuaugaacuaugaguucagugagagaccucuugcaaagaggaaagauggagagcaacugagaagacacucgaggcugaccucugacuuccacauguguacauacacaugugcacacacacacacacacaugcacacaaccacacacacacuaacaaauauacacacaccauacacauacauacauggaugcacacauguaagcauacauacaaauauauauauacauacauagaaaaaauggauaagaagccaugcacaugguaucuaccuauaagcauacaauauuaucacuaauaacaauaaagacuacucaucuggccguggaggugcaugccuuuaaucccagcaugugaggacagcguauagauaaauauauauuaaugguguaagagcuggaugucaugccacacaccugcaaucccaacacuggagaggugucagcaggaggagcaggagcuccagaucagccucugcuacauaaugagucugagcucaaccagggcuacaugagacacugucucaaaaacuagggcuagcucagcagcucacaguuguaaaacuaauuuaaacccuuuuuuuccccccaaaagacuugggaguuuuagagagccuggauuuuuuuuuuuuuuuuuuuugauuuuucgagacaggguuucucugugcagcccuggcuguccuggaacucacucuguagaccaggcuggccucgaacucagaaauccaccugccucugccucccaagugcugggauuaaaggcgugugccaccaugccccucugagccuggauauuuuuaaagagaucacuuuuaaaguguuugaauuuguaaggcuguggggccuuguaaguuuguaaauuguuuggcauugugaugucuucauuaauguggaaucucagggacaggaaaggccguugcuuaacagugacacuuuuguguguugaguugacaaggggccagcagugcuggcuagcuuuaugucaacuugacacaagcaggagucauaagaggaggggagaaaugcuucuauaggcaaaccuguaggauauuuucuuaauuggugauugauaugagaaggcccagcccauugugggcggggccaucccugggcuggugggccuagguucugugagaaagcaggcugagcaaguccugaggaacaagccggucagcagcauccuuccauggccucugcaucagcuccugccuccaaguuccugcccugugugaguuccuguccugacuuccuucagagaacagcaaagugggaaguguuaccugaauaaacccuuuccuccccaaauuccuuggguccugguguuucauuacauaauaaccauaguaacccuaacuaaugcaugaauuuauccaugcauuguccauaacucaguuguggagcaaugggaagaaugcuuggagauagguuggccauuaaccuauccauagagucccugguccauaaggaaacagugaagagacccucagcauguguaugcacugugccaagcagacacaagaaaagccugcacucauccuggcucagagaggcccaauccuagauuauuaauccuaggaauuaauaaccaauccuaggaguuaaaaaccacguuguucucacuguuucugaggcucaguacagacaccacacagaucccaagccaggucacuaaaucccacacuccaccugcccagcacaaggcuugcccuaaauacuuagcagccauuuugacccagagaggcaguguggaaagagacugguaagugcgaggaggccuagauuuagucuggucucucuuuucggggaccauuucucucccugggcuuugcugucccaucuguaccugaagggggcaggagcagugagccaccaaagccacucuguuguuaagaggucaccaacaagcaggaggccacucaccucugcagucacccggcagguccuguccaucugucauccaucugggucaaaagccacacaugugcuccagguccuacccgucuuucugacaucaccccuagcuccacccucccgaccucugggccaauuucucuucccugacauuuuaucuuuuccccucccuuuugcuuuguuucauuucugagguauuuuaagguagggucacauggaaccucugaggauggccuugaacgucugaucuucuggcugccaccuugaaaugcccagauuauaggccugugucccuaugccugggcuauucuccucuuaugauuuaggguuugcucuugaccuccuagaacacucuuuguacaggucuuugugugagcuccuucuugcucacucuccaggucaagggccgccaccuccagaaccuaccccuaacuccccaccaguuccagagucccuagcgcagggaauccuuuagucguuaauaagcccgucuccuccgccccuauugauuauaaacuguuaccuucucuucugucuuuucccaggugauggggcucaaacagagucaggcauuacuguggcuccuaaaccagacuuauaggguaaaagccaccuucccugggggcccuuucugcuuauacugccacaggccaguuagguggccucucuuguguuuccuccauccaaagcucugguuuuguguagguugccggaccuggucagcuccccugagaugggaacugccacauuugcuggcaaugaacuugcaggcacugggcuagagacaagucuguggauguagcucaccugguagaggacuugccuaaaauguacaagggccuaugucccaucugcugcgcugaauaaaccagguguggguggcggacaccugugagcccaggggggaagaggaggcaggaggaucaggaauucaaggucacggucaacuacagcaugaguuugaggccagucuauguuagacauuucgucucaaaaaauaaaacuaggaacuggagagauggcucauugguuaagagcacugacugcucuucuggaggaccuggguucaauucccagcacucacgugguggcccacaacugcuguaauuccaguuccaggggaguccagcauccuuuucuggcuucugugggaccagacauacaugugguacacagacacccaugcaggcaaaacacucacgcauauaaaauaauacaauaaaauguaaaaauuaauaaguaauauauauaaaaauaaauguuuguugcuuggcuaaaugaagguccucuuacagucuccuccucccuaccuccugauucuucucccuucuuuccauucacaggugccagaauacuggcacccacugaggggccguugaaaugucacgcagcaggaauuucucggaacaagugugucuugcuuccuccaccuaccagagaggcacuccagauggagagggacaaagcccuaccuagcagggcuaccucugucccaggcacccucugggcuuaggcuuccacagccacuggaacagacauuuccccuggaguguacccggggcagcuggaaugugccacaggacacagaggcuggcaaaggucuucacugugagcccugcuuggccaagagccaccgagaagcacuugguuauucggaugggguagcugcccagggggaaagggugcccuucccccaccgcagggaagcagggcagccaguccugcacagccugagaacccauagcgggaggaggaaauuggagagcaaaacucuugcauaagucacugcagggagauucccugagcccaggaaaacucuggaagcaggagacagaaacucggcagaaucaggcccaaagccagaacccugacuggaggcugggccagucccgccacucagacuccugaguggccucuuccugacccagagacaccaggauugcccuaccgggucugcacccuccccaccagaagccccaggggacagauaaacucugccugucagcucugggcuagggggugguucagugacuccuugggguauuguguagucuaauccuggggcuugcucaacuccugucccccuuaggucuggcuccugaagaagcaacagguucaagaaagcaggcauauggcccacagagauuuugccaggggcucugagugagcccagcccagaaucuggagccagguugcuaccauucaauuuuggauuaacauuucuggaacaacauggccucggggggguugggggggauaucccuuccuuucccauguuccuucaccuuugaagagagggauucuaggaccuacuucuuggagauauuugaagcuaccgagaaagcacagacaagcccucuuggcaggcugcaccguauggggcuuuagugaaugacagcucucaggagucacagcauuaauaaacagauuagggagagccagauugggagcucugcaccaaacauucccaagggagauguaguaucucuuccccaaagucaagcccagacugauacaaauuaacccaggaaccagagcagaaagaguucaaacuguaaguucaaaucccagcaccaccacuggcuagcccugcagcccugggcauuucaggguuccugugugacacaccuugcagggcuacccacccaucuugagacuaucagaccuuccuucccccagcuuaaagacaagacagugcugugcacugucagcccuggguggugccggggaaccuacaagcuggcacauugcauugggucugccccauacggggagaggugacaggucaguugucuucuguaacaaucucucuggacccagccuccaagaauauaagggaggggccucacggaaucgaggguacugucccccuuccuucccgauguauuuauuacacagagcccugacucugcucuuacccggaccuaccugccugagggcagcccagugaggugccaggaagccagcaggaagcucccagaauccuccagaugccauagccuaauagcugugguacacacccagaccuaccagucaccugccauugacugaccaaguccccacaagugagcaaaaauagugacggcaacaggagcccuccucccaggagaggcaaugagggggucacuaaguuacuacaccuaccauacaucagagcggcugugacaguaugucaggaccucuguccuuucucuucucacagcguuccugguuugcagauggucucccucugccagcuucuacccaggcuaccacugcagcuuguuccgaugauggucacaagaucuaccuugugcucuucucuggacugggcauguguucucuuggaggaguuacagggccuggggcagcuggagugcacaccucacacccucacgcucugauauuugaacucuugaaucugggguggggcucugcauuaagggaccugaaaagcgagagggcuccuauauuguguuccuuggagcacacacagccuugggggauaguccagauggccagucuuuguacucgauaccuacugccugaccuggagaauacguacucaauuucucugagcucugguuacaagaaauaaaugaauaacucuccguuaauaggcuuagaacaaagcuggguuccagaucuaccauaauuuaaacaaacaugcacagaugaauacaucaguuauuccucugcagaccuaugauggaguuaaucgguaugugagacccgagaccaaaagucacacaaggucacuuaaaaaauuaaucucuguaaaaucuuauucuucaaauauuuauucauccaauaaguauguaaugaaguaccuaccaugcacgagggaacagguacagguggguucagcaaaugaucccugggacugacugucuaucuaucuaucuaucuaucuaucuaucuaucuaucuaucuaucuaucuaucuaucuauugaucuaccuaucaucuaucuauugaucuaucugucugucuaucuaucuaucuaucgaucuaccuaucauguaucaucuaucucucuaucuaccuaccuaccuaucaucuauuugucaucuaucuaucuaucuaucuaucuaucuaucuaucuaucuaucuaucuaucuaucgaucuaucuaucuaucgaucuaccuaucaucuaucaucuaucuaucuaccuaccuaccuaucaucuaucugucaucuaucuaucuaucuaucuaucuaucuaucuaucuauugaucugucuaucuaucgaucuaccuaucaucuaucuauugaucaaucuauuaucuaucuaucuaucuaucuuugguuugucaaaccacucuugcuuugucuccugggcuugccuaaacucuuuaucuuccugucucuaagucccaauggacaggccagggcuauggagagcuuaugucauggacggagcaaggaaggccacaguggagugagaagggcggccagguugaagccaggaguggcucagguuguaaauggaagucuucacagguccuuaggcugcagagcuggcaggcuaugggaagccugccagggguguggccuggaaguucgaggcccucgcucuuguuaguguucucuauggggcccugaccuccaaaagcucacacuuaagccaggcacccgugugagaacagaucuuacccaccaggcucgagagcucugaccaaggucuagccuaauauugaagaggccauagccccagaagagcacccugcagggagccugggcagggaaggacagagcaaaacgcuggggucugagaaggccuuuggcugggcuccugacuuaaaguugaggguggcuuuaacaaucacucugaucucgaacaaguugcccugcucucugagccucgguuuccccuccugcuaaaugaagacauuacuuucaggcaugaccaaccguuugacacuguaauaagacauugucaucuaaaaaauucacacucgaaaggcccauaauuacuuuuuuuuuuuaacugcaaaauguuccauaacuuugggccacauucuuagcuguccccagcuauucaccaugagcaaucuauggcuguagacugaacaugucuguaaggcccaguauggugggugguauaccuuuaauuccagcacucaagaggcagagacagaugaaucucugugaguucaaguccagccugaucuacauagcaaguuccagaucaaccagagauacauagugagacccugucucaaaaacaaaauagaagaggaagaggaagaggaagaggaggagggagaggaggagaagggggaggaaaaggaggaggaggaagaggagggggagaaauggcuuuaaaauuugaugguaagccgggcguggugucgcauaccuuuaaucccagcacucgagaggcagaggcaggaggauuucugaguucgaggccagccuggucuacagagugaguuccaggacagccagggcuauacagagaaacccugucucgaaaaaccaaaaaaacuugaugguaaaagccugggaaggcaggcuaaggauguuaaaguggcaaauucaucuugugugguggacugaaauaaaccgggcauucauccaggaaacaggaaacaggaaacagggaacaggaaacaggaaacaggaaacaggaaacagggaacagggcaggcccaaccccacucaaguuaaaucaacacuccuguaccccaaccccaccccaggcggaaagaauaagcaggcacucccugugugaucccuggcccaccaaacucccucucugagccucagugguccccuugugaauccacagagaggcccgcacugagcuguggcuuuauaaugaagcacaugcucagaacacaugaggucuuggauucaggcacggcaccucauuggugacacuggugacccaggaagccugacugucccaggacugccugggaagcaagcuggagucuuaagcaaugcaguuccccugagccguuuuuuuuuuuuuuuuuuuuuuuuuuuuuuuuuuuuuuuuuuuggcuaaagcccugggcuguucuuauaauuaacugcauggauguauauaaacaaggcuagcagaggggcuccuggaugagacacacaguagguguucgucucuguuacuauuauuguuacuacuguugauguuauuagggaggggagggcaaccuucagcucuuuccaggaaagugugaaacagacucuucuuuaccccucuuacuuaaaccaaagcaguugccaggcccacaaaccagaaagccucuuuaggcuaagugugggguccugcuguggccccauaaaaggucuuacaccauaccaaaagccaguucaggccagugaaugucauaguugguucuuccugcacucugacugaggggcaccaugacauuugaaccagugccaccuggcccugccccgccuggcccugcccugcuucuacgacaucacuaaauuaaucugguucuggguuguccuuuccucucaagugccaguucucuuuuagugacucauggcuaucuggcguacuaugcuguagcggaaggaacuucagcaggauacagagcauugguugauaaaugaugucugacacaggugcagagcaggggcagggcagcaugcgugucagcuuugugucaccaaggagcuaggagaguccuaaggccccaucucauuugcaugaaugauguuuuucaggaaagacacuagaaaccgagacaaccaagacaagaggacaaagccagaguugcugauccaugcccucuggguacuaagggugauuccucugagaacugcaauggucugcuggaccaggaagggguguggccaggcugagagucauuugucuaggagagcagaugcugaugcauaaguaauucccccguggugcuugguccccuccuuuuggggaccccaacccuauguugcaaaucccagaggcagaugguucaacugaaaauauguacagagacguugucugcagacugacauccaaacaucaaagcuccaaucaguccgcuagucugauggggcaugagaccuaagcacagcggugcccacacuuuggaacuaugugacuuucagaaaguuacauaccaacucugagacaaaagagcaaguuagauacaauaaagacacugaagguaauuguuccagcuucuagcccagaauauaguccuuacaauuagguauagggauggaucaaagcacaaauaauauuauuuacaagaaauaaggucugagagaagggcuugaacaagcugcaagaaggaacgcuugauagccaugcucaccagaaacugagcuacugaacuuaguggauucuacauaaauaagccacuggcucuuccgggaaggcaguuuauaccacucauggcucagggaaggaagcaacuugaauggguagguugccuuucccacuucucagugaagggaaucugggccucaguauccagaacugucacaggaccacacacaugugucaucagcguuagagacaauggacuaggggaaugagggcguguguuaacucagggacucacauuucuuugagcuaaguuccaacacuaugagacaggcacucacguauugccugggcaggccuugaauuuauccuccugccucagcuccugaguaacugggauuauaggcugacagcaggccauuuuucuuuuuuguuucuuuccuuccucccuucucuuuuccuuccuuccuuccuuccuuccuuccuuccuuccuuccuucguuccuuccuuccuuccuuccuuccuuccuuccuucguuccuuccuuccuuccuuccuuccuuuuuccuucagauucacauaauccagguuggccccaaacuuaagacauagcuaaggaugacccugaacuucugugugcugggcucaccaugccaccacgcccgguugacauagcauuggggaugucucuguaccugguaguagauaggcacaauguagcaaugagcaugccuagaagcaaggagccugggagagggagcaggacuccaaacacaccgaugaaacagccuugacuuagcaccaaagguguguuaguccuaagcagacgucaggccagccauuguggcuaggcuggaaggagaugagcuuggccaacgcagccagcagggugaggggaguccaagggaaagagucucuucugaggacgcaucugugcgugcuacugacaaaggaagcggcugcuaggguagaacucagccgcuggggcaggccgagcaagaaugagugucuggguccuauucccugcccugcaaaugaaauaaaauaaauccacuggguagaucuuuacaaaggucgcauuuaggguucuccaaauaaaagcaauuugcucuggcccuugcagacucacuucuaaaggucaguaugaaacacuggcagaccucugcccaacagccuacugaccaccagacgaaggacagaacgucacucuuccaaccagacauccgagaggaugaggaccaggcucaaaccuaagcccaggugagguugacggaauuacaguacuuggcaggcugaggcaggaagauugccaacagcauggggccacuguaagacucugucagaaccagaaaaauaacaaaagcuugggguuacagaugaguaaggggcuggggggcucacgacagggucucucuggucuuucuacacagaaacuaccuuccagacccuuccacaaccgggacagggcgcugccugaagaucacaaccucugagccucuucagcagcaaggggagagaauggggaggguaugccugggagcugggagcucaggguggaucgaagcaugaucuuauacaguguuaugucaaucucugccagugcaaggcacaggggccugauagaacacucaggaaucgaggucccccaaguucacuuugugucccccaaacagcuuauucauguagacguagaggcucaugccugguuguacccugagagccucacauuucuccaccagggcccacagcaucgaugcuacccuccagcucacacagugauucuuuuuuuuuuuuuuuuuuuuuuuuuuuuuuuguaccagcaaagugauaaagaugagagcuguggccguagguccugcuugugacauggacaugaggugaggugacagacaccauggcagucccuucucccugggcugcucaggcuccagagcguagguaugucuugggcaggcccagaggacaaaaugucuacagguagauauugaugucccauuccccacacugcuggagccccuagauucuccugaagcaggaagagguuucccaccuagccagugucuuucagagaugcaucuaggccauagaagcagacuagcuggggugggggguggggaauguauccaugcuuccaucccaccccagcccccugcaggcuggccccagccauccauagucauucaaauaugaugccuuuccacugugccccuaaacuacaaacacagaggcagcuggcugugcuugggaggcaagugggccgugcaaggaugggagcgccaggggaaccagagcggcugccucucagcucccaccauuuggccaggcaggggcguggcucuguagagccuacaucuucugaucuuucaagagaagccagaaaccaguguuuuuguguaaaacgaaaccacccgggguuuaacaacaccagcgacuaaauugaagcuuuuaacucaguguagaugccaagucuccugccccugcccaccccacccuccccagccccccuccuaggcuuugggcucuccacacucaguaggccagaggugagggaccucaguuagauccauuccaauuucaggaaaucccauccucucuccucuucaggcaucuugguuuacagauggggaaacugaggcuggagagaagagguaacuuguccaagcucacacagguaauucaucaagacagaucuuucccaccacccacagaguggguacagcuuuucaaacaaaggccaaggauguggcucaguugguacagugcuugcccaauacgcaugaagcgcuugcuucuacucucagcucauaaaacaugccuggagguacacaccuagacuuccugaacuugggagguugaaggcaggaggaucaaaaaauucagggccgggcuggugagauggcucaguggguaagaguacccgacugcucuuccaaagguccggaguucaaaucccagcaaccacaugguggcucacaaccaucuguaacaagaucugacgcccucuucuagugugucugaagacagcuacaguguacuuacauauaauaaauaaauaaaucuuuuaaaaaaaaauucagggccauccuuugcuacauagcaaguuucaagccagccugggcuacauaagauccuguuucaaauagauuaauuaauuaauuaauuaauuaauaguaaauuaacaacauacuauggaaguaacacacuaacacaagucauggcacuugugugcgcacaugagcgcgugcgugcgugccuguguguguguguguguguguguguguguguguguguguguguguguguguguguguguguaagagccaggaggcugagccuaaacagcuauaugccucugggcaagcuguuuucccucucugggccucaaagauaccaauggacacagccagggucugagccuggccagucuucaauucuaggcaucucugaggucuccucuucagccagcaguuuguggccucugaugacuauaaagcaauaauaauaauacugggugagcaaguccacaccagccaggaaagaacaccacaguuuuuagagaaacccgacucuugguuacuggaauucaaaaggggcaaugguaauaacauggggggggguguaguuuaaccaccauccuccaguuaaacaaaaacacaucugcuuuaacuucaucuucucccccagccucuacccucagcucaaauuuuaccccuucauuggagacguuaaaucaaaugcaaacaauugauuucaugccacagcgaggcugggguuugaagcauggaaaacuuuaggccuggguuuuuuucugggagcaauuacaaaauguugguggagagggggaaugagaaggcagauaaauauagagagagagcacucuggcauguucuuuggacauggagcaucaauaaugaugcuggagacgauuaugagcugucauucaagagagggaaggcauuuuguuuccugucacagagcugacaauuggaaccaaagcacuggcuguccuggaacucacucuguagaccaggcuggccucaaacucaaagauccgccugccucugccucccaagugcugagauuaaaggcgugcaccaccacugccugguuuaaguuacuaacucuuuaacaauccauguagguggagccuaauguucauagacugcuugugaucuugcuggcccucugcaacugguauccauguuuauuaccccacaucacagaugaggaaacagaagagaggaaagaagcuugucuggggggggucacacagcaggacagauaauaaauugucaaucuacugccucccacucuauucugaagguuagaacagcuacagaaauaugaggggggggugacaaaauaacaaacauaccacacagcccagcccuggugugccaaugucgaugggcuguugugcuccgaagcucagucagcauuccuguggccacguggagaauucugagcccaaguucucagcccagucugcuccgcuacccacaaggcucuccucaagcuccaggguuuuuguguuaauagcccagucagauagacuucgcgcugagaacuucaaacucuaccccuggauuccacauccuggauucacccccaucucuccugccccgaagccugaagcccagauaugcucuggcagggacaucacugaaccuaucacagaaccuaaacuuguagguacuugggcccagccccagaugcccaaguggcuuguagaugucccagggcaggucacugucccuucaagagguuucuucauaugcaagaaaggauaacaucuccugucugugcaggauagaacaggaaaggaccuggugcugggcuuugugggcaaugagguagagguggguggcaggagauuccugggcuauucccagccgggagcuccaggcuccccucccaggcuguguccgggagggaggaggacacccaagugacaguaaggaaggcugagugcuuccucccuguccagcccaucaaggaaugggcagagccugggcaaaggugguugacaggaucgcaggguucagaggcagugacauaacccuguacacacugaugcaaucucugcugagacuggagcuagggacagccacugcuuucuaaaguaugugaacccgcuaaacauguugcaggcuguacagcaugcuccccaccaauagggucuacagaccaaagacuuccagcuccuguacgcccucaaggagaaucccgagccaccgugagagcagagcuguggccagaucacacaguuucaccccaucuuguuaguacuauguacuggcugcucacugugacaacagugugacaucuugaucccuuuuuugggggaacuacgucaucuucauucuaccaugugacacucaaauuuucaaagccugaaaagaauuuauuaugccaauguucgccucaaugaguuggguggggggaaggggucguuauuuacuguucccuucucagcaccucgaucagaguuuagcgcacaacugaugccugguaaguauguguggaucgaagacacucacugucuggccuaucgggucuuuugauucacuguagucuuaacauauagaugggaccaucacugacauggcugcgaaccagcccagaccugucucacuccaccaguaggcuucugagaagcuguguucuccccuaagggaaccagagacgguucaggaauuggaaaaggaggcagagacaggagacggccagggagugggagaggaaagagcugacuggggagaccagagaggcuuggagggugaagggcauacugggggggggcucuccuuaaucuccugggcuguggagaaugggcaacaggguucaaugccuaaugucauugccuacauugucuaaaacucucugucccuauuuguagucugucaggugucagagcaguccuuauccagcauuuaauaaacaguugcccuaauucucaaccagacugagaaucugaggcugccugagggggggucuuugaauucuucuuggagccaaacguucuuucaggccugagaauaaucccucuguuauauguauguguguguguguguguguguguguguguguguguguguguguguguguguguguguaugauuuugagaccuaaucuuccuagaguguuagaguggccucgaacucacagagauccucagccuccagacugccagcaucucuccagaguugccgcgccagcuuuccuuuuuaaucaggauucacaggcauaccccagaguccuuugcaagucuuccuuccucaggcccauuacgcguugaaaaggauuaccauggacaaugugggaguaagaaugagguuuuuuuccuccgucuuggguccugccgcugugacugugccuuuaacccuuucuuacccgcgcugggcaaggcagcagccccacucucaccugcacacagccuggaaccguucacaggcuccuuccguuuccugggcucccccacucucagacagacacuagcacgcggucuccgaucucucccgccaaagaucgcagcacgugccuucuuccugcugcuccccaacuacuuuagacaccaacgggacagagugccaagggaccacgaagggcgcagcuguggacuacggaggcgcgugggcaccgggagcaggugcuuagcacgagggugagguccuggguagcggcucagcgggcgccacguccaucauccugccaggccacaagagaugcgcgcggaguccggagcgggaggucguggguccccagggagccugaccuuccacguguccccaccguggcugggacagucacugcgggaccggcggagcgcgcgcgugggagucgcgcaagccacgggcgcagcaugcuuuccuuaccugcaggcacucguggggagggucuguuccggcucgcgagcggcagcccuaaggagcgcaguggcgggagcguacucuggcggccaccucccccgccugcuuaugaaggcggccuggccgagcacccgccggccuccccg

SEQ ID NO: 2211 - RNA, 7893 nt, Mus musculus
gagccagugaacaggaacacagggguuuucuuuauuuuaugcauaucguguuuugucuguacauacgauguaucacuuaaauaccuggucuccugggaggccacaaaagggcaucagaucuccucagacuaccauuauagaagguugugagcugccaugugggugcugggacuugaaccuggguccucugcagugcucuuaaccuagucaucuuuccagucccucucgggucucuucagcagcaauucuuaggccagcugucagucuaguuuccacuacacugugggugugugauccccaccuccaugaggagagaugagaggcacggaggcucuggcacagugucccuaggcagcagcccugccaucaucagugucauggggccaggugacaggugagggcagugguucucuuuauuuuagaaaugggggcggcugcacauacaaaaauugccacagagugauucaaacuuggaaaacuuacagaaaaaaaaaaauguucccugccccccaccccauaguccucgcccucugagguaaggcugugccauuuucccauggccuuuacaaaacaaaacagaacccgaccgauccauucgugauggccucggccguacuguguggaccccagguucuggcucagucagacuucuccuucuccuucaugugcaagaagacgaugcugaagaugaagagcccggccaucauggagaaggcacuggcauaguagggauaggccgaggggaugaagcgcucauacugcgugugcuggaguggccucacugacaccuguaaugggacagaugacaggcccugguggcugggaggccuaagggcgacaccuacuggccagaaacuggacugccccucacuuaccuggguggaagaguacagguggguguagccuagccgguuguaauccacuuuaaacuggaauacaccauacacgucaggcagcuugaacuggacacuguacuugccaccuggggaagaagcaacaucaaaaccaggaggguuucccagggggaaguguguccuguggcagacacaggugacagcugaguggcuuucucuggcaggagucacacacaccuuuccucuucaggaagguccucacgaaggggucgaugcgcacgaacuccagcugaaugucaucaccaucaaaggggacccacuugccauuggagagcuguucuaugaugaugcuauacuccugagaggagaggccaggucaggacugcccuuaaugcccaccccagacguggcagggacuccaggaggcccgcagucacugagcauggcugaccacuccucgcagggcaacagcuggagcaccucugccuucccugggccugagguccuuagugcgguacugaagugugagcgagcaggcugccuccccuccagccugcaacauccacccaaagcuccaacugcagugucgucacucaaccgauaaagcugacugccccgccagguagacacaacaggcccucccuccacugcugugcagccacuccacaucucugcugacucucagggacagacugaaguacacagucaaccuucuggacgccccuaagcaccugugcugagccccccgaucuuaggacugcccucccaggaccucuuaccaccaagucggugacaguguaggcauuggguggagccaucucgcccacccggugaugggacacaggcccuacucgaaggacacccuccuccuugaacacccagcgugagagggccacagcuaguucauaguugccugucugagaauaccuggaguagggagaggagaggcugcagcccacuuccuguuggugccagcaggccagcacacacuaccaugcuccaugccauggcauuaccucugcgcaccggguguggccuucugcacugccgaguugaagaaggcaucgcugaagaaauccagagagccacugaagaugacccgggcguuguuccuggccuggagcccggcaaucagcagaguguuccuccccaccgcauggggguacugcaaacacaacagggcggucaccugggcauuaccagaguaccggcaaagccaccacagcaaguggacagcaggcugaacccagcuggacaccgaccgacauagcucugcuuccacgcccaccugacggaggaccuaggaucccacuguuuccaccacugucccggucccagcaccuuugcaccgaggucagcauggcccacggcuucauguaugugacauguguaugugcguguguuugacaugucagugucagcauggcucugcucugggcuugccacuuggcccaggagcuggagcauggagccugcagaggcuuacuuaccugggugauugguuuaucugggaagaaggaguaagagguugaagagccuguuaggauguccaaaaccaagggauuguccgggucugccaccauucugcaaggaggagagagcugccuagcacugagcaggaaguggcugcgggacuuggggucccacaccaucuccccuagggaauuuccagaguaguucuucccuuucccauuuguucaucauccauccauccauccacccauccacccauccacccauccauccauccauccauccauccacccacccacccacccacccacccacccacccacccauccauccauccauccauccauccauccauccauccauccaaagauauggucucacuagccaggcuggcauggaagcuccaaucccccugcuucagccuccuaaguagcauccggccuggaaggauccuuucucaauagccaagcacuugggcuccucauuuacagugagacucacuggcaucacccaggggaagggacauucucaaccuuaaauuuggcuugauguccacaaacagcaaguggcccuugucccucugggucucgcugguccccugaauacucacccaacuccucggaagagaaugggguucagagaugacuugccaacaauggucggggccuucagcagguucucagugucagccacaaugagugugugcugcgaaggggacagacaaggcaaacagucaagaagaagguccuggccagggaguccuggcaacuuccagcuggucucuacgcaaagcugagcuuugcugugggauccagauaucugaagggacaagccugccuaccuggccaaggucagaaacaucauaguugugguggucgaugacagcuguuuucucuucaucaaauucaaucccacacucacugcccagcucccgaagagggucaccugcacagauccaagagauugccuggcugagcccuggucggcaggucagauaacacaggccacaacuucacaccucacccucaccuggucagccacggugcccugagccuucagcaggcaggccaccacuuccagggcuuggaugaguaguggagcuaaaugacagccacccuccucauauaaagauuuaacaacuugguucuaccuacacccucuuagcaaacuuggcaaagccaaagccaauacuggcuucguucgacaggccugagcucaccugcccuccucacaccccaccaagugacccacugagaugaaagucuagcacugcugcaaacaggccugagcuguccgcugcuggagcugaaggaccagugcaugaacuaaggauacaauucucucccuacugcugugcaacuuuggaacuuucaaaaccagaauccaaaacuaacuccacccacugccugccugacuuccugguucccccauaguggguucuucugaugcugcuuagauucuaacaccaaauuuugguuccucaagaugugguuccccccaaugaacagauccucagggacucaagugaugccgugugaacuuucucgacaaguucacuggucaguaaaaggcuagagccugugauugggcaggggagggagaaaagugggacuggagauuugaguugagggguuugcaggcagugagacagaggaggaagcagccuccaugacccagaaccacaaggacaggagaagcaacaaguaacaagggaccuacagcuggggaaaauguuagaucugcccagucuaggcucgcggcuuguaaauaagacaccuggacugugugucuuuuauacgggcuugcuaggauuauaaauucauaccacacccguaagggucccagggccacugcaucucucauugccuccccggccagugccacgcuggcaucuccugcaugcaaagcucucugagcuccaugggaacgggugcaaagacuugcaacuuccuagggcagacuuaccaauaucagagcuggcagccaccaaaacgcugccgccaccaucaaugaaggcacugauggucuccacguugauguugccuccaaaaucugcaagaaggccccagacacagucacuauaggcacccugucccccucugacaccugcauggagguaacagacccccccagagcagccagagcucccaaaaugagagggugggugaaucuaccacaccuguuacauggcacaaacccacaugaucgaagcaaugcccuggcacucagaugcaauuaccaaacgcguccuggucacaucuguugacgugacagcacacauuccaagccacaucuauucacucaaaaacgcucaacagccccacccacacuucacaguacugcuguucaaaugcucagaugcgccuucgccaucgcuggcaccaugccugggccacccuccaguagucuaucaaugucgcuccaccuaagcuguuugaggaaguaccacagaauacacagacgacacucacuugaucguaaggcucacuggccuaacacuaacggcuuccuuguucccauuauccacagcacaaccauucagugcuuuaaacaucacccaaauggcuugcuggcccccagcauuugaccgcugaggcucuguccaguucacuuagugacugaccacugcugccaccagcaccagguguggcuugcugagcccuaggguucucuccacagugagucugguguuuaaccuaaguccacuuccuugcuaaguauuuccuaugggcugggaacaaugaaagggaaaaugagggaagggagacacuguguuagugaggagagccauuguccagugacacaugcaaagauggaaggguuagccgggcagcagcgugguggaagagcacacaggcagagugaacaacggcagugucaagucugccagguagggugagcuacggggcuggacaggaggccaggagugaggugagguagccaguuauuggaaggcugggacugguggaaggcacuggauggagcauucugagcuggagaacaacaugacuuccuuggucccaagguggagcuggguacagguagcauguaggucagaaggcacugugccaggcugugaaagcauccuaaaccaggaguaggugcuggggcaccaggggaggggcuuuccaugggaccuaaagggagacagcaggagccggggguggggcuggggggacuggcacuuuagacagcuggcagaacccacucuugugugaacuacagaauacaaaguagcugccaggggaaacaaaaggccauccguguuuaacugaaguagagaauggcagggacaucuuaccccagacagggacagccugggccaaagaugaaacggaaaaacuaccuagcacauucaccaaaaaagcaaaagaaacggccagggcuggagagacggcucagugacuaagcacgcaggcugcucuuccagaggaccaggguucaauucccagcacccacacagcagcucacaacugucugcaauuccaguccaaagggauccaccacccucuucuggccucugaaagcaucaggcauaaacauggugggacauacaugcuggccaaauauccaugcaaaacaaacaaacaaacacacacacacacacacacacauaagaaauugucaggcuggacagauggcucagugguuaagaggacuggcugcucuuccagaggaccugguuucaauuccuagcacgucuguaacuccuguuccaggagauccaacacccucacacagacauacaugcauucaaaacaccaauauauguaaagcaaaaacaacuaaguuauauauuuuuuaaaguguuuaaaaaagcaaaaagagccaggaggugguggcgcacgccuuuaaucccagcacuugggaggcagaggcagguggauuucugaguucgaggccagccuggucuacaaagugaguuccaggacagccagggcuauacagaggaacccugucuugaaaaaaaaaaaaaaaugaaugaaugaaugaaaagaaaagaaaagaaaagaaaagaaaauugccaaaggaacuggagauagcuaguuagugaaaauacauaggaaguggcuaaagcuaugggaagggcaagcaucucagcaagauaaaaauaugagacucucaugucaucuauucucgguuggggacaccagacucacaggcccaagggaguuaagaacacuucuccaaauauacacauggaagagagagacaaaguucagcucaguagaucuuaacagaaaugucuagugguggacucaacugccuuguaagacagaaauaguuaaguguaaguuacagaucuucacuccauucaguagucucugagggcuggugagauggcuuagcaggcagccacaggucggucacuggguucaagucuccaguaagggcugggaaugacaagcggugccuauuacccaagcaucaggaggcagagacugaucugagagcucacuguccagccugcuuagucaaaauggcaagcuucagguucagugagagacccuggcuuaagggagugaggagugugacagaguaggugacccgauucuacacguccacagaagugugcacaaccucacauacaugcauauuucccaccacccccaauaccaacuagccuuguguuggucagccaaaacacauccaucaggccuuaaggguugauggguauguaucuauuuguauucuuaugaccugcagaaugacuuuuuacagcaauccauguuaauaaugugacaaaucuuuguacacaagcaagucaaaucaagaguuucuuuaucaggacccuuguuagagaaaacccccuucuccagaagcgaaaugucuacgggugacauuuggcacucuauccuuagcuguaucuuuuugacggaugaaaucuccgaggcccaagcugcaauuaacauuuuccucuacuauacuucgaaacucaccccaagacccagaacaugcccaggaacaagaagacagccgucuccugagcccccccaaucccauuucgaggggcgacgcgcgcccuuaccuuccaccgacggggaaaagaugauaagguugucauagaggaacuccccguacuuaaugagggacaagcuggggucaucugcggucuugaaggugagcucaaagccccggucuggaggaaagaaacccggaacccggucaggagaggaaucccugcugcagcccucggagggggcugccgucuccgccccaacccgggccauucccucggcucugcucggcgcucacccuucaggcugcggaagaacagcgagugcgugucccgcacguucagguuguccagcagcacgagggugcgggggccgcuggcgcagacgcagccgagcacggccagcagcagcccgcagaggggccaggcgcggacggcgaggcggggauccaucuucaucucccagcagcccaggccagcaccugggcaccggaagcgucccucgcggccgcccaauggccgcucgcagcggcggaguaccacuuggaagcgguccggguacuccguggccccgcggcccacgccgcugcggggacggaccaagaagca

SEQ ID NO: 2212 - RNA, 12906 nt, Mus musculus
ccccccgcgcuugcgcacaggcgccgcccccgaaguuuguuguugucccagacguuuguggcgguggcagcuggcuccggucaccgcgccaccauggcggugcgacaggcacugggccgaggccugcagcugggucgggcgcugcugcugcgcuucgcgcccaagcccggcccgcuguucggcugggggaagcccggccccgcggcggccuggggccgcggagagcgcccaggccaggucguaagccccggagcacagccucggccggucgggcucccccucccggaccgcuaccgcuucuuccgccagucgguagcugggcuggcggcgcggauccagaggcaguucauggugcgggcccggggcggcgcaggcccuugcggccgagcggucuuccuggccuucgggcuggggcuggggcugaucgaggagaagcaggcggaaggccggagggccgccucggccugucaggagauccaggugagagcggcggugggcgggagcgccgggagcgggccgaaccgggccagaguguagcccugaggccagccgggccggggcggggccuaggccaggaggaggcgggguuaggagagugagugaucuggguggggcggggccaaauuggacagcaagggcggaguuaguuggauaguuguuggggcagccucagaauccuagugguguaggggcgggucgugaaccagggcgugguaggagccugggcauugggaagggcaggucucugagccgugauugggcaauuuaagggggugggguacucguggaccagacugaguggcugguggcaucuuaguuaugugucuaagagcaugaggacaugccuagaccuuggggggggggguagguagaucaggggauaaggcaaagauuaaaaucuaucuaugacuuggacuauacauuucuuggaauugaucuguuaauuaaggcugaccuauuucccauuacugauggccugauaugccgacacuuugcaaacaguaugguuuaaaagcugcugauuauuggucucuguugcacuguaacaaauggcuuugaguaaauuucuuuucuuuugggaugcauaaaagggggacagagccuugauuuguauauguagcccagguuugucuugaacuuuuuuuuuuuuuaguuuuucaagacaggguuucucuguguagcccuggcuguccuggaacucacuuuguagaccaggcuggccucgaacucagaaauccaccugccucugccucccaagugcugggauuaaaggugugcaccaccacagcccggcuggaugauaacauuuggaauguaaauaaauaaaauauccaauugaaaaaaaaaagucacucaggaggcagaggcaggcggauuucugaguucgaggccagccuggucuacaaagugaguuccaggacagccagggcuauacagagaaacccugucucaaacccccugccccccccccaaaaaaaucaaaaguuaucauccccuuucccaguuuccccucgguaaacccccuaucccauuccuccucccccugcuucuaugaggaugcucccccacccacccacucucaacucacugcccuggcauucccuacacggagucaucgaaccuucacaggaucaagggcuucuccucccauugaugccagucaaagcuauccucugcuacauaugcagcuggagccauggguccauccauguguacucuuugguugguugguaguuuagucccugggagcucuaggagggggggggguugguugguugauauugcuguucuuccuaugggguugcaaaccccuucagcuccuuggccuugaauuucugaucuuucuaccucuaucuccaaagugcugggauuauugguauggaccaccaugcuugauacacaucuucuaaaaccccuaccacucucauuccuuggugcacucaucauccuaauuuacagggaguccaugcucaagagagaugagaagguuuacucaaaaucacacugcugauaaaaggcagugcccaaaguucacccuucaaaaggcuggcccucagcugagccagacugccugccacuccuguuuagccaaacagugggagagaggcugagcagaaacugcagcaacgcuggaauuucaggagaacacagaagaucuaacguguuaguauuuaaccagaguggaguuaugacuggauacauggaagcucuggagccuuuuaaacucuuaaaauagcacagagaccucucuagucgcacaguugucuggucaaggucacccagaccaacagaaacaauggaugugucuauuagagucugggacuuauuuugaggaguuggcucaggcuagguucgcagaucuaaaaccggcaagcaggcccagggaagagcuggcucugcaauuuaaguucuugggugguuggcugccagaacucagccuucuuggaggagagcagccuuuccccugggguuuagaaccccuugcugagucagaccagccccugcaugcuucaggguaagggcugagcagcagaggcuuaggcaccaugcucuaaaccaucaaugaaggaccaaacaagcauuuccucuccucccuguuccuaguacuggaauccaguuccugugucuugcauaguuaugcagggcaacccugccucaaacaagcacacaaacaauaggaaaagguaugaggccagguggcagguaagcagguguaaagacuuucaacacccuggccauuugacaagugugcauggaaaauagaugagcuauccauucacacuucccagaauagcuaaccuauuguaagaacaauagccgacaccaugagguggggaaacagagcacucacuccuggugguguugccaauggaacauaauacaaaauuaaauagguguuuaccacaccagccugucguugaaguugucagcaucuacuggggggaaacagaaacagucacacaaaacccugugugcugcaguuucuauggaaaacaguaacccuaaccucugaagauuaacaauagacucauucucccugguaauuccacuucuguaugaauauuuggcauaauggaaaucguauacagaccuuucugcacugaagcucaaggcuacuuacugacuauagccagggggugaagugacccaccccaccccaccccacccauguccuucagugcaugaauggauaaacggaguagauacaauagaggguauuaucuagccuuugaaaaggaauucuggcaccugcuacacauggaugaaucuuaaagacaguguacggcucuaguucuaagagccaggcuucucugcaugcccggacagagaggggaagaauggaauaucguucuauaguaggcacagagccuuauaguuuugcagagcuggaaugaugauagugguugcuuagcaacaugaucguuccuaacacugcagaaguauucaaauguaugucagacauauuugacaauaugugcuaggcauguuggaccauaucucuagucugaacacuugugggaggcagaggcaggcagaucacagagucugaggagagccuggucuacagagcaagccagauauagauguagggagacucugucucaaaagaaaagaaaaauuacaauuuaaauauaaaucuauuuaguguaguauauugaugaugguagcaacauuguucauaauaccccggaacaaaaacauccacccgugagugaagagacaguaacauaagccaugguuuguauguccaugaugaagucucccuccgcaguuagcaagcaaccagcuagacaugcagauugggaccugaauguaccuugggcagcaggcuaaauguagaaacuggggcuuagaaagcugcacgcugcacgauuccaugucuaacucuuaauaugggucaucugaggauggcacuguggugguacagagguuggaggaaccaaggagcuguggcuacggagcagcccugugucuugacuggguggucaucacaugagaccacaugaagugagauuguaggaggcugcacacugaugcacaggugugcacgcaugcauacacauggauacacacaugcccacacacaugugcauauacacaugcaagugugguugcaguuaaguguggaccaugcagugaugcaguguggaaugugcuaccgcaguaugguaucuugugcucaaaacccugguugauggggaucacucugcaaauaucucucccaccccucgggauuuggguuuguaaagcuaugggcaagggcacacccauuuccauuguauuaaacaguuagaagcuuugguuuaaaauauaguagcuucuagggacccagugccuuaggaaccacagaaggcgugugugacaggcugguccccagggcugguccuggaggaagggugacccagucugggcuugagucaauaggguuuugccaggcacagcaagaacgcagaugggggccugggggagagaucgggaagggacucaggaagagggaacugcagagcaagcccagauaugcagggcaggggcauagcucagugacaguacuugccuagcguagguagggcucgaggaccccagaaaccaacaaguguaggcgugcacagcccagccuggcauagcuccagggcaagccacagcuguccccuagugaccacaggggauggguucuagguccuguucagucagauagccaaauacauaggaaccagguuaauaagaugacaguacuguauggacccguccauauuccugugagcugucaguuguuaguauaucacucacagugcccaacguggcauuacacagacuggaacaaaugccaugugacuguucauagaauaauggcaagaaaaaagugcccauacaaguuacuugucuuguuuuguuuaguuguuaaagacaaggucucaggccaggcaugguggcacacuccuuuaaucccagcacuugggagguagaggcagguggauuucuaaguucaaggcuagccugguuuacagagugaguuccaggacagccagggcuagacugagaaacccugucucaaacaacuuacccucccucaaagagagagagagagagagagagagagagagagagagagagagagagagagagagaaaggugagaaagacugucuuaggcaaugaagcagaagcaggcugcaugagaacccuguaucaaugugccuccccacucuuguguuugcuauguagguggccccuccccucccccccauuccccgcccuccaccuccagauaacuacauucuuuucccucacaggcaauuuuuacacagaaaaccaagcgcgugucugacccacuggacacucgaugcuggcagggcuuccgucuggaggauuaucugauagggcaagccauuggcaaggguugcaaugccgcuguguaugaagccaccaugcccacgcugccccagcaccuggaaaaggccaaacaccuuggccuuauaggaaagggcccggaugucguccugaagggagcagacggggagcaggcuccagggacucccaccuuucccuuugccaucaagaugauguggaauaucucgguaaggauggacuguccuccuucugagcaggcacgucucaaagagauugucuuuggggacugggggagacuuucacaggcuuuccacaagaaagccuaugggguuaggcuucuccugucuuaugugagcgucugauuuuuucgcaaguucugauggugccgcccaggcuucuguucugugaacuacucugagcagcaacugccuaaaccaccgguuucugagcugacgcuuaguucaucugaggucagccauaaaaccguucacuccuccuuccaugacuggcuucucuggccagggaggagccauggucuucucuauaccccagcaugauccaaagcugucuguccccucucuguggucaguuuugagcugguggugacagaagacaucccugguggcaagcaucaagggcucugaaaucuuggccucuguucauucccagggccacuuaacuaccaagaguucgagguauagcaagcguucucuaagugguaccuuccgccgguuucggggaguagaugguuugggcuugccacguuagagguguuuaucucaccucgauggucaaagccagaucuagguugccaucgucuugguucagaucccacaggucuguuuaaucacacgugcccuguggcuguguuucaggcagguuccuccagcgaagccaucuuaagcaaaaugagccaggagcuggucccggcaagccgcguggcuuuggcuggagaguauggagcaguuacuuacaggugagcacuccuuugcccaccgagcaaucacgugcucuuugagaauaaacgucuccccagcacuacuacgcugcacaguuaucgcgugauguccuguaagaauuuuugauuuguggauaaguuaaacuugugucacaccggcuaauaaugaugcugguggcugauucccaugggugcaggaguaaacaccagccaaagaggcccaguucagaaggcuaggcauuguccuaauucuggcaaagcaguguguggguguagcgccaccuagugguaagccuuugugacugaggcgccaccuagugguucacauguacugucuccacgggcgggaacacuauugacaguggcugagagccugaagugcaaacucccguagcccuaacccuucuacuuauuucuaugacuuucuuagcugccuggcuucgguccuaugugucuauucgauuuuuccagguuucucugguugacaauugguucuguauucuaccucuggugccugugccaaggguacuagcugaaauucugcugggucuccagagacacccccccccccagacgacucauggcucaugcaugcccacuuggccucuguccggaaaccucggacucugcuccuugcugccucucccaccucaggucucgcccuugccugucuguacccuccccacucccgaaagcucaccccgucuuccucagaagccagagcucugacuuucugcauugcucaggcugcagucucugcacacugcagacagaccuaacuuggaccaaaucucccaucuccccacacugccuugaagcuacuaugacaccugccagggugcugccagccuccugcugagguccugacacuccgugucaccauucacccagggcaaggacagugcuacauagugcaaggacccacuccugugacacagaggggcaguacaagaacacacaugaacuaggccccaggacagggcaguuauccucccaaacuuggcucaucacuggggacuccuccacucuccucugcacccuuagcacuggugcuccucucuguggcucuucugguccugcaagccuuugcuuccagucgccuucccuguguccccuaagagaagugaccuaccugccuguuccuuuucccagcagccaucaggaucucagaugaacccaugagcacccugaccuugguuccuaaugcccacuuuugguccagucagcuuuggcagagaggcagagccacccuguccacagugcuuuguggggcccuggcuguggggcauccugcaggggugaacaagggccaccagguggcagcacuacagcgaacugcaucaguguuggggacucauuugggaaagaggaugcuagucccugugaagggggagaugacuugggcugggucccuguccucagagagcuaaaagaauuacucucguguuggaucucaaagcggcgacucugcucuauacauaguuccagcauuguagcuaaugcuuggcucucugugugaccauaguaaaugcuaacagagcaucagccuugcugagucccugugcugcugagcacgacuguagugcucugugcguaucaaccgccuuguacagagcaucgcugagucuguauuucccacucugcccugagcucagagggaaugaguagcauugcccaaggacugaguguggcagucgccagggucucugagccacuguguuccaccaugugagauggauagaugggccaaagggugggcuagaaugggagaagucaccccuguuggggugcaauagcuggaagagagcagaccugcaguggauauggcaacucugccugaaugggugccugaggugguggccuuagcucgucugcccagcacuugucucugaugcuggccccaucugcuguuccauuugccugaacagaagauccagagauggucccaagcagcuugccccacacccuaacaucauccggguuuuccgcgccuucaccucaucugugccccuccugccgggggcccuggcugacuauccugauaugcugcccccacacuacuacccagaaggccugggccacggucgcacacuguuccucguuaugaagaaguaagugguggugcuugugugggggcggggguaaggaucgugcagcagccucuccugucccaugggagcuggucugugcuuggagcacagggaagaacaaagcacgcagaaaugagagccguguaggagagagcuggguuagaaugaaugauagaucaucucaucuuccagaaugugcgcuuggcaccuugguagcuccucccucuauggcguccucuuucagugccagcuaacuucagagacggcgcugaggaguuggggagugacacuggcauggcuucugagauuuggggucaggguggaugagaucugaaaggaugccugggaauaaagauaggagaaacuccagaaggggaaaggcccaguccuagcacggaaggaggccauggaaauugugauccccagacauucuguccccuccugccagcuaccccuguacccugcgccaguaccuugaggagcagacucccaguucucgccuggcuaccaugaugaccuugcaguugcuggagggcguggaccaucugguucagcagggcauugcccaucgggaucucaaguccgacaacauccuuguggagugggacucagguagcugcuggccagagccacagugcucuggacacacccagagugcuccaagaaggggcauuagagacccugagggcaguguguguguguacaugugacaugcacaugucgaggccaaagguuggggccuggccccugucuccuucucucucccuuauguuuuuagaaagggucauucacugagccuggcgcucacuguuucaguaaggcuagcugcccaccaaggcccugggaucucucuccaucacccuagugcugagguuauagcuuugacaugggugguggggauccaaguagguccucacuacucuaaccacugagcaaucuccccagcccucugaauauucuguacugccuucuuuagcucuacuucaagagaggacuccccuccaucucauggguaagauaggcaacagcccucuuacaguuccuggggucuucucuguggcccccuugcagaacaauaccaucuguccuguaguuuuugaaccagugagagguaggagagguagccagauuguggcucagugaaagcugcccacacaaaccccuggcuucuccaucacuggcaacaugcagugagcaugcaaugagaagcccugccugggauguucuagaggauugccgggcuggagagauggcuccgugcuuaagugcuccucucuucuggauggccugaguuugguucccagcacccagguggaaacgcacagcugccucuaacuccagcuccagaagaucuggcgcccucuucuggccucuccgggcaccaacacacauagauaaaaauaaaacagaucuuuuuuuuuccagaccugaggaacugaacccagggccuugcgcucuaccacugagcuaaauccccaaccccaaaacaaaucuuuuuaaaaauuaaacuuaaaauaauuaaaugugucacuagaaagcuuucuuaggaacuccaggagccuuucucucccaagguccauuuguuagauuauuggcauuacaaacucaaauguaagacuccuagaauauaaagacccuuggggaccauuuugccaaggaugaagucucugagcuguaucuagucuaguucauccuuaccuuggugguagcgucuggaggggaucugggaggggcugucaggaguacaggccgacugcaccgcucaccuuggccgccucucugcagauggcugucccuggcuagugaucucagacuuuggcugcugccuggcugaccagcauguuggccugcggcugccuuucaacagcuccaguguagagcgugguggcaauggcucccugauggccccugaggugaguccugccugcuguguuuguguccugccagcagggggcauuuccuaaacguucccaauaagcgacugcccccacuuucacugggcuggccugagguccccgggaggucugucugcaucaauggguggcuguggcagaugucucccggcuucaugccucccugugaugcauuuacaugcaggguucagauuugaucccagcuuaggcugugcaugaacacaaaagaugggcccaguggggccugaccucucuuucugcuucccgcagguguccacagcccauucuggccccagugcgguaauugacuacagcaaagccgauaccugggcugugggggccaucgccuaugaaaucuuugggcuugccaaucccuucuauggccaaggcagugcccaccucgagagccgcagcuaccaggaagcucagcugccugagaugccugagucggugccuccagaggcaagacggcuggugaggucacugcuccagcgagaggccagcaaggugaggcuguucccaagcucuggccucugggugagggccucugcucaugucugagucaaggcugaguuuaggcaaguucuacaguguuaaacagagccugucauauacaggcaaaggccagcuacagaacaggguagguuugagaauaaacagggcaggaagcuggccaguuagcccugaaucagaggccuagcaucguagccucuggguccuuuugggucccuuucacucccuguucauggggcuuuggcaugccgggccaugucacccgugcuucccaguccucuugacuuuggcuauauuggaguugcuuagaaggauggccuggcaagauggcucagcagguaaaggggcuugccacaccugacaaccggaguucaaaaccugggacccacaugaaggcaaaaggagagugcugaccucaccaaguuauccucugaccuccacacacacaucggauagauccaacaagaaugaaaaaaccuuagggccggcgagauagcucggcggauaaagacacuugcugcugaguuugauccccacgacccacacaggaaggagagagccaacuccugcagccucccgcccccuagauaaauaaauguaacuagaauauuuuguuuaaaggagacuggcuuggaaagaaaaggauguguuuuugagaaacauguagcaaagaugcagcaguggaaggaguacuccucucagcccagcaggagcccagaggccaguuggccugagccagacuugcaagggcaggucugguaaggguggcuccuuagaaaacccugagaugggccuggcuucagccuauuguucugcagccuccucaccccucacuguucacaccccucacuguucacacucucacuguucacacuccuguuuauaccucucacuauucacaccccucacuguucacucacucuucacauccuacuguucacacaccucauuguucacaccccuugcucuucacacucauuguucacaccccuugcucuucacacccuuacuucauagcggcugcucagcaacuacaucaggugcaaaggcuuuuugccgcagugcuagagaucagagcaguguaugggaccccuucaugacagaggugucccagcaaagccaacaugggcaagguccugggcuugguuaggggguagcugagggaagauaggaggaagaaucaaauuggggcaggccugagauggcacucccucggcugcaguguggacuaugugcuuugugcaggcauucugacggccccuuccguugcuuugcagagaccgucugcacgcuuagcugcaaaugugcugcacuuaagccucuggggcgagcaucuucuagcccugaagaaccugaaauuggacaagaugaucgccuggcucuugcagcagucagcagccacucugcuggcugacaggcugagagagaagagcugcguggagacaaagcugcagaugcuguuucuggcuaaccuggagugugaggcucucugccaggcagcccuccuccucucuuccuggagggcagccccaugauggcucugugcuccaguuacuaaaagacuaaggggcaucuguguccugaugucaugacaguauacgaaggcugaagaagguggcuuggcugggugggcaggagucaggggacaagcuggaguagagggaggggcuggucagccuugggcucagcaaaugggaagaacagccuugaacagcucaggagggagagaggcacuaccugugcccguccaguuagguucuugggcagaauuaagacaucaggccagaccaggaguugguaagcuauagagggccagacagggaaugaaguaguuguaaugacuaaccuaucacugaggcaaaggccaagcaagcacugcagugaggccaacacugaacuuugcuugucgucaauaaguucugcucauuuuucccaaccacuuagaaaugcaaaaacauagguuuaauuuguaagcagcaaccagcauggcucauagucaaauuuaccaauuccugggcuaaaugcauucuuuaugucuaacucuuuaaagaugcgagcauuaaagacagucuccaugccaaaga

SEQ ID NO: 2213 - RNA, 5186 nt, Mus musculus
cgucgcuuagcuuccagggaucucuccccgaggcccacggguccccuccucccucccuccucuggcgccucgcuuucagccugggcuggcauucucccuagcagcucgcaggcugcuccuucgucccugccucccucuguccccccucucuccuccuuccuucuccgacccucuauuuuucccucuuucgcuucuccgcucugccucuccgauccaaaucuagucuccccccuuuucuuuuucucccuccuuccucacccucccuccucccgccgcuccccuugccuucuucugucuuucuguuuuucuccccgucgcccucucgguuucuucccucccucccucccucccuccggguuuccucccccugcccucccuccuuuuugcuccccucccccucggccgcucgcugcuucacaguccccgagucgccgccgcugccgccgcccgcauccgcggcaggacuggcccgcgcgcuccccggggugcgcccaccucggucccgcgcccuccgggcucgcagggacacccuccuccccgcgcgucgcggccccgcccggcucggcccccgccccgcgcccgagagcgccgaggaugugaguccugcccgccgcugccggagcagcagccacucgcgcgcggagcccgagcgcagcgcagcucagcugcgggcgcucguugggucgcucgcgcgggcugcgcgcuccugccccaagcggugucccuccccggccucucgccggccccagcgccgcggcagccccgagggccguccccggccggccauccccggccccagcgccgcugacccuguccuccgcgggcggggacgcgggcggaggaggugccgccucggagcccccggacgcgaccaugucggaggugcugcccuacggcgacgagaagcugagccccuacggcgacggcggcgacgugggccagaucuucucgugccgccugcaggacaccaacaacuucuucggggcugggcagagcaagcggccucccaagcugggccagaucggccggagcaagcgcggugaguuccccgccccuuacccccugcggugcuggugcugcagccuggcuggggcucagggguccccgcgguaguaggaggaccaucugcgagaucuagggaucccuccugcggcggaagcuggaucaggccucgggcaagaguccccgcuuguccgggccaccagcggggucacccgggggcgugguagccucuacuugcugccgaggcccaaagguuauacccgcguccucaaccgcaccaaaguuugcuuuuagguuucacaccccucccccuuuuugcgcaguggagucgcaucugcacucucucugcucggccacccugggguaagggguccuggagcuucuuaggggucugcguggggcgcugcaggggaaggaccuuaacucccgcggggaagggcgaggagcauucaggucgcacuggcuuuucacuguuacuuggcagaggggagaaggguggucuagccugagauauuggaguuggagaagccccagggaaaccgagacucagggugcugccggaaaagacugggguggcgaggugaaguggggagauggucgggagaccgaggugggcugagagcuaaagcgagggagcuguaagggagccugggacucaagucuagggaggacgcugaagugcuggaacaaugagggugacagacaaggagaccuacggguagagacccagaguucuggacaggugaucugaucauccaguacagggaccgguggagggacugagagaggccaguggaggcagugaggcaggcggaagaggcaacugaagguaaagccccaggcggcagcgaagggagguucugcccuuugcgguggcacagagagcggaggggcggaggcuacagaccggggaacggggaagggagaacgggagggggacacccguucaggccaggccuaaacuuugcagccgcugaucggcgugggaaccuaccccagcuuuccuuccugcuccgggcaucuuugaacccggccugggcuaccgccaccagugaucugaagaccucaguuucccuuucucuccuuaagaaucagccuaggagacuucuuuguaaaggguugcaucggguugcagucgagcugggauggcucccucuggcuugcuccuucuuagaauccaucuaggaugagggcuaggcaguggggcaguucagaaccaggcagggaagggagccuagggcaauggggcuguucacccugcuuggaacagccagccuuccuuccucgcccuccccugcaccuccauaauggggauagacaaaguaucugcgaccccuggcuagcccaagcucucucacauuucucuuccccuccccccccuuuuuuuuuuuuuuuuuuugcaguuguuauugaagaugauaggauugaugacgugcugaaaaccaugaccgacaaggcacccccuggugucuaacugccccaaagacaauguguugagggaaagaauaagaagaguggcgggcugugacaguuacugacaaaaagcacgaggaggaggaggagggagaaagcacuuugaaauuuauuaauagcuugcuaccugcgaugaaaucgacaacuugugucucaagucaggccgggagacagaugagguggagaggaggaggaggaggaagaggaggagguggaggugguggaggugguggugguggugguagcagcgguagcgguggcucugggcuccucuacaaaaacaaaaguuaaaaaaaaacacacaaaaaguaaaaaaauaaaauaaaaaaaauaaaaaucacuauauacacacauauaaaagaaaaaagucucaguugcagcuauuugucaagauuaauaccuguuucuuuuuauauaugguaaauauugugcaauuauagcucuggaguuugaaccacuucccgaaagcagcaccgaccacgugaaggugcuugccuucucugcugauuuggcuguucccaauguuuacauaauuucaucugugcacuuggaugugacaugcggucuaguccaguuuuuuuuuuuuaauguuguuuauucuuggauguacaaaagaaaauugggggcaggggaaugaccucuguagauacuguuguacuugggucaucuuugaaugaaccccauuuuaaagcagaaaguaacuuuucuacggacugaugcuuugggaaggccccuuccuggucuuguuuucgagagacaacugaaaagcuugcgcuucuuuguugcaguacagcucuuugcccagguuaacaccaacaguggguuuuauaugucagaaagaagaagaagaaaaacaaagacaaacuugcuugagcuuuuucuagccucccugggggcucuguugagugaaccccucuuucuucuucaauauugugucacuuuauccauucucuuuaauggacuguaaaaaaaaaacaaaaacaaacaacaaauguaaucacaagagugccaaauaucuugaaccgccaaaaggcauuuugguuuccuuuuguccccugugcucugaguccugugugggaacacuuggagagucuuuucuguuauuuauagggguucucuuaaggcucgccagcugccuguuuugcaugguauuugcaaaaaaaugccucuugcgugaggaaucuuuuaccuuuuuuuuuuuguucuuuuaaauuauuuguuugcaacuuuggaccucaagagguccccaccccucccaguuccuucuuuucuuaauucucuauucuguauguugcaccuugaaccagcacacagggcuauuucuccaguguacaauaaagaacucuuccugugucuacucuuucguuagccuuguuucucagggacuggaauacagagaugguggcuuuggccuguaggaugaaacaguuugugugcguuguugggggguuaucagccagugggcuggaugggucaggcuauccccuaagaauggcagagucaguggacuuugaauuuugcaaauggcuccuucuggauucccugaggcuugcuugggccauccuguuggguugggaggccgccaguccuguggagacugaagcugggagacuggacuuggguucagguucuagcucugacugccuuacucucggaacuggaacuucuguaaacaucaccugccugaucugcagagaccgaugaacucagcugcugccucuuagggucaagaagaggaguaucaauccucggcacaccagaaccuuccacauugggccgccgcuagcauccacuaaacauccaacccgagacccaguuauggacauacgugucucuaccacuagagccuacuguuacaugcuugaggaugagucuguucucuggggaugcauggggggggggggaagucccaaaaguuuccaagcaccugcuguaccugccucuaaucacccauuaggaaaagucuguugggcaggguggggagguagcuccaguucucuuuaaacuggaggcagugaugagggguucagguucuguagggagaggacuugggaggagggguuuuggcucaaggaagagguccuguguccccaccuccuugccuccuaccccucccccaacccuugggauguuuugcauguagaaaccccacugccuggagcuuuuaauguguuuguuuuaaagcugucagccagggagucacaacacagcucacagugacaggagcuugaguaugacucagacaucagguaagaguccccacggggugggguggggggacugcagaagaggagcuccagggggccccagggaaaggagggcaaaugucuuaucccccuucuuaagucugacagccucagcaggucccagccugggguucuucauccuguggucauuacugggacugaugggggagcuggaacuggcagugcccagccugcggaugcaagcggaugccaacuucauuuccccaggcgcacaguccucuucuugaaucuggcugucuucccucuugaccccaggcacucccuuuuggacuugaaggucuauaggcuccauuagagccaagaaaugcaauguacugcuccccuccccagaaggccgaggggguuacugggggaaaggauuagagcuagggccugcuuuuuguucaaauaauaaucugccgagagggacagaggccaggcaagaagguagcuuuagggaugugg

SEQ ID NO: 2214 - RNA, 28604 nt, Mus musculus
aaacaauccaagucaaguuuauugagugggauaguguagagacacucacuggucagaagcaguaaaggggcguugggaggcgggggacauagcaagcugguacaggaaccagucaacuaagcauuuccuaagucugccaucuccuccaagcagagaaaaugucauuugccuugcacaggggaccucuacgcccacccagcacaccccuccucccccaucuugacaugccaucauuuaaaguguaggcaaagcauuaaaugaggaaagacauguucuccaaaugccaacgguucucccgaggcucccuuaggcuggcugugagccuugccagcagcccggucccccguguaaagaguacagcucucuagaucuaggcaggcuaggaagccagcggcagccauguugcagggcucugccacaaugguggaaggucagagcuggacgcuguggagagaaggccacucaugcuuacagcuuuacagagugcuugccuaaaggagagaagaaaaaaaaaagagucagcuaagggcaauaaagacuccaccccugaggggcuaugguaucugugauugacagaugcugccuucauccuauguuucuguuuuucuucuuggguagauucauagguagagccccccagagggaccuccaucacacauucccagacauucccuagugucugccggguguuagucuuguauuacugauaccaucucguguguguguguguguguguguguguguguguguguguguguguguguguguguuucugcucuucuaaaauauaaaguaccuggaaaagcagaguguaccugccuggcuuauugcugcaaagaccguguugucuuuauuaggguaaugagaugccuguucugaaacacgcagaugaggagcacggcagaugggcugagcugugugcguuugccagcucuccacaggaagcucugcaaccaugccaagcucuuuggggauggcagcaucgugaaucgcaucaccgugcccuggcugaagggcuuggcugacccagauaacccguuagcuugaugccugugauucugagcugguuucucauaucaaguuccaggcucucucaaugguuucguuucggggagguuggcaccaaccugugcagagacacgacaaggcaccagaaagauggaaugaugccauugucacaggcuagcauucaaaggccuugcagccuuggggaagaggacagcuggguacugguucucagaucucacuguuucccuggaugcuuccauccaugaccucuauacagcagcccccauguuagacugcaaaccuccccaucuucgaaucucugggucuauauacccuucaaugcacccacuccacccacagacaccucugggcaccugcugugugccuggcacuguuuccugcuggacacacaucaauaagaaaaauggacggcugaucuaauccauggcggagguggcagcuucuaguccucccgauccucccugagugggcaggcugguccuagagggcagggaaccugucuucauuucugggccaguuucuggcucauuaagcgcguggggggacaggugaacaagaaaugacggcaauauaagaugguugcuaaaauaaaaauuaccauuuguacauacuucuuacaggugucaaaacauccugcgaauaaaugacuucgugugauuccucacaaagccccgggagaagcagucgccucgcucugugaauggaaggacgcugaggcuaggagaaauguugacccgcccagcuucuccuucauguuggucccgcccacacagauguaggccacgcccacacagauguaggucacaugacuuuuccauccuaaugcuacauagugucugugccacacaggaauguuuccuuuuuaaaaauaaaauaaagaaaauuuaagagacuauuuuaugcauauggguguuuugccugcauguauacaaguggaccaugggcucgcaguauccucagaagccgaagaagguguuagauuccccuagaauugcaauuauauaagcuuauuaucugccaugcggauuccggaaaucagacccagguccucuacaaaauacaucuugagcuuuuaacugcugauccuucucuccagccccacgauuuuuuuuucuuuaacugaaagagaaaaugaacuggaggagcccagggaagagagagcacccugcgggcugaagcugagccuacaagaauggcuaucucaccuuuucguuacugugauaaauuaugcugacaaaaaccaaccaacuaaccaaacaaaaagaaacucaagggagggaggguguacuugaauuuacaguuccggggcacuacccugccucaugacugggaagacagcaggugaggaaggcaugcagguaggagcgggaggcggggguagucagucauguggugucugaaucugggaagcggaaaguggacaggaaguggggguugggcucuacgggccucaacacucaccccuggugacccacuucucccacaagcuucccaaacggcaccugcagcugaggaccauguguucaaaccaacgagcccugacauuucacagacaaagcacggcagugaccgaagucauggaucaugacguggacuugagaugauccgguuuguccagagguuccugaccugacucccgcuugggcuucccucagagacuuuucuagaaaguccuagaacguguccuugguggccccuucuccuugcgauugacauugaaaggcaaaugcucucugcaaacaggacugacuuccaggaucccauguuggucucugccacaaccugccucucaccgcuccucaccauccuugaaaaauguggacagaaagucaugagaagccagcagcuugguaaccugacccuuaucccgaguguugauggcuuugcucugcccucugugaagguagcauauggacucccucuggaggcugucacagaugcucggggauauuuccugccaccaagugcuuaguugguuuccgacucucaccaaaugagauggaggaugcuuggcaaauacaccagcgucucuuucacauggguuuuccccaacuugauuggaaauuccucgagaacagaucuagucugauucaccguccuguucugugccuggugugcuguguccuuguucagcuuguuagcgcagugaaaacauacaagauuugacucauucgaacccaagcucauuagaacaggccugaauuccaguacuggagaugcugacuugggaguugaguccaggaguucaagaccagccuaagcaauguaaugugguccuguccugucaauuaucgauuaguugaacaagaaccaguguucauauaguucaauaccacauauauuuugcaaaguacaaugcacuacauaaauauggauagagauaaaacagagauugucccugcuuugcauaauaaucaucagauagaaucuaucuuaguuuuaauuuuuaaaacaaacauuauuguuguuuguuuuuuagacagggugucucacucuguagcccugacuguccuggaacucacuauguagaacaggcuggccucaaacucauagauucauuucuuucugccucccuagugcuggauuaaaggguaugcaccaucacacucggcaaaauucaaauuuuauuucauguguaucugaauuuugcuugcauguauguauauggcuauguaugugcacacccuguguguaaugcccuuggagaccagaggaggcuguggaucgcuggaacugaauauggacaauuacaaguugccuuguagguucuaggcaucgaacccagguccucuagaugaacaguaauuuuuuuauuauuaaauuuuauuuuuauguguauaggugcuuugucuacaugugugucuaugcaccaccuguaugacuggugcugucagaagccagaagguccccuugaacuguaguuaccauuguaagccaucauguguauucugggaaucgaacccugauccucuagaauagcagcauguauuccucaccauuaagccaucucuccagucccaggagaagcagugcucuuaacugcugaacacacucucucucucucucucucucucucucucucucucucucucucucucucucucucucccucccucccucccucccucccucccucccucccucccucccucccucccuuccucccuccucuauuuuaguucuaaagagugcauucucugcagacagaagugugugcaguauaaaucugaagauuugggcucaaucccagaaccuaccccagacacacaaacacacacauaaacacacuaaacaaacaaacaaauaacuuuuagaagugucuucaaagacacaauguuaauaaguagcaguagcccaugauacucaaaauuaaguguuuaguuuguauuuucaauuuaggaaaagauaaaucauuaaaagcaauagccuaaguuucugcuagcuuugcucuguagccacuuaaacagcaaagccaagucaaugggaccugaaagcugaggucuuccauucugucucccccuagucugaggcagaagcuugcaagcucaaagucuaccuggaucacaggacuacagagagagccagaguaaaguccuugacugucuuucuggauauuuacccugaagaaauaauuuacacacacacacacacacacacacacacacacacacacacacacacacacacacaccauacguguagaguuuuugcuuugacuucugugguuaaaaacaaaacugggaacacaugaaugcuucauaaagagaaaauaguucagugaugauaagacgccaaggaguugaguauuacucaacuuuaaaauaauuguggguccuuagaaagcugggauuguggacaugcaagcucuugcugggaacacaaauguuaaaaaauauucaugugugucuauuggcaagaaagaagcauacaacguaaguguaaucucugaggauaaaaacaaugugugccgagacaugaaccauggcagucuuugauaagagggguugaggauggcuuucguccccugucaguuuucucaauuuucacauuaccaaaacaacuuaaggugucuuuaaaggacaggcuauaacugccucuuuuuuuggaggggggggucugggaaaauaauguauggugaagaugguacaugcuauagaucugcaucaaguuugauauuuuauaauaaaacuaugacuuuggaaaaaaguaaacauggucuggggguguggccaagugguuagagagagcuugccuggcauguucugagcccugggucugauccccagcuuugaauaaacugggugucauggcucacgugccucuaacccaagcguuugagaaguagagacagaaggaucagaaguucaaggccauccucagcuauguaucaaguucaaggcuacuggaucuaacaugagauccuguaaaaggggagggaauggaagggaggggggagggaaggagggagggagggagggagggagggagggagggagggaaacagugugggcaugucuucugucacaggggacagauaucaauccgaacagugaguuuucagcugauuaccuaaggcccaagacccaaagcccuagaacccuccuugucaacagacagucaugaaaguuaauaaaguaagaggcuuguuaggucacuagacccucuggagaagacucggguuccaaaucagcaucugggauuuaaaugaaggaaaugaacggcaucaggggagggaggaacagaggagccagggagccaguacgaugcuuccuuggagcaggugucuuccgaagcaagcuuggucaggaaucacagcccuggaggagguggcaauuagcauuaacucugccuaaccuggaccagugagucagggaccugugaaggcgcaccuguccucagcaaguggaguuaauagccuuguuugccuccacgcauuguguccauaaacacguuguuucuucccuucguaggagugccacagaugcccagggcuaucccccugccuauuguggauuuuagcgcucuuguuugucuuuacaagaccugcacaucggaaauauuggucaggccaacucaaggacaucccagccucucaaccacacccuuuuucuuuucuuuccaaagagaagaaauuggguacccuaaaucugaccggcucccaggagcccaggccacccccacucccaucccuugccuaauuacucucuacuuccuggaguugaucuuccaucuuccaccccagcccccuagucuauucagccaccagccagagagucccuccagucagggcaggcugaaucagugggggcugaauuucacccaccagugugugucucaguggauguucagcccucuaggagagaaucuaaguguccagaaauaccuugguuugcucuucuguguugacuauucaggggagcagaugccuccagaacauuugaauguacaggaagacaaaaggacaucagagugggcugggagggacaucccuaagcaaggaaguggggacagaaaggaaaacaucugaucuuauuuuuuuuauaaugggaacuacugacuugcaugcucguaacugacucaccaaaaguccguccugcuuccauugccugggccuccacagugggucuaagccucuauggugugaccuggcuguuuuggugcagcgauuaagcuguaguguaggcuuaacugucgcuacacuauugcgauguguggucguggaugaagaaaacagauagcuguguuugaucaaaacacuuccaagcugaugucaagccaaaagcccauccaggagucugcuuagaaagcggagcaauggaccccaucacacgaaaggcuccucugaaagauacaucaaacaaccaagaaacugagaguuuguucaucccagccuaguucucccugcaucuacuugugcaaggcuagggaucugcccuccucaggucaccgguaauggcccgcaaucuuguucccaggcugucucuuugacagggaccacccuggccugacuguuggccacauccccgggugcagucaggguaagggcugugucagagcugacugccaucuguuaaugcauuuuauuuauuuuuuuggauucgaggugaugagucaccugcuucuccugcucuugcugcugccgagggugaugcaguuauugucuuuaccggaagauaugcugggaucgcgcauccucugcuaacucugcgcccaugaugagcagucauuccagugccaccacaggaaaaguggaggugauaugguugguaguggcaggaaggagacaaagauacagggggacauagugugaccccugccccuacucugggccggucagauacagcugagccacugaacaaccuaagagggagugcucaguugugguuuguacucccuugcuaauagucucuugggaugucuugguuagcauuuuguugcugugaagagauaccaugaacaaggcaacucguauaaaggaaaauauuugauuggggcugacuuacaguuucggguucaguccaugagcaucauggagggcgggggggggggcaagcauggcaacauccaggcacauguggugcuggaggaagaguugagaguucuacaucuugaucugcaggcagccaggaagucuuccacacugggugaaggccugagcauagcaggccucagaguccaccuacacagugacacuccuccuccaacgaggccacaccuccuucaauaaagccacaccuccuaauagugccacucccuauggccacauauuuaaaccaccccauggggguugcucaugccgaccacuauauuguacuaggggagaacucucagaugacuacugguucaacaaacaaugaaggucugugaucacaaacugaggaagaacaaccaaccaaaggccaccacgaugaauguacaaccaggcagguaccacuagaccagagcaucccugaugacacaggggaguuggaggggacucuuccccagcuaccuccuaggucagaagcagaggcacuuuucuuuuuuuuuuuuuuuuuuuugguuuugguuuugguuuuugguuuuuggagacaggguuucucuguguagcccuggcuguccuggaacucacuauguagaccagccuggccucgaacucagaaauccgacugccucugccucccaagugcugggauuaaaggcgugugccaccacugcccagcgcagaggcacuucugagggggcuuccaagguuggauucuguguggugugugguguguguguguguguguguguguguguguagccuugacuacaauggcuugcgggauacucaguuucccagggagacaccugaagaugagauucaugugugugguguguguguguguguguguguguguguguguguguguguguguguguguguagccuugacuacaauggcuugcgggauacucaguuucccagggagacaccugaagaugagauucaugugugugguguguguguguguguguguguguguguguguguguguguguguguagccuugacuacaauggcuugcgggauacucaguuucccagggagacaccugaagaugagauucaugugcgcucugcgcacuccugucuggguggcucaagucucaggcuaaaacaugagauuggacgccuucacacaggcuuucacacaaaucaguuuuuauugcucguaucauuaucuuuuguccaagaagaaaaaaaaagagaggugauuacgauggcucaaaucuagcuuuaaucaugucuccuggaagauccuaaaacaguccuaugcuuugugccucucccuuucuuugccccaccacccccaaauacuaagccaaauagcagcagcaaaccccuaaauccaggagcuccucccuccacuaagcauauucuaaagcuucgaaucaccaaguugugcguguguggguggaguuuuauuccuaccauagaguaggugugugauuuuuuuauaggcuccuaccuagaucaagggcagaauuguacacuuggggguaaguggaaugccuguacuggaggguccaaguucaagcuaccagucccuucugucguggucacugguggaggagguggccaguugcaugggccugccaccucaaagucaaguuccagcugaccuuugccaucaaaggagccacuaaccuaggcaggacuguaaaucuugcaaauguucaggaaauguccuaguccagagugaucugugugaugugggaggugucugggguaggaugacacuguugagagucaucacugcugucaccaaggcauagugugcuagaaggaacacccauaacugcugguggugucccgugcacaaaaugccccuguuacugagguagugacacuuugagaugcuccaacaacuccuaaacccugccuugucuggguacugaggguaugggaggcauguaccagucaguacccaggacaugugguacucaggcuccaagggggacaaagugcccagaaggucucaguguuccugacuccaaauggggauuuggccgucaagggacacagaugacuugugggugucuggcugaaccugcaauaugagagagcuuuggcaaaugaucuguauccccagaaaaacaagacucuacagugcuugugacagcucuggcuaaggcgggaaggggcauuccacgccagugagccggcugcacagcaugacagggacacagggaagaagccccaacgagcugccuuccuucuccuacggaggcccugacaccagagcccacuuuggggucacuggccuuccacauuugacaagguugagagagacgcugaggcugggagauaaaauaauuuaccugugcucaaguaggccaaggggugguuaguaaaaaauugugcagaagcguagcugugugcaucuuaaaaacagggugcugcguaguuuacuuccauuuuggaaggauccugcacauagacaggugauaccaaagaagcuccaaccgucaguccacucaaaagcagcccuggcugguccauggcuggagaggccauuucuaugggccucuagcucuaagguguuucagagaugugugcugagggauuugcgacagcagaagauagcucuucccuuugcugccaccucauaccaacagggacccucgugggucucugcuggugcagcuugggagggaggcugcguccaaacacagcauugcaagaaaugccagcgccagugccguggucccuaagcccccacuuguuuacuagacgggaauccucucugggaagaguuuaaccuggugucaaguauagaaaggccaaguauuggcuuugagagacccagaguucacugcacugacagaagauucuggaaggagccagcaguggaaaguagauuauccuggccgcagccacagucuagggauggauguagaacuuccucauggcugccggagagaauguggggcuacaacguaguuuucuagagaggucucuuccuguguguggauucauccccaccgccacagacuugcuauacgaacaaggcccuaggggucuuggcugaccugggcucucguggcaccugaaaccaagguugcguuggaggcuucagguugcccaacguucguucucuuugcucaaagaccuggggccccucggccuggugcggagggcucagggccacgccucccccuccuccugcgagaugcccaacacggauuuaugaaggaugccgcauuccuggagggacuuggugaggucggagaaccgucuccugggcacuuccaucgucucaaugcugcaguguugguagguggcuuuguuuuucugcucggccaccucgaggacggucuggaggucgucacugggccugaaauagcgcacgaaccuuuggccugagggugaccggacagccagcagcagccuuggcucuucguccgacggcuccucgauguuggaggcccuggaggagcucugucuuuugguucggaugaugaacuucuucucuaaggcacagaccugcguucuggagucuuccuggcuugaauccucuugguaaagggccuggacgcugcucagcugcagggaacuggucuugcuggccacaguguccacggcucccaccucuaagcuccuccuguugauggaugggaggaccggguaccuguugagagaugaggcgguccgugucggugccugcugcagcagcaacuccggcaucucgucaggagcucccugagauguugagaccguugcacagacuccugguuucugguugcugggagacccggaggaccgugguggaggugaagaggauagugcacugggggagccgucccccaugccuuguggucugugcaaauucggccgcuuccggcccuuggcagacuugggccugauaacgugcauccugagugagcugggcugccagguggagcugucgccugcggugcugaccacagugcugcguucagguggugcaaaguucacaggggcuucuauggccauugcuucucaggaccccuaaggaggcaggcagaaacagagaaggcauggguugagcuucccgaggcacuggggcucccucuucugccaugugcucacuggaagagugagcacccauggaccacagugugggaccuaccucuaguuuucugacaugggggagcaaccguggcucauccaugauaagcucuugggacacacaucagugauccaaaguccuuggaacuuaaauccuuaaggggagugaaagccacgggucugcagauguuuucaaggaaugguaaguacuaugaagaaaagaaaagccaauucucgcugucauggagaagggccuacacgcagaaaggccagucggagggggaacgagccaugugacaagcuggaguaugugacaagcuggagucacggucaggcauccauggaugcuuuuguuuguucugacuacugcacugggacauaaccaguauggucacacacucaagagagugcacugugcucugguaacaucugauugggcccaacccagaaaagcguccaggggacagaagggccccaccggggaaguccuacaucaggcaaaaugugcccggcuccagaguccuuucuggcucccugggcuggaagcucccuaagggaguggcucaacacagaccucagaugcagaugaagaaugucagaggcagacuguauuugcuuagagaggggaaggcaacccugcuaagacucucugcagggcaaccaggcucagcucuacucaauagcaggucacuucuccagacaagggacacagucugucugcagugacaucacucacuauagacacaccacccucugggauucccacccagcccuccugccaugggcugccuacacuuugcccuuacacacaggucacauggaacaaggcuccccagucuggucacagcaagccuccucaggaagaccuagagagcaucuauuuugacuuuucugucuguacuguccauagacaccugcuuuagaacauuucccuaaggcgcuaguuguggcucuuccuucuccuacuuaguguuaaacagcugggagauggcagcccccaaaugugcccuguccacugcacagaacggucaggaggcugacuucagagcucccccguccccgcccccucccaugcaguugccucaagacaacaaaacauuucuuggguugauccgucccuuccaccuacgcacugucacucaccuaagaguugacuucccccaagcuccuccaucaagcagcccucaggagcacuaguccagguucgugggcuuaggugugaccccugcccccagaugcucuguguguucucuccuguacuagaccaccaggaaccaggccacagggaaccaaaacauacuauuucuacgaauccaggggagccugcuguucaaaaucucugaccagguucccuuccguuuucacguuuuaauccucuuuauccauguguccugugugucuguguguuuugcauguuuggggguacauguguaggcagguacacaugcacagauagaggccaagguuugaugugaguagaaaucagccuccauggcucuuaugccuuauucacugaggcaggaccucucaaucaaacccagagcucauccauauggcuagucuugcuagacuggggauccugucucugccuucuggggcuggaguuauaggugagcuggcacacucacccagcacuuucauggauugugggaauccaaauucuggaccuugggcaaaugcuauccccacugagccgucaccucccucccucccucccuccuucccucccucucacccuuccccccccucucucccacacacacaccccacacacacacccgguuaacgggugaaaaggcucuguggcuaucccugcucuacacagccaaaccuuccuccauucucccccucuguucuccaugcccaaucuggaggcagguaguucagaaacuucuuccugagcgaaaaguuuugacgccagaaaugccugccccuucccuugcucauuuauuuucugaucaaccauaaaguuuuuuuucccuaugaguuucucguucggaguggcaggagaaagccauagcuguccagcugaggcgaggauaagccucuagcugagcuuccauccuucucacuugggaauggcuauuaauuugccacagcuuccacagaauuaucacaggcuuggcuuccaacacccacacaugccuggggaagguuuggcugucaggaaguuugguaacuuagaaaccucucccuaacaacuucgaugagaaaagucaugcguucucccaggcacucugcgggguuauuuuuaacagucaaacuugagugugugcgugucguugcuauaccuuuugguacucuguauaauuagccguguucagggggugucauauucaagacacccuggucauaagauaacaugacuugcaagcuaucucaagagaaaaaccucaauuaugacuaauucucauaagcccacucaaggcuauuucgagacuaacaccuccuucagguaaagccguuacacccaaccugcuuuuauaacccaccgccuccuacccagcacagagaccaucuguuacacagagggaacaccagcucccacccccacccagaaggagggcaggaugcuacaggaaacagguguuuggagaacggcagccauggcgccuucagagauacacacacacacacccugggucccaaacucuaccuuugcccucugucuaggcuccugcgacagcacaaucccugcauggcucauuuauuucaucaccucuagggccuggcagacacucaacuacaaagugauuugacaacgucuaggcguaggcauccaucacgcugccagcagaagagacaaguagccuguuuacuuaaacacaauagcuaggaggcagacgccugcuaggaagcaggaaacaaaacacgggccacuauuuucaagauguugcccuccagaagggcaggugcccauuccuuaggauuaucaccacacgaacaggaaggaagggacauuggauacaaaugaaaucaagauucccgugguuuuccaauggugcccacaagccaccauagggucagaccaugguacuucacagcccaaaucuaaaccuacagcgcaagcagcaaaauacacccuccuacgaaccaucugcuggcauauaccgggacauguacacgugcauuggucuuuuaaaauuguuuaucaguuacuaccacccacugccgccaccccauaguccccagccuggcuuacaaaauuaaacucuguaaaggaaccaaccccgggggauggagggggagagagggagagagagaggaucgaaaccacucgcuaugcuaccccaaaccagagauuacaaugugggaaaccacaagccaccaagugagugaagagagagaaccgggguugauuccaggauagaagggcgggcgaggggguuggggagaggccucuauuauuuccguggucuggcaggucuggaagcaaagcuucaagugcagaaggaagaggaguguuccgggaauggcagaaaggucuggaacgugaaugcagaccuggguaaagggcacuuggagcugugggaggcucccugcagcuccugccucugcacaugaccccgacucccuucucucucuuuggaucuggguccagggacuggcuuguagacgccccucccaggagauucccuuagcugcugcagacucaggcuccagccagguuggcucugucccuggggagggccacucaaaugccugccucucaguuucuggggacccacagcgggccucucaccucgcagcucagcuccauccgccuccggugccuggcugcgaccagcugguaaacagcccugucucccuggcaaccgccaaggggugggggccacgugcuuccggugggaccggaaccugccugaccuggaccgcaagcugaauuggacuagggcacggagggcggaggggcagaggugguucacggauuccaggcucaggaccuugguguggcccugccccauggaggccacagggcccugggccuggaccccugccauuggaacucuucuuccugaccuggccugacucuugugucuccuggggaaugugcguucaggggagagggagcccugcccuggagucggggguagggaccaggaacaaaucccugucaauccuuggccugacuuugccaguguccuuguuuuaaacaggguugugcaacuguuuuaaaacgagacccuuagaaucuggguggugauuuuuuuaggguauguugucauggggguucccacccccaggccaccagucuugugaucaccaccuguaucuccuauuuccuccuuaagggucuaacuauauacagucagcaacuccagccacuucaccgcguuucccaacagcuuugaguuuuggaggccggcagccugacugcuuucucagaagcuaugguccacuaccucagccauucuguugguaagaguccuccuggcccuacugucaucccaucagugugauggaugccuuagcuggaaucuguccaacccacaccgagccaugacaugucacacacaugagacccucugcccucccuggccagccuucuguuuccugcccucuccaauagcuauuucaaauccuaucuguccucuaaaaaccucccacaugccgucuuccuuccucccucccugugggaugacagucuccugcccucugcaaaggaaaauagaaaccauugaaugugaaccuucuuaguugucugcugucagaccagagggcucccagccuuugcacgauugcucucuugccucuggucuguuagaauggucaucugaucccaucccuguuagcugucucugaggugcuucccaaccacagccacacacacgcacacacgcacacacacgcgcgcgcgcacacacacacauacacacacacacacacauacacacacacucucccccucccuaggcccaauauccuugcuucuguugaaaccuugacuuaaaugaagacucuucccuaguuuagccugucccuucacuugcccaauuccucccugucuuuguuccaaucuaaucaacucuuccuuccaagcuggcauuaagaugacuuuaaagcugagaagugacagcgcauuccuuuaaucccgacacucaggaggaagagguaggcggaucucugaguucaaggccagccuggucuacagagcaaguucaagaacagucaugacuacauagggagacccugucucaaaaacaaaacaaaacaaacaaacaagaaaaaaaaaacugcuuuaaaaggagucccguuggacucugcucuagacagacccuuagaguaauuuagugauugaacuaguagaaguuaacuaauagacaguuaagaaccacagauucacuaccuaacuucauggccacaucuuuguuaccugcuucaugcagggauaggauuuugauaugagcagaguucuaaggccuugucagcacauccacaguuggguuggaaagacacauugcucauggauagaauuguaaagaauaccguuuucaguaaaguuugagccaagggaaggagagccuguuggaugcgaucauguaugcugugcuuggugccacuggcacuuuccuugagagcuggcauggaggaguucauuucagugaugggcuguuagcccaucucagagaggaagcugcugaccccgggagagcaccuggccguggagcggagccugcacuaggcuggccuccuuucugggaguucugucuucagauaucccagaggcaucuguggccccaggaagguacagcuggcaccuucagaagcugguugcuuugcgucguaagaguugcugacuuacaucuuguuaaugaaucugucagaagucuccagcccuucagcgcccacucggaaaagauuaaaguagauccugcaucagcuauuuuaacaucaccuaagaauuacgcaguccugugagaagcgagucuguuucaaucccuuguuccccaacgggugugcgagaguggugugcgugcccucgcuggagcaucucgaaaugcugcuuccgcccaugguccauuucauguucagcaacacaugagucuuuguuccucggcauggugugaugcagccccguggggaggaagaggcagccagcuagucccugccuuuaucuccugaccuguaccacagagaggagcuucaaagaauguccccucugaugccugcgcugaacaugcacacacacucacuagcuucucggaagaugguuggaggcuacucuccuccugucugcuuaugagucaacucaucuuucuuuguaccaugccuccacuccccggcucucuccagggcuccagccagcuuguuccccaaaugggccuuugguguuuuccuguccaguauccugcuucucccucuccaaggugacgcuaaacugcuugauucuucaagacccuucuuaaaagccaccuguucugugaaggcuuuucccgagcaacuuugucucccuaauaccucccaauggucuaucuuaggucacuucuguucagugacaacaugcccaagaugcaccauguguguaccuuucucaggucagcuccucagauguccaugaaucuucuccacacagauaccauccauuggggcugcuuugucuuuuaaaaaacaacugaguuugggggccuuuugcuaaugaauaguagaacaauuugggaacuuagcacaaacuggucugacagcccacaguguaccacccccacucuuagguucccaaguggcacuucaucuggacccgccugcugggcuggccaugggacuuguggguguggucucugcgguggaagcagcaguuugaauccuugcuccagcacuuucccaugggacaccuuggucaugccauuaacuucuucccuagccuaguuugcacaucuauagaaugggccuuuuagauggguugcuaugagagaaagugaugucauccauuagcggucuuggccuggcgccuggcacagggcacuacuuuguacuucuuaccugacacucuccuucggguguggugauaacacugccuaagggcaggaacuugcuuguccucccucagucccacgcuuagcccucauaaagccuacuuguggcagaugcccaacaaaugagaaauuguuggugacauugauucugacgaaaagacccacaagcaccccaaggcuaacuaauuuggaauguaaauggccucccuugggacuggcugaaggcaagcccuccagauuuugugguuuggguuggguuuuuuuuuguuugguugguuuuguuuuguuuuuuuguuuguuuguuuguuuuuguuuuuuuccaguuuguucccagagagucuguaggccuauuuugaauuggugacuucuagauuucagucugcagccaguguuuuucucuguugacuuagaucuagauccugucagacccauugauuuagaauacagguagcauuuaagaagaacgagcauaaucuaaucacaaggccaacaggccgcaggcacagcuccuuagaaaucaccuuccugagagauucucaacagagaaguuucuggauaauaaaauggagccaccaaagagacacaguguuccauugcucccugcaucucucuggaacauaaccaagcaugucucgacacauccugucugguuaaagggaauacaucaaacugucacucacuuuggccccauguugaccaagcacuuucacaccaggaaucuagaaucuugcuggcgccauagaagacaaaggucauuggcuccacuucacagacgggaagcucgggguccugcagcuuagguccacugacaggaaauauugggucucugccaacucucuuugacacagacucagaguucaucgcuccccaccacugcugccucuuacacaaagccaaagucagcagcugugcuugggcacaauguuguugacagaagucaaggccccuauggggcucuuggucuaugccugggcucuguuugucuguagucagcuccucgguccuuuggaccuuccuugggaucaucucauuagcuaaggacacaguuggcacuucaguuggaucucauuaccggaacagcacuccaggccccuuuguuugggaagucaccugcugguucaaaagcuuugaguccuuucuuuguagcccaaacccaggccugguuuugucagguucccauggagacagaacuuaauuaguaaagcuuguacagcugucgaaaugaugguuggccaggaacagccuggucaggaccccacagccucucagcauccuucaacguuguaccaaagaaggcagagcagcugggacaccaggugagcucucccagagcucuugccauaggucugacauuuugacauuuuccugggaaaguugaccacagaaugaaaaccuuuccaaagcuuuggaccugccaaguucccaugacuccgauguugugacucuguugugcccucuucgggaccugagacaaucagauguagccugaugccucauggggcugguggcgaacacuuggacugcaaguaagcugugugcugaugguagggccaguccauggagaggcagacgugcacacucuucccccauugccccaguggaagugugccuuauagucuucccaucucauuaugguucuaaugugaauguuacaucuaugugugaguuugguuuuagucccagguguuuuuugucauuugccagcugguccguaccacaaguccaugggaguggacaucuguaagaauuuguuuguucucuccgugucucuguuaucucucuccagccagccauccauuuauccacccauccacacauccaccuauccauacuuccacccauccauauaucuuucuuuuuuuugaaauaggauccuucaaauuugcuagguagucaggggugaccucgaacuucugccccuccugucucuacccuccacaggcugggauucuaagcccaggccaccaugacuagacagaggccaggguuuuguggugugagggaagcacuuugacagcuggaccacauccccggcccuaucccaccucuucgguggagauagacacucugaagcugaugugagucucuagcuguuauaacuaugacacggucgaugguugacauuacucacagagguuuguuccugcgugccaucaggagaaaccgugcuuuagcggggcugaguuuguaacuccgguaccaggagaucaaaggagaaaccgugcaaauggcagaggauguugacagccuuggcuuuccuaaaccacacucccaagauggacgccauauaggccaucuaaaccugggaucgcaggggaugcugacuccucuacagagaaaagaacaggcagugauaguguucgcagagaaagaaagacuccugcagcacucacuguuuucaaacggagcccuucugacaucugggucaaagugacaggaaagggugucacauucagauaucacuagcucuggcaaagaucucuuaaagcccagugcuggggcacccaaaggccuguuuuguaggggguuugucuggcacuguuaaauguuuucagaugcuaaauucucuaccccaagaccugguuucuccugauguggagauucucacauauaacugcuuuuguuguguaaaccuugcccccccccaaguuaucccugguugauuaauagagaugccuacagccugggccuggcagaagggaagggcagagugaagguuccugggcuuggggucucaggcagagaccaugaugagaagagagaagaaggagaaugaagucgcaaugggauagguggauugggagcgugugaccaugagggcuggccagucggaguagcagugacccagguggaauauggcaagugauaucuugguguuauugagagggaaguaggcaaaauagcagaguguguugauaucugcccagcucuagugcuaaggcuuauuaucaauuuaaagguuguugugucuuuuauuugggaacucuauggucuaaguaggguauaaacccuuaacagauauuuaaagacaacaaggggguguggcaaaccccuagaauaauuaucccaacagugguuuguacccacauggccucuuacuuccuccccacacaggagccaaacuggcaaaugaaggugaaauccccgaaccguggaccuccuggucaccucgggaaugaagggcauugccaucuuccuugucuucaucuucuacuguaagugaagccaucugggagggugugggggggggaggcuguaccugugucacaggggaggccccucccggguagcacugagugaagggaggguccaaggcauccaggagagagcaagguucccuccagaguucuccaaccucugguugugccaucggaugugccaggccaucacagagcaccuuggaauccaaaggccacauacugaguuuggcuguggugucggcacucccugccugggaggcuuccuuccuucccggucugguugccuuuauuuaaagcuaugugugcuguggugcagaaacagcaggcaugauucuagccagccgggguuacuuuucuggggaaggcgaccuggcgaugccuugugggauacucaguccaacccagucacugcugccaggguucagcuugcacaccucuccaaagagaccaagggcuuccggggagcugucugaggucugcuuaacaaacaaacaaaacaaaacaaaauccagugucucuuaccgagugccuggguuaacggcugguccaaaaccaguuucgggccaguuucagcaaugccgcaguaccuuugggguucuguaagucagacauaucaaaaucaggucucgaucuuuccccaaguuugccuagugagcucugcagcuuucaaaaucacaccaagcaagguggaggugguaagggccuauaaucucagcacuugggaaguggaggcaggaggauggagaguucaggucaaggcaucuaacucagcacugaggagggagggagcuugagaaaaccuuccugacacccuuacuguucuccuuugaguccaugccuuugcuguauuuguaucgcacaccagagauaagccuguaauuggggaaucuacgggcccagccgguagagugcuugccuaccagacacaaaaacccagguucgauccccagcacugaauagagcccgacagaauggcacacaccuguguuggagguaggggcagcagaguuagaaguucauggucauccguagccacauaggaguugaaagccagauucugugagacucuaaccgccugauucuaccuggagcagaggcugccuggaacgucaaccucucuguugagggucucucaggaagcugauucauaagcagcuuuacauagccauauagucuguuagccuugugacuagauuaugcacgucauuauuauuuauauaccaugaaauauauagcaacaaagguacagccucauuagaaaccaguacauuuuuacaccuggaugcaacagcugcuuuggagacugcacaugcacgcgcacacacacacacacacacacacacacacacacacacacacacaccgucaaaaugcuguagcaaaauaaagcaugugucuuagucacuguccaguugcugugaagagacacuauuccaaggcaacucuuaaaggaaaacauuuagcuggggcuggcauacaguuuuagaguccauuaucauccuggcaggugcuggagaaauagcugagagcaacauccugaucagcaagcaaagagacguagagacuaggcuuggcguggguguuugaaaccucaaagcucaccgccagugacgcacuucccuugacaaggccacaccuacuaauccuucccuaacaguuccauucccuggcgaccaugcauuuaaauauaugagccuguggggccauuuguauucaaaccaccacagcaugcuuaugaagaaagguacauggaauugcaugcaaacugcacguggccugguucuuucucccaucugcuucagucucacugcauggaguucagcuguuagaaaugauauauccccccaagacaugugcuuuggugaccauucuccuguggguggacauaugacauuuccaguguucugaucuuaccacgcugccagcaaacacccuuguauaugcaucucugcguuguugugugagcauuuuguaaaagugaaaaagucuacugaugcaugccugagaaguccagcaccucgaagguuugagacuggucucuauuggguaagacaagacccuguccguuaaaacaaaauaagaauugggucuguguguauuugccauuuuauaggcuggaucaagcguguuuuacuuucucuuaccccuguguucugcuccugugagacucuaacggccugaugcuaccuagaggagggacugacuggaacaucagccucucuguugagggucucucagguagcugacuucuaaggagcugugcacagccaugcgacccguugaccuugugagcagacgaugcaccuucuucuuaaaugcuaccuguacucucagucuagagggccuaacaggaucagugucaacagagaaaacaccggcuacagacuggaaccuguggcuuugaauuuucccaguuaacguuguucagaccuggauggugguagagcaaccccugacagcuggggagccugagccccauccugauuagcaagacacuuucugagugauggaguaacaccaguccuaaauucuuuccuuugaaggaggcugaugucuugggggaggguucugggcuguccgccccucugcaaacacuccagcaaaggccgugggcccucacacucuucuuguuuauuguuuccuccuuggcagggacaaccuccacccucagcaguuucuggcaguuccagaggauggucaaacacgucacagggcgcagcgccuucuucuccuauuacggauauggcugcuacugugggcuugggggcaaagggcucccuguggaugccacagacaggugaugcggaugaccugggccaacccuuauuuuauuugcuuugaaguagaggcuuuacagccaggggagaggguguugggaauccugaagaaacaauuacaggacagcacaagaugaagaagaguugcagggucagucccgaggaagccagagcugagccaccuuccucugugugaccugugacacugccuaggggccuguaugccugggauccuuaguauggcuugugugcuguugccaucuugagacagggucuuaucuuccaacucacguuggcuccuaacuuacuauauaguccagguuggacuugaacucuggacccuccugccucagccacccaaguguucagauuccaggcauaugccacuagguaccgcucaaacccagaaccucaucccugcuggacagagauuaccccaagccccauccugcuagccuccauccaggaccccaguguuacacagucaguccugcccagagcucuggaggccucaccuauuugcuuacaaaggugaucuuuccucaucugcuccauuuuuuuuuagggugaugggcucagugccugcccugccaacucccaaccuaauuccauauuuuaggagagugaagccaaguggcccaguuugaaaaaguuguccaucuggaggcaguuguacgguacaaaguuggcuuccaggacagcucaaaggaucugagggugggcgguguaaacuuuuagaaaaagcgaaagcuacuacaguuuggggaagggcccaguagggagacuggauagugugugucuuuucccauuugaaaaaaccaagaagggaaaugccccuuggcauccuaauagcagggcuuuagcccagcgauucucaaccuucuuaaugcugugacccuugaauacaauuccucaugucgggcugaccccuaaccauaaaauuauaucacuguuacuucauaacucuaauuuuacuucauaacucuaguuuugcuacuauaaguaucugauauggaggauaucugauauauaacgccccccaggggucacgacccacauguugagaaacacuggccuagcauaucacacuugaguccccaggcuuguguguggagccacagaaggccgcuggcacuugugagauguucauuaugguucacugaaccgguggucugcauaugggcuucaacugucacggugaauacaggaggcagcacccccacuguaacacaacucacagcagaggacagagagggucucacacuaagaguugcucagccucccaccccuagggaaagcagcagauccuggcccagaacaaagaucuacccacuccuagguccgccuccuguccuucccacgcccuauaggaggaccaaagguagacucaauccugcacaacauuagcccaggccacagagagccaagagcacauuuauauauggggacagccauaaaaggacaaacgcaucaguaacucaccucugcaacuccagugccuucaggaccagagacgucacccaguguucuuuugcucacugucagggacaccugcacauuggcacagucccucaccucucucuccccaccacuaggugcugcugggcucaugacugcugcuaccacaagcuuaaggaauauggcugccaacccaucuugaaugccuaccaguucaccauugucaaugggacggugaccugugaguagcucucccuccagggaaacaguaugaccugggcugguccuuaacggucaccucguuagcccacugaucaucuuaggaaaugagacuguuccaagugucuugagaucuagaaagcagauggagaggcaggggugagauauauaagucugagagucagagcgucuugcuucuuggagagcccuugcuuuauuuucccugguuucucuugcccaccacugaauuucagcucccaccaggaagccagagcccacccuguguuauggaucaacaaggaguuguugacugccgauucuguugacuuugcaguuucuccaggcagcuguggcugcugagagcauucccccaccccuccauuuuuuucaugugugugguguguggugcacuugucuauauguauaguuugguuugguuuggcuugguuuuuugagacaguguuuuucugugugacccuggcuguccuggaacucuaggcuaggcuggccucaaauucagagaucuuccugccucugccucugccucugccucugccccucugccccucugccccucugccccucugccccucugccccucugccccucugccccucugccccucugccucugccucgagugcugagguuacuggcaugugcuaccaugccuggcgugcauguaugccugagugugugugcaugcauguguguguguguguguguguguguguguguguguguaucgacguauguagcacacauaggugaagacuugagauugagauuagcgauuguccucuaucuuucuucuaccuuauucauugaggcagagucucucagucaaacccucagcugcccgauguggcuaucuuacaguaaggauccuuuaagggcuuggauuagaggcugaccaccgcacccacccaguguuugguuucugugucucugaacucuggucuucccaugugcuuuaaccacugaauuauaccccagccccgacaaugucuucuaucugucacguguuaauaaggcacugugcuuaccuuucaguugaacaaauauuugcuaagggcgacugcaugccaggcacugucaccaauguggguagggacagaaaaguaacuaggcaugaggcacugcccaggagggaagagggagggacuggggcgauaggcacacagaguguccauucaagaggagucuauguccugggccgaggcuuagggcacagugagccacuuccucccaggugucugcacagcuguguuucugggcacacauccaccaccuccaaggucagaggacugccacuugcccccgacucauccccgaggauaggggacuugugacuccauagugcaugcccaguaccccucccagagcuguagcacagcacacaggcagccuaagagaggacugugauuucucccuggcuucaguuaugagauaggaacugugacagucaggaggcucagacccccgcaccacacacacacacacacacacacacacacacacacacacacacacaguaggagauugucuucagcucaggcugccuaauagcccugcacagcuggcagagggaccugaaacauaaagcgagccuuugccgccgaggccuagggcaacccucugcccuuccucugcucccugccggcucaggagggugagguaggacuggaaacuguaccuccgggccuagaacuccaggagaugggaaaaguauaagaaguuauccauugacaggugacagucauagcagauggcacauccguguuuggcaugugcuagcuagugacaggagacagaggcaggaccugggagcuuccccacugcagcccacgagucuugccucaugcuccccagaugagaggccugcccagagcucuggaaaaugaggagacuucccccagacacccccagggcaucagugucacccuccagggagccuagaaccauguggccuggguucugaugucccgccugcugcugcuaaggagugagugacguguagaaacagccuuuguuggauaagcaucuacugccacugugguuccaaagccagacacagagcgaggcaggcccagcuccugcucuccugagaaacuucagagcagaaaaaugcccucggagacuaucccagccaaccucugcuacacaccuggaagucugagccccauggaagggaagggcuugauccgagugagcgaccagcaagaucaagacuugcaugccgggccuccccagugcucugcaccuucuucucuggcuugagccgugugggccucgguuuucucacccucacccaugaggugagagcaguggcuaccccaguguaaagcugacugcgugcuuugcaccccuguccucg

SEQ ID NO: 2215 - RNA, 19260 nt, Mus musculus
gcugaauuggacuagggcacggagggcggaggggcagaggugguucacggauuccaggcucaggaccuugguguggcccugccccauggaggccacagggcccugggccuggaccccugccauuggaacucuucuuccugaccuggccugacucuugugucuccuggggaaugugcguucaggggagagggagcccugcccuggagucggggguagggaccaggaacaaaucccugucaauccuuggccugacuuugccaguguccuuguuuuaaacaggguugugcaacuguuuuaaaacgagacccuuagaaucuggguggugauuuuuuuaggguauguugucauggggguucccacccccaggccaccagucuugugaucaccaccuguaucuccuauuuccuccuuaagggucuaacuauauacagucagcaacuccagccacuucaccgcguuucccaacagcuuugaguuuuggaggccggcagccugacugcuuucucagaagcuaugguccacuaccucagccauucuguugguaagaguccuccuggcccuacugucaucccaucagugugauggaugccuuagcuggaaucuguccaacccacaccgagccaugacaugucacacacaugagacccucugcccucccuggccagccuucuguuuccugcccucuccaauagcuauuucaaauccuaucuguccucuaaaaaccucccacaugccgucuuccuuccucccucccugugggaugacagucuccugcccucugcaaaggaaaauagaaaccauugaaugugaaccuucuuaguugucugcugucagaccagagggcucccagccuuugcacgauugcucucuugccucuggucuguuagaauggucaucugaucccaucccuguuagcugucucugaggugcuucccaaccacagccacacacacgcacacacgcacacacacgcgcgcgcgcacacacacacauacacacacacacacacauacacacacacucucccccucccuaggcccaauauccuugcuucuguugaaaccuugacuuaaaugaagacucuucccuaguuuagccugucccuucacuugcccaauuccucccugucuuuguuccaaucuaaucaacucuuccuuccaagcuggcauuaagaugacuuuaaagcugagaagugacagcgcauuccuuuaaucccgacacucaggaggaagagguaggcggaucucugaguucaaggccagccuggucuacagagcaaguucaagaacagucaugacuacauagggagacccugucucaaaaacaaaacaaaacaaacaaacaagaaaaaaaaaacugcuuuaaaaggagucccguuggacucugcucuagacagacccuuagaguaauuuagugauugaacuaguagaaguuaacuaauagacaguuaagaaccacagauucacuaccuaacuucauggccacaucuuuguuaccugcuucaugcagggauaggauuuugauaugagcagaguucuaaggccuugucagcacauccacaguuggguuggaaagacacauugcucauggauagaauuguaaagaauaccguuuucaguaaaguuugagccaagggaaggagagccuguuggaugcgaucauguaugcugugcuuggugccacuggcacuuuccuugagagcuggcauggaggaguucauuucagugaugggcuguuagcccaucucagagaggaagcugcugaccccgggagagcaccuggccguggagcggagccugcacuaggcuggccuccuuucugggaguucugucuucagauaucccagaggcaucuguggccccaggaagguacagcuggcaccuucagaagcugguugcuuugcgucguaagaguugcugacuuacaucuuguuaaugaaucugucagaagucuccagcccuucagcgcccacucggaaaagauuaaaguagauccugcaucagcuauuuuaacaucaccuaagaauuacgcaguccugugagaagcgagucuguuucaaucccuuguuccccaacgggugugcgagaguggugugcgugcccucgcuggagcaucucgaaaugcugcuuccgcccaugguccauuucauguucagcaacacaugagucuuuguuccucggcauggugugaugcagccccguggggaggaagaggcagccagcuagucccugccuuuaucuccugaccuguaccacagagaggagcuucaaagaauguccccucugaugccugcgcugaacaugcacacacacucacuagcuucucggaagaugguuggaggcuacucuccuccugucugcuuaugagucaacucaucuuucuuuguaccaugccuccacuccccggcucucuccagggcuccagccagcuuguuccccaaaugggccuuugguguuuuccuguccaguauccugcuucucccucuccaaggugacgcuaaacugcuugauucuucaagacccuucuuaaaagccaccuguucugugaaggcuuuucccgagcaacuuugucucccuaauaccucccaauggucuaucuuaggucacuucuguucagugacaacaugcccaagaugcaccauguguguaccuuucucaggucagcuccucagauguccaugaaucuucuccacacagauaccauccauuggggcugcuuugucuuuuaaaaaacaacugaguuugggggccuuuugcuaaugaauaguagaacaauuugggaacuuagcacaaacuggucugacagcccacaguguaccacccccacucuuagguucccaaguggcacuucaucuggacccgccugcugggcuggccaugggacuuguggguguggucucugcgguggaagcagcaguuugaauccuugcuccagcacuuucccaugggacaccuuggucaugccauuaacuucuucccuagccuaguuugcacaucuauagaaugggccuuuuagauggguugcuaugagagaaagugaugucauccauuagcggucuuggccuggcgccuggcacagggcacuacuuuguacuucuuaccugacacucuccuucggguguggugauaacacugccuaagggcaggaacuugcuuguccucccucagucccacgcuuagcccucauaaagccuacuuguggcagaugcccaacaaaugagaaauuguuggugacauugauucugacgaaaagacccacaagcaccccaaggcuaacuaauuuggaauguaaauggccucccuugggacuggcugaaggcaagcccuccagauuuugugguuuggguuggguuuuuuuuuguuugguugguuuuguuuuguuuuuuuguuuguuuguuuguuuuuguuuuuuuccaguuuguucccagagagucuguaggccuauuuugaauuggugacuucuagauuucagucugcagccaguguuuuucucuguugacuuagaucuagauccugucagacccauugauuuagaauacagguagcauuuaagaagaacgagcauaaucuaaucacaaggccaacaggccgcaggcacagcuccuuagaaaucaccuuccugagagauucucaacagagaaguuucuggauaauaaaauggagccaccaaagagacacaguguuccauugcucccugcaucucucuggaacauaaccaagcaugucucgacacauccugucugguuaaagggaauacaucaaacugucacucacuuuggccccauguugaccaagcacuuucacaccaggaaucuagaaucuugcuggcgccauagaagacaaaggucauuggcuccacuucacagacgggaagcucgggguccugcagcuuagguccacugacaggaaauauugggucucugccaacucucuuugacacagacucagaguucaucgcuccccaccacugcugccucuuacacaaagccaaagucagcagcugugcuugggcacaauguuguugacagaagucaaggccccuauggggcucuuggucuaugccugggcucuguuugucuguagucagcuccucgguccuuuggaccuuccuugggaucaucucauuagcuaaggacacaguuggcacuucaguuggaucucauuaccggaacagcacuccaggccccuuuguuugggaagucaccugcugguucaaaagcuuugaguccuuucuuuguagcccaaacccaggccugguuuugucagguucccauggagacagaacuuaauuaguaaagcuuguacagcugucgaaaugaugguuggccaggaacagccuggucaggaccccacagccucucagcauccuucaacguuguaccaaagaaggcagagcagcugggacaccaggugagcucucccagagcucuugccauaggucugacauuuugacauuuuccugggaaaguugaccacagaaugaaaaccuuuccaaagcuuuggaccugccaaguucccaugacuccgauguugugacucuguugugcccucuucgggaccugagacaaucagauguagccugaugccucauggggcugguggcgaacacuuggacugcaaguaagcugugugcugaugguagggccaguccauggagaggcagacgugcacacucuucccccauugccccaguggaagugugccuuauagucuucccaucucauuaugguucuaaugugaauguuacaucuaugugugaguuugguuuuagucccagguguuuuuugucauuugccagcugguccguaccacaaguccaugggaguggacaucuguaagaauuuguuuguucucuccgugucucuguuaucucucuccagccagccauccauuuauccacccauccacacauccaccuauccauacuuccacccauccauauaucuuucuuuuuuuugaaauaggauccuucaaauuugcuagguagucaggggugaccucgaacuucugccccuccugucucuacccuccacaggcugggauucuaagcccaggccaccaugacuagacagaggccaggguuuuguggugugagggaagcacuuugacagcuggaccacauccccggcccuaucccaccucuucgguggagauagacacucugaagcugaugugagucucuagcuguuauaacuaugacacggucgaugguugacauuacucacagagguuuguuccugcgugccaucaggagaaaccgugcuuuagcggggcugaguuuguaacuccgguaccaggagaucaaaggagaaaccgugcaaauggcagaggauguugacagccuuggcuuuccuaaaccacacucccaagauggacgccauauaggccaucuaaaccugggaucgcaggggaugcugacuccucuacagagaaaagaacaggcagugauaguguucgcagagaaagaaagacuccugcagcacucacuguuuucaaacggagcccuucugacaucugggucaaagugacaggaaagggugucacauucagauaucacuagcucuggcaaagaucucuuaaagcccagugcuggggcacccaaaggccuguuuuguaggggguuugucuggcacuguuaaauguuuucagaugcuaaauucucuaccccaagaccugguuucuccugauguggagauucucacauauaacugcuuuuguuguguaaaccuugcccccccccaaguuaucccugguugauuaauagagaugccuacagccugggccuggcagaagggaagggcagagugaagguuccugggcuuggggucucaggcagagaccaugaugagaagagagaagaaggagaaugaagucgcaaugggauagguggauugggagcgugugaccaugagggcuggccagucggaguagcagugacccagguggaauauggcaagugauaucuugguguuauugagagggaaguaggcaaaauagcagaguguguugauaucugcccagcucuagugcuaaggcuuauuaucaauuuaaagguuguugugucuuuuauuugggaacucuauggucuaaguaggguauaaacccuuaacagauauuuaaagacaacaaggggguguggcaaaccccuagaauaauuaucccaacagugguuuguacccacauggccucuuacuuccuccccacacaggagccaaacuggcaaaugaaggugaaauccccgaaccguggaccuccuggucaccucgggaaugaagggcauugccaucuuccuugucuucaucuucuacuguaagugaagccaucugggagggugugggggggggaggcuguaccugugucacaggggaggccccucccggguagcacugagugaagggaggguccaaggcauccaggagagagcaagguucccuccagaguucuccaaccucugguugugccaucggaugugccaggccaucacagagcaccuuggaauccaaaggccacauacugaguuuggcuguggugucggcacucccugccugggaggcuuccuuccuucccggucugguugccuuuauuuaaagcuaugugugcuguggugcagaaacagcaggcaugauucuagccagccgggguuacuuuucuggggaaggcgaccuggcgaugccuugugggauacucaguccaacccagucacugcugccaggguucagcuugcacaccucuccaaagagaccaagggcuuccggggagcugucugaggucugcuuaacaaacaaacaaaacaaaacaaaauccagugucucuuaccgagugccuggguuaacggcugguccaaaaccaguuucgggccaguuucagcaaugccgcaguaccuuugggguucuguaagucagacauaucaaaaucaggucucgaucuuuccccaaguuugccuagugagcucugcagcuuucaaaaucacaccaagcaagguggaggugguaagggccuauaaucucagcacuugggaaguggaggcaggaggauggagaguucaggucaaggcaucuaacucagcacugaggagggagggagcuugagaaaaccuuccugacacccuuacuguucuccuuugaguccaugccuuugcuguauuuguaucgcacaccagagauaagccuguaauuggggaaucuacgggcccagccgguagagugcuugccuaccagacacaaaaacccagguucgauccccagcacugaauagagcccgacagaauggcacacaccuguguuggagguaggggcagcagaguuagaaguucauggucauccguagccacauaggaguugaaagccagauucugugagacucuaaccgccugauucuaccuggagcagaggcugccuggaacgucaaccucucuguugagggucucucaggaagcugauucauaagcagcuuuacauagccauauagucuguuagccuugugacuagauuaugcacgucauuauuauuuauauaccaugaaauauauagcaacaaagguacagccucauuagaaaccaguacauuuuuacaccuggaugcaacagcugcuuuggagacugcacaugcacgcgcacacacacacacacacacacacacacacacacacacacacacaccgucaaaaugcuguagcaaaauaaagcaugugucuuagucacuguccaguugcugugaagagacacuauuccaaggcaacucuuaaaggaaaacauuuagcuggggcuggcauacaguuuuagaguccauuaucauccuggcaggugcuggagaaauagcugagagcaacauccugaucagcaagcaaagagacguagagacuaggcuuggcguggguguuugaaaccucaaagcucaccgccagugacgcacuucccuugacaaggccacaccuacuaauccuucccuaacaguuccauucccuggcgaccaugcauuuaaauauaugagccuguggggccauuuguauucaaaccaccacagcaugcuuaugaagaaagguacauggaauugcaugcaaacugcacguggccugguucuuucucccaucugcuucagucucacugcauggaguucagcuguuagaaaugauauauccccccaagacaugugcuuuggugaccauucuccuguggguggacauaugacauuuccaguguucugaucuuaccacgcugccagcaaacacccuuguauaugcaucucugcguuguugugugagcauuuuguaaaagugaaaaagucuacugaugcaugccugagaaguccagcaccucgaagguuugagacuggucucuauuggguaagacaagacccuguccguuaaaacaaaauaagaauugggucuguguguauuugccauuuuauaggcuggaucaagcguguuuuacuuucucuuaccccuguguucugcuccugugagacucuaacggccugaugcuaccuagaggagggacugacuggaacaucagccucucuguugagggucucucagguagcugacuucuaaggagcugugcacagccaugcgacccguugaccuugugagcagacgaugcaccuucuucuuaaaugcuaccuguacucucagucuagagggccuaacaggaucagugucaacagagaaaacaccggcuacagacuggaaccuguggcuuugaauuuucccaguuaacguuguucagaccuggauggugguagagcaaccccugacagcuggggagccugagccccauccugauuagcaagacacuuucugagugauggaguaacaccaguccuaaauucuuuccuuugaaggaggcugaugucuugggggaggguucugggcuguccgccccucugcaaacacuccagcaaaggccgugggcccucacacucuucuuguuuauuguuuccuccuuggcagggacaaccuccacccucagcaguuucuggcaguuccagaggauggucaaacacgucacagggcgcagcgccuucuucuccuauuacggauauggcugcuacugugggcuugggggcaaagggcucccuguggaugccacagacaggugaugcggaugaccugggccaacccuuauuuuauuugcuuugaaguagaggcuuuacagccaggggagaggguguugggaauccugaagaaacaauuacaggacagcacaagaugaagaagaguugcagggucagucccgaggaagccagagcugagccaccuuccucugugugaccugugacacugccuaggggccuguaugccugggauccuuaguauggcuugugugcuguugccaucuugagacagggucuuaucuuccaacucacguuggcuccuaacuuacuauauaguccagguuggacuugaacucuggacccuccugccucagccacccaaguguucagauuccaggcauaugccacuagguaccgcucaaacccagaaccucaucccugcuggacagagauuaccccaagccccauccugcuagccuccauccaggaccccaguguuacacagucaguccugcccagagcucuggaggccucaccuauuugcuuacaaaggugaucuuuccucaucugcuccauuuuuuuuuagggugaugggcucagugccugcccugccaacucccaaccuaauuccauauuuuaggagagugaagccaaguggcccaguuugaaaaaguuguccaucuggaggcaguuguacgguacaaaguuggcuuccaggacagcucaaaggaucugagggugggcgguguaaacuuuuagaaaaagcgaaagcuacuacaguuuggggaagggcccaguagggagacuggauagugugugucuuuucccauuugaaaaaaccaagaagggaaaugccccuuggcauccuaauagcagggcuuuagcccagcgauucucaaccuucuuaaugcugugacccuugaauacaauuccucaugucgggcugaccccuaaccauaaaauuauaucacuguuacuucauaacucuaauuuuacuucauaacucuaguuuugcuacuauaaguaucugauauggaggauaucugauauauaacgccccccaggggucacgacccacauguugagaaacacuggccuagcauaucacacuugaguccccaggcuuguguguggagccacagaaggccgcuggcacuugugagauguucauuaugguucacugaaccgguggucugcauaugggcuucaacugucacggugaauacaggaggcagcacccccacuguaacacaacucacagcagaggacagagagggucucacacuaagaguugcucagccucccaccccuagggaaagcagcagauccuggcccagaacaaagaucuacccacuccuagguccgccuccuguccuucccacgcccuauaggaggaccaaagguagacucaauccugcacaacauuagcccaggccacagagagccaagagcacauuuauauauggggacagccauaaaaggacaaacgcaucaguaacucaccucugcaacuccagugccuucaggaccagagacgucacccaguguucuuuugcucacugucagggacaccugcacauuggcacagucccucaccucucucuccccaccacuaggugcugcugggcucaugacugcugcuaccacaagcuuaaggaauauggcugccaacccaucuugaaugccuaccaguucaccauugucaaugggacggugaccugugaguagcucucccuccagggaaacaguaugaccugggcugguccuuaacggucaccucguuagcccacugaucaucuuaggaaaugagacuguuccaagugucuugagaucuagaaagcagauggagaggcaggggugagauauauaagucugagagucagagcgucuugcuucuuggagagcccuugcuuuauuuucccugguuucucuugcccaccacugaauuucagcucccaccaggaagccagagcccacccuguguuauggaucaacaaggaguuguugacugccgauucuguugacuuugcaguuucuccaggcagcuguggcugcugagagcauucccccaccccuccauuuuuuucaugugugugguguguggugcacuugucuauauguauaguuugguuugguuuggcuugguuuuuugagacaguguuuuucugugugacccuggcuguccuggaacucuaggcuaggcuggccucaaauucagagaucuuccugccucugccucugccucugccucugccccucugccccucugccccucugccccucugccccucugccccucugccccucugccccucugccccucugccucugccucgagugcugagguuacuggcaugugcuaccaugccuggcgugcauguaugccugagugugugugcaugcauguguguguguguguguguguguguguguguguguguaucgacguauguagcacacauaggugaagacuugagauugagauuagcgauuguccucuaucuuucuucuaccuuauucauugaggcagagucucucagucaaacccucagcugcccgauguggcuaucuuacaguaaggauccuuuaagggcuuggauuagaggcugaccaccgcacccacccaguguuugguuucugugucucugaacucuggucuucccaugugcuuuaaccacugaauuauaccccagccccgacaaugucuucuaucugucacguguuaauaaggcacugugcuuaccuuucaguugaacaaauauuugcuaagggcgacugcaugccaggcacugucaccaauguggguagggacagaaaaguaacuaggcaugaggcacugcccaggagggaagagggagggacuggggcgauaggcacacagaguguccauucaagaggagucuauguccugggccgaggcuuagggcacagugagccacuuccucccaggugucugcacagcuguguuucugggcacacauccaccaccuccaaggucagaggacugccacuugcccccgacucauccccgaggauaggggacuugugacuccauagugcaugcccaguaccccucccagagcuguagcacagcacacaggcagccuaagagaggacugugauuucucccuggcuucaguuaugagauaggaacugugacagucaggaggcucagacccccgcaccacacacacacacacacacacacacacacacacacacacacacacaguaggagauugucuucagcucaggcugccuaauagcccugcacagcuggcagagggaccugaaacauaaagcgagccuuugccgccgaggccuagggcaacccucugcccuuccucugcucccugccggcucaggagggugagguaggacuggaaacuguaccuccgggccuagaacuccaggagaugggaaaaguauaagaaguuauccauugacaggugacagucauagcagauggcacauccguguuuggcaugugcuagcuagugacaggagacagaggcaggaccugggagcuuccccacugcagcccacgagucuugccucaugcuccccagaugagaggccugcccagagcucuggaaaaugaggagacuucccccagacacccccagggcaucagugucacccuccagggagccuagaaccauguggccuggguucugaugucccgccugcugcugcuaaggagugagugacguguagaaacagccuuuguuggauaagcaucuacugccacugugguuccaaagccagacacagagcgaggcaggcccagcuccugcucuccugagaaacuucagagcagaaaaaugcccucggagacuaucccagccaaccucugcuacacaccuggaagucugagccccauggaagggaagggcuugauccgagugagcgaccagcaagaucaagacuugcaugccgggccuccccagugcucugcaccuucuucucuggcuugagccgugugggccucgguuuucucacccucacccaugaggugagagcaguggcuaccccaguguaaagcugacugcgugcuuugcaccccuguccucggcucccaggacagaccucugagauaggcacuuuucuccccauuauugcauaggaugucaaggcucacccagccagggaaaggauggagauuugggcccaggugguccugccucccugauacccugcccaaaggcuaggcaucuacuugaugagaggguuauuauccaauugcaagucucugggccucuaacgacuggugaggugcucuguccggccuggggaggagaguaaacgggccuagaucuaaccucauaccccagaucuuuccauuugucugugccaaggaaccucagcuuuccaguccagccucaaccucccagccaagccugagucuccucacccacacugcacuagguugcugagugaccaacaggagugcccccucuugugacacacacccccccagagaggcuggcccaugcagguguuuaguuagcgccugcuauuuggaccugggaauuucugguuuggcccagcugugcuuuuuucuuuguagaggaauaucaggacaauuucuaaauugcauguauguaaguguuuugccugugugugugucugugcaccacaugcauucaauguuagcagaaaccggaagagggugucagauccccugaaacuggaguuacagacaguugcuggcugccauaugggugcuaaaaguugaauccgggucuucuggaagaggagcaggcgcuuauaaccaacaaaccaucucuccaguccacccuccccucguugccuuaguuacagcuccuuugacuucugcccugugcuagccccucuggggcuaaagucauuccugugacccuuguggaguuaagguccucccugccccaggccacacugcaguucagagaguugugcuggaagaguuaaugccuccagcagcucugaaauccugcacccaaaccuggucccagguugccuagcaaccaguguggugaggacuguggggcgggugugguaggugagggguggggagagaacuugggguccacagcuuaaaagaccacucagagaucagcacacaucaaagucuuugaaggagcccagggggcaguuuucuugaaggggacagcugccccagcaggacugccgggguggcggcuccuccucugaggugguuuauauaagcacuuggcauucacagggacuuugagaucagcucacugacacccccuuccacccacacaugcaugcauaugugucgguggagccuagcugugggggauagagacugguucuagccaccaguaccguggccuccuacaucagaaggccuuugacuccucccucccucugggauuugggggagggcucuacugccugggacaugccccuuucucacccagcauucaccucacccugaaauguccugugccuccuuuguuuacuuguggggcgaccccuaccucccagcuagaaugcaagcucccugagagcccugaaugugaccagcagucaugacaaaaugccugauguuacagacuuaccuugacucagucucugcaguucagccauuccuuggccccggggccucaagcagaagaaauguggaggacaagccacagccuccccuccccaaaaagacuugcuaacagugacuuagugccuucagcuagacacacacccccccacaacccuccaccagccaaacccuccaucacuuuccaagcaagcacugccagccaaggaccuggaccuucacccaacaggccuauggagccauuucgcacccaguccauaauauggugccucagcccucgagccucuuggucaucucaugucgcaaaauguaguucauuuucaaggguccucaaacucguuuucuguguuaauuggguuuucccauugguaugacccaagaggacaaccuuaaacgcuggcuaggauugcauuucggcucacaguuucacacaccuggguccauuguccuuggcucuggcauuuguggguuggaggggagggggugcaugcagcagagacuacucaaggcagauaggaagccagggagaaagaccagaaccaaauucaaccuucaggaucccccuucaguggccuaccucccccagcagggcccugucuucuaaaguuuccacugcuuccccaagauagugcuaccuucuggggaccaaguguuuaaugccugcaccugugggaggaauauucauauuuaaacauaacagggguacccuugucuuguuauggugggaacucauucucuggguccauaugguaugguguucuugggccugugcagucugaaggugugcuugcuugugucuguaccccaaaucucuagacaaaggcgagucaugugcuaggaguuuaauaccuguuuguuuaauggguggcuagauaaaaacccucauucaguaggugaugcugacguguuucucucauuuaaaagcuaaggaggcaaggucugggagaagcagcaaccugccuaagaccauaaagucugugagucacagacuugggucuagaacuuggcuuccaggguccgggaauggaugcuuuucuaugguccacaggucacauaaguucagcugcuaaaauggguucagccaauggcaauggaccagcaauacggcuggagaucaacaagagcaagacacagucuccgaccuggagaggauuuagucacacaguagaaagaaugcacagagagccgggguugcaacucaucugguagaagaaugcuugccucucgugcaugaagcccugcauaaaagagcauggucauccacgccgggagucucaguacucagaagauggagguaggaggaucaggaguucagagucaucucugagugacacaggagugaguuaagaccagccugggcuacaugagaacauaucucaaggaagaaaaacuagaaguggcugagaagaugaucccgagguuagggacucuugcugcugugguccaggaccugaguucaguucccagcacaccaauggcaguucacaaccaucaguaccucuaguuucaggagaucugacugcuguggguaccaggcacacauacggugcacagacguacaugucggcaaaaccgcucauacgcauaauccaaggagagggauaauuggauaaaacugaauaguaaggggaagggaauaagagcuaaacaggagaggagaggagacagagggcaagcagggaggaugcuggggagaacaccucucuucaagguuaggaguuccuagguggcagcaccagguccccagaggccugcauucagacagcccacacccuguguggccuuggcagcacagagauaugcuguugacaggaagggagagguuugugaauggggcuaagauggguggggggagcucuaggggagcugggacuugauggaucugggcagaccuucacagguggagaagggcaugugagagcggggguugugggggggugcuccauaccuuccugagggaguguggcgaggggcagcugaggcguagggguaguggugucugcucuagaaaucaagucuccggacaggaguggguggacagccccagugggauugugggcugcugggagggaggacagcagagagacaaacugcacugguccuacagacagaggcuugcuucuuaguguauguggagccaaggguagcacuuccagugcagccuaucaaggcacacacugugagcaacagccacggugaccagcguccuaacggggcuuuacugugcuguucagucuuugaacacggucaacauugcuuuauccaaaggagacucucagauuaacagcugcagaauacaagccccgggucuggcagccuccuuccucacacagagagcagacuuggguggaguucuauagaaaggaguugugucuucgagagcccaguaugcgcucaugcaugcacauguaaacacacacacaaagcaugaggccugugacuacucaacauagugccucaauguaccuguccuucggcucagaccagaguucgaaguccucggggcuucauugguuuuucugcggcaguaucccggggaggagcucgcaugggcuagccucuguucuucaaggggagccgcugugauggaccagaccucauggagccuugcucugcaggcuagaaaagggcacagcgaaucaggaugcaaaugaaaucagcaaggggaccugggagggagaagcuggggagagcuuuaagccaacugacuuggaugagccucucugaagaacuccaucaagauccaaacugccuguggacuggacucaucacuggaagacccaggagaaacgagauuaggauaccggcauauacaaaggcccugggacaaggcagagugugauaccuaaacucacagaggcccugugucuggagcggacugggugggaggcuggcacagucaaacugugaugggugggcugugaacggccacaaagggagggccaccguuuccacugaagccaggaaaccacagcauggcuuuaaacaagagaguggaugcaauucagguggcauuuugaggcugcuuguuuguuuccccucguuaaggaggaagaacugacaguacugggggggggggcaggggagguggucaggaugauggacagaagagagcagagcuuaaaguggcuuaaacacguggacaucuaugggauuagccaacacaugggaaucggagucaaaggagcagagggcuccuagagagcugcuggggccccgcugcagucauuccuaagggcagagagguacaggcucgguggccauggaguauaugugcaggguagcuuugaaugucugcagcuggagacaguccagacagcaccugggaugucgagucgacaucuggaauaggagacgggucuggggucugggggguggggggggguugaguccugccuguugccuuggccugggugcugccugggugcaguaauucaucccacccccaacaugcagaccagcuucugcaucccauuaacccccuccuaggcgucagcucauugcagcaaggaaggaugcaacuggggaagggcugugaacaaaggaagagcaccccacacuccuucccuucuugccccccucuuggccccuguaguuccuccuaggcccccagccuuccccccaccugugggaugggccguaagccccccagugaugccaaguuucuccacagguggaugcaccguggccagcagcugccucugcgggcagaaggccugugagugugacaaacagucuguguacugcuucaaggagaaccuggccaccuacgagaaggccuucaagcagcucuucccgaccaggccucaguguggcagggacaaacuccagugcuaggaaggccacccucaucccuccaucaccugcucuagucccgagccccuucugaagagcuuugcugucuggggagugucuuuucagucauuaagggacuggagguggagaauuccugcccuggaaacaaaccguggguaucuggccauuaagagauacagucugucaguaggaaacaaggacauaagggagcagggauggggggcauccugcaaucccagcauuugagacauggaggcaggagaggaaggagaggcaggaggccaggggcaaccuccacuauacgguaaguucaaggcuagccugagcuacuuuagacccugccuugaaaaauuuuuuaaacauuuuuuaaaggaaaauaaaacaggggaacacagggguugagcugaaaggugcucucaaacccuucuccccagaagagcagagagccccaggauccagccuaaacuccccuguacccucuauccuggucaggaugugugucugacuggggaaccaagucaucuacccaggucaggcugggaagugagccgggauccuagaaaacacagcccaggagccucgccuggaaucuccucauuugcaccaggucugaccucuccagcaggaugcaggaugcaccccugucucagaagguggggcacuaucagaaaaauggugugcaccagugccacaaagaugucacugguuaagauggcaucaagaaauggaaagaggauguucgggacaggggguccaaggcacccaaaauccuuaccccaauuuagaagccuuugguccuguaagacuuaauucuaguaaacgaggaaggucuaau

SEQ ID NO: 2216 - RNA, 1226 nt, Mus musculus
cuuugcuuuuaaacuagaauuuauugguauacaaaaucaguuccagagauaaaguggcacgucuuugcggcuucuauugcaccaaguguugaggauuaaaaacacaaaaacauuugguucuuaaaacagugcagauagccaaguacaguacuucagaaaauaaagaguaaaugauucagaugaacgcacgcuguggagagagauggccugagggaaaugggcucgagacaccaggaaauggugauuccucaccacuacgcucuagagcuaaggcagacuugcugagucuaagggucaugaucccauggagaccucagacaccucuagacugaagccagaacaagcauagugcaauuaggaaaagagagaaggcagacacacuggcccucuuccuggggggaugggcacucacuccauccauccauccauccauccauccauccauccauccauccauccauccauccauccauccauccauccaucccugugaccaggaagggagcgggguguggggugcugagccugacugcaggcucgucucccuucccugagcuuagugcuaguaagggaugcugguagggaggccgcuauggaaaaaaugagcccccaagaacaggaagacaagaagagccccaccucagcagggcucagguuucaacagagcucugucagagggcugaagaacuucagugacugcccuggugcugaaacaggggccugcaggaugcucaugugcaggcucagagccagacccaaagguuccuccuauguucgggacgcagcaaaggagcccuggccugcagguacgccccgcuuaccauaaacucauugugcaagugugcaacuguaugcagggacagcauccuccgcacggcuaccagccuucuccaguaacugugaggagagucaccauuucaacugacuuacugaacugagacucuagagagaaacagacugaaugaacugucagaacuugaccugggacagagcucucugagcccagccucaaagugcagggagucacacauugcgcucccacuuacaacaaagggacacugguugccucucucccucccucccucccuuccuccccucagcagaaaccaccaacugggcccagcagucaacuguuagaaccuuagcacacacaaggauggugguggaacagcggacguguaaggacgugggggacguuccugucaaagugccucuuggggccaggc

SEQ ID NO: 2217 - RNA, 27536 nt, Mus musculus
caugauugcaggccccagggacuacucaggugagggagaugggaggucacuggcugcuuucugcgcugccgcuuuaccugcaaaguggcucacaugccuaacucagagcccagcucuucuggugggagaaccagcagcagugugcugcuuaguuuguuugcuuaguuuguuagauuaagcuggcugaaaugcuucaaucacagcgcgucucucugcugcccccuugugggcucugcgggaccgacaggcaucgcuuucugcuugccugacuggcuccgaacgugccagaguggguguggucguggugcuaggcacagaggaggaugaagcagucacaaguuuaugcagcgugaggauuacagcaaacuccguaggcaauuagauucuggcacagggaugggaugccaaacaaagaaauugcugcggagucguaaaagauaagccugaggcucaggggccaucaaguuaucgaagaagcaugagcaagccccgcccccuccaccccuuuccccauucagcccgggagguggucugaugaaaucaagggagggucacccaccaacagaaacuaacgugucuuaauucccccugggagcaguuugcuggagaaaguaauaauggauauuaaauucuuuguuugcauuuauaaauaauuuaguauacgggcuaucagguuuauaggaaagcggagagguagucuguggagcugugagagacuguguaagcucugcugugcugacagcuccugaggggcagaaaugggaagggaccggccuccauccuuccauuccucuguauguuaagugggugagacaagggguuguaggcauccugaagaugagggcaaggucacagaggucaagugggacugacaggcucaaaggcuccagcaccaccaccugcagaggagaaagaggaggggcuccaucgguacagggguaucaguggugugagcaucgggauggaguucuagccucagcacccauguaaagcuaaguguuguuacuaaauguguaagccaagcgugggggagguagggacagggagacccagcuuagcuggaucugugcgcucccgguucaguaagagucccuggcucuaauaguaaggcagagagcgagcggcugaggaagccuccuagugcugacuccuggccucuacauacaggagcaagugcgcacacauacacacgcggguacaaaagaugaaaacagaaaggggaauugaaaauugcauguuguguggacauguacaagccugcaaccaucucuacaaaauagaagcagaaacacacauuuacccgugcgcgcgcacacacacacaguuuucauugaaugucaugcuucgcugucaucaauagaggcccacuagaagauugucaucaauaauuaccuguuaaauauuugcagcuucagguucaaaauccugaaagcaaaaucccagcuguaguaguacucugaacucuacagccugggcagccuuuuuagagaggcugccagacagaguuccguccugugccagggucacugauggagcaugucugggugguaggcacgagggugccccauggccuggcugauuagugauacauaauuuguucccugugcccaccagacagagugagaugccauuuacuuaagcucuccagagaggcacagccuguggcagucggaugcggcuaaguugauguuuaacucugcuuagggugucugccuucaugacaagaacaaacagaugggaccaucaagauugauccaagggugguauggaaagaacacugugcccaaaccccuauggucuugcccguuucuagaagaaagugauaaacauaccaugagucauguccguugaucacagugcacgugcacgcgcgcacacacacacacacacacacacacacacacagcucuguaaggcuucaguuugaaaggauauauuuugauacuagaaaaaaagacaauaaauaauaaauuauaaugacacacucaacacuugaacccccuggauucuuuuguuuguuuguuuguuuguuuguuugagacaggguuucucuguguaguagcccuggcuguccuggaacucacucuguagaccaggcuggccucggacucagaaauccgccugccucugccucccgagugcugagauuaaaggcaugcgccaccacgcccggcucccacuggauucuugugggaaaaaaauuuaaaaauaaaggcagggccuuuuucauucuaaccucccuugccagugugcuuuuuccaaaccaugucuuccaucuuucagucugcagguguguguguuugcaucuaaguauguaacgugcuugagcauccccccauagcccaucuccccaucccuucccaggcccccccaccgccguuuccuaucagccccuugugaagagacagcucacagaacugcaggguauuuugguuagcuguauaucagacagaugauuaauaccuaagacauacgaagaauuaaaaaaaaaacaaccuaaacaccuggaaaaaaaaucaaguagcacaguuaauaugaaugggcauggagaucugcagugaugaaguauaaaugaugaauaaacacaagaaaauguucaacaucucuggacaucugggcuauacaaaacaaacaaacaaacaaacaaauagacaaaacggaacaaaacaaggggcuggagagauggcucagugguuaagggcacugacugcucuuccagagguccugaguucaauucucagcaaccacacgguggcucacaaccaucuguaaugggaucuguuacccuuuuccggugugucugaagauagcaacaggguacucacauaccuaaaguuaaaacccaaaccaaaaccacacguugauaacccagcucacucuagucagaauggccguuguggagagaucaaaugguaaccaauucugccugggauguugaguccuuuauguuggugacugugguucgcauacagacaacacggaauggcuccuucugccauacgcuguguggaggagagcugcucacgugagcuggucuuuauuuuccccuggccuccuccuuuuaaauguuguacaguauugggugacuguuccgaagcaggagacguggagaucccgaugacgugcacagagguuguuucuaacugugcuugcacaucaaggauacauucucggauacagucuucaaauacagggcauguucuucuuuaggaagggugacgagcugucagggucgacacccccucauccacagaguucagcuuuauuccuguugcugugauaaaauacucagacaaaaagcauuuguacuggcuaguuuugugucaacuugacacaggcuggaguuaucacagagaaaggagcuucaguuggggaaaugccuccaugagauccaacuguaaggcauuuucucaauuagugaucaaggugggaggaccccuugugggugauaccaucucugggcugguaguuuugaguucuauaagaaagcagggugagcaagccaauaagaaacaucccuccauggccucugcaucagcuccugcuuccugaccugcuugaguuccaguccugacuuccuuuggugaugaacagcaauguggaaaguguaagcugaauaaacccuuuccuucucaacuugcuucuuggucgugauguuugugcaggaauagaaacccugacuaagacagcauuguaaaugaauuuuaguaaacccuauuaauuaauuauuaauguggcagagccagcucccccaauaacagaagcaaaguccuauagauuauuuaaucagcucuuguacaauuacugguagauuaccccuaaucuauauuucuauuugcuagacuguuaauucccaucugugcuccccaaacacuugcuguuugaaucuagcccggguuacuucuucuccagcagucuguccuggggggaacauuucacucaggcaugugucccuugucuaucacgucuaauggagaccucugcucccucugucuaccuccucuucguggucccuuacugugacccagcccaguaacugaaacuccgcgucuucuugucuccccaaauuggcuguagccacuuaauuuuaaccgauagcuuuaauuggggagcaggguuuaaauaucaucacuaaguguaugugaggaucugcucauaggggcaaggggaucuagagggccagguuuugcauuugaauacagagcagcagcagaccaacccuagcaccgcaacuuaagggaggaauacguuacaguccaucccaggugacagucuaucacuucaggggaguuaaggcagaagcuugaagcaacuggucacaucacagccacagucacauagagaggggaacacaugcaugcauguuccaugcacaacuagcucucccuagucuuacauaguccagggccccagaacagagcguggugcuguccacuuucaggcugugucuucccacaucaauuaacauaaucaugaggauucuuacagacauggcuguaggcaauccugauguagacgaccccccauugauacacuccucccgggauauucuagaugacaucagauugacaaacuaauccuggucaacaugacacacaggcacaucaccaagccacagcccucuauccguuguccacaggucucauguuuaucucacaguguaaaauauaguccaaccuuuaaaaguccucaagucuuuaaaaaccgaaacacuuuaaaaguccuaagucucuuaauuaugagcaacuauaaaaagaaaaagaaguuauguacuuccaagauacacuggcaaggaacagaagagacggaggaguuggaggaccucucuuuguaagaacucguucuggaaaaauacaacauucaucuuuuaucagaguagagcuuucacgaacccaccucuuugacaagagauuuaauuuuuauuuauuuauguaugaccguguauguguaugugugcauguguacaugagugcaguaccuauggaggucauaagagggcgccagaucaucuggagcugggauuacugguuaggagaugcgggcguggguguugggaccugaacuaucuucugaaagagcagcaaguacuccagucggagacuucacuucuuaaaggucucgcuaauucagcacugccaaacuggacaccaaacuucagaugcuugaaccuuuggaggcugaaucacauccaaaccacagcauguccuuccuuccaucucucaccccaagggucaagccucgcauuccuuaaguuccucaaaguccaggucuggugcuggagacucacuagcaucugcucuuggccacuuacacucauccuugaagcuccaacugagaauuuucuccuaugagaagucauuuuguaucuuugaacuucuuccccacccccgcccccucccccauaucacacacacaccuuccuagcagcauucacccugcagucuugucaucacugaauccuugcuuauaauaaaaccuuuggauuuggggcuuucuguagucaaggucgaugucucucuauuucugcaacuuacaugugcuguguagcaaucuccucugaagggaaacauucuuuccaaauggagccucaugagauucaggaagugaacaacuuaggagucucaggaaguuucugaagcuggcaagaccaguuuauggcagcagguggaggagacucacugaccugcugagcugccuguaagcuauccagggagaucuggggauacagcuuuucugaguuggggcauccaggcaggggcaggcuuuuggugauguagcugccuuugggacaucccuacuucaguaaguaauuccucauuuauacucuuauaagucagcccaauagauguuguugguucuccaacuugaccuucagugaaaucauuacuuauuauugauuuuauggcacagggucuuacucuagcuuagucuaggccaguaacucucuguagcccagguuggccucaacaucauggcucucuccugccuuagccuccuuacuguuggggcucuaagcaugaguucccaugcuugccuaguguucccagguuagguauaaaagaccucagucagauagaagguucaaaagggaaggcagugacauuauuguagaaagagggugcuuaauauaaaaggagccaggaggagagagacauuaucaccggugaugauaaccccaacaagugggcauggcuugggguaaacaacucuccugguuuuccccaacacuaucaguuugaaccagaaaguugugugcgucccagaaacagcuuuaguccaggcagaccuagauuggccaucccaggaugaaaucccaauuauuggacugaagggcucuuucugcuuucuucuuuggauuaaagggggaaggacaggauuaaugaaauaucugggcuccagagucagacagagcuuugcuucucagcugcguggcccuuucagcuaguuaacuuuugugguugaaguuccuguauuuugggaaaaaaaaaaacaaaccaagucacauagaagcaugucucucaaugagugcucaccauguccgugugugcgugcuccuguguaugcacguagauggaggccagagucagccuauccugcucuccaccuuaguuuuaaaaaagauuuagacauuuuuauuuuguuuaugaguguuuugucugcauguguguuguuuguauguaugugugugcauguauguauguguguauguguguauguauguauguguuguauguguguauaugugugugugucuguguauguguguguauauguguauguauguguguauauguguauguauguguguauguguguauauguguguauguguguguguguguguguggguguaccauguguaugcagagcuuguggagaucagaagagaggaccagcucccagcuccccuggaacuggauuacagauggucaugaagcaccuuagcaccugggaacugaauccagacccucuguaagaaucacaagggcucuuagccacugagccaccucuccagccccacaccucaccuuugacaacuucaaccauguaaaaaaaugcauuugauuuuauacacucuuacuuacuccgucccucacucccaggaaucuccaucaccgucuugacuugauauuuuguguggguaaccauaggcacaaugaguucauggucuaucucauuucuugucacaggaugucuuaguuaggguuuuauugcugugagggaacaucaucaccgaaaaggaaguuggggaggaaauggccuauuuggcuuccucaguugaggaagugucuccaugagaucuggcuguagagcuuuucuuaauuagugaucaaugggggagggcccagcccauuauggguggugccaucccuaagcguguaguccuggguucuauaagaaagcaggcugcguguugucaauuccuuuaggcucugcccaacaguuaccuagcaacagcuugcguuucucccugccagguuugaagaccacuguuaaccauaaucucucucucucauaucccugacuggacccuaccucuguuucucucuucucuuucuguccuucucugucccccuccuuucucugccucuacuccuuuuccagguucccuucccuucccucgauaaacuuccuuuuguucuaggccugucguaugguggugaguccucagaggaaugggccugcugagguucuccugccgccacauuauacugccguuuuauaaaacauaacacugagcaagucaggggaagcaagccaguaagcagcgcccuccauggccucugcaucagcuccugccucggggguuuuagaccugcuugaguuccuguccugauggccuccaaggauggaugcugaucuugaaguguaagccaacuuguagcucacugauuggcuaaacugccuggcagugagugcagugggcugucucuuccuccuuagggaugggaucacaggggcucucugacaggccuacccuucuuaaagugggugauggagauccgaacucaggucgaaccuggcauauggagcaagcacuuauauggacugagcuauuucccuagcuacuguaggcugaguuuuuaaagggucugugcacgcacgcaggcguuuguaauugauugcggauuagcgcauucuagacaaacauauucccuuaucauccuuuccuuguccuggaacucacucuguagaccaggcuggccucgaacucagaaauucgccugccucugccucccaagugcugggauuaaaggcgugcgccaccaggcccggucacccuuuccuucuuuuccgcauuuuuuugcucuugccucucuucugacauccucagucauccuugaccugucuggucccacugcgccucacugagcacuacccaccacgagggggcagaaaauaaccaacaaaacaggugcuucucuagucuuccuaucuuucucuauggugccugcuggccccgccccgggggcggagcuaccaccacgugaccuggcugccaggcgaccgcgccggcgcaguggccgcgccgcugucgccaggcgucgucccccugcgccgcuccgcccgguggccggcugaggcugcggccccgggcucugcggcuccggcuccggcuucggcuccuuccgcggcgaagccgugugccgccgcagccaugucccgaaagcaagcggcgaagagccggccgggcagcggcggccgcagagccgaggcggagcguaagcgggacgagcgggcggcgcgccgggcgcuggccaaggagcggcggaaccggcccgauccuggcggcagcggcugcgaagaagaguuugugagcuucgccaaccaacugcaggcccuggggcugaagcugcgggaggugccgggggacgggugaggcgggccgggagugcgggaagcggcgcuggggaugcgcagggccggucgcugagggggaagcaagggucaggcuugguggaacgcugcggcagggucccccgaggguccgagcgggucugagaggugaccucgaggugcagcugucaugaagccgaaugggaaaggaccuaggucccgcucggugucaugcuggcccuccuggguguccucgcccacuuuugcacugggguaucgagggcggagagcuaaagguagcuuccacagagcuugcuucccacguuuuggguuccccaaguaaaaggcaugagagucccgggccagcuguuucugggagccggauacaagaguagcagcuggaaacagaacggaggaaggcgaggggaagcaacuuaauggaacggggacauggguccaggaacguggggagagagaaggaaaagaauaaagaaacggggagaggaacggguuagcagguccgagggagccugccugcuagguguguuguugcaagaggcacuguuaguguguucuccucuaggaauggucagguugagccauggaagaauggaauacagcuaaggagucuacaaaggcagauguggcaaugagacugggggauuugccugggcuauagggugacaggguuucaaaaaacaaaacccaacaaaaccaaaccaaucuuucccucuugagaaagucucgcuauguagucuuagggcuggccgggaauccccuguguagaccagguugcccuuaaacucauagccaucugcugggauuaaagaugugugccucugucccacuacauaaaguauuuucuucauuugauacacuacgcugaauuuuauugaucaagacucaauaaacuaaccccauuuguaucuccugccuucagagcuuccggcaaauuggauagguauuuuguuuaaguugcaauuagaguuaauuguauucagcuacugcuucgaacaguuccugggucauaggaggcauucagcacuuuguuuuucagggauuaaaaacuguuaagggaggccaccuagcuccaguagaaguacaaacugcgguagacaucaaaccaucaagugaagcugggcgagguggugugggucuuuaaucccagcgcugggaggcagaggcagcggaucucugaguuugagaccagccaggcuuacaaauggagccaggguugugacacacagaaaccugcucuugaaaaacaaaacaaaaagcaucaaaguugaaugccguggccccaggugugggcauucugcaaaugguuagauuguaucugucauacugagcaggguuucucugugucaaagaaauaggcuagggaaaugggaacuauggagagauacaguagguucccaggagggaggcauguggcaguaggucacuuauagcuugguuugggggcccuuuuguauucugaaaaaugcuguggaauaagcacacauaugcacuguaugagccacagcucaauauuuaccauauucauaauuuaaagacaggaacccauuagccaucuagcauugagauaguagcgauacacacacacacacacacacacacacacacacacacacagaggcaggagaucuuuauguagcucuggcuguucuggaacucacuacuauguagaccaguucaaacuuacagagaucaacuugccucugugcugggaucaagagcacugcgccaucaugcccaguaagaugucaggcucuugagaacuacggaugagagagugagggugaagaagauagaggccuugguucugagcuugcggauacccugaaggggucuccaggcguuaauaccucugggcuauacuuggggagcagaucuggggggggaacagguugguaugaucuucauaagggaccacgguggugcuauuuugaggaaguggcugacaugccuugaagugccaagaaagaccuuuccuuccucagcuagcagggccagcgacuuccgugugcaaggugccucucacaagaagccaugcuggagcaguucacaaaggaacaagaggaguuugccucugugggaugagugccggguggaaggccagagcaugcgugucugauagcuccgagugcugcaguuuaaugggagcccaguauaaucaggguaggagcacugggaagugaggggcagaggcuagcuagcuacuucccagucuguuguuuggcaguguuugauggcuccaugacagccuccugauguguacaaaccuuggcuggggugacaucucgugggcuggcuuugcuggucuaauguggcacugucauuuuuccgucugucauugcagugaauguuguuccccguguagguggugguuuggaagggucacagaucuuucuuuucuuugagacaggguuucucuguguagcccuggcuguccuggaacgcacucuguagagcaggcuggccucgaacucagaucgccugucacugccuccugaguggaucacaggccuccccuccucaccagccuccccuccucacagcacuguccgacgaauggauuauuuuaugaguuaauauuuguugaguaauauccgguuaagauauagugauguugcuaauauaaaaaauaguuacuaguuucuacuguuuguguuuuggccuaguuacagcuuggauggccuaagauggggacuugcuguauguaguagguggcuccuugaagcguucuguacucgcuuguuuuucugaacucuaaugcagggccuuacggcuguguaucccuaacgugcagugguucucaagcagggaugguuuugccccccgggggacuguuggacugccuggagacguuguugguugucacagcuggugaggagggaggugguccugccaucuggugcccauaggacaaggauguacccaaggauugacagugagcaggacauugcucccuacacagacagacccaggugucaguaguguggccgcugagcagccccacagccccacagcccugcgguggggagaucaugacucgggaaccagccggaucucugggaggccccgagggccaugagaugcuagcuuggugccaucugcaguguguguucagggcuuccuaagggaacccagggcacuguagugcuuguuauguuuccucugucacugccuuauaaucccaucagaaaaacacguuauuuuauugcaggguuuuuuuuuacuugacuuugguggccucaaguaaaggcuggcagaugacaaguguuacuugcacacaggguaagucuagcuaguaauucccuuuaguggaacauugccuuaauguuugggagagccauggcuagagccagcuugcccagguuugcaucguggacccaacacuuuucccgcuggccaccuugcuagccaccuugcuagcccuguuacuagcauuuuaauuuuacagagcaaacacgaugcuugacaguggcguuguuguucucuggugacaaggugagcaagcuuggggcugugucguucccggcauguucagguguuucuuccuucgcucucguuagagcuugggcaggugcagacuucugcuuguucuugucgcuuaaguacucaaugggugacgucccacguccuagcuggguagauuuagugagauucagaaagguaucgguaggugugacaucauuuugggaguuuaaggccuuaggccuggagugguuugugaagucugugcucugagcugaggcgcugguuaucaacuccaccacugaaccagcggaggcccugagaaacggaauaccuauugauuugaccugguaaacauggccgagagaccuuacuugcugccucucagguaagguugaggucugcccuagagcgcuccccucagcaucugcucagaagagccaagguggcugcuccccggggcacaagcacagccaggcguguuagacgaacucagucgguuucugaaagaucuuacccagcaucucuguuuugauagcaauugccuguuccgggcucugggcgaccaguuggagggccacucucggaaccaucucaagcaucgccaggagaccguggacuacaugauaaggcagcgggaggacuuugagcccuucguggaagaugacauucccuuugagaagcacgguacguuccccaugggacgcugggacccucgggagccaggcuggguaauccgcccaccagcacccgcccccaccacggccaggguuugcuuaugcgaguuaugcuauucauuuacccaacacuuucccugcauauucugugauaagcccaaguuguacagcugggaauccauagauuuagauauaugucuccuccaaucaaagaguuggcuagggguguggcccagccggagggugcuugauccucacacaacaccaccaccucccagacagaagagaaaggaggugaugauagcggaccagacuuuccaccucuugccaguggggugggcgguaagcugugcauacacagaggcuacuuuuuaggcaguccacgcguggaggugagagagguaugcaaagaugcuagcauuuuauggaguuuuucuugauuuuuaaaauuuuauaaaaaggagauaauaaaacaccugaaaggauuuuuuuuuuuuuugguaaagauuaaauuagcuaacaaaauuaaauucuuaauaaguuagcugucugaggaugaugggacuauagauacguuuaauuguuuuccauacuuuuuuuuuuaaauaaucauguauuuauaccuagaaaaaaagaaaacagcaagcccauguuaacauuaacaucacaaaaaccuaaacacagcccuuccaccaccccuuuuugaggcaagucauugguuuucauuguaaugauucuaauuaguuguaacuuaauuaggcaaaaaucuaucaaauauguauauauaugaacuucaaauguuaguuuugagaaauaauuacuaaggcucuauuaccccagguacugacaagguuagguuauagauaccauuuaucuuuugguuuggguguguuuguagccugaccuuuugaccuucccagauguuacccaugccacugcacccaguuuauggggugccugggaugggacucacacccucuugcaugcugagcaagugcucucccaacugaguugcauccucacccaccaccacaucuccaccacucgguuuacaacugugucuuaccaggaucaggcaguguagucucuguucugaugacaguguagggccacauggagaauggaagggggcuagucucggaggagaggcuggugaggaggggaggcaggugaggaggggaggcaggugaggaggggaggcaggugaggaggggaggcaggugaggaggggaggcaggugaggaggggaggcaggugaggaggggaggcaggugaggaggggaggcaggugaggaggggaggcuggugaggaggggaggcaggugaggaggggaggcaggugaggaggcucucaaauuggcaguuccaacagugaugcgggccaguuuauuuuacucaggcaagaaaaccaggggauuuagcucuaugcauggaggacagauggagguguaugucuggggacacuguggacacuguuagugaccccgugcccuuccugguccucacugggaacgggcacauggaccucuggguggguugaguguaccugucacugagcucugguggcccucuuccugggauuguuguucaagccagcaguuucagagcuagcauuuuacagguggggguggggguggggugggggaagagauugauugauugauugauuuuggagcuuugugcuguuuaaaaugaaucauguuacugggugugcaagugcacacuuguccuagcacucaggaggcugaagccggucugccuggaaaaaauaaauaaaaaaaaauuuaaaaagauagcugacaguguuacuucguaugaaacuugaucugaauuccacguggacauccuuagggaugucuucugggguugggguguauccgcgccucagaacagggagcucaaggcuucagcugcagugugacgucacucuagcugugcaggggaaagguauuuucuugugaugucacugcauggcugaacacugauucauaaaagcgugagcaucaaacaggugacaaauggcuuaggagcagaaaugaagaguguugaaugccaggcccacugccuuucucucccuacacagggccagcuuuucugucugucugccaugguguacucaguuucucagggacaacuguagcgccuuuguuccgaugcagccguaccuuggcauuuggaggcaucccuguagcauuugcuggaccaguaggcaggugucucaguuaaguggugaggaccugguaaccuuugcacuuggcuuuauguacaggauuauucucacccucuguacuguggcucuguagagucggcagcaucucuccccaucuguauggauacccagaucagaacucuagcugucguccuuaaugccuugucucccauuuccucccaccugcgcguucugugggucuuggccauuuuccucagcaguuuccuccacuuaccaccugggcucaguaguuuuuauugucacuugacauaacauagggucaccugggaauggaggcuccuucuuaccucaguugaggauuugccuagaucaaacuggccuguggacaugucuguuggggauugucuugauugcuaauugguguaggagggcccagcccacuguggguagcaccaucccuaggcugguguccugagcugcuggagagagcuggcuaagcauaggcuuacgaugagccagcaagcaucuuuccugacccugcuuccaggguccuucaguaaucagguugauguagagguagacaaugcaguaagcaccuccccccuccaggcugcucugggcaccgugcuugccguagcacacagcuagaccaccacuucugaaacucggguguggugaccguuccaccagguucccucagugcagugggccuggccuguggcccugugaucagucagagccgugauguaaguuuguuuuccuccaaaaucuguggcuccuagugaucugagggccgagccugugcuccagcccuuccugaccugugaucuguaaucuuucuccucucuuacucucaccauugcuuuucucccguaccucugcaguccagguuccugccugacggcccaggucacaguagcucugguucuguuuggaaugucauccacugcuccuuuuaacuccuacuuggccuuagagcaucuuggcuguucaucugacacaugucauccuccucccccugcacgcgcgcgcgcgcgcgcacacacacacacacacacacacacacacacacacgcaugcgcacguguguguuccugacauggaucgaggauaugagcauagcacagcucugcaaauucugacaccaccugcagguuucagauugccccacauugacaggaacuuuccuaacagagcaaaguuaacuaaggggaagacucaggccggccucagaaggcuccaagcgcagugcugcuuuguccuugggaagguuuuuuuuuuuuuuuuugcucuuggcaucucugugucacugcauagggcaguguugucagcuggaaguugcuuucugcaacuugagcguccagacuugguuggcugguuguagcacauggcugccauauagucucuuagcaccuguagccaagggccugucugugcaaaagugacucaucuuucuucuuuagaaauuccaaaggauucuuugugggagccugggguaaaguccagaccagcccuuuccugaagcgcgcauuuaucaggguuguccaugguauucugauugugaucuggguagagugacagaguagccacucuccagggcucacucaucaagucaggcucuguggccuugggcuaguuuuagcucccucaccucagcuuguuccucuuucucguggccagucugauaaucuuuccagagccuugccgcaaagguuagaagugauuucugagaaaucuaaaacacugcuugacccgcgcaugcagcauccacuaccgcuguuccugucuguuguuugcacgccaugucuuuuauacagcugggcaguugggaggcacgcagcacucacugaagggguuaaucagcagacccagcacugaugacaagcaccccugcgugucgaucaccucuaaguuccuagacugaccuuggcaguggccuuggcagauguguguucuugcuucucacugcuugcagcugcguacauacccaccauguuuguguuugcucuuuccaucauaaagacuucauuuuucuuuccuguuuccaugcaguggccaguuugucaaagccugguacuuuugcuggcaaugaugcaauuguagccuuugcaagaaaccaucaauugaauguggugauccaucagcuuaaugccccuuuguggcagguaggucaccuguuuaggaauguucccguacgcuagcccuggggauguccuuuagaugacgggcuucaccugugaggcugaccuccagagaauagcuuggaccgggagccugaagaugggaucuccagggacuuggagcuaccccugugcuggguguacguggagucuggagugugaauuggaaguaguuuacgacauuagagacauucauuacucaacagucagcuacguggguaauuuggggacaaaccuaauguagaaauaccucagauaauucuauugaacuaucuuaguauaugaauacacaccguagcuuugauguauguccguuccccugugguuugaugugugugccuuuuaggaguagagaggcgccauaaaauccuugauaauaaugacuacacuugcuguaaugacugagaagugcugcuuuuuauucagcuuuauuucuuuguuugcuuuuuucuacaauaaauacuuuagagcaaguguuugcuccaggaugaggcaugcuaagcuacacaccccugcauugugaaguauguguccauuuaccucccucuccuccucugugcauaaccucgccugucagucaugaagccagacggucgagaacauggacaaugaaaggcccccaccgguggcgcaccccucucccugauucauucucccagaauucagagauucccgccacucuggcuuagcuccuggacacuuucacuguccagccacucugugucacaauuuugaacuuugucuuauuuagaaaguuaaaauguuuuaagugaagaaaaacuggggaauucagaaaagcccugcaggugaguaaggucaccagggucacacugacuggaaacauuuuuagugagugucugccuccccccccccccccaaaacuugggcauaugacuggagagugcauaucacaguguuuuuacagugcauuuuaaacacacguccacagauucccucaccacacccacccacaccccugcaugcauuacuauauuaaaguugugcugccuacaugcacugcuuacagauucucuuagucguggccuguccccuuuucuguuagaaauaucaguuacacauaccugaaaucacccuuuuccgguuucuacuuguauguucugaccaucaguaaugcuaccgucagcguauggacuagccccacucugcccugugggaucaccacccuccuauaucuuccaaccucugggagccucuguuugauuuccuuccguauagauguacguuugugucacauaaauggaagucgucagccuuuuguaucuggcacaauguccuuuuaacagccuuacagaggacagagugaaguggauacuggugagaacaucuacuucagggaugcagcgagcgagcgaucgggagggaaacaggacccgagccuuggccagaguugccaggugucaaguggcagagaggacccuguuuucagugggugcucuuaagagugaucuacuggcccagaaaacacacggcugcuccugcaguuucuguuuguuaauaguuuacgcuguuagcaggguugucagggcaccagaguauauagugugaggagacugcuaagagaagccaugcaccuccuagggcagccacccucugcuuucccuaaagauaacccuuacuuuuuuuuuuuuuuuuuuucaaaacagauuuauuuuauguaucugaguacacugucucugucuaccagaagagggcaugggaucccauuacagaugguugugagccaccaugugguugcugggaacugaacucaggaccucaggaagagcagucaguguucuuaaccgcugagccaucucuccagccucccccauccccaccccccauuucauuucuuuuuugcccuaauccuuuuuuccaaaucuuuuuguaguguucugguuuaugacuuggaaaacaaugaaacgauacauuuaaaacauuuauuuccauugggucccccugcuuggugaugcggucacgguucugagcucuugcauuaaugauggcuuggcuccgacucguauggcauggauacggagaccuccauugucuaccggccugcccucuugugagcaguguccauguauaguauagcaagcagcaggccuguuaggaacagcugcugaauguggcuccuagcaauuuugcugacuauucuagaugguuuguauuuauaauauacguauguuguuagcacagguaguaacguuuaggaaccuuguucuaugaagacagaguagagcauuuccccaguguuccuuuuguggagcaacagugcugccacuguguggaauguccauccagaccacugucugucagaccuagacccucuacagacgcuuucucgggucugugugggguuugggugguccuguggaccugucaccugggacuugcagggaaaaccagaagagcguguguguuggaguuuuaauagcagcacaguuacugggaggcagucggaauuauuuucauuucugugacauggguguuuuugggggauuuaccccgacuagcaccuaguuuuguauguuuguacaugauuuuaaggagucccaggaugugguugggaugugacgccugguggccagugugcaggucugugugggguacuaguacgguuuuacucuguagaauuuugucugggaacuggugugaguggcagauuuuaagacuguugcugcuuguaagucucacugugacugacagaaaaggaagaugaguuuguuagagcuaaggagcccgucaggcccauuugcauggcuccauuugaaggucuucaagagggucuagaaacuuuauacuugacauuuugcuccuuuuuuucaaggauaaucucuaacuguuugagcuuuaggcucagcaaaucugggucuguuucugggucuucccauuggaaggagccugugcacuccagagggaggcacuuaauuuuaggacuuaacugcaggccugucucuggaguuugauucacuuccaaauggauuuauuugcauauuggcaaauguuaccuaggcuccuguaagccuacaagcccggaggacgagaguucagagacugguggguccuagccagggacuaucugucuguguagagccugcaggccccggacuccccacgggcccaccuugcacaggcccaccuuguagcuccucucugugucgcagauucgaggcacggacaaaggcagcacgagggagcuccacaucgccuaccgcuacggugaacacuaugacagcguccggaggaucaaugacaacucggaagcgccagcucaucuccuaaccgacgugagugaagcccagcuccuccugcuuucaggccugcaggagacaggggcagagcuguguccucagcuaagucccagcggcccgcuguugucacugccucucagggagccggcgauccaaucgauugcuaaagcagugcagguaccauacauauggacucagguaucacacguaugcaugcccgagaguccagacgaggauggcucagaucuacuggggucgcaguuacuguugcugugagcugcugugugggcgcugggaaacaagcucuggucuucugcaagagcagcccaugcgcacucggcugcugggccagcucuccagccccucucuacguggguuuugugagcauuuugucauugcucagucugcaccuucuaaguaagaccuacugcauccuuccuuuucuugugaacuguaucuauucuuuuucuguucauuuuugucuuuuugucuaaugcuuuuaggaacuucguacauuagggaaauaugcuucugugagaaauuacagguaguuccuagucuguuauguuuguguuucuagggcuuggggucauaacuagaauggccuuuccugcucugagguuagagagcgagcucacaguuguuuuaauacuuuuauaauuacauuuuuuguuuucucugcuuagcccuggcuuuucuggagcuugcaguguagcucaggcuggccuccaauucagagauuugcucgccucggccucccgagugcuggacuaaaggcaugcaccaggccugaccuaauaguuguauuuuuauuuuuccuuaguuuuaacuuuuaguuuucugaggcaaggucucccugcuacccuacacugacuuggaguuuguggagauccugcugcucccuguuucggaugugcguaguggagauauuacagauguggauccuugcaccagaccuguuuguuuaugggaugugagcagaugugaggugcuggugucagcuuucagccuucugcuugccuugccgccguguggcuagacugucucugcccugugcgcuuccuuccuggguucugacccaugcuggcugcacacacucugucccauauguguuugugucuccuuuuagcugcgugguucugcuccucuggccucuguguguugacuguuuuaauuaacgcaagucuguuguaaaauaugguacaguuuuucacuuacuauuuuuuuuuuaugauuuccuguuuugcuuuuuaaaaauggcuugcuuuuuuuuuuaauuggaaucuuuuccuuuaaagauguauuuuugucuucaguuauguguauauguggaucugucugagggcaugcauguaugugagaaugaaggcacccgaggcaucggggugucagacccucuggagcugacaggugguugugagcacccggggugcaugcugggaccugcucagccgccucuccagcuccucaccgcauccuguguguugguuuuuauucugugggacuggguguugugccuaaguauaugccugcaccagguaccuguuugguucucucggaagccaaagacagcauuggauucccuggaacacgaguuacauaugguugugggugcugagaacucaaccuaggucuucuggaacagucagugcgccuaacguucggccuccugccuuuuguuuuugcuuuugaggcagagucucauguauuauguagcccaggguaaccuugaauuguguauguagcugaggcuaggaacuuccgagccuccugcuucugccucuccugugcuccgaguagaagcggauguuuuccuguucguguuuccuagcuggccguuguucagaugacaccuuaugacucagccagggguucuauagaauucucucucaagcauugacauaaaacccaccuaccauggauugaaucccuucauacgcagcauccgcugcaguuggaccccuaagguccuuguccaugucuucugguagcauucgcugcaguuggaccccuaagguccuugaccgugucuucucgcgguuccuaacccucaccauccccagaggaagcucacagcaccgaagccgucuuucuuuaccaugaaugggaucguggaguugaccuuugcugucuggccuuuucacuuagcaugcuguuuuugagauucagccgugcuguagcacguaacaguucuucuaaugguauucugugugugggucugucacacuucccuaguuacauuucuauugcugugauagaacaccacgaccaaggcagcuuauaaaagaaaguguccauuuuggggcuuaaggcuuccgagggccagagucccugauggcugagcaaaggcuuggcagcaggaacagcugggagcucucaucugauuggcuauuuauagaagggacucacggguuucuuuaccguuuuuaaaaaaagaaguugaguugucauuuuguuguuagcuuuaaacacccuuuauagauucuggcuacuagcuucuuaccaaacaugcagcacgucugcaguuuuuguacuugugcugcaguugcuguggucuuucaugguggcuugugguuguuuuggagagcacagaauuaucuugucuaaguaauguuucuuuuccccuaucuaucccaaaacuucuuuuucguuuuuguuuuuguuuuuguuuuguuuuuucgagacaggguuucucuguauagcccuggcugucuggcuguccuggaacucacuuuguaggccaugcuggcuuccaacucagaaauccgccugccucugccucccgcuaucccaaaacuucuauuguuuugugugcaccaguugauaagauugaauguccaucgcuuggugcugauggcgguaaacccucacugugcagugcuugcuucuaacuacaguggaggcggcaucccaagggcggcaguggcugaucacugcucuguggcugggagacccuuaccuuuuuucuagugggacaccacugaagauaacuuuucuacuggucuguaucucacauguggcuaauuuccugggccgugaggauggaugcucagaguguaggcugcugugugucgagacugucggggauauauuccccacagcugggcuccacuuagacuuuuagugcaaaguacagcaauguccgugcccauuuauugaugggcggcagaaggagaugguggcuguguaucaaaggguggggaggggugguuuuagaguucugacuuggguucugucauagaggccuuugugccuugagugaacugcacuguaguacauaagccuuuggaugggugaguguggcgugccucauaggugccucaaguuagcaaugcccuguccccagagcaugcugauaaucagagaacauggcagccagaugagagcuggguccauguguuuucaaggcgagcauuauaaguugagaagcucaacaggugugaaauagggaaccguccucuguacacagcaagcagaaacauaugugugcugccagacuugccgucugcucuagcacugcagcccagagagcucaggugccuugcugcugcuguggcugaguggcuccucccagccucuguccucagggcugugcuggacucucagggugugggugaaucucgccccuggacucucggccugcagucuuccuccuguauuggaugguucgggagucggagucuuccuggguuggagagucgagugggauuugcuggagcaaugguuccuaugcuguuucuuucauuuaguuccagaugcuucaucaagacggagcaaauaaaaaagagaagaugaagacaaaagggguggacguuaaagauggccugagagaugacguggaagaugcuguccacaaaguuggcagugcaacuggaugcacgguuaguacccaugcucagauacugccgugcagagccagccugccagaguccgagagacuggggcgcugcuagcucauucccuuguuugcugcaugucagccauuaaugcucaagguccugaggagugggcuuugucuuuucugagaggggcuugcccuaguacaggucuaguuuuauaaagacgguuuauuuauuaaugcacugucguggcuacugccuuguuuggacuugauguucuugguggaugagggcuuggaaccgcuucucuguguucacaugugucagcugauggggcagagcgccggagcaccacaccagccacagucuuaggcguuucucuguuucuuugauaggauuuuaauuuaauaguccagaaccuggaagcugaaaauuacaacauuaagucugcaauaacugcccugcuucaggugaaccaggggacaggaaacgguaaggcugugaccgagaccugcgaaugagcugcaaggguuacccugcugcucccucgagaugcuguucccaauucuccugaccgcgguaguguccacucuguccauccgcccccuucaaggcugugagcaccugccagucagcacaacaagcggcacugcccagugucugugcaucuacaucuuagcagccaccguaggggacaguguagggggaggucauauucacugcccagggucugugcaucuacaucuuagcagccaccguaggggacaguguagggggaggucauauucacugcccagggucugugcaucuacaucuuagcagccaccguaggggacaguguagggggaggucauauuuuguuucuagauuugggauacaaaugaauacuuuaucccuaaaaauuaucuguuuaaaguuuaucuaaggaaacaaacccugcauguagaaaguuggcugugugccuugcagccagccagggcuuuccgugaaaccuuccugaccauugauguaagagucgaauucccucucaaggaagcuggcuuugaaaaugacaggaaucuggggaccugauaaccuuggagucauuuaauugcaguugcuuuauguaacuguugggcucuuggucuuuacggaaugccuuucuuuggaagaugcggaggagaaccaugagccuggugacagagugaagcagcggggcccuucacgugaggaggcaggcagcggccguagacucucuggaaaucagggcagaaaugaaggcaggauggagaccagugaggcucgggccagcccugcugaagagagcaaagcacacaagagccagcucccaaaggugcggcgaggagggguggggaggggaggggaggggcagggcgggaaggcagggcacgcagggagucugugcuggggugggaaguaggaauucaccuuagugugcaguuuuuuaaauguauggaaauaguucuugcagagcaucuggggacaggcacugagacgcagaaagaccuugcuugucccucagucgcaguaggaggauguaucugccccucucugugcggacgcacagcugccucuuccgucugguguuaaugucgagaggcacagggucuuuggauugucuguaguaaauggcuuuuguguguaaagucuuugugcuuugcaguauuuucuagcaugaagccccaggugaaaugugugaaaugcaggguaugucucucuagugagugaggcucuugguaaccugcaucccugccccagcuccagcaagggcccacuaagccaguggucuccugguuaaaacucaccuuaaaggcagauguucugagcuagacugacaccucugguuccaugugcagaaaacaaugaugcuuucugcgaucuuacugcaguuaucuggagucuuaaaugauggagaaugugucuccaggccccugcaaaguccgucagcugcuggacuagggacacugaauuugugggucaggguuagauugguuuaugaagaggauuuguauuugaugcuucaggaaggggacauaaauuuccaaguguauuugaacaggaacagaagaaauucuggucucuugggcucgaguccugcagcagcagagacccaugcugcuccugucuauuccaggucacaaacaagcagcggcgggaacaacagcggcuggagaagaagaaacgccaggaggagaggcaccgccucaaagcccuggagaacagaaacggcagcagggacacgggcagaagcgaggcagacaugaauacgcaggucaccuuggugaagaccuucgcugcucugaacaucugacucucgggcccugagaggugaaggauguaccuacgcugcagacaaggcuucccagccacaccuccuccgaggaugagacaacucucagcgcccacacaggagcccacaggagccaguguccuucaagcuguuuuguugugugacgguguggugacaccauucaccuccuagaacucaaaacacugagccauaggcuggucacagagcggggccauaggccagucacggggcaggggcuuugugugcccugugggucagaguguggugggucuaggcucuuccuggaugcaugggguggguuccuuguaccgauucuugaagucgcucagcacaaucauuagagaccuucagugacaaugcccucuguuucucucucauuuccaagcaggaugagcgucuugguuucucagcucaggaguguguugggguuugauugcuucugauacgggucacccggacacaucagugguaggacaggaccaguagcucccagcagccagggaggccaaggccaucuccuuccuccugucucugguuccuuucagagagugugggugccccuccccucucaccauguggugcaugugccuggcuaugggugagagcuggguuugccgggagcugcacagugcaggggacuuuaggacagugaggagaagggguggcauugcuauggcucaucucugagcucagaaauacaggcugggucuauaugcaggcggggcuggggcucuuggguucuccuuggaacaaucuaaagacagcagucuacaggaguaaggguucc

SEQ ID NO: 2218 - RNA, 5253 nt, Mus musculus
cuuggcauuaaaaaaaagaagaagaagaaggaauaacauaguuaguucugcucuuuggacugcagcucgcugagucagggauucaaagagaguagcacgaggcugggagcggcagaggaauuugcagcagaugcagaugcccccagagacuugguguggcuuaaagaugcuucccuccaucacugcugcuggcucaggaaucaaggucagggacggggaaccaaguucaguucccuggagcccaaggcccagccucuuuuccagagaacaugagccuuguuccacccuuggacuccacagaaggcucggcuugagugucccaggcggagggugugagaagaauuugaacgucuguccguacccauuuguuuccguucucuuggcugcacuuucugaacccugaagacacugggcuggggcuucguucugugaucugccgagccuuuguucagacucccaagagggagggaggaccgguuauuaaaagagcagauucuucguucaauauuuaccccauacaacauugccuugaucccuaaaauaccuccaggucaccgggguggaaguucuccuuccuuuuucuguuuuguuuuguuuuguuuccuuucguuugguuauguugaggcuguuuauggagacugucaccauagugacaauaucagagcaggucagauggaacgccgaauccuuggguuauuaguggcuuugccuuuguacccggaagcaugacuuuuucaccccaaaccaugucuuucauuucuuauaagcacuuacagucucagcuccaagucaaccaaccucccuuuuugauggauugccagcgguuccaaccacagaggugguccacuccaggaagaggagggguggggagacuuggcuuggggcuccugacuggaaaccguauuuaccagaaacccucuuuccuucggcuacaacuugggucaagguuucaggguguugaaagaugcacuauauaaacuacagaucuaaaggaccuggcuguuugguccacagacauggagauggaguucaacaaauaaacacagcuggcgugggauggccuuuagcaaauacuuaucaucuuuucccccccacaaucauuuucuuggccaggaaguagaguaguaauaguuauugcuguuauuauagcauucucauacacugcuaguggaguuguggccaucugucaacaggagaagaaaaaguuagaccacauguccuucuguugauacuaaauuauucucaugcauccuaagaaaaaauuugggaugaggauggagggcugcaugcaaagaugcuuaauaauaguuuaaaaaaaaaaaagaacagugcaacucugggaggcacuuauuauauucuaguauuagugugguagcagugguuaugugcaugugcacgcaugaaagcaugagugugagugugugugauguguauguauggugaguguguauguaugugugugugguuguacgguaugugguggugaaugugugugugugugugugguguauguauaugagugugugugauaugugagugguguguguguacaugcaugaaugcaugagugugcauguaugugauauauguguguaguggguaugugaugucuauaugugguauguguaugugugugagugugugugugugagugaugaggggguacaggagagaggacaugguaggaaacuccuuucacuguggucuccagggauugaacuuagacuauaugggguggagagauggcucagcaguuaagagcauggacugcucuuccagagguccagaguucaauucccagcaaccacaugguggcucacaaccaucuguaaugggaucugaggcccucuucugcugugucugaagacagcuacaguguacucauaugcauaaaauaaaucaaucaaucguagagcccauuacacgcugagcuaguucaccaaccccauguuuuguuucuaaucaagacgcuuccauaacaaaagauccugggaauccaguaaacauucuucugugagaauccuuaacguguccaggauguguucuugguuaagaauaaaagcaacuuccaaaccuguauaagcucauuauggcaaauuauucauauaugugugauuuaugguaaauuacgcauaugugugugacagaaaaagacuggucuacauucuaaaaagaaagcagcauuugcuucuaggcugauuuucuucuuugugcguaugugcgcuuucauccgccuguaaguuucccuuuuuguuuguuuggguguuuuugcuguuguuuguggcucuguguaucuaauucagggccucucgcacuuuaggccauugcuauaccacugagcuacaucucagcuucuagcuauaaugggcaugcacacauauacacauaggcauagacaagauuuguagccuugguaggccuggaauuggcuauguagaccaggcugcccucgaccucacaaagauccacuuguucagccuccugaauucugauccugucuggcagguuuuucuuucuuguaagugguccugcaagguccuggaccacagauaucugauccugucuggugugguuuuuuucuuguaagaguuauuuuuauuauuaauugaggcaagggaaaggagagacagggagagagggaggagggcaagagggaaagagagaaaacucaaggguguaguaccugaggagaccacaaggggacaccagaucugcaggagcuggaguuaagaggugguugugagcuuccugaccugggugcugggaaccaaacccagguccucugcaagaguagcgagguccucuagcugccaagcuguuuaccaaccugucuagcaggcuuaagcugccgaggaacacugaugacacaggcucagucacuaugucgcacccauguccuuagauuuuuuugggggggguggggagguugagacagaguuucucuguguagcccuggcuguccuggaacucacuuuguagacuaggcuggccucgaacucagaaauccgccugccucugccucccgagugcugggauuaaaggcgugugccaccacgcccggcucccuacuaugcuuucuauugacugugguaaacaccaggaccaaaaguauguuggggagaaagggguuuauuucagcuuacagcccaucccugagggcauucagggaugacaggaacugaaaccgaagcgaugaaggaacacugucuacugccucacuccuuguggcuggcucaguccgcuuucucaaagcacuacagggcugccugccuagggauggcagcacccacaaugggucggggcccucccacaccagucauuaaauaagaugaugauccaugggguuugucuacaggccgaucugaugggggugggaggcauuuuucucaacugagguucugucuucccagaugaccccagcuugugucugucaaaguugacaaaacgaaccaguacacugacucauuucaccugcgcagaacagcuggcccagauguucauagcugcuucuccauauuugccaacauuucaugugcgccaggcuggccccaaacucccuauguagcagaggauggcuuuaggcuuuuguaccucugccucuugagugccaggcuuccagucauguaccaccaugccugaaacacacaaugcugagaaucagacauggggccuuacguguguuaggcaagcacuguaccaauugggcuacauccccagcccucuguguaacuauuuuuacuuuaaucuggaucuuugcaacaacagugauguugaccaccaugaauaaauagguuuucaggucuacucugguccucaaaguugaaaaccuucacaaaggcccaguuacaaugugugcuccauugguucuuuugaacaaaacuuaggcugauauauuuuauauuuuuaauuuuauuucuuaagguguguguguggugugugugugugugugugugugugugugugugugcacaugcaccaugagcaugcaguacccauggaggccagaagagggccuuaaaucaucuggaaauggaguuacagaacgcugugggauacuggacacuaaaugcugagcccagguccuagugcuuuuaguuggagacagaguaucauuauguaguucuggugggccuagaacuugccauguagaccaggcugacuugaagucaaggagauccaccuaccugccucugccucguuuggauuuuguuguuguuguuguucuguauucugucuuacacagauagcaucuuccuaugcugcccaggcuggccuugaacucaagcacuuuagugauccuccagccucagccuccagcagcugggaccaugggucccuccccguguaucucagccuugcaccagacuaugcucucaguucaguuccuucccuucagaagaucuuggguaaggucagcaucuggccuuucaccgggaccaugacagugucuaaucugaaggagggaugggaggaguuggaaccgaccgcaguuuacguccuggaugacuggaguuuuucugggucaucauuugacaggcuccauuuguggcaagagauuguaucucagggucuaaugguuagggagugacucacaggcccuaccuaucucaaagagcuacagagcagccggacaaacacuaagagcaaaggaagagauaagguguacaaagugcaugguuuccaugggaacacacaacaggcggcggcuccaagcccagcuuuugagggcguguugcagaauaugaucuggaaagacaggggcugcuuaucccaagcccaaggugagaauuggccuuggguauguuauauaguccaguccaacccagaguggcuggcugacuggccagcuuaauucacuggacaggaauucuccccagaugugcauauaaaaacucccaacagcuggcccgcauuugagaggccucucuacaucucugaucaagaucccccagauggacaggauacaaacacuucugguccagcagaacagaacacagcugggacuucucccagguaccuauuaaaaaaucaaaacaaaaaccccaagaugauugugacaaaccucagaaugaaggaucgucuuggcgccgcagccucgggcuguauuacacagauggguggccagugcucuggccuccuccccuucauggcuccaugcucuguccggaugcugaacggugggagaagcucugagucaagacggccucuuuuacuacaaaccacaguuuucugucuucagaagaagucagugug

SEQ ID NO: 2219 - RNA, 491 nt, Mus musculus
ugucucaggaggggcgggccaggcgcaacgcuccugcgcggccagggcuguggcguuccggagggacugggucuacuugcgucccuccucugacugucagccucgcuucucgcagcugcaggacgcgggcuagcugaggguggagcgguucacugguuccccugggcggaggaugcggaaggcgccgaaacuaggaggggaccggcccuccgcaacccacccggacccggaacuggugcgccggacgaggcccggccccuacagagcgagcggaaccugcauggggaagccggcucugccgccccuguugcugaacaccugcuaucaggaccaggcgggcagcuuuuagguaccaaaagaugacaagugaauaagccauaaggaucccugccugcacuucauagcuaccagaguaguugugggaaagacccggguaagaagacuagaacauuuggguucaauaaaugcuguuucauauacuuuuuuacauu

SEQ ID NO: 2220 - RNA, 16682 nt, Mus musculus
ggggggcgggacuucgcggaggucagcugaucccggcgggcucggauccugaagcugacaccggcuguggaucuugaacuggugaggaugaagggggcuggcggcugucccgggcuggggggucgggacuccagacgcgcccagcuaagucuuuucuacacccuccuccagcucugcacgguccccggcgcugguccccuccuggggagcgggaucgugggucucugcccaaccuggccagggauccgggacggccccacuucuuaccugcagguccuugccuuccggccucucggcuucccuggacugggcggccuuguuuucccugcucugggugggggccucgcggcgcuugccccagccgcugcccuaucauuaucccuccgaacccgcagagucaccggaaggaguuagagccuugguuuggaggccaggaauggguaggaucccggagccauugcgcuccccugacacauucuccguagcucugcagguagggaacccagaaugucccauuccucgccaagcucaccgcaggauuccacagagggcugguuagaaaugugagguaaaggcaggcggauaucugaguucgaggcuacccuggucuacagagcuaauuucaaggcagccaggggcuacacagagaaacccugucucaaacugcucccguucccaccugcccaaaaaagaaagaaagaaguguguaguuucagguucacuucguguguacuccaugcuacaaugugguccagggggcuacagcaagaacagaauauuacuguugacugugccagauaggcuuuggugggaagcaccuuccuggcuuugcuuggaauuggggaagagcuggauguggcaggagauacugucuccuggccagccuuuacggacaugagccgcgaaagccaauccccuaguggggaauguauguagcucagugguagagcacuugacuagcgugggauauggagguuuggccuggguuuuauuguagucugcaugcaguuuaggagguaaguaagugccuuuuaggauuuccuucauuguauacaucagaaugcugaaacuccaacacuugcccagagcgacaucucagcccugggcccgcucaauuuacaaguuuccuugcauacgcuucccgcucccgccuccccucuuuuuucuuguucuguuucuuuccuccuuuuuuuuuuuucucuucaucaugcuuccuucccucucccucucccucuccuuuacauuuuccgagccuuuuguuguacagcuggugcauccagacccacgagacugggaaggauacagacaggggagaggggagagagacuugcuugaagaacacugguuaacagggacaguguugccucuucuccaggauuguguuccaggggacuggaggcgguggcggcaaugucccuuggauaggcaaguuagaaaugggucaggguaucucuacuaggcauuugugauagagaaggauucccuagaggaagagagaggcugugcaggugccugggacucugaggaccuggggcaggagaugagguuaggagggucauucuugggguccuuaggaccuugccucugugauuuugaacuugauccaguaucagaauggaaccugcaucugcuuugguggggagcaccugccuggcuuuccuuggaguuggaggggaaaugggcguuguaggagauugucuccccgaccagccuuuaaggacaugcaccaugagagucagaauccuucauacuagugggggauacaacucagcauuagaccauuuaacuagcaucuaugagguccuagacccaagcuuugguaucaggagucuuugcagagacugggagagcugcaugaacccaggguccccguucaucugguuccacugguguggagaggcuccacaguggucaagauacuggggucucaucuuuaagccaucacucucacugggucagaugggaggcucauagcuuuauguuuggcucagaaggauguuaauuagccccaguucauagacagggucagccaggcugacucgcuugccugaagccacucaacccuaccuguaaaaugggaacaguguuucccuacccagccuggguauuagauguuaugaggaaugacaguguaugcaugugugaugaauuggaccacuccagaucuaccagaagagguguugggaggccaauaggauguguguggcugauaaacaagacuucuuagggugcagaucuuaccuagacuguaugaauuggggugccagguaauugcuccccaaauuggcugugcagaugucauccacaccagccacuaagaccagggaagaaccuuccagcuauccuaugucccacccuagagcugccacaaugagcugaccaggcagugaccagaggcacccuuaccccagcucgaggagcuggucacauuagggcugagagucugggcuuucugagaaaagaugcugacuugcuucuucuuccugcccugcucacugcaagcucagcaguccuggggccagccagagcucugugaggaguccaggccucccuggcauagugggaacuaagguacggaugggagugagucugucuggaugaggaaacgcccucuuagcucagugacaaaaggggaagccugggccauggcagccuccgugaagccucucccaugggguuugccucucuugcuuucugacuggguggcccuggcagaugacuucccuguuguggucucagguuccuccagaauaugucaggaagguccaugagaggcaggcggaggacaccaugugcgaauacuggccaggucuggagaagauggcuccagcuaaaccuugcucucccuacucucucuagguugucaugcacgcagagugaccacauaggaacucugugcagguggcaaggacugagagggugucuuucuuccugcuccuucaaccagccauacucuggcuugggcuguggcuuccuuguagguaaguauucuguaugccuuucaagcuuuggaaggaacaugggcuccagcaucuuauccagguacugggcaacccuaggaacugccaccaccuuuuuguuuuuaacuaauuuuuuugggagggguguuuauuuuuaaagauuuauuuauuuauuaaagauuuauuuauuauauauaauaagcacacuguagcuaucuucagacagaccagaagagggcaucagaucucauuacagaugguugugagccaccauguaguugcugggauuugaacucaggaccuucagaagagcagucagugcucuuaaccgcugagcuaccucuccagccuaggaacugccuucuuacccuacaugaaagaugcacguguuagccuucccuccagugaguccuggccucagacugugucagaguagagucaugaaaaggagugacagccuggcccgaugguguggaucugcaaucccagcacucagaugucugacacaugagacucgaagguuuaaaggccagcuuggacgauuugugagaucgugucuugagauaaaaaguuuaaaagcgccgggcaugguggcacaugccuuuaaucccagcacuugggaggcagaggcagguggauuucugaguuagaggccagccuggucuacagagugaguuccaggacagccaaggcuauacagagaaacccugucucgaaaaaccauuaaaaaaaaaaguuuaaaagccagggguacaggacaguuguugaccuccugugcagcacacaaagagaucuagacuugacccccuccaccccaccccaaaagaaaaccaaccaaauauaccuaaauguuuacaaguugcaucaaaagaugcuguuggcguauaggcccacccacuccacauaugaacucauuuaacuggcaugguagcuauaugaaguagggccucucaucguuauccccacugugcagaggacaggaccaguaacugccagucacaggacugugaauggggcuagaccucucaaggcugaagagcucuuuuucccuuuguguaggauaaaccuuugccagccucugaccccuuggcuguguucauacaccuguaccuucuuucccgcugagacccucccucugcagccauggucuggaggacacugggcgccagcaacuuuuccaccugucccaauggcucuguccaguggaucugggauguguuuggugaaugugcccaggauggcugggaugaggccagcgugggccugggcuuggucuccauucucugcuucgcugcgucuaccuucccgugaguauguggcugugugguuggaguggggugugggguggaacggggaaggggcggggcuucggggguuggugguccuucauguccugcacuggguuuggauagucuaggguuuggcuggccggccauuggccugucuagaucccaggccagauauauucccugccugaucauauucauugaugcccggcuugcugugaaggagggagggaggcugccuggagucuaacgcaggccagaccucaugcugaaugguguugugugaccuuuucuaccauauauugagcaccgcguguaaaugcugcggcauuuaaccucguuuaguccuuauaacagccgagugaaauaggcagcaaaccuuucccugucucacagacgagaugcagguuaggucaugugcucagcuggcaagagauggguguggagcaugggcgggcugggaaugucgguuauggcuguguccuuaaaguaaagaaaggcaggcugguggugaagauggcagugguggcugcaggggccagaguguccacacucaguucugccaccucuuggcuauggccuugcuugcuccgggccucagaugucauuuacgcaguauguguacaagcuggaaagcuggccuugugcuagugucugcuucugugaagugugagagagaggaccugguggcucagcagaggcacaaagggcugcaggcaggaagcuggccaggaccugcaggugugugagagaaggaacagcuacugucgugccuggcugggcacugugggagggugaggugggcagaaguaaccucaggaguucaccaagggaccuagcaucuaaagcuggugucaguguuuaauuuuuaaaaauuguucuugggcuaggcaugcuggucccagcacuugggagacagaggcagguagaucucugaguucaaggccagccugcucuauaaaucaaguucuaagacagccagggcuacacaaacaaacccugucuccaaaacugaaaaucaacagcaacuacaaaaauuguucuccggccggggaaauuuccugcuuuugcagaggaccuaggauugguugccagcauccacauaguuacugccuggaacuccaguuucaggagaucugacaccagucugacucuucuggccucugcaccagucacacacgcagugcacauauauacaagcaggcaaaacacguauaaacuaaaaauaagucuuaaaaaaaguuugcuuguucgcugggggagaacacgcaguguaaagugcuugcuacccaugugugugggucuuaguuuaaucccccggacccauauuaagauggauacaguaauguaugucuguaaucccaguguggaccagcugguagaagguagagguuucucuugaccuccaugugaguauuguagucccuguacacuaacucccuccuuaccccaacccucacuccuuacagcuccugggaggcugaggcaggagaaucaugagucaaggccaaccuggacuaucuaaggagaccuuguaacucugaccuccugacccuuccggcuccuaccucccaguugcugggaccacacauauagccaccaucccuucacugucuuuuuugauuucuuuuuuuuuuuuuaagauuuauuuauuuauuauauguaaguacacuguagcugucaucagacacaccagaggagggcaucugaccucauuaugagugguuaugggccaccaugugguugcugggauuugaacucaggaccuccggaagaggagucagugcauuuaacugcugagccaucucuccagcccugauuuuuuuguuuuuauuuuguuuuuuguuuuucaagacaggguuucucuauguagcccuggcuguccuggaacucacucuguaaaccaggcuggccuugaacucagaaacucgccugccucugccucccaagugcugagauuaaaggcgugcgcuaccauugcccggcucugauuucauuuuaaggaaauguuuaucuuauguguuugguuauuuugcuugcauguauguaaguacaccacauguggguaccuggugcccacagagggugguagaauccuuugggaccguagcuuacagauaguugugggccuccauguacugcaaacugaaucugggucuuuuguaugagcaauaagcacucuuuuuuuuuuuuuuuuuugguuucuugagacaggguuucucuguguagcccuggcuguccuggaacucacuuuguagaccaggcuggucuugaacucaaaaauccgccugccucugcuucccaaguacugggauuaaaggcgugcaccaccacgcccggcacaacaagcacucuuaacuguagaaaugucucucuagucucacgagcuuuguuuaaaaaguuauuuaucaucaauuaauuauuauuuuugagaggacauacauccucacuaucuugccucagcagccugaaacucacuguguagaccgggcuguccucccgagugcugggauuaaagucuggugccacugcauauuguuuuuuaugugugcguguuuagcccgcaugcaugucugugcaucauaugugcaaggugccuguggaggugagaggagggcggcagaucuuuugauauauauauauauauauauauauauauauauauauauauauauauauauauauauauaauauguguguguguguguguguguguguguguguguguguguauaugaaugcuguguguuuaugucuaugcauguauguaugugugugcaaugccugguuuaggcaaugucagguauugaacccugggcuucaugugugcuaggcaggcacucugucagcuguucuacuucucaaccuuuuaugaauuuuuauuuuuagcaucuguuuauuugaauguauacagaugguuagaauaaaaagcugaggccaggcuaguuggcacuugccacccaagccugacauucuaagcuggauccuggaaaacacauacaggagguggcaaaggacugacuccaccaaguuguccucugaucgcugcacgugugcggugccccaugcgugcccccgauaauauauuacuacuuuaaaaagucgaggaggagcuggggaugugguagaacucugaccuagcacaugggaagcucuggguuccaaccuaggccccgggcgggggggggggggggggagcaagacuggagucugaggccuugucacaaaccucuggccagggugacucugagcaguaacagcaacacggucaucugucuccagugugcaguggccuaacagaucugaccuuccuuguauugggacuuaaggagucaucgccugagaccccaggcucuuagcagcagcaguggcagcggcuuucuuuacauuacauuuggcuucauacaacuccgccucagcauggagggccucagggaacagucuggggacugaaagccugugaaacccgagagugaccagguugucuaugucuuaccaucggugacuccugaaaacaggaccuggccgguccucagacccaccucaacugccaccgccccuguuuugagcuccuaccuagccagauuuuuacaaugaagccaaggccuauacacacccucugucccuucugggagaccccagggggcaguggggagaaucuaaggcagagacucugucuggaaagagacucggcugcugugccccugggcuaguagggguccgguagaauuccuccacaggucaaagaauccgucagaggauaauacugccugugaaauucuggguucuauccugagguuggagcaucugggcucuccugcccaccgcugcuccagucauccucuuaacaaguccuguuggccgccuuaggccaucaccucugagcuugaguccccuccucuuccacagccaguacaucaaagccugcaagacaggcaacauggaccaggcccuaucacugugguuccugcugggcuggaucgguggagauuccugcaaccucauuggcuccuuucuggcagaccagcuaccccugcagguggguggggcccaggcacaguagggcagcuuaaaagacaaauagggguagcugugggaggagucuggggcuucaaauaugucagcccacaccccauaaucuaccauccuguguaagacgugggucaagacaucuguccaagucucagauuucuaauuuccacguaagcauaucacaccccaggggucugugguucugagggguugugggcccagauacuuuuucugaguuuaggccccucaaaguagcaagugggguuuuucuuggggagcacagacauuauucuguggccagcagaacuggggucagucaggaaggccauggcuacuccgucucaguggcucuagccacagaugcuguguugacuguccaggcuggaccuggguccauucuugauggacccuuuguccaccugacuuccuguuuacacagguaggaacaggaaaccuucuguucagucaccacuuggggugcaguggaggggugcuggggcggucacgucauggccugggacugcagccagugccugggucugcuucucucucagaccuacacggcuguguauuauguccuggccgaccugaugaugcugacgcuguacuuccauuauaaguucaagaagcgaccuucuccgugugagucugggggucacgcugggucgggcucagcugcccuugggaagccugggaccugaggugaagcaggcugagauggagacguguauacaucaaaccacagggaggagacucuguucagagucucugguucagagccagaagugagggugcaucgcagagcagacuccccagcugagugccgacccccccugcccugacuaucuuuccuuugcaucccuaggggaaggguacuguuguaugcccauucuacagaugaaggacuggagcucagagaggcuaggucacuuguccaaggucauacagcuacugagaagcaaggcuggggacucccaucccaagcugucugcuguacacccagauaccuaaucuuggcuucucuccugccucaauccagugucugccccuaucaauucugugcucuuguucaucuuggggacgguguguaucacaccacuguugagcagcacugauccuguggcuguccccagggaaggcuuccgggggcggacacuccugucuguggagccaggcaauaagguaggaaggagaugaugggucuguggugguggcaugggggggccaccucgccuuccccugcaugaucacauagauguuacguuguggggagaccaccccucuaaagcucccaccagauauugaguguccccuuccacccucccagcccuucacaaagaaggaggucaucggcuuugucaucggcuccgccuccagcuugcuguaccugcucucgaggcugccucagauucgcaccaaugugagcuuucaggagggguggggucacauggaggagggccgccagguuaagcagugggaugggucaggaguuuuguucggaagaucuaaaccacagcagcagaugacauggguaaagucacccagcuggcugcgucucuuuccaccucugggaaauuggcuccuugacacaccuuucauggggacaugcaugagacuguuucccagcagugcuggaggucaggugugcgggaacugcuaagcugagaaaccagaguggacaggaagugaugaggaccccuacuggaggcuuaccuggcagaaggaguccgugggggccacagccagggcuacccaugguccugggggcagugcuuggagcugggauuuggagcugaccauggacagggaguuuugagugccaagcccauaguugguauggggcacacaaugaaaaaccagcuaggaguaugugucauggaggacacacacagggacuguggcugcauagauuaggcuuggucuuggacucaugauccuccugccucaaccccccaaguacgugcugggguuguagacaagaacccucuuuggggucucucacucagccccucccccacaguucauacggcagucaacccaaggcaucuccuacucgcuguucgcacuggugaugcuggggaacacgcuguacgggcucagcgugcugcucaagaaccccgaggugggccagagugagggcagcuaccugcugcaccaccugcccuggcucgugggcagccugggggugcugcugcucgacaccaucguauccuucaaagcgugugauguuggcaccguugugugggcaagacggccucugcuucagugugcacaucccugccagcccaccccucugucuacauacucauccaccuguccauuagcacauucaccuauucguccguguguccuuccaucuacaauccagccuuuaaccacccuucauuuacccauccaaccucauccacccacccaucacccacuuagacaccuauccaucuaugcacucaccuaaucauacacacaucccauuuguccacccauccuucaucuauaauccaacauuucauccaaccuccauuuaccuguccauccccauccaucuacccaccgucuguccaucauccauccauccaucuacccacccauccauuaucuauccauccacccaucuacccaucuuccaguguaucugcccauccagucucccacccaccuguccauucacucgacuacccauucaguuucccauuuauccauccauuuauucacccacacccacccauccacccaucuguguguccaucaguccauccaugauggguggacccagccaggaccagucccaucagugagcaaggacagagcgugcacuagguuuuggggugguuaccuaacuucaguggcacccagcgccguggagugaaucaccacuggacucuccugguuugggggagacagaggccccagcaggucaucgcaccgggacugggggagaaguuauucaggcacaagggaacagagucccagcacagccugugcaaaggccccaagggacagaagagugugugcacuguggaaacgagagcugagucauggagacaagcuugugugggcuucacuccucuucuccguuuccucccugaugacaagggugaacugccagucagacccucaggguuucagucacugucccugcuggcaucagugucugaacacccucuccaugugaccuguuaguguugccaagugguucagcuggacguuauuuggcaagaaguaaacacggucuuugugucaacauuuggagagucccagugggacguggugagagagaaaagcuuaaagucuagagggcccauguggcccagccucuggguguuguagggaggaagagcgcccuauuccagggucccugauggcagagucagggcaucaaggagggcacucgguggugggagagcaaggcgacaggagcagggcuggcccaguguggcugcaguaccuuaacaguguccucagaucuccauccaguuccugguguacagaagccaugagacugcugcugccucagagcgagagccccuccuccccagcugaucaucguccuggaugaugggaaccucagcugccaaaccaggaaggaugaggugugggcagagauacugccgccgcuggacugggccuagggggcugccuggaacucugggccuggcugccuagaacuccuccugaccuucagacagaucuggaguuggcuugugcugcacaggggcauacaucucagguguaugacagcugcccgaggagccucuagggcacccauagcugagaccccagaagacgguauggucaccucccaucuaccuaccucaaucugacuguacucuugguuacaucauagucaggggacccaggguugucccucugacuggauacaaccuaguaaaugguaccuuccagcugggccuguuucugcugcuccuucccguggugcuuaggguccaggcagggagauagggggaccauguguagccuccguggcccuuggcauccugacuuguaucucucugcccucuuguacacagaccuuacccugcugugacauggagcaaaggggacaccagugggcucuuuguucguggggcucuggaagaagcagauaacuaagggcaggauuugguugagcaucaccaggggcacuuggcaugaccacacgaccacccucuguguccuugccaaggcugcguagguagggugaggcgguuagcccaaagggagauguguagucaagugucucgcaggaacucagugacaguugccuuugaaguagagcagaggggcagacuggugccuuccugaagaagguggagaccggaagaacagauggaggacaaagccaacaggagacagggcccagaggugaugaggacagagaggagggagaaagguugcuccccgcugucuuuguuacaccaccuuuuggggacagaggaccagcccccuuccucgcuggccucagcuuacucauacauuauuguaggugcagaaaguuagaugcaggccaggggcuaccugccagagacaaacagggcagccaccucugagugcugucucauugucuuugcccacagcuaaagagaagguccuggcacagacccaggugaggcauguggugcuccuggucccuacucccagcccacugcugcccucaggugaucuuucagcuccaugccauccugggacuuggcgcuaugcuaguuuccuagggccagauggcaccuuuuccaaauccugaagaucuggggccucaguaaggcacgugaccccaggcgcaggccugaacugaagcugcacaggcaggagaaaaugagauggcagcccugccccugggucugucaggaggggugacacuccuucgugggggacuuggcuuugacagaggggguacagucucagaaagauuacauuucuccaaacuuugauuucuucugucuucuggaagcuugcuccagugcuccaaguaggggucagagaagagggcuugcagaaccugguggccugguuauuauaucuguuaggugagggcuucacagacuuaagcaucucaagccuguuuccgcucccgggagccgugugacuuaggccaguucccucuguuucccucucccacaacacuggaaacagcguuaccgaccucugacccucggcgcugccugcaugaguuguacguuugguuuuaugccccaggaucuggcacaugggugaagaaauggugacuacauuacuguccccauccaaggggauguagacaucucauaccucccugggggacagccaucuugacuaacacaacccugcugucaugauggccccacugcuacugagagcgagaaacuccacagcuggcuuccacgucuucucccuggcccacacuucuugcuucuugcaggucauggagugguggggugcccauccugauguggccugccguacaacaacaggcuccuccucagccucguguguggacuuucugguuccaaccaggcucagccacagaaauggaaaucucaugccaggagagucccccacgccaggagagucccccucgucacucuuagggaggaaguggggggugggggaggaggcuggaccaugugccugcaagugguuauauugagacagggccuuccguagcucagaccagccuaaaacccacaauccuccugccucugcuucugaguacagggacuacacacagguguaugucaucaugccuggcgucuauaagaugcccuagaggaaagcccucuccugugccuggaccucuacaguauucacagggcuuugccuccucuuaagucgaggggcaggggaagcuggaggcaggagaacugggccuagccaggcaaggaaucucuacuuauuaaucagaccugggggucccucucccccuccccucuccuccuccccucuccccacccuccucacccucucucuuucccuaacuaggacaguauggcccccaggucuccucuucuccaggaaggggagcaguuccaaaucacccuccucugccccuuuugucugacucccagggaaguaaggaggugugagcucuaagaggaaggcuugaagcuguucccucauggcugggacugcuuuccccacagguucccagggcucaggugguaagguccccaccugccucccagcccugcccaauagcucuaaggacacagcuauccccaauuccacauccgagucagacaacugggcaaagagcaucugucugugcaccacuuuguccccaggauacagcagaugcucaacaggguaccagagacacugucugucuggaggcucuggcggagguggagacugucaugccacuagcaagcacgccaacgacuuuacagggugguuugugaaucagagcuugauucgcgauuuggaaaggcgucuuguuaccuguacagcuuuaauauuugaaagcaguguuagagguagugagaauaugauuaugucuugcaacauuccugugcauguccaauccagaguaugcagaggccagcuguguagaaggagcugugcagugaagcugcugcggaaagacaacauuugcuggaggggaaacaucugcagggauaauacuuggcccacagcacaucuguccagcccauuuuccaaauuggaaaguuucucaaaagaggcagagguaaugacaggagagcgucacucuaccaagagugacagguaggggcuuggggugcagcucaguuaggauaggacucacccggugugugagguacuggguuuaacccccagcauggcaaaaauggugugguggugcaugcuggaaaucccagcacucaggaggcagaggcaagaagaugaguucaaagccaccauccuuaaguauauugugaggcuagccuaggcuacaugaguuucugucuuaaaaauaacaaaauaauaauaaaaaaaaaaccaacaaaauccuagaaauaguaaguugaaauaaggcacaaaaacaucaauguaaauagaucucagaguucuguggauauaagauguuuauauucugcauuuuaugguuuauaaaaauaauuguugaaaaccaagcucugucagggcuggagauauuauguuuugguaguuaagaacauccuuuuuuuuuuuuuuuuuuugagacaggguuucuguguauagcucuggcuguccuggaacucacuuuguagaccaggcuggccuugaacucagaaauccgccugccucugccuccugagcgcugggauuaaaggcauacgccacuacgcccggcuuuuuuuuuuuuuuaaagagauuuauuuauuauauguaagugcacuguagcugucuucagaugcaccagaagagggcgucagaucucauuacagaugguuguaaaccaccaugugguugcugggauuugaacucaggaccuucagaagagcagucaaugcucuuaaccgcugagccaucucuccagcccaugaacauccuauucuugcagaggaccagaguucaauucccagcacccacaucagcuuacaccugcaacuccagcucuaagugaucugaugacugcccucccccaauaaguaagaaagaaaauagaaaaauggaaaagaaaaccaaggucgguggcacaggcugaucucagcacugggaggcugaggcaggaagaacacacugaaggauagcuugggcuauaaggcaaggucagccugggcaacguagcagacccuuucucaaagguucaaaauaaaaaaagagcacaguaaggagacacagaacuuauuuauagagccaggaaaaaaauagcacuaacuaguuuuuuuuuuuuuuuuuuucugggcaacuaucuguguaccucaggcugacuuugaagccuguggguagacauggacgaucccgccuccaucucccaggugcuggaaucccaggcucacaccaccaucccaggcucugcaaucuaucuuggcguaucuugauuacagagaacucuacccuuuaagcagcaggcucagacaaucgugaguuugcucucuagugacuuaagcauguuauaucgcacgcagacagacccagaucccaaagagaggcaacccauacagcaaagcuugccccucaguagaaugaugcaucuuuccuaacucacaaguagcccuacacaggugucccagccagagcuaaacagcuugcuugguguaguggcacaggcucugaaucccagcacucagaggcaggcugaucucuaugaguucaaggccagcuuggucuucauggugaguuccaggccagccagggcucagcaacuguacagugacauuaagugccagccugcauagacccugugacaggaggagucuguugaguguuuccuacuguucucugcugucuugccugaugcugaucuaauaaacucucuccugcccuuuug

SEQ ID NO: 2221 - RNA, 8059 nt, Mus musculus
agugcgcaggcgcagucuccaugcugcgugcagcguccagagccgugggccgcgcugcuguucgcuccgcgcagcgcuccgggacuucggucgggcguccucucgccaugucccggccuccgccaccccgcgccgccucuggcgccccucuccggcccgcuacggugcugggcaccauggagauggggcgucgcauggaugcgagugcuagcgccgcuucgguccgcgccuuccuggagcgcggccacagcgagcuggacacggccuucauguacugcgacggccaguccgagaacauccugggcggccuggggcucgggcugggcagcggcgacugcacagguaaccgcugcacccggccucccccgccccccgcaccgaguagagcugagccggugcccgcaaccggcgugcaccagccaggaucugcauccaggagcuucggaagcuccggauccacagcugggucuaccccaagcucccaaggcaacuggaguccugaacuagugaacugaacuuugucccgccucuccuuagaaacuucuaguugcagcuaccgaggcgggugcgaggaagcuuccuacgcuaauguuuagccuacucugggcgcuuugcuuccuaccgcaaucccugccucccggccaaccguuguccauagccgcccccccacccccgacacgccccccauccccaccaggcuuuuuguucgugccuaccccucuugcccucaccaccucugcgcuccuggagaaugcuuaucauuccggucuuuuguccggacuagacuuugucccgugcagucgacagcaccuguggaucucaaggagaccuguggcaacaaugccuagggcccagcugggggcaggggcggaaagguggcgucgggagagggcauuucggccuuugugcccauucucugugccaggucuuacaauggcaaacucuguagcucuguaggcuaccgugggagaagugauuucuccacggagaguuaaagguccaacgaggaagacuguagccgcgauugcugaggagugcaggaaagaguagcuugucgggaagagcaguaggcagagcccauagagaacuggggaugggcccuacaguguaaguagggugcaccggagacugcaauccuagcuauuggaauauggaguuugagaguugcaaaguacgugugugaucagugacgcgugucccgcguuggaaggggaggggaaccgcccuucauuugcuugaagcuauuggagucucaggagggugccugauacguaaagaggccucacuuuuaccuguucugagguucuuccucccgguuccuguacagugggcuccauagacucacaugggguaaagcucacuuaagugaguggaucucucaagccgaaugcuguagaguucaccuggaugacauacauuacugauaaugaacauuucaguuuucucccccaacccccccuucuuuagcccauuucugcuucugaagacucaaugggccaaaguccucaggcaaaagguuacagaaagaaugccuuggggcuggggcggguguuguaguaaggagaugcuguggucuucuagccuuuauccugugggaucagagggcuccccuuguucuugccagaauccauccauccuuccgccgucguccaucaguccagguaguugguuccauaucugggaagaaacagugcagagcacugaggagcagcuacaguacgcuugcauuacaggcuucugagggucugaaagggauuuguguuaagauugauggcuuucaaggaacacauucaggcccccgugucucuucccuaacuuuuuuuuuuuuuaccugcauguaugugugagcccacagaggguacuggauacccugggacuguauuuauacaugauuguaaaccaacaugugugguucugagaaccucugaauacuucgugagaacaguaaguucucuaaaccacugagccaucuccccagccccucuugccuaaauucuuagucuuuaaggaucuccaugcuuucaggccuggcccuuugaguuccaucuccagucuuuauuucuuauuuaauguaugagugcucuucugcguguacacccacaugccaggagagggcgccagaucucauuauagaugauugugagccaccauguaguugcugggaauugaacucaggaccucuggaagagcgagcagucagugcucugaacugcugaaccaucucuccagccccuauguacauucuguggugagaaggagccaauuaaugggcccacagcauccugacaauaccuaggaacaucaaguccaaggucuaaaggauguuugauucugcacaaucaugucucaagucccauauugcccacccugcaauauacgaucuguauggcaagcaccuuuaucuaccuacugagacaacuuaccagccaacaugucuucuuuuaaugucuauuuagguacuuucucuuuaaaaaaaaaaguuaaaacuuuuaaagauuuuuuuuuuaaauuauauguggacaaguguuuucccugcauguguggguguguaccaugugugugccuuguauccaaagagggggcuaaagugauggaugauucuaaacugccaugugggugcugggaacccagccuaggcccucugcaggaacaagugcucuuagcugccaagccaacucuacugccccuaguuuguacucuuaauuaaaaauuauuuuuuaagaaucccucaguucacagauagcaugcaaaaaugagaaagauuuuaaaacucccuagaauuuuaagauuccuuuauauauguauuuuauguacgugugugcucucuaucugcauguaugucgguggaagagggcaucggauuccacugcagaugguugugagccaccaugugguugcugggaaaugaacucaggacuucugggagagaagccaguacuuuuaaccgcugggccaucucuccaacccucuaccuggaauuuaaaaaagaaaaaaaaaaaaaaggaaagaaagaaagaaagaaauguagccccugugccucccauauggggacaguuccauucuugucaccucaucuuacaaauuaggaaaugggagcuaaguuaaguaaucuagccaggaacagucacauuugcauguccagugaauaauucuuauaaauccuuuuuuuucucuuuuguguguguuuguuucugagacaggguugguuucucuguguagcccuggcugucuuggaacucaccacguagaccaagcuggccucgaacucagagaucugccuggcucugccucccgagugcuaggauuaaggaugugggcaaccaugcccagccuuccaauaaaucuuaaucuuuauaaucuugcuccaagugaaaaucgccaccaaggccaaccccugggaagggaagucacugaagccugacagcauccggucccaguuagagacgucucugaagcggcugcaguguccccggguggaucucuucuacuuacacgcucccgaccacagcacuccuguggaggagacacuucgugccugccaccagcugcaucaggaggugagggagggggcccugagcgcagagaggggaucacuuagcuucucgcccugagucugccaggacagugaggcucucugggcacagacucgguucccagguuccucaccagcgcagucuucucuuccugguuccgugggcugagcuaaguuguaaugaguccucuccccugcagggcaaguuuguggagcuuggucugucuaacuaugccuccugggaaguggcugagaucuguacccucugcaagagcaacggcuggauccugccaacuguguaccaggugaggggaacuugcugugcuagggccacccaggccucgggguucaauugauccuggguuuuccugugcuuuggauccccuccuucuacccucauagcaggccuucccucuucaaagcaggcacagccucagcucucacagccucggcucucaccgccccggcucucgccagccuggcaggugcaccugugugcuuccugccugagcacacauccugaucccauccugcacuucggccuagagcaugcuucucacacccugaaacaagugcucggcuucaaccuagaaggcccuuuccugggaauccccucagauuucccccugccccaggggcccagucucugaaccacaccuucacacauggguguucugaauuaagcagaaugaucaaaggaagacagggagagggucaggccaggugugaucaggcucugaggcaggggacgaucccagugagucuccaacagccaccaugcagacgcuguuuauugguuguuaacaaaaggguuuuggggguagaacguguuucucaaaccaaagccccuaaucuaaucucuguguuuccugaaggaaaacaccacaucccugcagcuuuaauccugacugggaacucuuugcaguacucaggaauggaagagguccuagcauugucaggacucucuugugacccaagucaugcgcagguuguaaagcgccuucagaaaagcaacucuacagauagcagaacccaauuacugcuuucuacggugauuuccuccuggucaagggacuccuagaaagcaacucuuuguucugaugacuacccuagauacacugaaaaacagcuuuccacuguugacccuagguacagugauuccacuagaaccccacuaccuucacgcacugagcacaucugccuuagagcgcgucuucaccgcaguucccugugggcuuuccuuacugugguuuauuuugagggucugagaccuaacuaugccagcaggugcugucacugagugacaccucagccugcugucuguaguuuggauuucgugauuccaccucuuggaagcagagaauuugcuaaacuuuuaaauaguugugaauucagcauccagcccguagaggaggccuggggaaagcuguagacugaugcugauccuggccagcuucugcucccugcacccgacacccucucccugccagagaucuuagacauaacugaaccugggauggggucaguauagagauuucaaaauacaagacugcaaagccaggccugugucacacaccugugauccagcacuuuggaaggcugaggcaggaagcucacuaaguuaaaggcaaauaugggcuacagagcaagacuguuucaaaacaacaacaacaaaaaccccaccagacuuaauagauaaaauaugcaugcuguauagccacgaggaccugaauucucaccuccgaauuuacacacagagccaggugugacugugccccuaguacccaguucugaggaaggcaagagacgggaucacccagcuccagauucagugagagacccugucucaagggaauaaggcagaaagcaagagaguaggacuuuccacauccuccucugaccucggcacccauacacaugcacagcacguaccuacagacacacaaauauaaauacaauuuaaagaguggaggaccaggcuggagagauggcucagugguuaagagcacuggcugcucuuccagagguccugaguucaaaucccagcaaccacaugguggcucacaaugaucuggaaugggaucugaugcccucuucuggugugucugaagacagugacacuguacuuuccuucuuuuuuuuuuuuuuuaaagauuuauuuauuuauuuauuuauuauauguaaguacacuguagcuguccucagacacuccagaagagggagucagaucucguuacggaugguugugagccaccaugugguugcugggauuugaacuccugaccuuugguagaguagucgggugcucuuacccacugagccaucucaccagccgcacacuguacuuucauaaacaaauauuuuuaagcagaaaaagaggaaggcuggaucccuucccuugacacauccauacuuugcaacaggccccucuccuucccugcagggcauguacaacgccaccacccggcagguggaggccgagcuccuccccugccucagacacuucggacugagguucuacgccuacaacccuuuggcugguaugggcugccguggggacaggcccugugggugggagggcaugcccggccugacgcuacagauugcugcccuggcaaucugucugagaagagacugggccggggucugacugcagccuucccacagggggccugcugacuggcaaguauaaauacgaagacaaggaugggaaacaacccgugggccgcuucuuugggaauaacugggcugagaccuacaggaaccggugacuggggcucucugugucgggauggguagggcggggagccccuuacgugccauucuuaccucugcuucuagggauagaaaccaccacuaugccuuccuuuucuguuccuugauuccuauaaaaauagcgaauccugggguuucucauuuccuucuuccuacauaacgaaaugaggaagucccacuuccaccuacagaccuugugguccugggaguuuuugcuacucugagaaguaaccugccaagagggaaagagaggaccuugggugaaggcuuuuggguucuggggccaagucuggcucuacaguagcuuccucauugcgcuagguaagcgguaggcaggaguuuccacaucuagcuagcagugagcaccccaggagcuucugguacuguacggagaagcagcucucccagaggacuacagcuccuuccaugcuacagaauggggugggaacagugucguggucggcucuuuggcuucagcucccggucugacugaagauucucagcccaugccucuccccacucccucagcuucuggaaggaacaccacuuugaggccaucgcccugguagaaaaggcccugcagaccaccuauggcaccaacgccccccgcaugaccucggccgcccugcgcuggauguaccaccacucgcagcuccagguagcccaggccccugagcuccgcugcugccccuuugggagacccagacuugccuggcagugauuucuagaaaggacaccuccuccggggcuagggaggagcuguucugauucgggagcggugcacggugcuugcuggacaggcaugagaggaauguccuauagacgggaggcuuuaacuuaggucuccuuagggaagaccucccguaacaagagaggagaacagagucacauauuuucagcugguaaaggcaccuucaguucuuccuggcuguccaggacagaaauacacaaagaucccagaucuuaccaggggaccggcaaggaggggcaugugacaggagcuaccaacuagcagagagggugcugagaucuggcugucuccccuugcagggcacccgaggggacgcagucaucuugggcauguccagucuggagcagcuggagcagaacuuggccgccacugaggaagggccccuggagccggcugucguggaagccuuugaccaagccuggaacauggucgcccacgagugucccaacuacuucagauagacuguuguggcucaagaucccaggggcucuucugccaccccauggaggaggaguuacgccuggccacuccuugcccagugcugaccuagugugugcuuuucggcuggucuccaccuguuuccugucugaauaaagcaggugucugaccuggcugcagccagaacugaaccucagaccgucuccucugcugcccaacaccugcucccuccacccugccuggggaccaugagaaagggugaaaccaggaguuaggcuucagagagcacagauagggagagucucacgcugccuccaaggucuccucacugucacccucgcuuuucuacucgugacagaaccagguggguguggguacgcacaccugcuaauuccagcccucggaggauuacaccacgugcgaggucaacacugaucuauguagugaguuucaggccagccagggauacguaaugagaccucucagaaacaaacgaaaauuuaaaaggcacgugcuuugaagaaacggaacaauuaaagucaccaugagaguugucagugagg

SEQ ID NO: 2222 - RNA, 2021 nt, Mus musculus
cuuuauucugaaaucuuuauuaaggcagcaggauagaaaugggccaccagcccaaaccuuguggcccgaggaaagaccuguggcccuagggcuugcccucucuccagauagcucugucaccuccacggcaucgauccaucccaaccuaaugaagauaagguggaggggugaggagaggaaggcaugaccccaucccaggcuguagcagcuccugggccacaaagcaguagcagaggggaagaagggagggaaaaagcaaccgccaggguuaccaccacuugugggguacaggccucacuguacccucuuacaguuguauucaaagcaauacauuaaaaugaccaucggcaccccucaagaccccucaaucacagaagcuaagcaggaagcaaagcaacaauguauggguuccugcucuucuggccaaagccuaggcuguucccucuaagagcagcuggaguacggauuacacagaggccaucuagagcggcccucauaagcgucuaucgggaugcccgaaggggccugcgagggccaacgccuuuggaagguacuggggcguuuuggcaacugagaagguuggagccccagacagaagagggacucaaaagaaaugcugguguguggauuuuaccuguuuguauuucucugaccaucauggcccaggacagccaagcugguugagugggaaggaagagaagcugacuggccaugaagacgccccucaugaccaugcaaccccuuagugcacacuguggggauaggcaggaccuggccccuugggcuuugugagggggaaggagagcucccccccccucaggcuucagauauagcauggauuguuagaggcagggagggaguggcaggggccccuccucugcuuggugggcugagagggccugucucaagcuacaggugaauggcugugacaucugugggagugcuggucugaccgggccccuggcugcuagagcuccgggggacuuuggacaccgggcugggggcugucugagcagcuucccugagguucucccugagggcagcuucgaucugcuccugacaggcacgcaggcaguccacuucagugccugugaucccggccagcaacucugugagcucauccgcagacauagagcaggcgccuaggccuagcacugccgccccaaugcugccuguggcaaucauggauggaggauacaucgcaaagguguaaucuguagcacagagggccaaaaaagucugggcaugcuuuuugaccaaggccugccaaccacugggcagagacaggcggugcagaaucagggccaggaagucgugcgcaaucacagcagccaggucccacuugagcuuccccaggaccagcaccucccacucccgcaacugccauggagccacagccugguccguaauagaugcaaagcuucucaauagucaggggcgugguuucgcgcagcuuggaggccagcaacaggcagacggguaccuagaagcugcaauugcgccuuucggguggggacgcaggacagguagcgauacagguagaucauagccagauggaagacauccuccucgcagcgcugcuccucacacaccuccagcauccaguaugccagcaucuuccgcaugugcggcuugaucuucuuuugcaugcacuggaaggaggaggaucgcggcacguagcgcuccuccaggcggaguaaacucugcaggacacacugguccauaagcagccgcgggucgggccuggcccggggcgcgugccgggugcccucgcaacauagcagcuccauccugcgauggcucacgggugaaagcaagagugugggcuagcgaguccuaggagaagugagggagagcgccgggugcgggcgggucuggcgcuggcgcuggcacuaugcggagaaaccccagccggccccaccaccuggcuuuuucaagacaagauaccaaaugcucuaugcuggccuugaacucccuauguaucaggucuccuugucucuagcuugcaauuuccaguguau

SEQ ID NO: 2223 - RNA, 5144 nt, Mus musculus
cgggccucaagccccucccuccgcagagccauagagaggaaccgguucgcgagggacuugguggagugcucgggacucggaagccgccgggacuggagggacccgggaccugggcagagaaguggccuucaggacacugggcggagcgcaggcggggaagagagggcucgccacaguucaggcacacgcgaggggcagccccgagcgccgucccauaagcccccgcggcagccggguccuaaccggccgcccagucuuccgccgcacgugccuuugccgcgaugcccaaauccaagcgagacaagaaagguagguucggggggccugcgucaagggggcgagggggacgcgggugagacgccggggccucuccgagaggcucggccggccgagauagcgagagagcuggaaacugguccgggccgacagcagucgcauagcccaggcucuccucgaacuugccaaccaggauagucuuacacaacuaaccuugcugcuucuaccucccgauugcuggaauuacaggcagcaucacuaaaccaaguacgcucuuguuaggcaaacacuacccacauagcacuggucuacauccccuggcaugugcgagcgaccguguguguuugagagaggaucuugacgauguagcucagauuugcuuaggacggucucauuaucucaagaaaauagggguuuuacaguuucgacuacugcauguuuuguuugucuauuuauugcuggggccuugaacucuuccaacugucugccuuggccccaaauacuaggauuccauacugagccacuacaucaagcuagcgggcuggcgcuuuuguggguguuagaagacaagacaguugaacaaaaaggguccggcuucaucagacucaccaccuuaguuaggggugugugucugucugucugucuccuauaccccugucaagucaguauaaugugucagguaguccaaguggaguauggagcaggugggagugauaguguuuugcauaauguugucaggaaaacucucagcgguuagagaaggucguuuggaauagagggaacacaaaaugaaaggggucuguggugugauuaacauauugugggacagccaguguggccauagugaacaaagugggcuuagaggaaaagacccagccuuugguguggcuuugcuuugaaagggucccuugauagcacagagaauaugaaggcagcaaggccagcaaccaccugcagcaugcuaagucgcaccagaauccuagcgguggagaguccgggaaugacuggcugggugugacugugugccuuguaaagagggacugugaguggcaggcaggguagaugaaugggccauaucggcuccuggggacacccagggcauuauagcugauguuuuaguaaguucuuauagagucguuagggucuggaaggagcccuggacagauguaagcaaaggccgggaacucuugggaguaggacagauagagccugggucacuuuucaguagagguugugucccccaucugcccucuccccagcguugcuguagucuuggguucagauuacaaaaaugaaguguagguauauaacagaauaggaaagauaaggucccaacaggaugacgugguacaugccuggaaucccuccacuuaggagacagaaguaaggaacuguaucuugaguuuaaggccagccuaaacagcuuuguagcaagauugugguuuuuacaaaaggaagaguuggucccugucauuccauagccccaccuuggccagcagguugggaaucccacagacagcgcucuauccgcaggaauauugaguaugguaauacugcaauaaaugcaacagucggcccaaggaacuaagggcacuuuguuuauggcaggggauguauuuagggaucuuaggguccaagauugcuaggaaagcaaacgcucugucagccuugaaugccaggaaugacuguccauugcugccucugucacacuggcuuaguuuagccaagccuccaaagagggaagcagaauuagucuccagagcauccacacucacaguugccaccaucucuuuuucuugguuuuuaguuucuuuaacaaaaacugccaagaaaggcuuggaacugaagcagaaccugauagaagagguaagugcuugcuuguuccugugugugugugugugugugugugugugugugugugugugugugugugugugugucugucugucugucugucugucuagauagaucgaucgaucuuugguuaguagaauuguucccauaccuccccacagcaucccuaugaccuaggaccaggugaugcuauugcuguuuugugcucagggguaauuaaagcuuauuagugaguuuguaaugcugcccaauguuagaaggcuggaggucaccagguggugacuguggccagcuaucucuagcugaccugcugguucugggucagauaagugcagucuccccgggcacaaauucccuauucuuuggaaauggagcuuuauuuaccauagagaggcuuccuucaggagccuggccagggcagugagggcgacaugucucuccuuguugauaagguggggcuccuuguauuuugauuuagcaggggccuucccaggguggguagauguuucuagaucaacuaagugaacagaggaaaacagggugauuguuccacauuggucauggaaggaccauagagugugggucccugcucacccucagugguagaugacccuggugucagucacacccguggaagauuaaaggccuauugccacuucucucgugugaggccagaguugcccagccugugcugucccucaacuccagagccucaugaauugucccacagcuucggaaauguguggacaccuacaaguaccuuuucaucuucucuguggccaacaugaggaacagcaagcugaaagacauccggaacgccuggaaacacagccggugagcgugcagugggaagaggcgagaaccgcucucaucagagcccaggagcagauugacccuucaaggccgcagcucgccugcugaagagcacggucucugucagaguugggcuuucccugagcuggggaugggauuuguuggucacuggggguauuucaaggaaguggucccuggucuggcacacucuaauagaagugucaucgugugcaucugaccccaaagcaggcuccaggagcugacggguuacacaacuugugcagguggcucuggggucacuguaugcugccccagcuccaguaaggccuguugaccaugcuucugcucacagcagacauggauaggugauuuuugaggcucgaagugagcugucucaaacuguuggcaagauccgauccugugaauaagaaaaucuaaacaggaauccuggggacacauggguggguugcauggagaacaggggcucuggccacaccuccugucgccugguucugggcauuggcucacacccucuucuuugugguaggauguucuuuggcaaaaacaaggugaugaugguggccuugggucgaagcccaucugaugaauacaaagacaaccuacaucagguaggucacuggcccucacuauuugaggcuggagcucagcugccgucucuccugcucuuuucaacuuugugacuggccuaugguucaggagggccaagcuuggcuuaacucuguucuuaaucuccagacccauggggcuaugaccccuacuuacuaggcugcccuacuuacuaggaguucuaccaacuagaaauguucguagaugauaccaggugcccuuacugaagaagcaguggcguucacuugugcuuuucaggucagcaagaaguugagaggugaaguugggcugcuguuuaccaaccgcacgaaggaggaggugaaugagugagugucucugagcgagggaaaggcugggcgucacggaaagcugaaaggaugcaagccucuuacugagacugcgucuguaaucaggcuucuguuauccucucugcugugguccuccccucugccugccaguccacagccauuauggcuggacuucggcugcauggugguguuuucaggaacuuuacccucacccuucccugacuuaggugguucaccaaguauacagaaauggauuuugcucgagcggggaacaaagcaacucuaacugugagccuggauccagggccccugaagcaauucccucacuccauggagccacagcugaggcagcuggggcugcccacugcccucaagaaagguaggaggcuggagagguggcuuagaguugggaguacugacugcucuuccagaggacauggguuugauucccaagacccgcaucaggcccucucaggcaccagguauucaugugaugccaaaggcacgcagcucagggguuccugccccagacuccccuagaccagcugcuucuccagucugccuuguaaaggcagagcugagcacucgccuccugcagggaggaggcagccgcugucccucugggugcugaacuguagggaagacaauuuguggccaugugcuugccagggcagggaguaacguggugcugcccucccacagguguggugacccugcugucugacuaugaaguaugcaaagagggugaugugcugaccccagagcaggcccguauccuggugagucugggccugcagccugggagaggggcugcugccauucagcugccgggcgcggcccuaugcugaccacggcuccuccuccuccucacuccccuucccccaccucucacagaagcuguuuggguaugagauggcugaauucaaagugaucaucaaauacaugugggacgcccagucgggacgauuccagcagauggacgaugaccugccugagagcgcgccugagucugagggagagucugaggaggaggaugacagcugacucugagagccaggacuauggccuuccagcgaguucuucaucuuugcuggacaccccaccccaccucacccugcccccggacugcugucaccacucuagagggaacagcuauuuauuuugcuauggacaaagacaagggagggugcuagggaaugauuuuguuucuauaaagaauaaaauuguguccgcgggguguucccgggagacagcaggagacucuuu

SEQ ID NO: 2224 - RNA, 3836 nt, Mus musculus
caauaagcggcaauaugguuccccaaccuccuggaaauguaaguuugugacuuggauucggaagagaugucugaacggcgccauccuaggacagacaggggggagaggaggccacaaccugcucaguguuagucacuuccucugcccaguguaccgcaugagcagccagccauucuagcgcuuaccacuuggcaaacuuucugcgcacaccuucgcuuaguaaugauuuucuucaugaauuccuauuucgcagccacuucuuuauauauuuagaauuccuucgauaauaaucuagagagaacguuaagcuuuuuugaaauuuggucccuauaggccaaauugucugcgaaccuuccucccucagaccccagaggguaagcauuaguagccaucgcagcagucuuucaggggccccuauuuggguugacuguugauuucagcaauccuucuaucuucaccuccaguggaauuacagguguggguguccacaccuguuuauaguucugucgggaagggggaggauggucuuauuuuauucgggcguuuccacuguagcucaggcugacauggaacacuaacacaauccucuugccucagccucucaaagugccaagaucaucaccacgucuggccaucagcaguaauaacaagucucauauuucuggcuuuggggugucaaggcacucggaauaaacaucuuccuuuucaaauacauaauuuaguaguggagguucuugggauaacaucuauguuguaaauuuagacugaggagcucaagagauaacuugacaguuccauucucaccacccaggucuagcuguuaugguuguaacuccaguuccaggagaucugcugucuucuucuggacucuauagaaaccuccauucccaggugcacacacccuccacacauauacacacauguaugguguguguguauauauauauauauauauauauauauaugcgcgcacauaaaucuauuuaaaguguuugguaugccaucacuggggaggcagagaauuaccacaaacucaagaccagucuggucuacguagcaaauuaaagccugucaggaauauacaacaagacucugccucaaaaaaauaacauacauaaauuuagauaacacugaaaagcaguguuagaugaagcacaaguuucaacacuauuccaaucuaaaagguaagauaguacuuuccagaauaguaauauuuuaugaacuaaaaaugaaggacuuuuaauuccgagaggcagggggggugaccugaaaauuuagaauuaauugcagggcuggagagaugguugaacaguuaagaacacaggcugcucuuccagagaccccagguucaguuccuagcagcuagacucccagcuacaguaacucuagccccaaggaaucuaacacccucugggccuuuccccacacccagccuggggcacacacauguacauaaauaagaacaaauguuaagggaauuagaaaaggggcucucccagagggcacaguuucaguucccagcacccacaugaccgcucuaacuauacuccaguuccaggggucugauguccuagcccuggauuuuuuugacaccagacaugcauaugauacacauacacacaggcaaaacacaauauacacaaauaguaaaaauaauaugaagccaggcaugguggcccacacuuuuuuaaucucaaggcucagaaggcagaggcaggcagagcuuugugaaugcaaggccagcuuggucuauacagggaguuccaggaaagucagagcuauagagacagacaauauauaaauaauaauaauaauaauaaaggaaaauaaagacuuaggagacaaguuaagacuucacucaggccuuggcuauuucagucagcugcucugagcagcuuuggugauaugguaaagguuaaaggugaaauaccgggaguucuagaaaagguaggucacuucccgaccauuagccacuuuuucuggccgguaagugaaaaaacagucuugcagacuaacuguacuguagaaacacagcaggcacuauaagagacacaucauucaguuccuccagagggcucaguucaguucccaggaccuacauggucacaauugucccuaaaucuaguuccaagggauccagcaucuucuggccuccgugggcaccaggcaugcacgcagaugcaggggagacacucauaaaucuuaaagcaaccaaaaccaagacaaacaaacagggcagugugguaagaguuacuuaucuaucuugcacaaaauuccagcugcucuauuucaagacuagagcaggugggguacagugauauaugccuuuaauccaagcacaucucccagauucacaaggugagagcuuauaacaaaacaaaaacuagagcagaaaaguguaauggguuccaaugccuucucccagguggcuuuccacgaagccagcaguccaggcagggacugacacuggaagugucagauacucacuaacccaggagaggaaacugguuauuacugaugaagauguugguauuuugcccuacauaacuccauuuuuuccuguuuguuuucuaaguuacuaugugugugcauaugugcacaccccgaggccaggcaaggaugcuagaucuccuggagguggggauacaggugcuugugaggcacccaauguggguacuagggacggagcugaaaaagcaacagguacuucuaaccacugucucuuagagcauaggcugaauauguagcugaagaugaccuucaacuucugacucucccugcuccaccucucacgcgcugcuauuauaggggugugccuccacaaguggcugcuauuauagggguaugccuccauguguggcuuuucuuccccacccccccaucaaaagcagccuugaagugaacucugaagacacaaaacaaagcugagccaccgaucaucagcuuuauuccaggagcguggucaacucuuugacuucccugcucaaaagaacaagcaguccccaaguucauaagcaaggucaaacuugggauucuuucugugcagcauacagaagcccagacaggaguacacacaccuaacacagaagcccaaacaggaaaacacacacacaccccacacagaaacucagacaggaaugcacacacaccacacagaagccuauacaggagugcauacacacaccacagaaggagcccaaacaguagugcauacacaccacacacagaagcccaacccuagacuacauagcuaguucuagcccagccaugguuacauggugagauccugucucaauaaaauaaguaaaaagauuagauguguugaggcucuagcucaguaguaguaaaguguguccuaacacacaugaggcccuggguuugaggcacagcauccuccuugcagccccucaaaaaaauuauuaagauuuuaaaacuaagaaaaacaacagcccucguggcucaccuuauggagagcuucagugcagagaacuggccuggcaugagagaccuuggauucuaccccuaaugccacgcagaaaauuauaccaaugagauuuaaaacuugcccaccaccaagcaugauggccaacaccagcaaucccaacacugggaggcuaaggcaggaggauugcaaguuugaggccagccugggcuaacugagcaaaacucugucuuuaaaaaaaaaaaaaaaagcuaagcauggugaugcaugccuuuuaaucccagcacuugggagacagaggcaggcggauuucugaguucgaggccagccuggucuacaaagugaguuccaggacagccagggcuauacagagaaacucugucucgaaaagcca

SEQ ID NO: 2225 - RNA, 3699 nt, Mus musculus
agguuguuaaaaaguuauuuauuuauuuuacggaugugaguacacugucuuugucuucagacacaccagaagagggcaucagaucccauuacagaugguugugagccaucacaugauugcugggaauugaacucaggaccucuggaagagcagucagugcccuuaagcugagacaucucuccagucccuuugaggggauuuuauugaugugaaugagugcuuugccggcauaugugucuaugcccuguaugcauggagugccuguggaguccuggggaggaugcuggggcccuggaaccaguguuagcaguuuuaagcugccaugugagugcugggaacggaucuccaguccucuacaagagcagugagugcucuucacagucuagccuucucuccagcccuuggggauuucugagacaagguuuuauacuauagcucaagcugauuggaacucacuauauagcccagacugcccuugaacuugauccuccugucucaugccccugaauucugggguugcacacaagcaucacucccuucuuaaucuaaaacuagacuucuaauugcacaaacacacucuguucugaaagacuaaagcauugacucuuugccuaccacccaucuuucugagaucucccacaauugcauauucacuaggaaaggugccccuuucucuccucuguaugcaccccaggggccuggcuucuguucacucaugcccugaugucacccauaggcgggagaccuuugauuuugaugacgacugugacagccugacgugggaagagaaugaagacacacugcugcuaugggaggauuuuaccaacuguaacccaaccauugaccugcagggugaggugagcccaugaccugccuucucugggggugccucucucacaggaucccucauucuuuccuuugcaugcagccuuugauccccagcuaaacuaucccuucugugcccccagcaagaagaaaacuugggcaacuugauccaugagaccgaauccuucuucaagacgagagacaaggaguaccaggagaccauaggccagauugagguaagcacucaagccaaggagccugcuauggggucucucagggauugcauaguuaagauccugggugcucauagaaaugcaggcuugcaaaauggggcaagucaggguuugaagucaaaagccuggcauugcaaaccuguucucauuaggguauugguuuccuaaucuguaaagucaggcagugauuccugccuccccuaaagaggcugaggcaggagagugccaauaacaggcuuacucgaugccuagcaucauuuggcaucccucagaagucagccguggucauccuuacuuccuccucugcuagagggaccagguacccauacaaaggaggaaaucauguccaaacaggccaggucacuuguccacaguuucccaguuaugaggcaacauucacaccagugugcuuggccacugcuauacaagaguuagugcucuuccuguguugaauaaguccagaguccucccuccucccucuagcugucacaguacaggcucagagacaugaacaguuuccuuuucuggggaacaggcaaguucuccagagaugcugagcacacggaaguccccggaaucaguuggggcuuaguuggacaaaccucucugggguugcuaagcaaccauacccacuuuguucagaagcaagucuaaagaauauugacuggugugcagagaauaaggaagguugauagcacaaggcaaagccuagauggcgccgccaccaagggauagaggagggagguugcugcgggcaguaaccugaggugagcggucccuccucaucaccuuuauucgacaaugucuccuuccagcuggagcuggccacagccaagagcgacaugaaccgacaccuucaugaguauauggaaaugugcagcaugaagcgaggccuggacgugcagauggagaccugccgucggcucaucaaaggcucugcagacaggugcggcugugcgcaugcgcauaggcaugcgccccagggcuuccauggugggugggggcuuuacagagagacauucggggcugccucgugcagcuucacuacauuuuaauuuuuccgacccucugucugaccuccuauccauccaccuccccccaagcccccaucacgagcauaccuacuaugugcuaggugacuaauguauagacaaaacaaaacaaauaauaccaccaccaucacgaucgaucgguucaacagagaguugucaaaggcccgcugugugcuagagcgucugaguuaguguucuguugcugugaugaacacuaugacggaaagcaguugggaaggaaagggcuuacuuggcuuagacuuccacaucguaguccguuguugagggaagucagggaaggaagcuggaaccaggaaauggugcagaggucauggagggcagcuguuuaccauuuugcuuuccauggcuugcucagccugcuuuuguauagcaucgaggaccacggaccaccuguccagggguggcaucacccgcagcgggcugagaucugacgccaaucauuaauuacgacugaaggccagucugauggaggccuuuucuuuucuuucuuuuuucuuuucuuuucuguuuuucgaggcaggauuucucuguauagcccugacuguccuggagcucacuuuguagaccaggcuggccucagacucagaaaucugccugccucugccucccaagugcugggauuaaaggcgugcgccaccaugcucgguggguggaggcguuuucuuaucugagguuccuucuucccaguuaccugggguuuucagugggcaucgcuuuguuaccugggguuuucagagggcaccacuuugugcucagaccagggaugauggaaaguuacagaaugaauacccacgaccaccccaccccccacucccaaagagaagccacacgcuacaguaagcaguggcuaggguagaggucccaaggaaugccaagagcccuaggcagcuuauggaaccuacagggacugggagaaagugcgccuugcagggaucucacagcaggagccccucaggguagccgccacuguguuguugcugagaguggaacccagagccuugugcauacuaggcaaaaguuuugcucaccccagacccuucggguagguuuuuuaacaggugugaccggccagagcuccgggcccugggccguuagggucccccaggcugcucucugaaaggcuuugguuucuaaugcaggaauucaccgucccccagcuccguggccagcagugacucaggaaguacagacgaaauccaggaagaccuggagcgggaggcggauguggagcccauggucagcugaugacggaggcccgacgcuccugguggucuuggugaugggguccagccuccucuccccacugagccgugugggcuccacuccucgacacagacuucuguccucccuucuccggaggcccagcgggaccgcugcuuccuuccuuccuccaccaccgacccauggaauggugcugucgauuuuucuauuguccccacacacaccacaaacgcagacuuuugugcgucgaugcagugcaacugugccuucucccuuaagcugagccacuuugagcuccaaagaauucuuccuagcagguguuuuuuuaaauauaaaacucuaaggug

SEQ ID NO: 2226 - RNA, 1804 nt, Mus musculus
aauuugucuuaaaauuuuaaucaauuaauggcauaggagaaaguagggcaagcgcugagagcuugccaggcucaguucucuggguguuugugcauuccuucauggggucucuuuaaagauccaccgcuggcuuuccccguuccccagcaaggccacagggucgaacccugcauccuuucccuggucagguuccuaaauccacugcccaguuuccggaagaagcugaggcucucuuccccagggcaaaucaaagccagaacaggaacgaugagcagaggggcugacaggugaugccccggacgcccugaaagcuuaaggagaauuuagagaaacacaaagucauuguuuuuccagcagggagggagcuuauggcucuuguuacccagggaggugacaggcucagcucaggaaggaaugaggggcaaacgcagaccacaguuggguagggagugcgucugccuccuuaccugcugccucugacucugaguucacacuagggcaccuaccugcucacaucaugaugagggucaugcuacaucuugucugugugccucaguuuucucaucuguggaacaggaggucacagcccuacagugagcuucagugaaccggggggugggggagggggagcgggaugcucgucacgaagucuccacuguggaccugcaaagaccagcagcucuagagcuaaaauuccaugugguaugauugcuacacccaaucuucagguuggaaaaucgaggcccugggaggccaaacagacucagcagauaacacaagcuggucagguucacaagagacccugguucuuagcgcuuucggcugaccugaccucccagauauucaggaacacuuagauaguggccaagaaguuuccagagaaccucugggcugggagggaaugugggugaauggugagacaggagaggaaagagcugugucugucuacacagaggaugagcagucagggcagccuuccuggcagaggcagcucgagagcucuauguacccccaggaucuaugucacugggcacucaugcuggcccaguacuaagugguguccucagaugagcccuggcgcucuucccaauaguuuugagaguggugugacagauggggaaacugagccugagagaagucacaugauuuccuaagagauacaaggcaggacuagggcugagcugggaaucacauaguaauccaacagccuguuuuaaccugcaugcuuuuuaaccacuccagugcacugcuggggucaggggugguggcuagagacuuuccacagggacagggaagagaaagauacuccaguagagaguaucugaguaucuacaccccaccgcaaggcucaaccuugcaggacacacaaaagguuuaaaugcuggggcauguaguuguucuagauaccagaacaugcuguaggcauagaucagggcacacaguagguccaaaguccaggacacaucguggaccugaaugucaaggcauucaguugauccaaauaucagagcacagaguaggcugauaugcuaaggcacacaguaggucuagauguaguucacacaguaggccuagaugagggucacacuguaggucuaaaucugugugcagauguggcccuugggcccccccgcacucugugaaagccacaguguccagcccuuauccucaccuggaugaggcucaggccaacaggcaaaggcaacguuucugcugcuccuguucccagcuuuucaaaaacacaauuacucgcccuucagagacgccgucaguguugguaaacuccagccacuaaaccgcauug

SEQ ID NO: 2227 - RNA, 2118 nt, Mus musculus
ggauguuggaaagcuguuuauuuccuuaaguggcucacaugguccccuuuaacccuugaauagcagaccacucaagguacaaccuggacaggagggaagcccaucucaucugucagugcagagccugggugauccacccccccgccccaaaauccucaggucacuccucaacccucccgguggagaagaagugucaccagagagcuuggguuuucacacggaggucuugucccagcauguacucugcugagacagauaacggagccuggugauagagaggaauccccuagcuuagagccaggacagguguggcauagugagggaagagcggugcaaagggucugagggcagcccaccucagcuucauccggugcucaacgagggucugaaagggaaggaaggagaagucuugugggucaggggaccuguccagaauacauuauguucaccugccaugcuguuggguuuggacauaauccaugaggggugauccaagauguuuaagagcagcaggcuugccaccauccaauuuuauaaaguugcuguccuugcacagaaagaauugacaauaucucccgauuggcacggccaucaugaagcuuugcauccccgcucugcccacgcaucccccuucuuuccucaucauagcaaaugacaucaccacccacagauuuccucagccaggacucuuaaaaucuuucccguccucugagucuguugccacuacucauucacaucuccuccuguuagucaacucucaacaccugccaggaguccaucucuccccgaagccuuggucaacacuuggagcgggccacucacucacugcacccuuguauccuugcccagccucccuguccccauccacaucccugagcaaccagggugucuuugagcaucuguaucaggacagcgcccuccccuggaguggcuugguacugcagaauaaaacaagaggcccacaugggggauccucgcauuaugccaaagcccaggaagacgggugcuugaggagugcaggguuuucagcuucacagaaggaaacccuaugccuggggcaggcugaucuggaaggagagagagcuucagagucuaccuuaaucagugaauaacaauuagcuccucccagacuaccuugcaacccuacugacccaucccuguccccacccucuaccccuacaagcagccucagaagcccacagugccccucauggcacacuggggucccuggagagggaaggaaacugcugauguaugcaggccagccaucuaggcaaacauuguacugacacucgucaguucugguaggcugucuuucaacuuucuuaauuguuauauaauuacaucaccugcaaauagcaaugaccuuccucuuccuaaugcacgaagagguaacaggccccggaguggcaucgucuccuaagucaucaacacucagauccugcagccaagaugcucagauuccaauucacccucuucuuagacuuucugugacucuagcagggugggcuggagagacggacagacggcucaguagucaagagugcuugcugcuccuacagaggacuuucccaagguuaccugaagcuccaacaccaaggguuauagcacccucuaguggccuucgagaauaccagcacucacaugacauacacacauaagcaagcaaacaggcaaaugaauacaugagugaaugaauaaauaaaucuuacuauuuaaggugguucgaugauacccgacacaggcucacauagcugaauucuugguccccaguugguggaacuguuugggaaggauuaggagguguggucuuguuggaggaggugugucacuggcuuugagguuccagauaucagugccauucucagugucucugccuccuucuuguggaucaagaugugagcucucaguuguuccugucgccaugccuuuguucugccauugugguaucagacccugaaaccagaaacccuguucaaugugaucuucaugguguuauagcgauagaaaagucagugacccgcuauguaagcaguauuuuuuacuuacugaauuugucgucauuucuuaauucauuccauugucugaaacuuucagaauucuugcaaaaaaaaaaac

SEQ ID NO: 2228 - RNA, 23231 nt, Mus musculus
cuaguugguucuaauguuuuauaucaaagcaucacggcuuaaucucuucaaucuuuucgaaugccaggucuauuaagaggcuuucagacggugcuucuaauaucccugaaacgcaccaguuggugcucauuuucugaguuguuuuacauaagugcuuccacccaggcuggugacuuugaucaaauaacuuagauuugguucuccaggauucuccgccugccuucaaacguuugguccugugcacccuccccccgcccccaucccgcuucuugauguaauuaagaacgaacugcaaagacccuagaaacucucucuagucaaccaaggaaguugccaaaaaagaaacuuucaguguuaacucgggcgcucgagagagagagagagaaguaggaggaucagguucaaugucagccugggcuacacggucaguuucaggccagccugggcuacaugagacggaaacaaaaccccaaagaaaaacauuugucagaagagaaagugacacugagaugcaaaccuuccccuaguuccaaccaagccgaucgugcacguggcuugucggguccugugaggggggcccugucgacuccucagccuugaccccagcaccucuggccacuucucuucccggauuccuagacccugcacugucccacgggguaggggaaagguuuccucucccacuucugccaggucagauucuuuacaauuuuaaaacucagcucucccagggaacgccuuccuugauccuggaacccgguaaguaccaugcuuucaguaauuucuuaaucuuuccucuuacuucgccuuccaacugggcagagaucuuguucuccaggucuguauucuaagcuucuagcaccuuugcaucuagucuugcuuguacugaggcgcgguaaauacguuuuuaaaaugaagaaaauucccaucacaaguacuuucaaguccaccuaugcuaauuacuaauuucauaguacgucccccagcuaauuacuaauuucauacuacaccaaaccuuuauguaacuugaucauucuaacagcacccggcugcacacucuggacgcauccacgacguaucaaaucuacccugagucugcacaggagaaaguuacucaaauuguguucauuuuucauucccaucacucaauuagggcacgucccucgcuggcugcugcgugagcaaagcaacuauuuuccagcgaguguccucaggugaccugucuagacgcucagggggaaaaaacaagagaaucugacacucucccgagccccgaagacgccuugugacgcgcaggccgcgcugcgugcaagggcgugcggagcgcgcaagcggcggggcccagcggggccugcggcguggcgccgggcguccgggacgcaggcucgggugggcggcccggcugggcggugggguccuccggccgguagggggcgcgcgcacccggggccccucgccgcccgccgcgcgcgcgcucgcuugccgcccggccgcacauguguuucuguuuuguguuguagcauuuguucuggaagcucguauuuacauuuuaaguguaucuggugagugggcuggagcccucgucccggccggggagagaagaagccuucgaccccgucuuucagucgcuucccuccucguuucucaucacuccaaccagguaggggcuggaaaccgucugggaccaguuugcagggucugggaaaguuuuuuuuuuuuccucuuuuuuuuucuccucucccucccccuucccccccgagaaagguuaaaaaaaaaaaaaaagacgcuggggaaggggggguugggggacggaaugaauaagaaggggaaggaaggcggauccacgugguuuaaucggagacagacagagaucccauuguucaaaaucaauaaaaaaaaaaaaaaaaaaaaaaagcagacggggcgagcgccgggccgcgggggccgggcuggggccccacgaaaguuccucuuuucgcgcgugcucgcaggugcuuggggcccggccgggguacagggggggguccccgcguggcgcgcggcguggggaggggcgagggagcagcagguggggcggcccacgccgcgccgcgcguccccucccccgccccgcagcccgccccgugugcauugugcgccccgugugucucccgcagcccggcgaccaugcccaggaagaagggggcggccugggaggagccgaguucgggcaacggcacggcgcgcgcggggccccggcgacgcggcggccccgcgggcaggaagcgcgagcggcccgagcgcugcagcagcagcagcggcggcggcagcagcggcgacgaggacggcccggagcuggacggggcccccggcggcggcaagcgcacagccaggccggcgacggcgggcaaggcggccggcgcggccgcgaucaucacggagcccgagcacacgaaggagcgcgucgugaguggggcgggggcgguuggcgguuuugggggggaggggcgccguggggucacgccccgccccucccccacgccgcgcgggggaacuccggggagccagucccgggccgggggaggggggggaccgggugugcgcggccacgcgggggcugucagucccuccuucccccccgugcguccaccccccuccucccccccacccccgcgucucuuccuccccccgaggggggagggcaguccgcggggagcagccggcucgcgccggggcuuugagguucccgccgcugcggcucgggcgccccgggggggcggggccuggcgcgcggcgcgcaugcuccguguuagcccggcgcggucggcccggccggugcgcgcggggcauggugggggcccgcgcggcgcggccgugagcgcgcaugcuccucggaggcccuccccaccccggggcuccccucccacccgcgaccccccgcggagcggcgcugggcuuugucugccucggguccucgcggcgugggggccaguggggucggugcuccccugaggcuccggucugggccguggaacuugagcuuucgcgggggcggggguggugguggagaggaagccccgcagagccgggcccaggguccgcuugagucuccgccagaacuuuguaaaagcaaguuuucggugauacaccccucuacccccuccgccucugugucccggagaucacguucucuguuaacucuaagaaagagauggagcuugacccucgggagaguguugcccauguucccaaggguguucugcaaaagguggcaagggcacacuaagagggguagaagaguccuaaccaucuugcaguagaagaaagguucccgcuaggcaugcagaggggcccugcaugagguaggcucgccagguagaccggucuuagccagaguauuggaaggguaacucacaagcugcucuauuuauugccuaguggguuuggacaaggcuaagaaguugggcaugauagggucuuuucucugcugcaucggguuguccugaaguuuaggaaagccauguggaguuggauuauuuugugaguaggaaaaaaaaaaucaguaagacaaugacugcucguagggguggcagagggaaggcauuuauuguggauuaaacagagacacaggcagggacaucagagaagucugacccuuggggggagugaggauaggaaccaggugcaggagccgcccgaguaaaagaggggaccaaaauggucggguuauauagagaagaguagguagggggagaggguagcuuagccugugggcuggauuaaguuuaggguaaggggcggggguauaucugccuggaguguccgguaacagguacugugagggaugccgggagauccuaguuaccaguucugcuuugauauguuaaauaguccccuccgcucuuuguccugguuuugagacuucugccagggccuggugaguuccagggucugcaggcuguuaacccucucagggaugcacgugaguggaguggaggaggggcucagaggccucuaucuccaagggucuuguaucagaauuggcaccuugugugcuaugaggagaugccaugucugagaggaggcaguccccuguaguuugugcuuguucuguguguacagcuaacuucccauaucuguguagaaccggagcuuaaaaagggcuuuguguccauccccuuaaagcuagggggacuaucacuguagaaccgaccccucaguggucaguuagggggugguuggauaagugaacccaggggccucuggggacuuaacuuucucgcuguuacaccugggaagugugugcuuccagcuucugccccuguuagggucagguugaguuugguucaaggucaagaacacagccuugcagccuaggcuggcagacugcccagugucucuggccuaagggcuguggucucccucugcuaggcagacacaggacugucucugcagucggccacuauccuggauauuucagaaagcuacuuaacucggcagagaccagccucuccccugagggaggcuccucugccagugucugggccuccugccuucacuuuucccuuaccuugaacuugaaguugucuugggcuugggaagaugagccauguguucuguugaguuguccugcuagaguuagguggguuaggaaaaucaaacaguaguccuuaagagucgauguguggaaaacgagccuucagucuuguccuaugauauucaaggaccugaggcucaggcgcaggcauccagcucuguguguuaaaucgggguugcuaggguuucacggacccugcaacauaguguugguucuuagugcagugggaggaggguugguagggaugguuguugccagccucuugcucccugguucuccuagucccugagcaucagucuccuaaauggauguguuuaaagguggacucucggccucacucagggaguguauguacuugggugguaagucagaaacugcgguggccaggaagcccccguuugcugauuggagacacuuggugcauuuucugccuuggccacucaucugcauucaggucacauucaggugaccuguccuggagagguagcuaggugagguugaguucacccgaccuggacuguugguugggguacaaguguaggcugucagacagaugcagucauguccaggcugaguuagccccggagagcaggaagaccucugcuugcuuuuuccccucccucccucccuccaccuguccauuccuccguccuuuugaugcuggggacugaacccagggcuaagcacaagcucuugcacugagcccccauuuguucacugggauggccucuccccccauuaaggccagcaggcuuaugggauauguuguugauagucuguggaugagggguuuguuuggacaggggcuugacugaaagugaguugaaucgcacuaauuaaaacuuuguauuccauaaggaggggagaguaaguaagcuguagaggggugaacaguugaguuaauagcaaacgggguguaggugcucgcaguggauacggugagcugugagaaugggguuugugauggagaagcuggggccaggguagcaguuaguguucuugggaagccaggcaagguuguccacaggucucuuuuuccgaagggugggacuuucgagucccugucuaucagccaucgcgaguuugaggagccacagggauggcaguggauauuggcuaccagcauucugcacccugcauccugcccaagcccguggccugguggcgcucugggaucggagugaccacaucucgguguuggugaaggucgagcuugggaaccucccagcuucucuccccucagaaccugcuagcgcagcgcuguugggccugggcuugugcugguuuugaggccucuccccuauguuucuggggccccuucaaagugcagaccugaagaguagagugaauguauguguccgugcacaaguaaguguuggcccuacugcgggcccagugccaugggcugagccugguaggauauuccagccccaccugcccuucaacaaaggagaaggaagggaaaguaggcuuccaucccguucagguaacuugagucuggccccacaccccacaggaggucugaauaauugaacuggguggcuacuccauccuugugaggccuggguuggccaggcagguccugaagcuugauccuggccucugccuuuuggaccugacuggaaguaggggacaccggggagaucaggucccaccccacccccacccccccaaaaaagugugccugcuggggacuuguaggaugcauuggguguguugggacagccagccaggggccauugugggguggaaacuauuggagcugcggccacuguucaggggcaggcgcacagauugagccuagcagcccguuuauuuaucugcuuuuauuuaucauguguuugcuuacuguucuggggauggaaccuaagcuuacucugcccaggcuagaccuaauuagcccacagugugcuuuucauuuagcauacuugugcacaugugugugccugcucacaccacgugagugcagacgcccucagaggcccaagggugucagaacccuggaacuggaacuacagccgguugugagccaguaccuggucugggugcugggaccugauccuaggcccucaagagcagugagugcuuacccucugugccaucucuccaagcccugcaggguagauuuggaacccagguuuaaucccagcauuuggauuuggauggcugaggcaggaagaguagacaaauuaacaccgggcugggcuaccuacauaguaagaccuugucugaaacaaagacaaguguauuuccucaaaugcacaccuuuuuguuuccauggguccugaggauuugaacucaggucauugggcuugcguaaugaguccuuucaccucacugagcaggagcccacaaauguaaguugaaaggaaagaaaaauguauuuugacauuugagccagagagcaagcgaaugcgcaauggugugggcauggcccacaguugugugguggcgguggccuuugagaugucagaucugcacaggugguugaggcucaguagcccugaucuuuuucuguguaagaaugugggagaauugaaguacccugacuggacagguauggucauaggccuguagucccaaugcugagggagcugaggcaggaggaccacugugauuuagaggcagucaaagaaacuauauagcaaaauuccucucuaaacauggaggggacagggagucgggcucuuagcugggagcucuagugagggggcuccguaaacagcguuggaugaacccauggaaggcccucugccucagacccugcugccccgccaaagcugugcccacccuguuuuacccccuggugaaaucaggcuguaauuaccccuucuguauuaaaaaucccauuacugugggcagcacacaggacugaugccaugguaacucuguagaggggaugcagggccugagguaugaagguugccagugcaccguggugcugguaguggggacugcagagcuggccugggcugugagguuccugggucucagccuggugggcuggucuugugcaugacucuagcauggaaucagagcccagcucugcuuuggcucaguguuggugcugagcucggacuuaacauggggaauucugagggugggcuugaggucaucugccuuggagcauguggugguggcggggggauuggaugggaccucuaagcagugugaaagcucccacacaggguuauuuuaagccaggugugacagugcacacuugcaacuugcaaccccagcucuuggcugaggcuagaagaugugugugccagguuagucugggcugcgggagagcccagcucuuuauuucaucagauagcuguggagugccagcagcagccuuaacgagcuaauucuugguuuucuaucucucucucucucuagaaacuugaagggucuaagugcaaagggcagcuuuugauuuuuggggcaaccaacugggacuugauuggacggaaggaagugccuaaacagcaagguaagguaaaucagguggccaguggggugcugcuccgcccaccagguagguguucuugggguucguggacaugagcagagaagagaaggcccugcgaauugcuuaagaccacagagccacucuggggaggaugcugcaguugaguugaaccuggucucccugcaugucugugccuucauaguucuguguugcucgggaaauggaguccuuagacagccgugacucccugaguccuggagaucuccucucacuacaaagaggcggccaguucuguucucuggugccaugaggccccauauucaugucagacguggcgggcagcgauguaaaggcuugucacaacucagcugaacguguacacuguggcgagcagggaacagucccacccaguaaccuguguccagcugccuguagacagggugccauccugaggggccccuuggagagaagagggcuggcucagugccucauuuuauggcuguugguuuuauuuggaaacacgcccaaaguacuugucggugaacaaauauuugaacaccgcacacccuacacccaaaccugggggccuuggccuucacccugccuugggaagacggccguggguccugcaugggauggauggagcugaccagaugccguuccuuuguguggaagauagccaucuuuuaccacagccauggacaccaguccugagagcagaguggccacacaggcucuugcugucugcuguauccacugcccugauauggcaaggacgccuugaccugacugucacccucugcuuccggugcccucuguggccccggagcugugcugccgccaguccagagcagaccgggcuagugguguugggguugucucgccuuccuggcccuucugccucuggguuggugugaguaguuugacuguuaauuguaaccucuaggccuggccagguggccuguguggccucuuccuggagcugcuaggcggcaagguagaggaggggacucuuuauuucccgcaugggcccccugcuguagccuauggugaggacuggguccugggggucuggaaaccaugggacuaauggcuaccaguccagcucugaagccgaagccacugccagcuugugacugugaccugugaacugaaaugagggagagggucccuggagugggaaagagauccuuauguuauuguggcugacaauggugcccucuucagggagauaggcauuggcaggggugcuggagagccacuccgaccccccuggccccccucccccgggccagcugguucaagaaccaggccauuucuuuacuccagcuggugccugguauagcugcagcucacaauccugaaaaccacuagcgguugcuugguuuuccagagugacagccaugcagugcugcccgccuuuaucccugcgucuguuggucuccgugauucagggcugauugggguuucucuucaguucuaacagccugagaggccagcauuucaguucaucccuuggaauaucgaugcuguuugauucuguuuuaaaguacuuuucagugggguggcugcagggucccagggugcccucugaugcuagguaccuguugcgcugcaggggaccgggaggugggguuagagugcugcuggugagguaggcauagagaacccuucggggugacccgugggaaaccauuccauuaguugccagcaggcugugugugagccaucugaauuguggcuagcuucucaaguugcccacagcuguucuagaggugaaagaaaagccacacuccugucucagggacgugggaguggcacuugugaggccugucacgugacgggggaggcaguuagaguaggugggaugcacauuggaaguacagugcagaguccgaccuggucucccagagagccugggggauaugcuggggaaugaagccggccagcagcccaggcuucccggguaugggggggacucugcaggggugaguggcaaggucccccaaguaagcaggugcuggggggggaggggcgcacugagaaagacuuuuucugguaaggggaccaggggaagucugggguagagucaagaggaggguaaacaggaccacccaagcauucugugucccccagauggguacagaaaggccagcccugccugucccguaguguaggauuguagggcugaggagagagauugucgccauuaguguagguaugcuggugucccuuugcgaccccugguugauuuguugggugcuccucacauguucugugggauuugauuuguauucuucccuuugcagcugcguaccgcaaccuuggucagaauuugugggggccccauagguaugggugccugucaggaguccgggugcgaaccgugguuucaggcucaugugcugcccacagccuccucaucaccacagaagggaagcuguggagcugggguaagugugguggguuagaaacgugcucugaaguggggcuugaagagacuuaaagucaccuggaagaggcuguccucugccugguccauggcuacgucaguucuugccugcuacuuguauuuaggggcugacccugggccccaggcuuacuuggcaagucuuuacccgugcaccaucucacuggccccguucucugacuccaccuuggugaauguuuuccugaacuugaagcaagugugaucuucugaugcugccaucccuccgaccggccgucuguccuugccguguugucccuucaccagccauuguucugcuuuagcuccugugcccccgugaggucugugugccaucgcuaacguugccccuggcuuuugaagcuggugugucuuguuacaaggcgugguggcugggucccuguggcuccuagccucgggucugagacugggccuuuguccaucccucccgaguguccaccucccuuaggcaggcucucuggugacucagcugucuccuucccagguagccaggagguauugccuaaggcgcacaucaucugagacucagggcucaggcagcuggggaguuggcuucuccguuuguuuccagccuuugccuggcuucuguucaugugacguuuuuaguuuggucuauucaagccguuuuuauuuuuauuuuuauuauuuuuuuuuauuuuaugagcugcugcaccagaguccaaauauauuaacaucugccgccuucucugcacuuggcuaauuuuauaauucugguggaaaaaaaaaaucucacaaguguguguggcccaaauguauccucccaggcuucgggugacauaccaacaucugccccaguuuuguaucucugcguuggugugggcccuccugcugcuguguccucaacacuggccauggucuuucaugucaguguccccagcuugagaaagcuucucuguccuuucucugauggcaaggaucuagauugcaucucaggccugacccugugacaggaauaagucccccagaguaagagagggagcucccuggggcagcagcugggcuguggcgaccugccagaggugccgcgaguccacugccagacacuugguggaagggcacaagaaggaggcagagugcugcugugcuguguccucacgcagacgcaggagcugcagccagccugccuucacuaaacuugggguaugcaggcuucucuugaagucagcaccugcccagugcuggcccuggagccagcccuccuuucauugauucucuccuugucaugagggcucaugaggcuggggucuuauaaugguguguaugugugugcagagauaaguagauaugauccauacuaggugcaucagacucccugaggagaaggggacugucccccagccccuacaaggaacggaaacuguuccuggagcuugaggccuguggaguacccaggucacaccaagcauuuccuggaguaacacgguguagggacggcccugaagcugaccacuuacuguugggauagucucauggggccagcuccacuggcgagaguaggugucggguugguggaaggucugguuugaggaugagggugggggccgccgccccagcguguccuugcauugcuuacccagccagcugugaucuccuugcaggucggaaugagaaggggcagcugggccauggugauaccaagaggguggaagcccccagacucaucgaggcccucagccaugaggcaaucgugcuggcagccugugggcgcaaccacacccuggccuugacagguaagaaggcggcuucuuucaauuuacuaaggcgccaaagaugguuugucugggagugagcacuucagccagugucgggaggaugaugccuggugaguuagcugauuaguuagacagcuaguuagcugauuacuugcuggaagcagugacagggcuguggugacacugggagcccagaccagggucugcguguggcagggcucagcucuguuccucacucuuguccuugggauggacagacacaugccccaugcucggccugcugggugagcugcuugcaaucuacccuuccauccuuucuuguccuguuugucuccuuucagauacuggaucaguguuugccuucggagagaauaaaauggggcagcugggucucgggaaccagacagaugccgucccaaguccugcucagguaccagcgggcuuugagaaguggugcuuugcaagggagagugaggagaagagaaugccuguuugugucagcccggcagcggggaugcaaggcucucuucucucccugcagacugugccgaccuguccugcuccuggggccaguggcgggugggguuggggguuagcggcuaagucuuguaguugugaguccugcagugcaguuggggugagccuggacaccggguucuccuggaucccccagguucaaugcuugcugcuuugucugggccucagccuggccuugcccagauucugccuuuggucucugacucugcugugggaccaaccugucacccgcccgcugucuuuguucuuccuuauuugagccguuucagaucuggcuccucacugacagcuuuggucugggggcggcaugaaagccucaaguuggggcugauagcagugugagcaccagaagugaccuuuggggucacugaguuuucucuguucaugccugugguugagucaccggaugauggaggguuaacaggguuaaggucucagccucugcuguccuggcagcaugggggucgccagcaauuaagagcccuuguagucuaggcuuugcgauccguagccgcucaaguggcagccuuugaacuguugugggcggcuguuguuugaugccaggcagaaugaggaagagacuggugaagcugaaguuggcugucuucucuuuucagauaauguacaacgggcagccaaucaccaagauggccugcggggccgaguucagcaugcugauggacuguaaaggaaaccucuacuccuuugggugcccugaguauggccagcuggguauggaggucucuuucuaaaagcucuguagucuagcuguaaaugugggguugcacgcacaugguacaaguguaauugauccagauagcaguggcuagccgguaagugcgucucgugcucagcagaacagcuugccgguaaccagccggguacaggggucagugcagacucgaggacugagucugguguggaaauccauuugugucaagagucucaggcagaaggacaaaagcugagucccuuucauccgguuucgcguauauaaaugagccuuuauuggaagugagaguuccauaagagggagguuguucuggagauccuggcuagacuggcagcuggugugucuccagcucaccccucaccacacugggcuccguccuguacagagcagaagaggucagcaagccuguuagagcugaccgugcaagaucuccauuuuccuuuccccgcagacucgcagccaguuaguucuuccuagucccuucugcaguccugagcacgaggugaggugugggcgccaccuacuggugucugaacagccugcagcaguccaggaucuggguugcugggucucggcgucauuagaagugcgcagaugggagcauauaaauagaagcagagcauugcacuggccacagacugcagggaacagugacucuguggaacuaaauauaccucgcgucagagugaaugggaaggaccggccccuuacgcacacacgucccugcugguugccagggaguucucaggcuguuggauaaacgguuuccauggccacgggcgggccuccugccauccccaggcccagcacaggaagugcgcuucuguccucucugcugugugugcggcuucucugccacccuuagacaagcaucuugcugcagccagccuguuugccguugggaacuugaucuuggcgguaggaugguauccauggaguggcuuuggagggacaguuaaguacagcgugcacugucugcuacugaauucuuguugacaucuacuaaggaaccugcuucaccugcuucuacagacgcucucauuccguucacucugaaacaggcuggcacaccccugugguccuagcaucugggggcagaggccggacuauagcaaguuugaggguggccuagcuuacguggguuacaggccagcuggggcugcagagugaagguugucuccaaaaacaaaaagcaagccuaaccccccaguucuguucuugccucugugcaaacauugcuuuuagaauucaaacaugagggcgggggaggggcuggcggggaacuguagugaucugcugccagggacugagacuguccuccuggcuacuggguccggacugggccuccuagcuuguuuuuguuuguuuggugguucuauuuuuguuuguuuugagauagugucucacuguaucuccagcuggccuagaacuuguuuuuuuuuuuuuuuuaaagauuuauuuauuuauuauauguaaguacacuguagcugucuucagacacuccagaagagggcgucagaucuuguuacagaugguugugagccaccaugugguugcugggauuugaacucuggaccuucggaagaacagucgggugcucuuacccacugagccaucucgccagccccggccuagaacuuguuauguagaccggucuggcuucgaacucugggaucugccugccucugagcacugcaguuaaagauguaggccaguaggccgugcgcauucuugcuuguuuuuugaaacaguucguguagucagagcuggcuucagauuuccuguguaacuaaggacggcuuaacuuccugcucuuucugccuuuucaucccaagugcuggauauaccaccagugcaagaaggcagagagggcuggguccuugggccacgggcuugugguccgguaccaggcaggcuucaugucgcgcuggguuggaucaugcccggugugugccagcugcccagucuguaaugacuucucacaggcguugugaauuccagauuuuauguccugaucuugucgcccuuccccuacuccugguccucugaccuccccaacucggagcgugggaggcuguccucaagaugagagcugcccacuguugugaccucagccacaggaggagacgccauuuuccuuugccucccaguccuuacggauauauguaggguuuuuccuaaguugcuguacuauggcguaggggguccuuguuucauaugcauuuuuaaaggaugcccgguguuagguaccagcuugugagcaacugggcagacugagccucuggcugggggcagggugguaccccgggccugggccuuuugucacugacggccuguugugcuuaccacagggcacaacucagauggcaaguucaucgcccgggcgcagaggauagaauaugauugugagcuggugccccgcagaguggccaucuucaucgagaagaccaaggacgggcagaucuuaccuguccccaacguggugguucgagauguagccuguggcgcuaaccacacaguaagccuuguuucuuucucagugaccaagagccaugcugguauagacugguaucucuuacucaagcuaugucauuuggcugagucuccugucuggaucucuuuccucugcagacaacuugcagacaugaguauacacguaugucugcgcccugccacuagcacacagcacgcaugugcugucuguaugguaggcagugccuuuugcuagggugugagugguuggcuguugaggguggguccuuaaggucauuagcagaacaacuggaaggacagcaguugggggggggcugcccuuaagccccuuuauuuuagcaggugcacaugcacucaccauucacagugugcguguguaaaucagagacacuuauuccacgacagucaucggccuuacgagucaaggaccuucacaugcugaacccucugguuuggugguggugugguuuggugguuuuuaagaccaguucugacuguguagcccuggcuguccuggaacuugcuguguagaccaggcuagucucaaauucugccuguuucugccucucugucucugguucugggguguuggguguucuagcccuugaacugugcaccuucugccccaugcugagcuagcuauaguuacacauccacaggcuuuauuugaugugaaacgucaaagacaagacaagacagguugcaaacagcuggcacaucuguaccugucucaccugugugcaccuguggcgggcaagcacagagagguggcaggagccucccccuuguuucugcaguuuagacaguguugccacagauggccauuuggccucugcauuuaaagaaagaaaggaagaucgcagccucaugaagggagugcaugccggccccugcuggcugccaucuauuaggcugugggacucagguccucuccuuugcuggcugcuccugucccggauccuucggucagaagcaguggcucgugugcugagccugucuccucucucugcagcugguccuggacucucagaagcgaguguucuccuggggcuuugguggcuauggccggcugggccaugccgagcagaaggaugagauggugccucgccuggugaagcuguucgacuucccggggcguggugcaacccagaucuaugccggcuacaccugcuccuucgcugucagugaagugggucagugccucuuccccugucucguuucuuagguccccgcaguuggagccaggugcaggggcuuccuccuggggacaucugcucccacaggcccacagccaugucugucccucccuggcuuguucuguucucugcaguguccuuuuaagcaguugucccucaacuugguuuucuuuuuuuuuuuuuuuuaaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccucaacuugguuuucuaagaugcuuauucuaacacuucuuugguuugcaaccuuccagguggccuguuuuucuggggggccaccaauaccucccgagagucuaccauguacccgaaggcagugcaggaccucugcggcuggcggauccggagccuugccugcggguaaguggcuguauccagggcauguggugugugccugcucugugugccuguuuccugaggauggcacugugccugcugaaucugagucuuccuggcuggacauaggcgacaccaaacccccacagaugugggagagggggagaguuaaggcuugguaggugcuaggacaggcagcuccuuccuucacagaaaguaauuuugaaaguuuuuguuuggggagaaaaaagcagaggguggcaguuuucgcucagcuuggagacuguaggcuuuuaauuugucaacacgcuggagagaggacuuacugaagagcuccugagccacccaguacuuacaggugacgaaugaggguguguaggaguuagcuuaguuacugcuuccugguccuugugucccugucugucccccaucccaaaggcucccucugagagccccaggacccagcugggcagugaggcccuggccuugguauugaucugcaaacaaauguggccccucccugucugggaagaaagagccacuaacacuguaaugaguuagcauggagguggguugucacacugcaggguuguccuggucuggguggugaugacagcaucugccuguuugcaggaagagcagcaucaucguagcugcggacgagaguacuaucaguugggguccaucgccaaccuucggggaauuggugagccacgcacgcccgggaagagcuguacgcgggugggcgguguccuuguccacuaaagacugucccagcagugggccggucacauuugguuuuaaguguuaagacuuguccuggcuggcugcuggccuugcuguagagaggguggcaggccacagugacaggacuguucuugugguugggacccguggucuauacucgcaggaggcagugucuuacgcugcaugagucgcccugguuccugugaccuccagauuuugugcuucauaggcagacaggcccauauccuugugcucuguggaucagugucauuaagccagccacacaggugccuggaggauuuuguucuucauuuucuccaagucaggucacuaguuuguucucagugccagagacuggaguaagaguggaaggcaccgcccuugcuucuuucucacugugcagcugcccuguccauaggucccgaagcuccgugcacuggaaccucugugaggaggccaagguuggcuugcggguuuuauguuucuccuguggccaggguuacacccucaguguggccuggcccuugacucugauuggcuugguuuuuuuuuuuuuuuuugguuuuucgagacaggguuucucuguguagcccuggcuguccuggaacucacucuguagaccaagcuggccuagaacucagaaauccgccugccucugccucccaggugcuugggauuaaaggcgugcgccaccacgcccggcuuuguuuuguuuugauuugguuuucaagacaggguuucucuguagccccagcuguccuggaacucacuuugcagaggcuggucuuggacucagucugccucccgagugcugguguuaaaggcugcuggcccuugauuuucuuacuuuaucuuuuugggaguaaaaguuuucucuuugggcucaacaaagcagggcuguucuugucccucaagcugucacugaccuccaagggaccccuuguaaaaagcagagagacuauggcaaaagggacugugggucuuccucugcuucuguuuucucagaggaagauggaugcugcguuuuguuuuguuuucaaguuagcaacucaacauguagccuuggcuggcuugggacucacuguguagaccaggcuagccucgauucacaaaggucuggcugccucugcccccaagugcugggauuaaagguguucuccacuacacaugacugacgggucguuuuggggagccauuagaaauggucuuuugagccaggcagugguggcgcacgccuuuaaucccagcucuugggaggcagaggcaggcggauuucugaguuccagggcagccuggucuaaaaacaaacaaacaaaaaaaaagacuggucuuuugacagccugaacgucaugguagaacgucuggaauagugacuuauaggccagccugagccucauagcaauaagacccugccugcuucaaaaaauuguugaucucugggggcuggagagauggcucagcaguuaagagcacugccugcucuugcggaggauacagguuugauuuccagagccuucaugguggcucacgacuguagguccaggucuaggggauccaguacccacuucuggccucuguagauacuuagcacucaagugguacauagacaugcaggcaaaauauccaaacacaaaaaaauuuuuuuaauguuuuaaaacgcucccuaaacacaacuuugcaucgucguggauuugggaagccuuggccaggaaggggugccugcaggagcugaaucaggggcaggacaggccuugggaccugcccuuggccccaugcuccagcaguucuuagucacuugaaacuucucugagguugucagggcugcuguguugucggcaugucucagcauguugguuaugauugugugggucugacugcaguggcuuaucagcacugucaccaaaugccugacacauuuuguccuauuacccacaguuggcugauaguccuggaaacaugcaccucucuuguguuggaacgugccacaggcugaguuucaucauugccucuguguagcccuggcuguccaggaacucaacucuguagaccaggcuggccucgaaucgucauugcuucuucuuaucuccgcagggguauggggaccacaagcccaagucuucuacugcggcccaggaggugaagacucuggauggcaucuucuccgaacaggugagggccugugccugucccggcucaucaugucuguggggucacugcugagccaugucuguccuuguguagaguguugggaggguauagcccucagcagaagaaaggcagaggagugcuggccaguccccagccauguuccuggugcuguggucacacacuguuccuccccuuauucugagauccuggccaggaccagggacuagucucugaguagauaauaccuuuuggccuguguuugggggcaaguacaguguagagccacaccccagugagggcucuuugagcuuccugcaggccuggguguggggcuuggguggucucaguccugaacaccaggguuuguggggaggaaaggguuuccuuucaaggcucaguuucccuccauguugacccucaccaagccaggccagcauguggugucuggcauacaugaugaggcaugucugcacugcugacaccgucgugcuuccucagguggccaugggcuauucacacuccuuggugauagcgcgagacgagagcgaggcugagaaggagaagcugcagaggcuaccugaguacaccccgcgcacccucugagcaggccggcccuccccucguggcagcuguccuuuccacgugcacugggaccagaagucagacaaggaauuuaggaagcaaaaguugaccaagggugcauuggguucgccuccccgaggcuccguuuccaagcgauucaacguuaacuaccuuuuucuguaugcuuuccaaaguguuucccucaauguuugauuaaaacauuugcucauagccagccugccuuucuacgagauaggcaggaccucugagcgauguagguuuuuuuauuuuuaaguuguauuucuuuucucccugcucuugaguguccuuguccugcccucccauuccagccgugaugagcauugugauccgagugggugccacgugagagagggacugucacuuucccagacagaaacggccuuuucaggaaccagcagccgcuaggccaaucccugguggucggucuccaucccgauuccugccugcccgcuuugagagacccggucacuugcuugugggcccucccacuugccucugccaccuccccucauagcuauuccuggcuugcugucugcaaggcccaugugggccuuuuggcugaagcauuuguagaagcagccaucuucccccugguggggcuuuggggucuauguuagccauuuguaucuacuuuagcucucaaguccagaugagaauagggaccgugggguauggggugggcaguuagagguuggucauccagcagucagauguguccucgguccucuguggcccuccguugccgccugugugcuuugcccgugugcuccugcugucccucugccugggauggccgcccugcucugagacuuggccacucuuguccuggccaaguguucugcuugcauuugcuuggcucugguaccaaauaguugggauucuugaugaaauccccugccccgcgugcgugucagugcagauccugcgcaccacgcccccucccccaagugcccucugccgagcccguccugguauugacuuuguggcugaguuccgaggugccuuucccggauccuccucgcugggcccgaguguggcagcagcucgggucggggccuugguuuccagaggguccgggcugguuugacugcuuuaacuaggauuaguucaguggugcuugggggaggggcugaggauggaagugugagggggguggaugggaaagucaaagucuggucuugagggucauggguuugcuuuugcuguugugacgccuguucccgucucuauguuaaaaugccaaaaaugacccagucugucgcuuuccuccgccccagcgcuucacagccgcuucuggcuuugcaaggugucugucucggccagugccguggccugcugggaagggucagaguccucacugucccccgucuguccagcaauagucuguccagagacaagcuucuguagcggcagggcuuccgcaaaacuaaccugcuuuguccaggucaccccagacaccgccccucacuucauguacuggacgggagccguccguccaucugucccugcuggucucugucuagagagugcuguucgggaucugcuccuucugucccaggaggucuacuggaguuaguuguguggucaccaagaggacugaggacacaguagcccugagccaaguugggcucaucuuccagggagcaaaccuaaagcuggcagucagccgcccuggcuagaggccugcaguggaugagcgcaaagugcccggccacagcccccucccuuuaggcuaaaauucucacccaagcuuucccacgggaagcucuaggacaggaggaaggcgggaagcccugggcaggaaccacucuggcuguccaggggcuccugaaaucuucuggucaucuacaaaggguaacaggaagggaguuaacgaggauggugggauucgguugaaggugccugguuuagugcuguuaauugucuuauuuuuuuuuuuauaucuauauuucugggaguaaacauuuuaaauaaacggcgucauuguuuacucugc

SEQ ID NO: 2229 - RNA, 17998 nt, Mus musculus
uaggaagcccagugggcaugcgcccuacgggccgcugcugcacacacgcacuuccuguacauuggcucggagaaaccggaagcggccuuccacucguuggcgcuuaggcggcuagcgguccucagggugagaggccggcuucccaccgcgguguucgacgggaugccggaggggaagggguggggcugacgucaggagccaaaauggcggcgacggucggggucuccuugaagcgcggcuucccggcugccguucucggcagagucggccugcaggugagcccgggagccgugguucaguggggagccgugcccgucaccgaggcugccuggguagagaggccgcggagaggcggaaggagcccggguccaggccucgggggaggacuuaacccggcauccugcucuugagcauccuuucagacagccauuccgcgcuucuccaucaccggagagagaggcgcggccgggaggagguuggaagagagaacagaaagacagaggucugggaggaggacagggagaggucaaggucauaggaugagcgaccuguggucgggacccagaaucaaauccugcuaguuguacuccgccaggcuugugugaaagggaggccugcggggugucuggggugggacccgggaggccaggucgcaccuccagguuaggcuggucuggaucggucaggucggagggcgguggacucugcaaggcaaugcacuugacccgcagaggaagggagacaugaaagaaagcgaccccgaccccuugaaagauccguacuguggaagucugcaggcaagacccgguucccugaagcgugcuuauucagggguguguagcggcacugaucucauaccgcuggcaugggaugacaggcagagccuggagcugcuuuuguuaauaauucuguaguagcucugucauaggucuccccacacgcccuguauccucgggagcugcacaguagaagcauuuagaaaggcgagaaaaacugccucuccuuacuuuacagauaccauucaguccuccucugggcuucuggauaguccuucacaggcggacaacaggaacucccauuuuguuuugggggguuuuguugguuuuuuuuuuuuuuuuuuuuagauuuguguguguguguaugagugugugcuuucauguauaugcaccaugugcccguggagaaaagagagcuguauuuccugaacuggagucacaggugguuaucagccgccauaugcgugcagggaacugaacucugcuccuuccaaagugcuaagaugaaucuccacccugugauaauuuuaguguuguuuugguuagguuuugacuuuucggacagugucuuuaugcaacccuggcuggccuggaacucagagauucuccggcuucagccuucugggugcugggauuaaaggugugagccaccaccaccacccgacuugugcaucccuuugcaugcacaccuaucacaccagcacuccaaaggcugaugcagcaagaucaggaguuuaaggacauccucagccccacacggaauccaaggccaaccugggcuacuugggacccugucucaacaaaaacagacagugccuuaccagagccucaggcuggugucccagauauucaguuaaugauucuguuuuuguuguugagaauguuaugcaugaguacuguauuuaaauaauuuccacccccucucuccucccaugccuccccucccuuucacacucaugacuucuuuaauuaucauugcuaaauauauacauacacaaucucuuaagugcauuuaguguuccuuaugcaugacgaguuuagggcugagaacaugggaugaauaaucacaacaccaguccgugccaaggggaaugggagaaauuucacaaggccccaccccuaguugaagagcugcagcaaucaguggcuaacaaagggggugugucgguuugggggaggagccacaugauagguuguccaguuaaugguucuuggugaccuuguucuucagccucuuuccucguugcugaggcagcaguugaguuguaagagcccugcuguaaggggugacuucucaggcucaggcugggcuuucugaguguagaagaggcuggcuucaaaggucggacucugguaggauuucaggagaggccuuugccuacuuuccagaggccuccugucugugggaaugcauauuugugcucaaacagcgccauccucaguucugguucucaguccugugaugugcaccucuggacugcaguccugccugugggaguuuagcugcacucgguuaacuaccaguagcauccuuauuucuccgucuggacuaugaacuccaggagggcagacgccuggaaugcccgccugcagucagaacaauacaaauacauauauaagccaguguugaaaagcacagaucggggcuggagagauggcucagagguuaagagcacugacugcuuuuccgaagguccuaaguucaaaucccaacaaccacaugguggcucacaaccaucuuuaaagagaucggaugcccucuucuggugugucugaagacagcuacaguguacuuagauauaauaauaaguaaaucuuuaaaaaaaaaaaaaagaaagaaaagcacagaucauuuccugagcugugccagcaguuuggcuugcuccuugugaaguagguaucggcuccacccuccccuuugcaaaggggaaagugggaccagacuggcuaagcgauucucuaaagaaaacacagcucaaagguaacagggcuggauuggaagcaaacacacuaacacacuucagauacaagcuugccccuugagucuguguggguuuggcuucaugcugccuuugccuuccugccuucgcccaccuucccucuugguggcugugucaucugucuagcuucaggcccaccccugaagaagcuagaggaaguucgucuccucgcagauugucuagagauguucuucccacauagcacgcucacuagagucauagauugagcugcagauguguucagucuccacucccauggggaacuuggcacauaaguugcuggacaaggagggagggaaagaaggaagucucacacuuuggcccaucucccugucugcacagucuuuuuuuuuuuuuaaagcaaaaguuuauuaggaaaaacuccgagagccaaggagaugacucugugcauguuggucaggccugaugaccagagccccgcccccagagcccacaugaaggcagaaggagggacccuacugcaaaguguucuucugcccuccacacgagcgcauccucaccucugacaucaugcacacaaucggaauaaauaugguuuuguuucaaacaaaaguuuuaauauagauuuaggcacacacauuaggggagaggacaaaaacugcgaggggacacaggcuucucaugggguuacucauauuccccuuccuaauacugggcagcacugagguuccugugagcugcuguucugcaucuaaugucagugugcacgaugcuacacagcauccauuagggaagaaucgcaauacggaugcauguggucguaauuaccuggagaguccagaagagggcgcaggaugugucuguauuauccccagcaccugcauaaaccaggcauuguaggccaucccugcugacccagcaugggggugcagaggcaggaggauggggcuucauggccaucggcucagggucauuguccccggcugucugacucacauggcagagacuugguuuugcugagaugcaguggaacacagcagaacuuguuuguucccuaauuugauuuguguucagacauucuucaucuuguuuucuucaccagguuuccucagugugagcuuucacuggguuugggaggagugcuuucuuuugaaaugcauggucuuagccuccucuggccucaacugcaugauccugccuucaccucccaaguguuuuucgagaguccugugccaguuugaaaauguuaccauguuggguuuuugguuugguuugguuugguuuugguuuugguuuugguuuuuagacaagguuucucuguguagcccuggcuguccuggaacuugcucuguagaucaagcuggccucaaacucaagagauccacuugccucugucucccaagugcugggauuaaaaggaugcaccaccacccuagcugucauguugggauucuuuacaaauacuuaaugcugggcaguggugguacauacuuuuaaucccagcacuugggaggcagaagcagguggauuucugaguucgaggccagccuggucuacagagugaauuccaggacagccagggcuauacagagaaacccugucucgaaaaaccaaaaaaaaaacaaaaaaaacaaaaaacuuuauucuguuuguaugaugagggaaguagcccaugccacuguguggauagucaguccugucugucuguccaucuuaccuggcuucuggggauggaacucgaguuuuuaggccaccauagcaaucacuugacccucugagccaucucacuggccauagcauccuguuuuaaaagcccaaguagcuuucugacugguuucuucagaucucauguaauaagucucccuuuuaagugucauuauuucacguacauacauaauacaauguugucaccaccuugguuuaaagucguauaggccagucguguggcacacaccuguaaucucagcauuuaaaaggcugagggagaaagauugaaaaguuugcguccagccuggacugcaugugagacccuguaucaacugauguuucauugugcuccaugacucucaggacaaaaggaacccaccgcagugcucucgcccucacgucagccuccccauccuagcagccucacuccugccuuuccuccugccuacuaacacucugcucaucgggcuccaguuaaacccuaggcagggcagccaugaccccagcucaccuccucaggaucccuccaugcacuuugucacgcaggucccaccucacuguaggucaccacagauaaguucuguggagcgaagguucugucugugucagaaaugaagcucgguguggugucacuacagugcagugucacugccccuggacccauagcugccauaucaugggggauuaacaucuguuggguguugaugaccgugccuuccaaggaagcuggauaccagcguguuugugcccagaagugccaucaucaugcuugauaagugggggagugccuugcaguuuuuaaucaaucaaucucucucucccucccucccuuuuuguggcuuuuucaaguuucaggccugucgaggggcacagacagcugcugcugcagcucccagaaucaaaaaauuugccauuuaccgaugggacccagacaagacuggagauaaaccucgaaugcagacguacgagguggaucugaauaaguaagugucugggccagccaggcgcuggcgaaggagagcuugggaggguuugcugggcucucaguuaggucugguuucugccauuauuugcggugcuagggauuguggugccuguggggucaugccuuucaggucuugagagauguaaaauccgauucccuuaaugauugagauaaucacauguuuucugucuuuagagucaguuagaugucucucaauaacuagcuugcgugagcgcgcucgcacgugcgcucgcgcucucgcucucucucucucucucucucucucucucucucucuccagucuuuuguaguccaggcuuaucuugaacucacuauguagcugaggaagaccuugcauuucuaaucuuccucucuaugccuccccaauucugggguuacuggcauggcucgugugagcugccauaccugguguaugaggugcugagguugagccuguagcuucgugcaccuuguaugaguacuagcuagcuguuuuauuaaggaaaaaauuaaaaauauugccagauaauuagaugacaaaaauuuugcaacucaaacucaguaagaugggcagugguggcguacaguuuuaaacgcaaugcuugggagacagaggugggcagacuucugugagcuugaggccagccuggucuuugugagcuccagaacagccagggcugcgcggcaaaacugucucaaaaaacaagcaaacaaaacagcagaagcccaccuuggcaauauguggcuaaaguuauaaaauuuaaaaaauauauaaagccguuaaagaauuagcuuuaauauaaauguaagcagugaauuaaucugacagcuguauuucuuuacuuuaugcucuuccccauuagccacacagagaaaccaguguaauucaagcuacaccucaauagcugagcaguuaacugaucuaccuuggccuccuaugcuaauccggcucccucccagccccgcccugugacaccugcauaguauuacugaccuggcucuucgggcuccaggaguguuuucagggccucucuaaaccccuuccuuauggcucaaauccuccauucuccuugaagauccgaaucccccccaccuccccccccucuuacucccucucccucccucccuuccuccuccuucccuaccccccaugugaggauugauccagauaugagggccgagaacucagcauuugaauagcacaaggguaaacuuuaugcaguguagauaaacaucuugccuuccugaggccuuccuguucccucuugguaaugauagagauggcuuuccucagugugaccccagggagugugggaugacuguuggcacuggagagagccuggccuugagaacagggacucggcgagcgggcugcaugguucuccgugaggucaggcccuaaccucauagcagcagaaagauugaaacucugggaagcagagcacaugacgagcauggggccugagccaucucuccagccugagucaggacacacuccaguuuuagauuacccuggaacacaagaagaaacggccuaaaccuggcggugguggcacacgccuuuaaucccagcacucgggaggcaggggcaggcggauuucugaguucaaggccagccuggucuacaaagugaguuccaggacagccagggcuacacagagaaacccugucucaaaaaaaaaaaaaacaaaaaaacaaaaaaaaaaaaacaaaaaaagaagaagaaacggcuuaaaaccagucaucuaagacuuuaccuuaaggaggugggaaggagguuggagauacagcucagucugaguggggcuuagccuacaggaggccccagcgccacagaaacagaaugaagucagagccaggcacagcugcgugcgcccggcaucccagcugcugaguccaagguagagccggcaggugugaggccagccuagcagagcacgaggccuuguuuaaaugaagucaacgaggcuuaagacacagcucaauaguacaguaguaccaguuggccagccuuguguaaggcccuggguucaagccccaguauuuaaaggggagaaaaaaccaaaaacaaaaaacaaagaggaaaagaauagaagaauagcaaagcaaauccaaagaaaacauaauaaaguuaacagaaaaggccagaaaugaggauacacagcacagcaggggugacuucugcuguaggauuuaggaagccagcagccuguguaauagcaagucaaagccagcccaagcugucaucagaccuugucuuaaaagaaaggaaggaaagaaggaagaaaagaaagagaaagagagugggugcugggaugaggcuugcuuaguacacaugagcccuuggcucuuaguucuagcacuacaguaaaacagcaagauaaaaaucccacuaccggugcaggagagauggcucagugguuaagagcacugacugcucuuccaaagcuccugaguucaaaucccagcaacuacaugguggcucacacccaugagaucugacgcccucuucuggugugucugaagacagcuacaguguauuuacauauaguaauaacaauaacaauaauaauauccuacuaccaagcagaggauaucacuccagaccuuauaaaguuagauuauuguaagugacuguacugagacuuucagcuucagcaaguuugaugaagugagcuaaguccuuaaaaacuacaacucacagugacucuguguaagauuccugccagcaccgggacacucgucguaucuggacuacggcacuuuguacuauuacugugugggugguuuguuuuaagaccuaauuuuaguuguguguuugugugugugugugugugugugugugugugugugugugugugugugcguguguguguaccugugugcaugccugccuuugcauaagugcugcagggcagagagccuuagcuccagcacagcugagucuugggggcugggacugaacucagguccucugugagaacagcaugugcuccuaacugcucauccaucucuauugcaguuuauucucuuuuauuguauuuaucauauuuccuguuacuauuguguacuauuuguuuuuaacuuccaaaucagaaggauccuaaauucaaggccagccuagaugacauaguaagacaccauuucaaaaaaagcagaacaagccgggcaugguggugcacugcuuuaaucccagcacucaggaggcagaggcaggugaauuucugaguucgaggccagccuggucuacagagugaguuccaggacagccagggcuauacagagaaacccugucucaaaaaacaaaacaaaacaaaacaaaacaaaacagaauguuuaaaaaaaaaagcaggacagacaagcaggcugaagaauggaugcguggugaagcgugagcuuugcaagugugaggaccuaaguuuggagcccagcauucaugagaaaagccaggcagugcugcuugcuccuguaaucgcagcucuagaggagaggagcagacaugggaggguccaggucugggggugacuggcuaucaacccagcuaaaaaacagcagcuccaggcucaguggaagacccuaucucaagggaauaaaacugagcaauacaggaagaccuggacagccuccucuggcauccacaugcaugccuguguaugugugaagcggguaguuuuugcuacccugcuuuaagcuccugucagaccgcgcugccagcccugcccagguuuccucagauccgaggauaacacacauacacacauacgcacacacacaggcacacacacaaacuuauuuacaaccugccuucuuggcucaguugcugagugcuucuaaucucccucagccagggugcccuucccaauauucuuagcucagcacccuaaaucugcccucagcuuuaguugcuaccccaggcccagucgggcccauuccaccauagaucucacaugacugguggccuuuucuuucucagaagcauggcgaaaauccauuucccucugugugucuucucgccuccuccucuuuccuucugccuggcaauuggcccuuggcaucuuuauugauagauuaagaaccaauuggggaacaagaccuuagcaucaaaacuacccccuucauaugugcaccugcauauauacauaggccugcacuacacacacacacacaggguaggugguggugcacaccuucagucucggcacucaagaggcagaggcaggcgaagcucuugaauucgaggccaucuugguguacagagugaguucuaggacaaccagggcuguuauauagaaaaaccguaucuggaaaaaaaagagaacccacacaaggaauaaauacauacaacugugcaguagaugaaccuuaagcacgucaaaauaaaacuguaggaaagaaaucuggugcugauaggagaguaaaugggccccgcauccagguacccugacugcuguacaguggugaagccagaugcuggccauaauagaacugaguucuuuucuccaucaggugcggaccuaugguguuggaugcuuuaaucaagaucaagaaugaaguggauucuacuuuaaccuuccgaagaucuuguagagaaggugagcggggcuuucuuuaucaccagaccgagacuugguucagacuccagugaggugcggcucccacugaugggagcaccccgagagcugcaacccugcaagcugaccuuuacugagacuaguacagcguuagggauugaaggaaaggaaggagggagggauacacagacacgaaggaagcuuggagcagguaggccaugcuugcucugauggagggcagcagcuccacaacccagaaccucagguuguuuguuacacacagcacagggaugagguuagcucguguagguaggcgagggcucuguggggaguggucucagauggcagucaucugagaagcagcuguguccgcuacacugcucagucacucauaagcacuuagaccaaaggaagcuuagccagccugcgccucaccuggaggaaggccuugccauuuccacagguauaagacauugugguccuuggcacagccacacacccacucagcaccccuccacuccccacacccugcuguacaucaccucuuuguucguggauguggcuuccaaaguuugaacugugaugcaaguucugauuuccccuggggagcuuugucucgagguuccuggucccguggugucugucagucaccacgagccuggcaggcuagcuggcaucugcagugagcucuuuguuuaguggagguggaaguuucuggcugaggcgcucgugcugggcugcugagccggugagaagacaacgcccuucucuggggcugggugugcacuuagucugucugagaacgcggagaguguggagcauggccguuuccggcaacucagugugaggcuuaaggccagagcauuguccacaucuaggucuggacgacauaucgagaccaugccuuaaaagaaagaaagaaagaaaggaaggaaggaaggaaggaaggaaggaaggaaggaaggaaggaaggaaggaaggaaggaaggaaggcaggcaggccaggcaguggcgugcacaccuucugucccagcacucaggaggcagagggagggggagcucugagcuugaagccagccugcucugcaagagugaguuccaggacagccaggaccacacagaaauccuaucucagagagacagagagacagaagaaaaauaauugcuagugauaauacaacaaagguaauauuuuaaaauaggauuuuaaguaaaaaucaaaauaauuuaauaauaauacuuaaaacaaaaaacuuaaaaggcucugaaacccaaaggcucuuguggcuguggagucugucugucaggcagagcuguugugugagguaggugggugacuguguggauuuaguguguagggggugggccugcugaguuaggggacucugcaaggacauguagugagcuggaaaccagaagucaggcacagaggcagucuccgugucugcucagccgcccauagccuucgcauccugggauuaagcaaagacggaaggagcuagccaggccuucgggggacagguuguagcuuagaggguggagggcuuccugguucaaggugaggucuaggcaggaaagaaagcggagagaagguacauccucuguuagcgcagcuacugaugugagcaguguggcccggagggacagauggggagccucaggucacccgcugucuccccaggcaucuguggcucuugcgccaugaacaucaacggaggcaauacucuggcgugcacacgcaggaucgacacggaccucagcaaagucuccaaaaucuacccucuuccacauauguaugugaucaaggaucuagucccugugagugugcggcucucccaucuguggcaggggugguguccugcugugcuguuuggagugggcuaggccuggguggccacagcuucuuugguggacgugauggaacagucagacacuccgauguuuauggcaagggguuuccagaguccacagaggcauuaggaaccccuucccagauccacacagugaggcgugugcgacauaacaggugaugugcauggagauccugaggcucagauggcacguuugcuugggcauaggacuuagaauuucagagucaggaaggauuuagccauagcugcaaaguauuuguguggaaucuugggggggugggggugggcagggaggcuugacucucucaguuccucccucugcugccucgggcgccugcccugacuugaggcagcaggagaaaggaccgcagguaccaugacuucagcugguguggagauuucccagcucuguggcuaacacugaccguguucccuuccagaacugucauuugucacagccucugaagaguuugguuucugucugucguggugggaaagugcacgguuggaugugaggugauaggaagccagcauccgaaggcccugccaggaucugaucccucuccuuucucucuccuuucuuucccucaggauuugaguaacuucuacgcacaauacaaauccauugagccuuaucugaagaagaaggaugagucccaggagggcaagcaacaguaucugcaguccaucgaggaccgggagaagcuggucauuacuuaaaccuauugucaugguuggcagggugcuuucuggaaguaagagggugggggagcaguagagugacacagaacacuaaucgugcucugaaagaaauuggggaguaucugacccgaggggcagugaguugccaggcugugggcggggcuggugugcucaagacccugaguccauccccaguacuggagagggaaggacaaagagcagcuggcccgagguuggacacccucccucaccaucggguggccagcgauuaccugugaaggcccaaguggaccaaggagcaggcacagccaagugcugcccucagggcaggcguugccguguggcagaagagagcaguaucuaagaugccugcucugucgaggcugauggccaccaccaagcuguucucucucgggggaggggagguuaauaacacacacaugcccgcgcacaggcacacccucacgcacucacucaugcaugcaugcauguaugugaauggcacgugcuggccauucagucucagcaccaccacuucagacagagggcaggaggcuggagguugucuguggcggugguggggggcgggcaggacugaaguagagccuugccgucugcuccuaagcuugcugagucugacugaugcuggccuucuggaguugcugcucuugagucagagcuacaucacaagcugacccugcugccucccccucccaugugccccaucuaguaucugcacugcuggggcuccaucccagggcccugugucuguacaauaagacugugccaacugagcccguccccagcccugggcugugacaccuugaguggaggguuuagcauccagcuuuccacugccguuccuccccgagaaguccucucugaugggcaagcacaccgacucagcgaguggcugagugggccgagccuucuggcccuggauauuuugccagugucagggcaugagugcuucauggaucucuuaucuuuaaagucacagaaagcauacugguccauccucacugauggucagugagagugagcguucucacgaggacaucacugcccuucgccauuucuaccucccagucuuacacauuccaacccacacuggacacagcaagggagccucgccuugagguggcuuuauuaagaagugaaggccucugaauucccaauaauaaagguuuucucauauaaauaccuacaugggaaccaggcauagugauucaugccuguaauucuagcacuuggagucugagccaggaggauucucaugaguucaaggccagccugaacuacauaguaaguuccaggucagcccaggcugcagaguaucacaaacaaauacgcgcgcacacacauauauacauaccaacaugaagccagagcuguaacucggugguagaggccuugccuggcuugcacaggcccagaacccuaucaccagcaccacaugaaacauggccauaaguaacagacauuuguguagcauuuguuuguuuucuuaauauguuacauggaacaaauaauugaauauaguaugaacuacuuuuaauuuuuuuccauuucucugugugugugugcaugcgcacaagggcacaggcgugcgcgauguauagcugagggugaaaucucagacuugcagucugaguuugcuguugauccacuugcgcugcaucagguuuuugccacaugugcuaugaagccauccugcuacuguugcauaaugccaguauggcugaccucuuaccacaaacccagucaaggcagucagccucugccuccagcgagucuucagcuguagugugggcuguccugucuccaucggcuguccuuguccaucccucuggguggcugcuuguugccagaaucaggaaguccaacuuuugggucacagagaagacuugaggaaccaaguugaccccuccuuccucccuggaguucaagggucaguguaugagacauggaagguagcuuagggugcuccugaggccccaagggaaacuugaggacugcccagcucgacagacacuagacagacuaccagagagcuucagugccccucacugcagccugcacccccgcugggaacuccuuguucauggcucuuagguccgugggggugguuagagauucuugaaucuacgugcauuguuguuggacuuaaggcccuggucucugguccagaagagguuucucuugcauuacaaggucuuuuuuaugacucuauuacacugccacaaauaacccuuggcaugucaccaagaaagcacacagauaggcgacccucugcugugcacuggcaccuggucucugaccaccuuucucuccacacaggacgggcuguacgagugcauccugugugccugcugcagcaccagcugccccagcuacugguggaacggagacaaguaccuggggccugcaguucucaugcaggugcggcacuccccaccucaaacagccagagguccuagaagaugguggccugcuagaggcagcuaccugcagaaggcugcuggccugcgccagacaccggggacaccagcucacugggcucacguagcucagcgaaucugaagcuucaccuuccuguaccuuuguaguggggagggagggucaccccaaagggagggacccagugugagcuggaucccuguguggaugggagaagcuucgggaagcugggcugggggcugcuuagaaagaagcauuguuguuauuaccugucacauguguacaacucagggcaaaaaacccuguccauucccagggagcugcuuuucggauauguggucagugcuuuucagacaguguuaggcaacucaagauaacuugauguuucuaacuuuccgguaaaagggaagucacuggcuaugugaccguacaguagugucgaccuugccgugugcaagcaggugugcucacacacggugcuugcuuuccaacaucugaguuguugagaaccacacaggucucagugacacagcuggggccaauccagggcccugugguaaacuagugugaguuugcugcucucagggcauguguugauugacagaaaguagacaaacugucuaugacggcaucauagcucauuaaccuguaagcccuugcacuuggggaggaggggguggaaguaggaagauuaugaguucaggccaggcguugcugcagaccuagccuuaaaaugacaagccaggcccugucacuuaagcacucaggaguuagagggaggcagaucucugcguuccaggccagcuaggacuguccagugagaccccgucuuaacagcaucuauuuagucagcgcagguccuagcacggcagcacaggcugaaaggagggaaaggcguuugcacacacagcccaccuuuccuaauuagagccuggagggacaugaaaggugcugacgcccagucaguaccuuaaacaccgaggugccaagcacaggguggaucaaaggcucauggacaccugggguuaggaaagagcuaggagccuucccacaaggcaagaacuccagagcaauggcaggcuucugcccugcugagccugccugggcggccccuggcucagcugacacgcccugcuuucccaggccuaucgcuggaugaucgacuccagagacgacuucacagaggaacgccuggccaagcugcaggaccccuucucugucuaccgcugccacaccaucaugaacugcacacagaccugccccaagguauggcagggguggccgggccacucgagauggaugccugauguuucaguugggguuuggaauggcucucucagucacagacuccaccaggucccaagaggggcaggccuuaccuguggguccauagagauggaaggggcaagaugucuccaggacccaacgcuguggggggcagguggcucugggaggcagggucccucagcuggugucacagcucuggcuacugauguccuucauccaguguggcaggcaggcaucugcucugcagagcuaccuuggacucaggccaugggccucccugguccccacccucucauuucuuuuguugcuguguuguccuguuugagacaaugucucuauauagccauugcuguccaggaacucacucuguagaccagucuggccuugaauugagccugccucugccuccuaagcacugcgacuaaaggcguccauauaauuaauugggggaaaacucugcuacagugcaccaccaccgcccggcacccacuccugagagagaacucuugggccauuuguggguuggcugcuuucugaucuggugccagcuguggaugugucagccuuggucaagaacuaugagggcacccugacugcccuucagucagggacugggcagcaagauaggaagcgauaggguagccacuuagcaggauaaagagacuuccagcaugucuuggagaccuuugcuagaagggcccagccuccagcaucagggcaggcuagggcugcacgggagaggguggcucugcccugugaaggcagccaugcagcacacagguguacuaugucugccccaccuuucccgugccacaccccucucuaccuuuucaccuuguguaccuuggagaucaauggcucuguguugacaugugaagagccugcccugucuugggucauuuucucuuuaauacuuuaguuucugaguuacucuucuaaagugagaggcccucccucccccaaccucagauaagucaguccugccuggcacccgucauuuccuuccccgcuuuugcaaggcuggcccugacuagaugcuuaucgguccugcaaacaagcgugguuuuuugguuuuuuugguuuuucaagacaggguuucucuuuauagcccuggcuauccuggaacucacuuuguagaccacgcuggccucgaacucagaaauccgccugccucugccuccugagugcugggauuaaaggugugcaccaccacgcccggcuccagggcuguuucuuacauugcuuuugagaguauguagucucugccgucucugauuuacucucagcaguaauggcaggcaucuggcgaauccugaccuuggcuuguguuccuagaggaagcaccaugcuggguguccugagcaguuaggggcugccuaccaugggucaucgugggauaggccuggggcuggggcugcacaccacccuccugggaaggggcuuugcugccgcuguucccucccaccaugccugguacugaagcucucucucccuccccuccagggucugaauccggggaaagcgauugcggaaaucaagaagaugauggcgaccuacaaggagaagcgagcauuggcuuaacccaguccgugcugagugugccugucaacucuggugucaaacagcuggagucucccuaaguacagcauauguaauaaacauuuaagauaaauaggcg

SEQ ID NO: 2230 - RNA, 5563 nt, Mus musculus
gugaccguggucuuuuguaaaaacuuuuauuauuuuguauaaaacagaggugguccaugccugggggcguaggaaauccaagcagaccagcuggguaaggggcacagccuaccugaggagacugaggagggcugcccccaggcacugagaaggcacagugagaagcccaggccccacaacgaggccuuggaugaaccccacuaagggguggagacuggacaguuaggagcccccacuuaaggauggggaggggcccaaggcagcugugaccacacuccccaggguagcagcccacugauguccgggaugaaagggagggcaggauggggagaaagcaccaggucaggcagggccugagguggauccgagcuggguccagggcucgaaucucacaccagcuccacccuagcagcccccacagcuccuggcacaggaggcagccacagauuggcacaggccacugacggccaucacgccacacuuggagaacuugucucggcacaggucagcuguggaaggaggggaagucagggcgggaacucacugccccauaccaaugaggauggaggaggggagccugcaccagccugcauguggguuugggcacauauuccaugccagacaguagagggagacgauggccagguaacuaaguggguggaggaugcugccaggacaaggguagaggcuuuccuaccucggagaaguuccucgugggcacagacagugcggacacauauuuccuuguugaccacauacacucggcggaggcugggagaugaaccagggaugcucucagccacacccuuaccuacugccauugggagagcccaggcccagacccucccucagaguuaagcucaucugccccaauccccucuucccuggcucagagcugccccucauagcccucaccuguagaagcagaccucauugagacacuguuugcaaggcuuguggauggaguagaggcgggugcacggguacuguucuucgcggcagucuggggacgggugggucagacuggaggcucacgcaugaggucuggguccccacgcacccucaggcccugcccagauacccacacaaauccagcacccgguggauggcauaggaccgcccagcuuuguaccucacacaaagucacagucccaacuggaacaccagcugacagcuaccccacuuggacacuggaauaucacacuagcucacaggcugcuuccccuccccacuagguaaccaacuaaauacagagucuucaggccccuccucucaggcccucagcuaaguggcacuccguugggcuuauuggucauuccucaccugcccauuggcaccacacagcccagggcuaugacaccaagacagugcuggccccuaccuaagcucuggccagaugcuagugaggaugcagggugagagagcccaaagcugccuaggggcaggucugcccgcucccccaucuagcaucccacuguggcuaaacccugcaaaucccagucccuuucggaagccauuccggcuuucuccagcuuaccaagagggccaggcucgguaggcucagucuccagguccccugcagcugcuggcucuggcgugaguguggagagauagggguuacugggagggggucucuucaggccacuccucucagggccagcccagacccucgaucuugaggcacaagaggagcugggccuggggagacagcauuaccugggguaggggcugggaugacuuccuguugaacuugcugcugggacuggaacugcucuucagggguccgaggacucacuucuguagcagggaggguggaacaaggcuucugcucacguuccccugcaagguccccacagguccccaccaggcggccagccccacccauccuaccccagacuuuuaccuugguagucauaguagucugcguugucuggaagugaaauagagacagaauggguggggucaggcuguccaugggaucaggcuagcccacggccccaggagaguagggggaccuaccccugggauccuaccacccuaccaaaaugggugccuggcugugcauggggugaguggcagguaggugacauggcagcacuggggacacugaagggaucaucucuuaccaaucuggucgccauagugguuguacuggacaugguccgggaauggggggagaggauccaggucauauuggcccugagccagcaggccugccgagaggagggggucacauguaggcaccccgcauaggaaggacuaagagaaaguagguggugguucuaauccuacacccugacagacucacagaaucccaacucugaguccugcccaggucaguucccuucccuugccagcuccucugcccugggcagccucccagcugcuccaggaacucugcuaacauuucaggucugccgggcuaucucaccuaccuucccugcuggaugugucuuuuuuuuuuuuuaauaauuuauuugugcuuuauguacauugguguuuugacugcauaugucuguauaaggguguuagaucccuuggaauggaaguuacagacaguugugaacugccaugugggugcugggaauugaaccuggguccucuggaagagcagccagugcuuuuaaccacugagccaucucuccagcuucuugcuguguauuucuaucauagcauucaacacgcuaugaaauuuaccaggucugcuugucugauauuugccuugucccuagcccgggcaugugaugggugccugguguguccgccuaauucacagcuguaucuucucacaguaggaagucagcauagguguguucagugaguggcucccagguccggcagagccuuugcaguccccacugagaucuccuuaugugauggauaagaccccucaaaggccaagacuguacagaacaguagagcccuacgugaaucuagcacccagugccuggucuccccaccuugaggcuccuccacuguguggugcagggcuggaaaggagcugggccccaggguucuggcagugagguaagacaaagagucacacgugagugccacccaccccacccauccccacuugcuuaccaggcaugaacagcaggaagaggcaggcggcucucauggccauggagugaggaggcggugguggcguugaggacagcuagagagagagggaaggagagcgagcuagcugcaugccaguccagcuggcccaggaugagagaacacauuucucucccugauugagacuaugcgaggggcgcugagagccaggcaucuggaggccgccggggagggacaucugcagccauccuccugugaggcuauaaagcaaguuccagagcuuuuuuuuuaaagauugggucuugccuggugguguuggcacacaccuuuagucccugcagaggcaggcggaucucugaauugaggccagcuuggucuggccuacagaacgaaugaacugcagaacagccaggguuauacaagaagcccugccuucaaaaaaccaaaagaauaagaccucuuaacaagugcaccagacacgacucuguccugcuuacugaggcgaccucucuaagagccacuugccccacccuggcuguacucagcucaauccugucuaccccuggcccaucaccucccuguguuucagauggacuaugugaauuccaaugaccucgggcacauccucaggguaccagcccugcccagcccacagucagccaccagcuuggcagcaucugccaggccugccaccugcucccaauuagccccugggcccugagcauggcgcucagcaggaaagcaggaaaccacaugcguucaggcuccaggagcccccagagcagccagggcugggcaggacucccagcuccaccaagacuccugccagguccaggccucccaagaccuggcugucuucacuacagacacgagcacgcaagcacgagacaggccuguuuugucugcaggaagcauggaguaagagcuggaggaggugagggcgccucuggcucccagcaugcuagucgggagaggcuaagucacucgggccaggggucucgaaccuuugacaugacacuggauaacaagaguguggucuuggugacuggucacaacuugcacaggcuauguccaggaugagcgcagccuucagugcugaggcggcuggcuauccccugcccuagucaguggauggugauuuccagaugcugcccacgggcauauccauccagaggacuuccuaccccgucaugggaaguucuuccauacagcuugaaccccaguucugauguagaucccccugggaaucuagggagagcaggggagaggcagaagcaugguaucuagccucaguuucccuaagauuuccugagauuccuugauaccuugcccauuucaggcaccucccucacacauccucucucuggugggggccugagguucuugucaucuuagaccuuuucccauagggaccacugcuccaaauccccacucuuugaacucugggcagccucaugguaggggggucaccagcuccauccagaccggagguugacaacagugaccuauuggcugccaaagugugucagagccuuccucccacacucucacccggcccaggcuuaaggcagggacuggugcucauuggcuaacagcggcaugaagaagagaauaaugaaucgcucccaggggacccagacaaacucuaaaacuugaguuugggaggccuuaaggaggccaggagcauucgggauagcugacccacccccaccucuggcccuuuccacaacuucggccuuaucccuagccccaagucccuuggcuccucugugguucuagggaaggaccgggagcccccucccuggcucagaccgaggggggcccacaagaugcugcagagcccugcuguacagcugggaacaaucagccggcggaaacuugcucagacgcucacuggcucuccaucucgggucucucuuugucuccgcgaccgacccccgccccgcccuccacaucccaaacgcugggggcugggggaaaggguaaaaaaaaaccuguccuccagcaccuccauuucuacugaccccuaaguuccagcucccugcuuguccuaucuugcauccccccccaacuugccagaugcuccuucagcauccgcuccauauccuggaacuagggguccccgaagucucuccagcuccuggauccgagcucggagcauugugcuuagacaccccuggacgugcccgacccgcgccuaccuguuggggccucugcgcugugcucuagugcggcugaaagugccgccccgcagccagagccccccuacggcccccaaggcccacgcccgccccuagcccggagucgcuggguccuagagagcgccgccgccgccacgacgcacccucgaggcuccagccccuccccaacaccgcuggggcucggccugggccugauacuaauagaaccagccaacgggacaccccucuuucacagauaccucuccacccagagcccagaggucacggggcuggaaaugaaaccuugcuugcuuucuccc

SEQ ID NO: 2231 - RNA, 11848 nt, Mus musculus
cgguccugaaggggcggggagaagccggaagucccgagggcucgggcgauagagauggaggagagugaguacgagucuguucugugugucaagccggagguccacgucuaccgcaucccgccgcgggccaccaaccgugguuacaggugaccguuccuggcuuaaucuucccgucccccgccccggcaugcacugcgggggacgaggaccgguugucggguuuaggggcggaaaggauggagcccuguggcuacuuuaaucggggccagacuuaggaggggucgcuggcccugagccgucagcgggacgccggcaacggucgcagccagcuccuggggacccgagagcgcaguggguucccucggcggggucuacgggucgugucacagcgcuaaccgacagucgugacgggaucccagaaaacccugccacccgcggaaauccccgccgggagggcacgggagggaacccggccaucugggggacccgucccacgaagcccagggacgcuguuccuaucuccggcucuccugaccccaguuucaccccugaucacaacauacuugcagcugggaggauaccgccgcccuugucuugagugagcgucaccugaggcaaauaaacucaaaugccuguaaacacacggagugucuccggaagggaacccaggacucuagucuaggagaggagacacaaaguuggacaccuucccuaacugaaaaagaugaaaaauacgugguguguccugugcccuguggugggguguugcuacuuaggcuggguggcucucgaaggcgaugggugucugaguuguuuggaaacaggucgucggguaccacaaauguguuggagggccaacuccaucugcccuuugcgcuauguaacacaggcucauaacauuuucugaauggguaucuuagaacacuuaacugugucggugcgaugauuuuaaaauaauauuaaaaugacaagaauggaggucagcaagcuacagcugccugugcuugcuuuugcgugucuggguguggugcgggugcaugcagaagccacaggaguuccagccagugucuugcuuuuuucauguccguuguucccuugagguggccccuaacugaagcugggguuggcuguuuucaucuagacuagguguucagcaagcccagugaaacuccuuucucugccccaccccacacaguggagggucuacagguagcuggagccagaccuggcuuuuaggcgcuagagauccaaacucggggccucaagcuugcucaucugcaccgaaucaucuccacagcugucucccuuuccuuucuuguuaucaaaccggagauuggcagucuaccccuaucuguugggucuucguucaguagacuaggguuagcuucucuugauccuccggaggguggggucaccaaguauccagccaggcugguuugauacagaggaagcugcccgcccuacacucaaccuuucgggcucuccuuagccugaaucuaaagcccgcggcgccaggaagaggaacagaaacugagccugcugccuuguuagcugaagauguacauucauguggaucugccacagcugccagcuagaguucuagagagcugacaguggcuuugcuuagaacuucccagaaaagccuucugaaaguacccauggcauuugcuguucagggguuucucuuugcuucugcugcugcugcugcugcugacgacgacacuguugccuucuaaaggagccaaagaaggcauugacgaggguccucguucccuccuaccuggaauacagccgagaauauccuuccuagccgcucuuuccucccccggacccucaugcacuuuuacacucuuucuaccaaagauccugucccucuguacucccuccauggucucaagggucccccagccgguuggucccgcuagcuuggcaucacagugccuuaacagacacaauaggcccggagcugcuuccucuauggacaggaagcugggaaggaauucccacuugggugaaggucuguggucuuuagaauaggggccagcaacagcggcugcgugugggcguuuugaaugccagcacgcuccaacugccugcaguuuugaauggccacaggcuaagaauaauauuuuggacaacuugaaaugacuggagauuuugaagacuguuucauaacggaacaguuacgagcuucggauucugaggacuuccugagggacagccuugccaagaauagcuauuacaguuuucauuuuuacauuuacuuuuuguauauguauggauguuuugucugcguguaucacaggacucaaguuacagacccuuguuaucugcuaaguggauguugggaaucgaacucagguccucagauagaguagccaauguucuuaacuccuaagccaucuuuccagcccuguaauaaggacuuuuuuguuguuguuguuuucuguuuguuuguuugguuuuucgagacaggguuucucuguauagcucuggcuguccuggagcucacuuuguagaccaggcuggccucaaacucagaaauccaccugccucugccucccaaguacugggauuaaaggcaugcgccaccacgcccagccaggacuuucuuuuuuuaaguuuauuuacuuauuuauuguguuuaucuguguggacacauuacuguuacauagauguguacugugucuggguacauugcugucacaucuguguguaguguguuugugugggcacacugcugucacaucuauguggcggucagaagacaauguggggacuugucucuucccaugaugccacacaccuuuaaucccagcacucaggaagcaguggcagguggaucucugugaguuuaaagucagucuggucuacagagggaguuccgugccaaccagggcuacacauugagaccccauuucagaagagaacgguuuaaaccacauuuguugguguguaucugcgagcugguguaaguuuguggucugugcacgugugcuguugugugaguggccuucgguggacaguuggugggagcugguucucuccugcccuguggaguuucagggaugggaagcaggugaguggcugggcugugguuccuuucccugcccagcccucucaccagccccugcauguggcacagcaucagaauaguccaguugaccagcagaggcuguguggccugcggggauggagguuugccgauauugcacccuugagcaggcagccucuccccauucucuuucucggcaugggaggcauggaguaggaggcucagugucuuuuguccuccuagggccucagaauggcaacuggaccagccaucguggaguggccggcugcggaucacugcgaaagggaagguggccuacaucaagcuggaggacaggaccucugguaaaggcucaggacacgaguuaggcuaagaugucugagcugccucccccccccccccccccccccguggaugagagagacugcucuggccaagccaggcuguucagagccauggcaggaccauuacugcaagaugaaggccucugggugcauccaagugcugacgugccgugcuuauaaucccagaacaugggaagacccuuucucacgcaacaaaacaaggguguguuugauccaacacagagggcauuguuguuagcguaucuuugagugugaagcccagcauaaaagcuccuggcucaagccaggcagugguggcacaugccuuuaaucccagcacuugggaggcagaggcagguggauuucugaguucgaggucagccuggucuacaaagugaguuccaggacagucagggcuacacagagaaacccugucuugaaaacaccaaaaacaacaacaacaaaaagcuccuggcucuguggucuucgcugucugccuggucucugaaacuaaacuaagcuacuguauuuuagacacucugcuuucugcagggccuacuggcuccucuuacaguccuuccuugguguuaggccuuucugggugugacauaucugugauggcccaucacccucaggcuuagagccagccacaaauagauaaauugcugagccugggggguggcagcccuagccugccguuacugugugggcacggaggcccaguguaaguggaguuuuuaaucuuuaagaaaagcaaaggcuggcauggccuuaaucccaccuggaggcagaggcagguggaucucugaguuuaaggucagccuggucuauguaagcgaguucugaggcagccagagcuacauagugagacccuaugcccccacccaauaagauagcccuaaaaaugggggcuauuugaaaguagucugauuuggaaagccuugucaauuaaguaagaacuguugacccugugggccuauggccuguagcccucuguggcucugcuuuucccuuggcguugucccuucaccaagaauagauugcaucagauccuggaguaggcuuuggccaucugcccagcucuccugguguggcuauaucaggaaagcccugguagcaucacauagcagcaccaggcuggaggggcgccaagcucaccacccccacccuggccuuacaggggagcucuucgcacaggcccccguggaccaguuucccggcaccgcaguggagagugugacagacuccagcagguacuucgucauccgaauugaagauggaaaugguacgagugggucugcagggcucuucugagcagaaccauuaccuccagaaacgggagacugauggguguuacccccacccccuagggcgacgugcuuuuauugggcuuggcuuuggagaccgaggggacgccuuugacuucaacguggcauuacaggaccauuucaagugagugcuuccuggggacauagacuguuguguccucccuuguucccuggacaaacugcucccuguuaagauguccaaagaugcuuucucugcuagugccgcucaguccucuuccaggacuucucugcucuguggguccccaaggcugugucaccuggccuagccuucuuggugucccuucucuuccucagcagccccugagcugccagaguccuugucagguccuuuauaaugucacaaaugggacuaacauuuccaggucacuuugcagauguuuugguguccuuuguggaaggacagacagggcauccucagggcucugccucugcugguagauggacagggucuggccauuuguguagacaccccugucccauuggcugccagcagcauuguaggaaguuaggaaacgcuauucggcccuuugcuuuuagaccuguccugccucugcacaggaguguccagggaggagccagagggaaaggcucucacaccugggugccaugugugagugagcuuuaguucuuaucaguguuuagaacuuagggucuaaagcaaucaccuucagccucccucgugcucugacccgcucuuuauaacaguuccucaugggauacugaccucuaaccauaaaauuauuuuguugcuacuucauaacuaauuuugcuacuguuaugaaucauaauauaaauaucuguguuuuccgaugguuuuggaugaccaccccaggaggucaugacccacggguugggaaccucuggucuaaaccguggugcugaugagggagcugauaucugugcagaugcuguugucagugaaugcggggcagcugcauuccugccucaccgcucucucccuggucccccccaggugggugaagcagcagugugaguuugcgaaacaagcgcagaacccagaugaaggccccaaguuggaccugggcuucaaggacggccagaccaucaagaucaacaucgcagugagucccacccucacgcggcucugggagucacggguuuauaauguggcccauggguuguaacucugaagcuacccagcccaaagcuucccagccccacccccuucccagcucaguucuguccauggagguaggcagaauugacccagcagcugaccucauggcagguucaccccgggcaccaggccuccgcuuccauggcauuccaaguugagcggagccuauacagaugugauugcaaaauggcaggagagacuacaaccagagcgugcccuggagcuagggcuucuggggggaaacgcauggcucauaaugcaggaacccaaagaagacuuuguggaagcagugaccugagggugggcaggcaugagggggcaggaggaccacucaggaccagcacugguguuuccagccuggcuguuggagugggucgggagaaucugagggcuuaucucaagcugccuuggccuccugucugaguagggaggcuuggggagcgcucugggauagacggcaacgaggaggaggaugcugggaggcuugggcagcuucugcuggugguuuuguccuggcuucucgagucuucuuccuguguggcuaagcauacagcauccccugccagcucuugucgaagagaaacagguuaccagacaugcccucuuccuggcugcuggaguggagggggcaguggaguugggaggcauuugggggaaccacggaccaaacggaucuguacagagaaagugugugacucuaaaauaaugcuuuucuucuuuacucaccguuucuuucucucuccugcuucgugcugguggugcuuugggacccugaaguuggccagcuggccccuugagagaaaugcaggucccuccaguggacugguggcacugggauucuuucucuugcuuggaagaaacuaacauuuaaugagcgucagcugugggccagguaguguuuuucagguguucucauaugacuucagccuuucccuuuguaagagaugagagagugaggcacaagcaggaggggacuuggccaggguaggagaacuggaaauaacuggccccacugggugcauguggaggaugcugggacuuucaccucugcugcugcuguggucacaagcagggaccgcuguguccaucaguguggcuugcgcugguuucuggcucacugcuucgcuauguguacugaggugucguggacagcaaagugucaggaugcuaaaugcaaauccaaaccuaagggcugggaggaagauggcugucgguaaaaugcuugcuugccuugcaagcgugagaaccugggucucccagaccgacauaggcauguuggcgucaguagcacaugcuuauauagacccagcaguaggggacagagacaggaggaucccugugcucgcuggccagccguccucgcuaacugcugaguuccaggucagugagagaugcagacuaaagagaugggugaugugucugaaaaugacacucgggugaccuguggucugcacacucagugcaccuucagccccaugucugaauacacacauauacacccuacaccccuuaaaagcaugggauuuuccuaggucaggaaguagaagacggagcccuuugggagcaucuguccugcccugacuuccaaugcccuggauugggucugugcuucacuucugugaguugugugggagacugacucugauauaugauucccucauucacugugccauuguucccugugguuggucccucugcgauggcacaugccauugugccugugcucccguucaugugucucacugaggauggacagugggggaacuccauccgggucagcuccagauacugcugcugugaauggccaagcgccugucuuuguugcucacgagaggauggggcugcagaacccugugcugcgcugcacuguggaugccuuuggcugcuuuggcagagcgcucugcccagccucccuugccccaccgugcaugagugcucuggcugcucuguccuugucaguccuccccagucgauacucgggcaguuugugggauggaaugguguggcugcaagccgguguguacuuuccuguugagaugugagaccaaugcuggauuuguuuaacccugaccauuaguauuggugcuagauaggaaguagggguggguuggcuauaacucgugcugcugcaguuugggacgucauuugcugugcagguguugaggacuggagguccccauggguccccagugcauggacucaggcaccgaggcugacuguacucuucuuuucuauuuagaacaugaggaagaaggaaggagcagcugguaccccaagagccaggcccaccagcgcaggagggcugagccugcugcccccuccuccggggggcaagaguuccacugucaucccucccucuggagagcagcugucuguggggggcucucugguucagccagcaguuguuucugguucaggugagugcuguagugacuucuccagccacaccuggcagcuuuguuuccaguagugcuguggcguccuucucucacuugcuuugugccugugugaccagaugguggcaguagagagcauuuugcauacacuugagggccuucuauuccuuggccuaucuccauucccuucagggcacuuguccuggcaggcagugaccaugaggucaucgguaugccauggucucuucucacaugugaugggaaaggugagccacaggugcacgggccaaauguauggggcccugaucuucuccauugccggacuaugaagggagucuaggaaugguagcauucuagguagagagaggaguguggccaaggcucccauucuuagagagguggaugcagcuuucagugugccguugugagcaggggaagcgaggcaggagagcuagugugggcuccugguccaccgucaggugcugggaaacugagaggcugcucccagucggcugggcugaggaccccguaccgccuccucaccaggcugggaguguccgcacugguuuuacacagccccgucagcggguuaggaaugaccgcauuuaggcaggaagccuucccgugcuccugguucucagucucugauguuggcgccucucuguggaagucaggcuuccaaccucagucaugggagguugaugaggagagugccagaguugaaauuagccccugcccuguuuccggaaaugguucuucuagcauuauguucagagcaugcuugcuggaccacuggcuuaggcaucgcuagggacaggagcgaaagcccgaaugcuuaggucauucuugugugugucucaggcuucccugggucccagucccggucugagugcauguggagaauuaggucccuaagacagcuaggaccagagugccuugacuuagucuggcuggagcaccguucuguugaacagguggaacgcgcccuuaacaccuucauaagccacaacaaagcugaaaacccgaauguagcaccauucugucaggaccauuuguacacaggacccuugcucucuguggcuuccaccccaugcucagggccugcagugggcaugugagcgugcucacugggcaaccguccugucagccacaggagagauaagaaaaccaacucagauggccugcacagucacacagcuaauccugcccuuccaggggcugugcugagguucagaugagauaacgcauacucagcacucggcaggcugucaagcgcccccagcagagaccuuggucuucucuaguuucccagcccagagcagaggagaaauggcaguguggccauuggcagcauggcuccaggaagcugaggaggguaggggugugugugcaagguuggcuuccguauggccucggcuggaaggcucucccugcaguguggccuauagcucuaaccaguugauccacacagauccaggccuucuggaaggagcucuugguuugggggaggcauucuucacuccagaagccagggcagggcacaggugugacuuucccuggcacccuucccuccaccuuguauguagcuccugcuuucucucuaggggccaccaagagcauaugaaaaaguugggcaauguggcccucucuggaguuguuuguucccauaacaugucuccuuggguggcagcugcccagcugggguccugagacugaccacuuuuagugagaccaccagaaagacgucucugacucuguuucuuuucucccucucacuggacuuggggacaucacuaggaggugccacagaacucuggccacaaucuaagccugcugccgcugccacugcugauaucuggggagacuucaccaaauccacagggugaggagcacagcuuucugggcuggguggggccagagcuguuccccugagaccccaggaauugcuugcuggaccugcugacagaccaguucugauuagacauuuucauagccacaaggcaaagcccugccuuaggugccacugcccugugccucuaaaggcuuuucacuguuccccacugccugagcccuccagccccaaaccugcccaguucucaccaaguguugcccugggucaagaaucaagacccagauuuuagaccaggaccaucuucagggaaccuuugaggcaaggccucuccugagcuuuaaggccuguccuugggucaguguggaacaaugccaggguccuguuaaccggcucugugggaggcucuggaggugucggcacaggucugucuucuguaaaggaacagacagcugaaauccacacacaagccaggucggaucuucgagcuacaucugcugccugcugcugugggucaucuggggacugcccgcucagagcuccugccccagaagauaccugcucccuccgcucugccacagcuggauaaugccacucucccugucuuuuucacaggucccccuccagccagucucagccaggcaccggcuggguccaguucugaccugcacaaccuuuuccucagccgacuucugggaaggagcugccucguccugacccacggaagguggcagagugcucccugccuggccccuggccccuggccccuugccuggcuggcuugacagccugagcacaagaagcaguaaguuggcaccuugccacacuguugguugggcccaggugcugcucagccaggaaacgagagcaaacacuccagggccuuugcaagcccaucgcccuccucacuggagacacccagaccugccuuccuccaccaagagauccuuauuaaacacagcccccaaagcacagaauggauucaauuuguggccuggguucagcucugccucugcaguuggcaggugucccagauuugcuguuggacagggaccuucugcacuccauccauaauagccuuugguaccuuccagaggaguccuucccgagagcuggcaagucuuugagcuguagcuugaaugggcugucgggggacacuggaagggaguaagcagcuuuuugaaaauguuaauacauuacucugcuaauaugcugaccugcacuaaugcaccccugugagggaccccccauggcgagggccucugccucugacacacccuucucgcugcccugagccccggaggcagccaugggaggcagccugcauaccuggaagccagcugcacagugcuguggggaaacagaagcguuacagaccgggccaggcugccuggcugcugcucccucugggcucauagcuggcccacuugacggucccugguggcuucuggagggaagcuguaccucuagauacauuuuucuuuuccuucagagaccgugacagagggagcucugucagccggaaguucaggccaccagacguagugauuuguaagaaauuacugucuccucagugaaccuccuaguuucuuuauagacuuaaccuucccuucaguuaaaggguuucuuuuucagagggccuagacugugcugaccuugugugaccagagauuuaaagaugaaaaaaacaauaaauguguuuacuucugcaccacau

SEQ ID NO: 2232 - RNA, 1684 nt, Mus musculus
uguuuuuccuuaaaauauugcucauuuauuuaaguguuuucaauucugugugugugcuucuuagugaauaaggcaucccacaugacugauaagcacaugucuaccacagcccuggcuauuguaaacaacauacuuugauuauauucuuuccccucccagaaccucuccacuucucccccucccuacccaccaaacuugacgcucuuucaaaagaagcaagccaggcagcgguacacgcuuuuaaccucagcauuugggaggcagagccagaguuccaggaaagcuagcacuacacagagcuguccuguuucaaaaagaacaagaccuuggagucagauuugugauggccaacucuuucugagcucgaggcucuugaguguguuugauacaccugaugucacuccauugaagaaggcugauguccccuugccugccaguaucaguugcaaauagccucuuggugaggggugggaguuuauguccacuuuaccuuccacacacugggauuuuugucuggcuugagcuugugcgggucuuaugcauuugacagucucugugaguucauaugugcaucuucuugucgggagucgggaaacuucaguuuccucuggauccauuugccacuucuggcucuuccagccucccugcccacucucuggaauagaucccugagccuugaggguaugagaaacgucucccauuuagagcugagugccccuaagucucucaaagagcugugggucucuguuaauuucccaucuacuguuagaagcgucucugaggagggcugagcgaugggcugauguacgggacagcaagcagugcgucaguaggagucgguuuauuguuaugcugauuaagcagaaacguaguagguuuucucccuggggccccaaaaggagcccgagcaaauaucaagucaagauuauuuuaguaugagcauaaauuuguaccugaaugggggaugacaguuguaggauuggucccuguuggccacgccccugguaccgguaagaauaucacagccagcccaguggauuugccagccucccgcuggugucugugcgcuucaccuggcucugauccagaaccccuacacacacacacccugcagguggaagacccaccaggcacggaggaggguggggagugacuguaggaacaccgugcuaaaccugggugcgaccagaccugccugggaguggacggugugcuaaguccgggaggggugaagcaugcccgggaggugcagggccugccugcgacggccgagugcgguugccuggguagggcggggccugccuuggaggguugcugagccuagagggcggggucugacaggggccaggaggcgggggaugggggacgagccugagaggggaggaggugcugaggguggaagaggaggagcguugagccuggauggagcgaggcucugacuacuguagagggaccuagcuggaaccgcaggaagcugagucugucuaguacacagcuguucggcgucgucuggguugaagccgcaggaccaacuucuaagggaggggagaggcaggagagcagagcucggaguccacauccgagaagcucuugggacccccaaguccaagauauuucacuaccggcgaaggaacucgcccucaacuacuggaaaaaugcuggccgcgcaucuggcuucgucauc

SEQ ID NO: 2233 - RNA, 942 nt, Mus musculus
gguaggaaaacaagucucuugucaggguggaaaaguaccaacuuguaaguaaauagcccgagauggcugcagagaugacagccgcuuucugcuaggagucggcucccaacaggccacugaguaauuuauuuacccaguccgaguugcuggguuugaucccuaauacaacaaacaaacaaauaaauaaaauuaccaaaaccauaaagggagucacaaguagguccacaucuuuccuuugucacaaagauguuugaguaauccuuuugcaccuaaguuuucacuccucccaaagagaggagaaagaacucgguuguaucgugugagcaaugagacaauaaacaguaaagagcuuaacacagaguccggugcacagcaagugucccggcagcucucuguggagccggaaaacaaggguuaaaagagguccaacuccagaagagcacuaacuuucggcuggcacggcgcaugcgccugccggcggucgcgcaccucggacgagcgcugcgccagcgacggaagucccagccgggaagccagcgaggucgguuccgcccgguucuaacauggcggcgcccuuugucugcugugaagcgcugcccccggccuucucgcggccgugaugcaccuccaucuguggugggguucgggacauggcaggugaggcccgggcggcgccagcgguccggaagucccgggaggcgggacccgaggcggccggggaccggggccacgggacgccgggacgguugugugggggaggggaggcccgggcggagggcgccgcggggccccggggcggcgggagcggcccggagggguggccaugcacccgcgcggccgacggggcgcgagucgccucccgggcugggugacaccgcggcugguggcaucuccgcccccgccgccgggcugucaccgcccccugaccccgcgcgccggcug

SEQ ID NO: 2234 - RNA, 2157 nt, Mus musculus
ugggaugacagugaaggguggagaaggccgcggagcucgccgccgcugcuggccgagcuacccugagaaguuucuggaaagagggcuacaaagggaaccugaggggaugaauggaaagcgagccauuuucugagagaagacagcgaaaagucccaacaaaaaguacacggccuuagccgagcccacgaccgacgacacacucccauccaaggaggaagcguggggacaagggagcggacugggagacgcggaauggcggggacauugaaaagauggaggcgcagccgccggggcuugggaguggcagggaggcgcuaggucagggguccccgaaccccguccuccuuagcuccgcucccgugugcgcucugaccugcccgucuacacucggggggcccccgggguucacggggaugugacgcgcacacgcgcgcgagcucauggacagcgugggaaggaaccccggccgcgcgcggggacagcguccccacgccacggcccgcccggcugccauuuuguagcgcggccgccauuuugcgcggcccgggggcgggggaggggcucggggcgcggccccgcggcucgcgaugggcguggccggcggcgggcgcggccccggcccccuuuguucuccgccugggggucgcgaggccccucgggcucugcagccgccgccggcgccgcagcagcagcagcgugugaaccgggagaggcagccccagggcgugcgggauccgggagcccaucggaagcgggguguguccccccgugcgagggaugacauccugcguggggaaacuuaaaucgccgccgugggaagcggcuuacgggcgaaccgggcucggcauccuccaccucugcaaacaaagucaaguucggucccgaaagcaacaaaggugccgaaacuccgcggaaccuagcaccaggaggcggggcucgugcagcccacgagguggaggagcgcugagagcucggcuuccauuggcuggcccucggagcacaaggcuuucagggcccauucucccugacccagaagccugaacaauaaauaugcugugauggcuuucuucugucgauuuaacuuccacuuauuuucaaaaagcuaugaguuuauuaaaaauaaauaauaaaauacgugccugacauccaucgcccuuucacuuuccgaaaaagcaaaugucuucuugaggaauauuuaaaaaugcgaaucuuaguuguguguaaugcugaaaauucuggcacuauuucgcaaacccagaaaacuugaaaaacgcugcuaaauuugacuuccagcuuuugugcaguuuucuucccccuaaugguugacgugguuuuucuucacaaaagccugguaucauaaaggaaccagcccguccugacucaucuauuugugucuuggcuacaguaaaccucuuuuuuugucuucucacuauguguaauuauggcgacugcuuauguuuucuguaauagugggguaaagcuuaugaugacagacugaaaaggucaaaacauguugaaggaaccaaucgggauuuugaugacugccagaugagagaaauuuagcagaagcguuucgauuucaaauuucaugaauaggugggcuugguaguuauaaaacuguauacugugucuuuaagauuacauaaauagucugaaaccuuuaguagugauuacuuaaaauauguuguguucaccauguuuucuugucuuguaaccaaguaaaacaauucaaaucauuauuugguuaguugguuuucgagacaggguuucucuaugucgcagccccaggacaucagugaaaucuuauccugggacguuagaauaauauggcauauaugguguauugacacuccgagaaugauuucccagcacuucauugcacagacaaggagagucugauugaauuuuaaauucuauuuccuuuagaauuuuucacuguuuuugagaaagacucaagaagcucaagcgggucuugaacucagcuuuguaguugaggauaaauuugaacuaaagauccuccggucucuguuuuuuauugugcccaauguuuuguuguuuuuguucuguggguuuuuaaauuuauguguauauguccuuucgggucagaaagggugugggucuuguggagcuggaguuauaggcaguuuggaaccgcgg

SEQ ID NO: 2235 - RNA, 1581 nt, Mus musculus
cucccaaccaucuugauaaccgcauguuccuggugcaguucuuuguccugggacacaagaaccugguacuucagccuguguccuuugucccccagggaacucagggcagggccagguuugaggcucauauccuagaagccugcccccgaagacauuggauucaggaagccccuuuuucuuccugugccacugugauccucaacgcagguugagaaaagucaccuuuauugucuucggcgagagcaaggugggggagggguggccagagggcaggggccauucugaggucacaauuguccucuugcccagccaagaaaagugggucugcugacgcuguccaucuccaagagagagggauucacucugaggccuucauguccccaccucucuagguccccagcccuggccaccuccuuucuccagagcccccccauggccugcccaaaagucuaggugaggaccagccacucagucuucaggccacaucguguggucaagaccuugcugguuaggccgcgcaggccugaaacugacuucacauccuccgcagggcgagucaggaggggaccgcgcuccuggcuggggcagguguggaaggccggggcucacauggaucuguccauccugauucuccuucugcuguuacugcugcuguuacuguaggccucugggguggaaagcccuggggggaggguccgaagggacacauacccccaguuagucucagauccgucaucaggaucuuccgacccucugggacccccgggguugccagcuggaguggucccugguacccagguccucacuccgaguugaggguccccugcccucccgacucuugucaacucugggggugugugugcugggaaccuugggaacagggugggaagcuggggggggggauccauaaagguaccuaccuguaucuggcagaggucgauuaaggcgcgaauaccggcuaagcaccacagcucacccaaaagggagaaaaagauacucaggagauccagccagcggcccacggucaucaacagaaggaagaggccacccaugcgcaccagcaccgucuggaccuggcccuguaggcugaagcgauguugccacugcuccucugugggacgcgguugucacugucucagccggcaccuucuggagaucagcuggggccagccuguuucacuucucagcugccuuccccggggaucuugucagcuucccugacugccuucccacagcccugcuucugucucugggcaccuacaggacuucuuacccacccuuaaguuucccccugguugaggacagagcccugccagucgauggcaggaaucuaagguucucccccuuucugccugucaguuugaaucauccgcagcucaguuggcuucugccagucucucucuuguuccauccuggucccagccaccuuccccucuugccgaagcucacucaucaaggcgccugaguuuuguucccgaccaagcucuacugaccaucuaaagcgaccuaaacacaccaauaagaugacaccaucccucugcuuuuagagaacucuaauggaagucuuguuuuccacaguca

SEQ ID NO: 2236 - RNA, 1140 nt, Mus musculus
uggggguggaggagggguuuauuuggcuuacaugucccgaauuacagucuacugagggaugcuaagucaggaagucaaaccaggcaagaaccuggaggcaggagcugauggcuugucuuccccuacguugcucagccugcuuccuuauagaacccaggaccaccaguccagggauggcaccacaaugggcuguguucccucccaccccccaucaaucacuaauuaagaaaaugucauacagccuuaucuuauggaggcguuuucucaacugaguuuuucuccucucagaugaaccuagcuugugucccuggucgagcugacacaaaacuagccaagacagagggugugagggccgauagggaagagggcuuguuuuggaaguagaagauaccuugagaacggugaauuggaguguuggagaggauggagggcugagcucuggcaucagggcaacguugggugcuggaguggcucuaggcgguccaaaccucggaacccuggggugugcguggagcaguuggaaaggaauagguaggugucucugccaggccaagccuugucuccagagucucucgaguauucggguauaucuggggccccuugugggcaagggugaggaaugucagguuuggaaugagggaggggccccgucuguccugguccugaguggggucuucaaggaguuggccggguccuggaaggagagccuuugaauguuacagggaagggaagugugggcaaggagagagggagcaauaucuaaggagcuggggcaguuuuuaggcccgugcagggccuugcugcaagggguuaggggaacgacaacacggacaauacgguaucucagaggagcugggagggggcccggggucugugagguucccggggucuuugagcaggguggcucuggagaucggugagcucccagggucucaugaggaguuugugcaggauugggaagugggaggcgaagucuuugagucccagcguguuugaggucccgaggcucugcggugccggaucuaugcgauucuggcucugugagguccugggucuaugcgauccgggcugugugaguccccuaggucugcagguccccggggcuccggaucucugagcucccaggucuccaucgccccg

SEQ ID NO: 2237 - RNA, 17129 nt, Mus musculus
uccagucccugaacacacagccaccuccugcgagcggacccucuucccucccgaaggguugggacacccccuucccagguuccuuccagagggcuccugggacucagcgucacccagaggucaucagagagaaguugaugguuuuucacugugggggagggaggggaacgaugaugaggagcuggggagcggaaugcacuugaccccccuaccccccuccggggauagagaaggacccggcacgcggcaaaggcggcgggagccagcccgggggcgggcgguccccuaagucccaccuucagggcggcgccuggcggcggggagugucaggaagaggaagagcgcggccgggagcgcggcgcagagcaggggcccggccgaggcagcgcugcgcgggccaccauggccacggacgaguuggccagcaagcugagccggaggcugcagauggagggcgaaggcggcgaggcgacggagcagccggggcucaacggggcggcggcggcggcggcggccgaggcucccgacgagacugcccaggcguugggcagcgcggacgacgagcugagcgccaagcugcugcggcgcgcggaccucaaccagggcaucggcgagccacagucgcccagccgccgcgucuucaaccccuacaccgaguucaaggaguucuccaggaagcagaucaaagacauggagaagauguucaagcaguaagugccccugcacccgguuccccaccacccuagacccggccucgggcccuaaccucccguauccccaauuagauucccccagaaccccgucucaccaggguggggaacucugcugcuuuucuaaagagccacgaggcuuccagacccaccaccccagcacgcaaguggaucuggggagcucccguuccugacaugugaccccuccuccuggugauacugcccucggaauagcccacgcggauugggggcucccugagguuccuuccagauaaucgcagguccccagcgagucacuaccaccacacaggguaccgaccuccuucccacuguuaauguuacugcacccaccacccuacacccaaacauaucgagaaagggagaaagggccgguggcuucccuuccgcuccguccuaacuacuggacucccuacccccaccgcaauaaggcaacccuacugccucuuaaggggacauuccccccggcacccaugccagacuugugccuuuuacuggguccuuuaauuucuucugcuuaguuauggacucucuccuacuagguuggguccacaacccccuccccccaacacacacacacacacacacacacacacacacacacccucagcuauacuauguuuacuuacugugggugaaaacucuucaggccuuuccauucccgcccacccuguugaccagguuccauuuccuuaacacugugcggucuugcuagggaagggcuccucugucccugucccccagucuacaaacauguaacuccccuaucaucaggacagaguccccugggacuuagccccucuucauacacugugaguccaccuuccuccccucccucccuucucccccauuaccccgcccccccaccucgaaccccuucacuccgugguugugcaguggugacuccccugcccuuuaucagaaggcagcccucuuccccagugacaguuccucccuucccagacaaucccuggagcccauucucucucuaugugcccugccuagggucuccaaccccugccuucuacuuucuaugauucuaagcuguacccuuaccagauuaggauguccccaagaccugugggcucagccauuccacacccccacaaaauccagcaauauggagaugggggaagaguacccauagggguagagaagaugcaagugccccuccaaaggaccggccucccgucuuccuaguaagccaccuauguuccuggaaaggaaaugguccuccaggcaccaggcuggagcggaucccagaggggaccaaaccacagaagcugagcuuggggugggguacgcagggaaucccaaagcagaagacagccagcagauugagagccccagccacaccccacggacagugcccagacacccaucaggaagcccggaaagggggcguucccuccaaccaggguccagagaggauuuucccaugucccacuuccuuccacacccacagccaguccucauagggaaagaggacguuaggucccagcuaugggugacuagaagcuuccugaugccgcuauaaugcaccccccaaacuucuacauggagguuccagggcaagaggauacccucugacuucagucuccacugacugaccaggcuagaacggcaggaauccacacuccuugcuuuugaaccuuagggcaacggugacuuccagguugauccacccuguggauuccagagaguuacuuaggugucauagaucucugcagagauagggcuggggccucccaacagucccgugacucaggacuuuacagcuaccaaaugauaggaucaggauucgaacucggaccgguagcuucaaaagccauggccuucccuucugaacugucucucacagauaccugugucagugucucgaaacacaucccaacaccucuuuguguguguguucuguguguguguaugugagacugaccuccccccuccaccauccaccaccagcccauuuuacauuuccuccuucucuuaucuuucggcaguauucuuaucccccauaccauggcgcuguuuuagggaacccagauacccccaaagagcaagcucgggagagaccacuuugauuugcggggaacccguggggagaauggucuggaagcugugcuguacuguuuuacccaggcuguuuuggggggaagcaguuuaguugagaggugcuuagagggugcuggccuccucagagcuaccucuuggcacuagugcugcacgcuggggugcugggaggggugacaggguaggaaggggccagaaagcuggaccucaagagaaggaagugccacucgccagggucccuggcuggggcgcaaagcugcugauguuguauucagggaaacaaggccucacugugccccaugagcccagcccagccgaguccggcuggacacagccccagaaggcuucucagagcacagaauacacaaucugcuuccacugugcaaguggcugcugccuccuggggcccagcaggucccaggaucucagccagggcucuguugagagcgagugcagggaggaaguggagccgguggcccuggaaagcggagcuggcucuuccuuggcagcccagagcuaggaggccgggcuucccaccucaucgggaaucccaccucagguccuugucggcccuggaccucagucugccccagugcaagaggaacaggcugugugugaugauccucaaagacacgccuguucuagccucguuucuaaggggucuugagcacugaugcucucuagaacugcuucgaagucuucugguccauccauucaguguggaugaggacagugaucgagggagaacccgaggaaacagcaggcucugccaccuacugcugccugcugccuccagccccauuuuacagacaggaaaacugagauccagaagggagaagugaccugcuugggaucauggguuuuccuccaaguggggccuagggaugacacauacugaguucugccugcugucaggcauagaggcacugcaucuuagagccuguaccccacccucucacaccacacccccgccccuguggccucagacuuuaucccuccucucucacacacagccuccuccccucucuuugcccacucauccagaguuguuuucuagaaguuuccaagacaaaaaggcauuggacagauccacaaaauuucagggauggcuaccgcugcugagcuguuaacagcccggggagaacucuggaagguucuguaagcugacaucugccuggaagguguaauuguggaugaacuguggaauccgaggaaggugcccuaguuccuuguucugucuggcccggcacuggcccuaccccucugcccagccuccuccccacccacuucaucucaugaccccuuacgucagacggccaagguucccuuuccuuuuggcuuuuccuccuggggccacccggccuccucucucuucccuuccugguugagucugcagcccuacagggcuguacaccuagcugcauggggacucagagcacauuccuuaacccuuucuggggcucuuuccccaccugaugugcugucaagugcguaaccuaguacuuggcccagaaucaguacuuacuaaguugcugucaucauugucccaagcucagcauaugcccuggcccugguggcagccgucagcgcugguccugagguugcucagaacgagccucuggcugccuccacuuccccccaacagagcugccagccuguuaggcuggcacuggcucuuugcuuugggccagaaugacagggauucagcccguugcuacuuuccucuugcccaacagacgcucugauugacagcugcauauugcuuugauaaauaacaaaaauagagagaugaauucauuaucacuuaauuacguggcaggcaggugguagaagaaaagagaagagcuaacagcggcccuuggagcgacacuaaacugggacacaggcccuugccacccagcugggucucugugcaggguacugggcuccugagccucugcgucuccuugggccauaggaccuaccugacaguuccauguuggcaaacagaacugucccagguuuguccuggggucuguuaaggccauggauguucuuagaagacauccugccacccagcagcuaucaaauccagcugaaggccuuguagaacccacagaauuuuuggaaggucuuuggugggguccacaggaccaguaauggaaggcgucugcauuuccacuguuaggaaaaaccgcagccucucggucccacagcagccuguggguggugucaaacuucaggugucccuggcccuguccuuacuagagucccaggggaacucaccucuauuucuuaggggucaaguuuaguccucggggcucaaggaggugagucacuuggccaaggucgugagugcuacuugcaggauuagaucuagguggcucuuagggugaaaguggagguccuuguucguagaagccagagccaagcuugguggggguugaggugccucacaccccagggagggaggauucccaacaaugggccucuucucuuuuccacccacuuccccucuguaucugagucaccucuccuccccccucuggggacuuucugguucuguggaagggggguguuugcaucucccacugcccccuuucccuccuucccagccuucccaguggccagaggaggcccaggccuggcuuuggcuggaagaguccuggcccaagggucaucaggacuuccagaggcagguuggaggcccuuucugcaagggcagcugagcugagggguuagucacuuugcagccucuugcaaggacaucccuccagucugcagucaccgaguuccuucuggcugcccagcagccuucuugcaaagcaggacuucuucugcuuugcaagaacagggaaggcugcagggccaggcagguguggcucgcugggaccuuccugagcaggaaguccuuccuugacucagccauuugacugaugaauggggccacuguugacucacuggguaccagggcccuggcucucuucuucuuaggaaguuucuucugcuccuacuacuaauuaucaucaucauuauuguugcuguugauguuauauggguguuucgccuuuggaagaugcuagauuuccccaaacuggaguggaagcuuccauaugguugaugggaauuggacccagguccucugcaagagcagcaagugcucuuaaccacugagccaucucuccagcccugcuggcucccuuccuaauacuuuuuaaaacauacugcuagauucccacuggucagccaugucacagagagggagacugagucucagaaaauuaagguucagagauagugagaagcagaggcaaucacuucaugggggaggggagggucugucuccguauccugauuccucccucuugugguccaucgcggucuucuuaucacuuguaauccagagccagcagaacaagcaucuccgaaagcccccucuugucacaagugcuucccaagccuggaggcacuggccugucaucccagcugcucagguagcugaggcaggagguuaggaaaacucaaggcgggcuggagagauggcucagcgguuaagagcacugacggcucuuccaaagguccugaguucaaaucccagcaaccacaugguggcucacaaccaucuguaaugagaucugaugcccucuuuuggugucucugaagacagcgacaauguacuuacauauaauaaauaaaucuuuaaaaaaaaaagagaaaaaagaaaaacucaaggccagcuuaugcugcaaaguggguucgagaccagccugggcaacuccgugagaccucagcaugcaugaggcccugggguuaauccccaauaccacugaaagaaagggagggaaaagagacaguacaaggccaggccagucugucggcuuccaguucccgucccgguaacugcaggcaggugacuucgucugugggagugcuucaggaguacugugaauggagucaagaguggguaacaacucuggguucuauccguagucaguagcguacgugcuuauuaaguaagggugggcgggaaacaaagcaacggcaagacgcucgcucccacauugccaccuuggcucagccgguggguggugucagacuugagguuaagacaacccugaaucuuggcaacccucaagcaaguagcucucagcuuuggaggcucucaguggacccucuggaaaacuggggaggggccccgugagcaccgcacacugcuccgugucuaaaccccugacuuaggacaugugaucgaggucagauucugccccaaaguggugagugucugguuuguccccugagucaggcaguagggguggggacgugccaagcuggcccuccugagcugucauuacugggacccaccugcccuucccauggagacaggcgagcaggcccaggcuggccagaacagcuagcagaguuggaagucaccuaccuacccucaaaaugcccucccauuucuuaggauaucgaggcucaggcucagaaggccacagagaccuccccuaccgcaggaugguggaggccccaaaauacagcugcuuagugauuauaacagaauaaguuugaagcaccuacuguguggugaccauguucuacucaugaauacauuuacuccuuaauaauccagaaaauagauauggugguaacaaggcagcacguaaacugggggguuggggggcaagcccagcaccccuucagcagucuauccuccuguggccauuuggaaccggugacacaggccugggcugggugccagaagggacagacuguagucaguucccuguauuccuucccugugcuggggcaacagcugugcuaauggcuuugcuucugccagcccggcagggauggggcugggagagcgaucacugccuaccuuagggaacagugagcccucuguccucagagguauucaagacacugagcagggaaaaccacauugggagucugcccccuaacugagggcuggcuccccuucccuguguuauccuuugcagcccugcggcucucccccucuccgccccagcagccucuggaggcagcagcagacaggugugguuuuuuuuuuuuuuaucucaguuagaccccaccugcacccuuguugaccuuggccagugcacuuucuuucugucucagucuccuugucuguugaaaagggaugucuggacggagaaugccacccuugugacucgggguuaucagaaccgagggaggggaccgacagagcugggggaagcagcuuuguaagaucgcauucagaccuaaagacagggucagccuggguggcagcuguagggagggugacaggagagauuuuugucagauccuaggcagcagcugcugagcccucuccugcugggaacuguggcauggggagggaggcuggaaugugggccgggugccaggcccgcagcagccucccucugaugccuagcacgaggaaaggugcugagcuccaaagccugggaguucuguuaacagagcuuggugacauuggcuuuccugaaccagacucaagagccccugaguggagcaucaggcccaaccccaguggcccacgagaaagagggagccagagagauggaaagaguucaucuaguagaaucccgccugcugugggauccuggguuuaucacucuccacucugagccccuauuuuccuccauaagccggugggccaggcuaggaggaugaacccucgaggaccaaccuuucuuucccuggauccucugagacucccagagccucaaucccaguucagaaagagcagcaggauaagagggccucccagccucccucgugagaacaccaucacuuccacagcugucaccugcuuagagguguggggacaguccccacuguucccuccuuacagggaggcaaguggggagaccaggagcuauguagguuaaggcuccagucuccuucaguuuagccagaccuucagaagaggggaauucuggggagcuccuuggucaucuauccagacugauaccccacccaaccaggacacuccaccauaagccccuccucccagcucuggacuagaaccaaaccuggucuucgugauugaacagcaaugcuuucaaggcuucugguggcuuuuauuaacucaaugucacugccauugucauaguaaggaugugaaauguucaguguagcaucuggugcaugggggugggggugcagggguuucgagaaaguuucucuguguagcucuggcuguccuggaacucacucuguagaccaggcuggccucgaacucagaaaucugccugccucugccuccugagugcuugacauuggccggcuuuaagguauucagcaccuaccgugugucuggcccugugcugagagucaacuugagucauuuagcaaucuucacuuucagaguggguuuuuuaaucugcaugguaguaauggugaaaguggggcuuacggggucaggagccagcagggucacccaaccagcagcggcagaguugggcuuuggagacaaggugagcauuugguccgguuuucuguaagguuagccuuguggccuagucacugaugugcacauuuaaggccuuuggagaauagucaccuccuccagggccaccucucacccugugccagguuucuuuuggcucugugucaccuggcuuggcaauugauauuuuuuuggaacuguagccagccccugcaucauccccuggggacuggagucagccuggguuggagcccagcccugguaauugauugaccuuugauugauuuaggcugcgguuugagguguggucuggcccagcgugaagcugcuagaaagcagggaauccaccacccaacgugacauccaaguuugggcauggcgugugccucauuuagucugagaucauuguucugguuuuaaaagaagcauagacccuugaguguagguccagcuggggacacaggaaaacaaggggcauguggcucccaagcuggggucccaggcuauaguacccucuucagugauccuccccagcccugacccacuaugacggcggagcauaugaagugccuggcaggcugugguuauuugguaagauaacugaaucccaccagaguggcgauagcugccagguggagcuagccacuuacuguguggacucugccgugggcuugguauccaugagccuaagcaagucucccaauuacacaaucuagaaucccagaaaauagaaucccagugaggguuugccuggaucagguuggccuaugggcgugucaguagggggcuggguuauguuaauugaugugggaaggcccagccuaagagugggcaguaccauucuaugggguuggguuuuuaauuacauaagagcguuauucugguuuccuuucucuacugugauaaagcacuuggaccaaaagcaaucugaggagaaaaagauuuauuuuggcuuagacuuugaugucauagaacauuguugggaggagucagaacaggaacucaucggaacuugaagcagaaaccuuggccgagcgugguggcgcacuccuuuaaucccagcacucgagaggcagaggcaggcagauuucugaguucgaggccagccuggucugcaaagugaguuccaggauagccagggcuacacagagaaacccugucucgaaaaaccaaaaaagaaaaaaagaaaagaaaagaaaucuuggagaaaugcuguuugcuguuucuggcucacacucagccaacuucccuauacagcccagagaauggcgccgcccacagugggcugggccauccuacaucagugaaccaucaagguaaucccccacagguagacuugcaggccaaucugaucuaggcaaacccucgaucgagauucccuucucagaugacuguaucgggugacagagcuaacuaggacagcgagcacagcaaggacacucucuguucauucgcuugcuguugguggcugugauguggccaguugcuucaagcuccugcugaacuuccccaaccaucauggcugucaccuugaauugggagcuaaagaccccuuucucuccaaccugcuuuuuuuuuuuuuggucauguuauuuuagcauaaccucaaaaaagagacuaaaaccagaccuuucuccuuggggcuguacuggauacuguaggccgcgcuuccuugaugucuguucaggagcaccgaugacucccacuuaagacaagcaaaauauauguccagauguucccagaugcccccuaaaggucacauguucugccuugugcugagggggagcccaggcagucugacucgagaacaugccaucucggaacuucacugggguccacguucagaaaguaagggacucuguggucccaagggacacagaagaggcguccuugugucuuugccuugggaaagacaggccccucaucagguaucccuguugccaguggagugcagcgggugcccugcccucuaccuccuguagacacccugccguggcaggagugugaccaggcaccucagggcccuuccugcugcagaugguggcugggccuugauagcccuccccugccugccugacauucaccacauccucucacacuuacccccacuccagcagccccucuguccucagggcccacuagccugccuguccccacccuguagggaacacaugguuccaagugccaucuucuguguuucauuacuuccaaggccugagucacucacacaucaacuauuuauauauacccuuugcacaaaugcucacuuuggugcugcuggcagacgccggucugcagguagccacggggcccagaacgaggcagggagcagauacuuagauguauaaguucaucagccugacagaccugggauaguagcccagcucuuuccuuuuccguacugcugugugaccuuggguaggucaaucagccucuuugagccucugguuauuaaguguguuaaagaguaauaaagcucccauccaaagaccauuuucaaugcuaggggcuguuagaugucuaagucaggugcggcuguagguaacuggagaggggcaaaggggaagccagagagaaacaggaagggcacccaguaucuguaauugaucccuuauguguccucaggcagaaaagccaacaugucacccugagggcacuuuccccaggcucguguccagggagacaaucagagcaggugugugucacccugacaagaagacuugguggugccgacagcaccuuaccagcuggaaaauggguuggaggccaccucuggccacucagcaccaggaguguggugacauagaaaagggacauucagacccuguucucacccaucccugucucugccaggcuguugguggccgagaaaagaaaggaauggccgaaacaggccugguuaucaacugguucugugccaggcuccccagcacccugcccccacucccuguaggcucccagaacagccuguuccccgaacacacccagguccaccgcccugcugugaccguggcccugccucugcaucccucuggacacagugcuccaaagaggcugcugagacccuuggcucagaauucacucccaagucacucacucaauagucugagcaccuaguagguguuuucucucucucucucucucucucucucucucucucucucucucucucucucucucucucugucucucucucucucucucuccuggaaucuggcauaaagcuggagcaggaacuaagauccccgaguggaggcugcugguucccuccugugaggcgauguggcucuguuggaguagagcgugcaccacaauaaauaaauagaggagcgaaaugaugcacacagauagucccagcauguggagacaggaaggaggguugcugugagugcaaggcuaaccuggacuacauagugacuuguaggacaacugggcugcaaagugagacugucuaaaaaaagaaaaaaauuaaacacugagaccaucuuccacaucuguacuauccucugaccacugggaaugaaugaucuugugugcaugugcgcgcguacacacacacacacacacacacacacacacacacacacacacacacacacacaccaguuagcaguguuugagagacauuuggcucuuacagcccagaagagcuacuucugugaacaucccacacuccauugacagcccagcccacaagaccucuaccaccuaacugaagucacagaucgggcuaaagagagacugagacgacccucccuguccccgggugcccacagaggggccuggaccagagagagcaggauccaugggcaugaugugaaaacaucugcuuuuucaugcacucucaguauaggaggcuguggcuuccucccccacaccguggguuuaugugagaauuagccuuguuuaaaauacaggaugcuaccaggccacguggccagguccccuccagcucugaugggaagacacugaccacauccugccccccaggcuuguggccgcucugcagagucagacacaagggauggcaggagagccuuaagccucucucugcguccacagguaugaugccggcagggauggcuucaucgaccugauggagcugaaacucaugauggagaagcugggggccccccagacacacuugggccucaagaguaugauccaggagguggacgaggauuucgacagcaaacucagcuuccgggaggugaguccauccaggggccacucccagccagccacaccccagcacuggguggccuugagaggcucgcaaggcguucuuggcaggcggccuccugccugggccuccugggugccagcauuaugagugccaucaugaucgauuccuaugcacucaacugaguuguggggaaaggcugugugcucugagggccuggagauuagaagggaaagcgcccaaaacuggauuacacagugcuuggcucagaggaagggagggugacagggucugcugaggggaccagguguggcaccguguagcuucacauucucugagggggaagcuauggaccagccuguuuggggaauggccggagggaugagguucaaagcaaaauagccaugguucgggcuggagagauggcucagcaguuaaaagcacugacugcucuuccagggguccugaguucaguucccagcacccacaugguggcucacagccaucuguaguagaauccagugcccucuucuggugugucuagagacagccacaguguacucagauacauuaaauaaauaaauaagucuuuuaaaaaaaauagccaugguucuaggcccccaaacagcauggaguugcggauauggaguugcagauauggacuuguggauaugggaagggaguugcucuggcaugagucagagaggugguguccagggcuucuuggguuguauguuugggggugacaagaggccagggggaaaagucaagugguccccgagaauggcuugggcucagagagcauccaaccgaauccuuccaaugcugaagccguuugccaucuccgaaccaucauccguacugcagaaugggagugugggcccucuaaggcuuugugaaugcagggcagcuuuguguugaggaacaguggguggcaaguagagacaggcugacggugggaauucugccacccaggguccuggcaggacagaccaggaagguaggggccagagcccagccuaucuugacuuccgguccugcaggugagcacucggccuuucugcggagggaucugagcugaggcuuggguguggccuuggacuuuguucccuuuucucccuugcugaccccugugcccucccuccgcaguuccuucugaucuuccgcaaggcagcagcaggggaguugcaggaagacagcggcuugcacguccuggcccgccuguccgagaucgaugucuccacagagggcguuaagggugccaagaacuucuucgaggccaaggugagaagccagggacugcgagguccaacugugcgacgacacagcuaagacaggacugugccagucccuccccgucccucucagggcugcaggggaaagguggagcugacuuuuccugaggugugcagggccaucaggcucucuggaggccccacccuugccagccccagccgggacgaagcugugggccuucagaccaucugcauacacagccucucccucucccucucccucuccucuucuuucugugagugugcguguauucucuccaucucucucucucucuccucucucuuacucucucagagaaaaauggucucgaauaccccaggcuagccuugaacuucauauccuuccgucucucuuuuccccagagcuaggaucacaaguguucagcaccauaccugguuuucugaaguauagcucaaaaccaggaugucacccaugccaggcaagcacuuuaccagcuggcucuaucuccccucccccgccccccagaaagccccguggucaauuucuaagugugugccagguucuauauggagaaacugaggcagagaggugacuauggcucaccagggccggggucagaaaggaucccugggagagcagcuccucaggcugauguggagaccacgccccugaccugucugucacccucgcccccagguacaggccaucaacguguccagccgcuuugaggaagagaucaaagcugagcaagaggaaaggaagaagcaggcugaggaggugaagcagcggaaagcggccuuuaaggagcugcaguccacguucaaguagccagagccaaggccgagaccuggcccugccccgugugcggucugggggcacggguggguacaggggaucugugggagacuagcucccagguccugcucucugugcccggaccacuacuaaaaaccgcaaacgauaugugacccgaucucauucaggagucuccucggugguuggucccugcccugcccucuccugcgguucaugcggcugugaugccagccagcagcauccucucuggccaucccuacgugucuuguucucuggccaccuugcugccugcucuagcccaacuucagcccauucacgccccugccuuugguaccagcuacuuucuccacccacccaacuccccuuaacuauaggccgcccugccaugguccagcagagagugagacccuccccaggacgcuuccuuucagaucaggccccaucucugauggaaguggagagacucuucuauuagugaggagauccggggacuccuacauuagugaggagauccaggcccuagcacucuaagcugauuucaauggggcccagccaggcagggugaaggccacugugcgaaucuaccucacaggcuacacucugccaggcaugccuuggggaugugagugauaggguuccgaggggaggggcagaaaugucacccucugacagccuacccccgcagcaagcugagggucccaaggggcuguggagagagggguggggucccuaagggauuggccuuuucaggguggaccucagcacucugccuugacuccccaaggagugccugacguguuuauguucacuggcaguaggacucggggccggcaccccuuucacacucuccuuccuuggguuugucacccgugauggcaccagccugucgugcccacccguagacucgcauggggacuccccaggccacagugaaacccgugccguuccucuauagcuccaugugcuugcucacguguguguaugugcguguccguugcuguguugugaaacugugacgucacccagucuaagugaauggccaccggggccaccguuaugcaauguucagcgugucacugcuugugaagcucgauaacucuuuauuuuacuacaauguccccagagucccugggaccccugugggacuugcaaagguuuuauuuuuucggucuuagaaccuaugagaaucggaggggccgagccaagcccagcccagcccagcugccguggccuuggcuugcguuugccucagcggauauguuuauacagaugaauauaaauucucuuuacuuuuggcuguuugcauuuuauuuuugguucccccucucaguaccucccaaaaaaagaaaaaaagaaaaaaacuacuucuucauucggugguacgauuauuuuuuuuaacuaaaaugagauaaaauucuauauucuuaugugugugugguuuuugaugacuaacuagaaacaaagguggacaggaucaggaugaggucgcuggaucugggccgucacaucaggagccuggggaggaaggcacuccugcuggagagcucugucccuuagcaucuacaaacacuccugaucuaagcacuaccuguauuaaacucauuucauccuuaaagga

SEQ ID NO: 2238 - RNA, 718 nt, Mus musculus
ugccuagucugugugguguuacaauguuacaguauuaauacaguguauuacaguguaacagcucugggagugcaacaagcucuacccacugagccacacagccagcccccgcgucuaucaauccaucacuagcuacccauauucucauucauauucacugacccugcccccucuuccccuaugcuagaugcuauccaggcgccuccaucaaggaccuccaaccaucaaggaccccaagcuaagcccucccgaagagcugaacucugcacagcugacggauggugggcacucuggcguuagacacccuaguuucagcaacugagaaauccagucacagucagaggggaggccaggggaagggaaucauuuguccuuguucuuccuuugcugagguuggcgaagcuuugaagccaaucagguguugaguccuagacucugugcuagucacacuggcucucccagggcucaaggucuacaagcuccuucaaggggcucagcaauacuggcugaggaccaguccccucccuuugacauuucugucacucauaccuuuaugacucugcuucaaaucucccccuguggaggucucugacaaacaguucggagagauccucuuuccuaccgugacagacgcucucaugcaccauccugggauuuuguuucugacacaagcaaugguuaaucuaaaaagagcaaaccucaacuaacugaaaaaaau

SEQ ID NO: 2239 - RNA, 1650 nt, Mus musculus
uggucagagagagaaauuuaucgcauccaaauguguagucucugcacgagggggaguguguaugcguauucuuggcgccuuccucugcaaacagaauaacaaguaagcgcaugcgugaaccgggagacaagcugcuuagcacucggcuuccuuggcucaggccuggugugugugagcugacaauuggaggcaguucugggcagcagucuuuugcuacaauuccuucacgaagaagagauggaaguacggaauucuauggaccaggcucuccccagcugccaccucagagcguuccauguacuuguguccuaugcuugcuuggacuauauucuagcuguuuucuuucauguugguuucuguuauuaaacauugaagagaagagguuuugucuuaagcauuuuaguguuggcccugagccaaacagugccaaggauggucugguauuccagggcucacccuaguauuuacauccugagagcucugcaugugaccccuguggacacaguggggaccaugacaguuguauccuugaaaagacauugauaguccauguuaacucaaaaucuuuucuucuuuuuaaaaaaaugauuucauuguuuuuaagugugugugugugugugugugugugugugugugugugugagagagagagagagagagagagagagagagagaaagaauguguagguaugugcacaugaaugcaggugccugaagaggccacaggagggcgcugcaucucccggagcugaaguuaacaagagcacauaacaagagguuaugcgcugccugcugcuggaagccgcacaguaggcacucuuuacugcugaaccaccucuccaucccucaacauauucucuuaaugaagaaaguggccccaugagaaaaagaaccugccgucccacaggagggccuggacccaagcagagcucuugcuacauuacuguuaacaagaccaugauuuggcaaaugacagcacauucaugaggccauuuacuuaggguuccagaggcuggauaugaagguuagagucugcagagaggcagacucagugggacaagagauucccaauacgagagucuccuccucucucccuggugacagaaauggaccagagauguuuuuuuuuccaacaucagugauaggaauagcagcagaacaguauucugagaaauugugaguuucuguaguuugaguggcagggcaccaaggcccuuccauccuauggggaaggcaccacagagccccagcuuaauuugcagucaggggcccacugcuugcacugugcccacagugcaaaagaauagaacagcuucugccuuugggguuugcaucgguacaaccaaaggacagaauuugcuuuacggcuucagccccaucgaaacacagagagaacucuucaaacaugagaucgccgcauggguaaaucacucgaauccccucuucuucagcuguacccaauuuucacauuggagaaagcaaggacacccugugaugagugacgucugaugucaaaucccagcuuuccagcaagauccaggggcuacacugggcagaauuugacugugucucugaccucacuuucuccgcuaggacucccacaaaguuuuuuuuuuaaaggcugucacuggaggcugcugagcacccuuc

SEQ ID NO: 2240 - RNA, 1278 nt, Mus musculus
guguguguguguguguguguguguguguguguguagugaugcugugcugugguguauaccugaagguuagaggauaauucuggaaagccuguucucucuuucccccagguuccagguauugaacucaugucaucaggcuugguggcaaaugccuuuauccccugagccaucucacuggccccuauaauuuguauuucucguggguacauugguuaugauuguacugcuguucugacugcccugucuaaagguggcgcucaagggugguggugugcacagugccgucuggagagcuugguaaauauaaagaaugcugugugcacuuacccacuggauucucauucuguagaugugaauguggccuucuccccacaguccaguaauucuagugcaugcugcgaaguuuaagagccaucucucuaggcgucccguaacaggguagaacaguuguuuuccagugugaccugcauagucagccacucuuacugaaacccaaggguugauugagccagccuuaccuggcaccagagaaucuguguuuccaccuuguucccagggauaaagcuacagauguagcucaguggguagagugcucaccuagaaaacaugaagccauagucucagucuucaguacccaggagauaaaggcaggaagauugaacauucaaggucaucucugguauacagggucaggcaccauaguuugaugggaagagcuauaccagcagugcuuaaccagugcugauuuuuuuuuuuuuuuuuuuuuuuuuuuuuuugccccaaccuggcaaaaucaaggacauuuccagcaacuacagguagaaucuggaagugccacuggcaucucauagcaacacaccccacugugcaaggcagaaugaacucaucaaaaauugccuauauuugagauggggaaguccuuauguggaaaaggcauugauaagcuggccagccuccgaaagggagccgggcuggucagcacagacuuuugggaucacugagaugcagcccauuagcccauaguauguuucacacugaggucugauaaccacugaggccacacccuucuccugacaccuccuguccuucgguuucauuguuucucuguagcccaugcugcuggccaaaugcauguccuguguccgugucuuauguauguuccgugucccguauuagaauguagaugccagacuucuguuuguuugugucaucuccucccuauggacagcuccuagacucacaauucucaaccuauggguugagacuaccccccccuca

SEQ ID NO: 2241 - RNA, 2614 nt, Mus musculus
uacaugaagccuugugaucggcgggucaucuauuuagggguccggugaugaaaaagugucuuuuuacguccggggugaucaugcaauuggacaggaaaggaucucaaugaaucaagcuauaggugcagaccagauuuacgucaguggugaccaaacauacaugcuucuucaggggaaaguuguacauucuugcuggaggccaagagcaggguagagugguaauucuggccacuuguuuggcgucuguggauagaaccgugccuucagaacguacugagucagcuuccgguuacaauucugguccuaugaggaaagagaauggcuuccuaacugcucauuuacuuugacaaugaacccugagaugggcagguaagcaguaucguucccagcccaaauaagacaguauaugcuuccuggggccagggacaaagcuuuagcuugccuccaucucuccccccccccuuccuugcucccucccucccuuccuccauccaucuauuccucccuucaugcagccuccccccucccucccuucuuccauccauccaucuauccuuccauccauccauccaucuaucccucccucccuccuuuccucccucccuccauccccccucccucccuccaucucuuccuccauccuuaucauaauuacauuucaugaggccaaacuaaggugauggaagaugccuagcaucguauucauucagaagccaucucccucaccgucuagggagaacacucagcaaggugcacaugagcacauguguccgaccaccgcaggcuuuguucugaagccugccucagucauccuguucagaaugaaagggaacaaacugagccuggcuuacugcaggagaggagccacagccagggccgcacacagcaccaggcaggacuccuucagcuccaaggcagagcuucuccuuuaauguaaugcggugcucugguauuaaucagcacugggggccugcugugaggcugcagcugcccuuuagaaggccccgaccauuuuaguauuuucuagaacaauguagagaccuucugcugggugggggguggagguggggagagaucuucucauuugcuuucagaauaaggauaauuaguaccaauugcaacucacagcuacaggauuccgacaccuuuuucuuggcguauuacuuaggguuucugcaaauucaccgaugggcucugagacucgcagcauaauuauggcuccucugcauucaccuucgcuggggaaggugccguuaaaauauggagucaucaaagccuuguauaaggaugaauuaugugacucguauuacugagugcagggaugauaaggcucgguggccaauagccaugaguuggacaagaaccgugguaggggaaggaauuggagaaaagccauugacacaggauggucaccuacuguacagaggguugguggaucacaaaauccuccuaaggauaucuugauggucagccaccacuagccucuguguccuagauccuuggucagugcucaaaucccucugcuccacugacccacccuagagaguaguagagcacccuccguucaucuauauuaguucucagugcuguaagcaaaaugccugaccaacgcaauguaaggaaggguuaugcuggcucuugguuuagagguacaguuccaccguggucgggaaaacguagcaacugaagcgcuagagcuguggugucaggagcuugagucgggucacacagucagucucucaggaggaggagagagcugaauccugacccucgucuuacucucucuuuauucagcccacgcacccgccacagccccugugauggugcugaacucagguaggggcuuggauuaaacccuucuggaaauguccucgcaacacaaccagagacgcaaggcaccucuacccucuguggcuuucacgacgccagaccaggucaggauccuaccuuccuacucuggcuuucucgccacagacacguaaaugccgcagaaccucucccaucccggcaaucuguuaggggaacccacucagucuuucucugcuggccacaucuuuuccuccgcacggagugagagggaccuccuucauaaagggcccaguggaguucaguggugcaaggcuauacugaucagaaucacgcagacagcccucucccucccccacuuccuggcuuggucagagguaggcuugauuggacaggcucauuucuagcucugaucaagggaggcgaggaacgacagaauacuuacuguagcgguuugaaugaggaauguuccccacggguccaugcauuugaauacucccuccucagcugugguccaguuugcggagguuuagcaggugcagccuugcuggagggaguuugacugcucacgccgccacugggcaggugcugggcuuuagggaagcauugagacagcacuccaggggugggaaaaugcagucagagaugugggaaagccgcugcuggagaacggaaggagugaacgaaguguugggaguucacaggcccuugacgaggcuaggacccggugcucccaaauuccuggaccuucaggcacugcugagucuccgaggagucgagagcagaguugggagccuguaggcugagg

SEQ ID NO: 2242 - RNA, 105607 nt, Mus musculus
auucacaaucgcucagcacuuuuauuguucacugucuucacauggcagaauacugaaucuucuucacugggacggaaauccgcuagcuugggaagaccgccacugaccaggaaacaccucgucugacaaaacuuucucuuuguuuuccugacaaucugggaaguguugaagggugacccagcacaguuugcacaugcaaagagagggagggagggagggagggagggagggagagagagagagagagagagagagagagagagagagagagagagagagagagagagagagagagaaucccccacgagcccagcaacauuuuccaaguuugacugaaagcaguuugcuaaggcuuuggguucgugcgguuuuucccggcugcagggcguggcugggauacagugcacgcgaccagcuguaggacagacugugucagugggguuggcgacagccaugaguccaugcuuucgaggacuaacugcagggugcguagaaggagaaaauuccaguugaagaaauaaaagaggggcacgccagagucuggcuggguggguaaaucggaaaacugugacacuggacguugauggauguuuuccugcccaugugagggucuccagggacccuuuuuccuggaccagucaguccccuuacugcagccagucaacugauuaauuaaauaacacauguuauaaaacuuuaaaaauggggcauuuacagcaggguccauaaauacgugcuuuuaaaagugucuacauacauaucuacagaguugcaauaucaaccauaguagcccugaaaaagacagccccucucuugugugacaacucucccaaguucuguccucccacuuugacagguagggaccagaucggagcugaggaaacauuaccaaaaucgucucaggcauccuccgccccaaaggcacaaaacccaaggaccucagugagcaagguccguguuucugccgggcuccaacuguccaccacagcagaggucagaggucagcccugcccuccccuggcaagcgguuuuauggcaucugaaaaucacccguucaaauccuccugguuuuuguuuguuugaacccauccauauacuuuuuauuucccuuuuuauuauuuuuuuuccuuugcuucacuuugcagcuaacuugcaagggucagaugcuaaugguguagugggucccaccaugggagacaaagaagggcacaggagagucacaucuccaccccagcgucccuagacacugcuucuacuaaaugagagaccaggucugagaacggccgcggaggcugcauccugagcgcgugggcuccgggguucccaguggagacuucagagcaguggacuccugaaccucaaaggaggaaaugacuugaaagcuggcagcuccaguugcuuagggagaaaagggggugggguuuccuagugcuagggccaaggcucaggcucagcccugauggaucuauaugcuauuugcuauugauucccagagacagugugaggaaaaggucggugggggcgguggggagggguggcaugaggggcagcuugaccucugaaaggucauccuuagcuaggaccccuccccaccccucggggccagaucaaagucccagcgauggcaaacgcacagcucaagaagcacgaagcagggccaaggaacucuuuuaaaaaauugcauagaaggagacgccccucccgggcaggauggcugcaccacagagcacgguucugggccauguccaaggaucauccagaggaugacaugaagguccugcuccugaggcugggaccacacacaugcaccagcacacacauacaugcacacaugcgcucuccucucucucucucucucucucucucucucucucucucucucucugauccucucucaugcucacucucucacucucacaacugggagaggucagugcucucugcagggcagacugcuggucccuuuggcuucacugauuccaggucacuucaggugcugaggagagacaaaaagaaaaugacaaugucagccaguacucgcugaacuuccgaugugaucuaugcguuacauuaagcaguuucuuaaaguaugauggacauauggauaaaagccccacuggauaucuuugaggcauauguccagcaucagaugaagaugcagaaugugaccccaacccauccugaaccaucccccucaggaugccuccccaugcacagcaucacuuuagacggcuugcccuugccugucucccugacuuccuuccuuccauccuggccuccugccucccacacucuagccgcgcacccucaccacugagcaacauccucaaugccucuuuacuuuauuuugagacacuuucacaaugugguccaaggggacuucaaacucugaaauccuccugcaucagcuuccuacgugucuggaacuauaucuugcaccaccaagccuagcucauuuuuaaaaacuuagacaacacauugggcaccuaaggcucugugcuucaguuuugcaugucugugaaguucugggcaugcaguuauagcucugucugucugaauaugcuguguuucuguccaucugaccauguggguguagcuuugucuacaugcugcucuauaauauguggaaacaugccacaucugucugucugucugucugucugucugccccacugcugacgcacaacucagauguuuccggugggucagugaugcuccuggcguggcaccacuggaacuuccugugugggucuagaagccauggaugauguaccugugccaaggugaugcuggcagaggcacugcuaagcccaaaggagccaggaggucaguuuugguggccacuaauggcugguucucccugugagccagcguuugccccuugcuucccucaacgguucacacagccucugcggcagacagcgcagacgcucaugcaucaugaaggaaacaggcucagagaggacuaacuuuuccugagaucacaggacguuuagguccuucucuccuacacgcacaugggcagcucucccucccugggcauagucaccuaugguucaccuccauccaugccagaacucagaggaccagaguucugaugcacguccuacccauccaauucccucuugaaacaggagggugcggaccugcgugcuaucaucuugagcugagauucuaugucucagauguccaaaccuuucuguaccugugucugguagguucuacaaugaauugugucucccugaaagcccugcguuguagucaaaucccucagugugaaggagcaugaccuuguagagaugauuagggcccaucaugugcggacaugguaagaaacaagauacugucuacaauccagaaagaguguccucaccagaaccgacuguagcaauccugaagguuguccucugaccucuacauacacgugugcauacacacaaugcuuuggaauauuagauuuguuauuuguuauuuccuuacguguauacgaggcacgcuggugacuacuacccucccuugaccucccuugucuccucccacccacccccccuuuucgagccccucucccacuaaguuccuuuuuagucuuccugaguuguuuugagacccauugaguguaaccagggcugucugugugauuguggguuugaaccucuccacuagagacaucuaguggagcucaccaguggguacucaacugacggcacuagcuccccauuucccagagucucccaguggccaucgcuucagcagugggaauacaagggccgugcaaccucccuuccaugguugaggguuggcaggccuggugugggcaagcauaugcacugaucucaucgcuggaccaguuguauuacacaauguuaaaagaagucucuuauugccugagucuguuugggaugccauagcaaaaauaucauccaaugggcaacaucaacacagaaugguuuggcauucuccccucuggaggccgcaaguccaccuuuacacauacggaaguugagacuuggagaaauugacuuguagcccuacagccaguaaauggugaagcuaggguuugaacccuggugguccagaaucuucuugcuaagcuauaaaacucaugccugcagaaggccccgugcuagccuggagggugcuugacacaccaucucucccgcuuacucacucacccaagauguaccuggaccccacccucggacccaagagccaggagauggugccagggcgccucugucuccuaccuguuaaggagcagacaaagugccuacucuuugaagaagggucccuggaacugaguugcugcugcagccuugaccuuucugcauugucuggugauauaaggggcuguugaugaggcgcaucgcgaugccaggcggaggcuguagcuguauggaaagaagagcgcaggucaucagcagcaaccaguuugggccucuggcaucacugaaggggcggggauaucuuugccgcccauaucucccaggcccacgcaagguggcacuuccugcauguucgugccacguaccuggaggggugacagaacuuccuaauggaaaugucaguccagggcccuuuguguuuuacuuuuaaagaaguguuggaagagagaugaucccacccacuucuuuuggcacacagacugcuugugcccagcugggcucccaccuccucugggaaggcugcccucuuugccuccugugagugcaccccacgccucauccccacucuggcuccccauuuccgucucuggcaucccaaacugcuauugugggacacaggagcugcucuccuccuggggcacuaagagcucaaggucauggcuccuuagcugcugcugcaccauuggcuuagcaugacaagagccagaauggcuguaugugccuguaaccccagcagcccaggaggcugaggcaggagaauggugagauuggagcuagccugacucauacuauugacugugcuucauauagaccagcucucuucuucauacaagcgacugacucagacucauauuauccugaauugacagaagggaaaauggaggcacaaagagcccaggagccaucaucaugggaagcagcauuauuuaaccagggcaugugcuugucagugucugguaguauuuggguugucacacuggaggugugugugugugugugugugugugugugugugugugugucuguuacacacacauacauacacauacugcauauguuaagcaaugcucaggaaguuaugaaacaccccacuaugcacaaggcagcaaacagcuauacagccagagucuaacacaguagcacccgccccuuagcaacaagggaucuucuccaggacacuccauccccagugggcgcuugaaacuacugagcccaguacugaaacaguccugagcucaguacacagcaugguuacacauacaagcuguaguaaaguuugacuuagaaaucaaaugaagccaggccugguggcucaugcuuguaaccccagcacauagaagcugaggcaggaggaucacaugaguuuggggucaaccugugcaacagauuccuaucagccuaggcuagaauaagaucgcugaauguucuuuuucucuuaauaucucaccgcacguucagcuucccucugagaagccuugacagcuacucucuggcaucugauaccacccuuccuugugaaucuacccaacauucaaaaucagccccuagacacagaagucuuugcaggccccaccuuccucucuaggcggccccucuucuccaggaggcagcaaacacagacauuuccacaagggggcgcacccucucccccgcccaggguuucuguccuaguguuucccagcaaccugcaggaacggcccauucugucauuaccccugggcaucuuuggcaggaagggaagacaauuucagccacacucccaaggccucugugaauuccacauccuuucucucuggauccuccaccccagcagucaaaaagagcaaaugauucuauguucauuucacagauaagaaaauggagacaugacucaaggacaggggcuuauucuuggggguggcagagcccaggucuugcgcucccugacugugguggacaccaggucaccaccuaggugacugucaugaagucugggguuaagacucaacugugagauagacuccuuccugccuugggagguugagugcccacagcaacucuggaccgaguugguccccuguuuaaccuaaggauuauaugaguuccugagccccacugcaggugaugaccaccucaagauccuggagguaagcuuggggggcugaggucugaaccuagggcugaccccaagccugacauuucucagcuaagucucccagaggggacaucaccuggacauuugggaaaccccuugaguucagauccugaccucaacuugugacacacaucaucucuuucuuggugacugguacucucuugacauccugaaagccagacccacgggggucuuccuguccccuccucggcugcuguuggaggcuaucugguucaccuuccucccucagucccccaccguggacaccucucuccagguuuccugccauguuccuuccucauggggcuuuuccuggccacacgggccucccuccagucuguucugcagaucugugaucuuucccccaaagggcacacuagaccacgacaccccuucaccgcaccucucccucccaccacccucaggacaagccuacuuuuuuucuaaggauguacaggauccagcucuucugaccuccuagccuaccucagucgguucagggcucacugcuucagcuaacccggccggaggguuugguagaagcuggguuuggacagcuaagaaacagagccauguuuuuaagaguuccuuucaagcaucugacuucccugagauugaagcuguguugggggaugggagggcuuucucugugcuucacacgcacuggcucugcgcaaggggggugcaccacccguagcuugcacaagguaccuuccagaagcugcacuucaggaaacaaaguccauaggccgcacacgccaugcagccuaccccagucuguacggacagacggcacagugcagagcgccuuacccacaccuggcacuuaggcaaggcucggaaaaggugagcaggcaggacacaaccauucgaccgggcagccauuucuacuuccugugugugcacucugccaggcuguucagucuaucaggacucucucccucucaagacuccccuuccuuccucuggaucuucacucagaugcuucccuguuaaagccuguauccgaccccuccgggaagaucuaucggugauuaauagcugccggaggacauggagacaugcuauacggugguguagccacugucgaggugacagugaucccguacauaguccucgcccauacuccuaucagcaacucuaaugacucccaaugaaugggucacagaagggaggggggagggggaaaaagaaggagggggaacgaggggggaggggaggaggaggagaagaaaagacgacagcuaguugggaagagaaaggggaccagugagagucagaaagggagaggagaggacaaugggagacaaacaugacuaaauuacacuauauauauguaucaaaacaucaucaugaaaccuauuauuaugcaauugugcauagcuaauaugugcaaauaacucccaccacccccagcauccaggcuucugcccuauggccuauagaggaacagcucuguguccaagggagcuggguucuagggcucaggccucaggcugccaaagggcuauguucccuuuucagcucccaggaauccgugugaaaggaacccagguaagacgguuuguacaggagaaaugggaggaaguucagaagagugaguguagggggagauggggauggagggaagugauacaggggcacagaggagcagccaggagcagccaagucucaggcuaucagcaacacaugguccccgagggaguuagucugcuuguuuguccuggugacagagccccagugguuaccaccaagccuuggggagcaagggaaaagguuaggucacaacaccugagcuuucucggggacagggaaccugagaccaaggugaaauaaagccauagcaagaacuacaaagacaacaacaacaaacaaaacccucagaagggggcuggguguggcccgguuggcagcuugcuggcagcuauggguucaaaucuaccagcacauaaaacccaacguucuggugcuggggaggcaaugagaaagccaaagucauccuaagcuacagcaggaguucgaggccaccuugggcuacaugaaacccuaucccaaaauaaauuaaguagaagauagguaacucuaucaagaagucguuuuaauaaacgacuuaaaauuggcaaaagauaccaagucacugaacaaauuucaaauauaaacacugcuaaguggcagagcaaaagaacagcacauaccaucaccuucaaaagccagaacgaagcggccuuugcaugcgaggagacacggcaaacccaagaacaaaccccagcuuccaccagaggucccgccacaacuccugaagucugcccacggcaccccucuugaagccacauucccagaccugaugcagacacagaucgcuguccagcacagcaaggggaccggaagcacagcacacacagggugucagagccuggcucccugggcucaugugugcuagacauagccacaaggcaaacgggcacccaggacuccucagcccauaaugguuaagugaucgcuauguacagaaaugaaggcaggagagaguccgagaccaugcagagggaaggcaagggccgcaaagucagaggacggcugugugugagcugccaaauguggaucucaaaacacuugguucuuacagaugcuugggcagaggcgugucuaaaacaccagagagguggaggggaggggaggagaggggaagggagggaaggggagaggaggaucuuguaggcccugggugaaaugagagcuugcuugucccugaugggacaacuguggguuuccagggccagaacugagaagaccagccaccaggcacuugaugccauccaggaaaaagugaugggggcagagggcuggccuucgugaacuccuggaggcugagcagugaaaagccccagcuuuacacaaacugggaucaugguaggagaagggcagguaacgacaggguuggacaugggugugugaagagaacaugcaguuuagcuuagcuccaaagcaggaugaguuuguccugcugcuguggggaagggacuccagggagagccaggccaguuaggagcagagccaccacacauuuagucucucagaggccaguguuaaccuugggagcugugauucccacaacugauggacacaaauguucaacagugacuucaagagaaggccgagaggaaagcacguguaggcagacacuaggucaugggagcaaagugaggaccuuggagagagcaggugacguaaagggacaggagcucuccaaggcaugaggguggcugcugggucucucuaccuggcuuucaccuggcuccucucucucucucucucucucucucucucucucucucucucucucucucucucucucucucuggcacagaugacauugggccucacacugaugccuuaccuaucucuauaaauuuguggcucaguucacugacuggcaaucaguucuggagcggagguggaggggaaggccaaaggcguggaagcuggugucaagggaagacaagccugaaaccucugcugaaauccucuguguacugagugaagaagccaccagacaccuccagcaaugccggucaccuggcauuucccauuaugggcaccugggugauccaggaggccccucucauucagagccuagcucugccucugacuugccuuggggccuccacaagauuccucaaccucucugagccacaggagacucuccugcaaaguaaguaccucaagaagaggugguggcaucgggcgugguggcgcacgcuuuuaaucccagcacuugggaggcagaagcaggcguauuucugaauucgaggccagccuggucuacaaagugagcuccaggacagccagggcuauacagagaaacccugucucaaaaaaaaaaaaaaaaaaaaaaaagaagugguagcaugacagcguuugugaccugaacacugggggucgggggagggugcuauuuuggguccuuugcaggaguucuuugaaucaccuccccugugaggcagggcgccaugauccugucuuauuggaggggaaagaagagguucaaaggaguggaggcaccagcuagcaaaguucacagggaagcagucacgauacgaauccagaaccgugugcucccaagccuauuugcaccccugacauaggcccagcagcaguagcgaugaaggguucuucaguguggggcuccucugcccuagaucugcugacagaccucaaggagcaugcuuggucugcuuugaguugucccuuuccaggcucagaggaagcugggaacagaggcuuucuaacucagaugcccugguaaugcagaaaacacccaagauagggcucagagccucagauauuuggacuuggcuccccccuccccccaauagcucagcacugggcaugagagcaggcuugaagaguuggugagcucuguacuucugcucaaaaugagguccacggaugggcagcacaguaaccauguaggugggaccuacagacgcucagaaccaacagaaaucuuagaagaaacugacgggggugggguugggggugauaugcugaagcugcgaggaccugcagcugaggacagguagguagagccagauguacaaauauuuucugaucuggguuggggcugguguccagcagcuguaaacaagucccucuaauaaugcaggaguggggaagaaaaggcagguggucccagagggccagaaaaacgcuggcccuccuggguggcccgauggcucagcagguuaaaaugcuugaauagcuuaaugggauugcugggauuuacacaaaaaccccagaaguaguggugcauaucugcaaucccagcacuccuacagggggaggagacaggagacucacuagcaaggcaacuagacacuguuguggaaauaagagcaaucuugucucaaaaugaaguggaaugcaccaugaaaugaguacaucuacacaaacacacacacaaauuuuucaaaaaaaaaagcagaaagaaaaaauucuugggccuggaugguucugagucuuaugauacuggggcaagcugcaguugacaugggcagucggcaagcacagccuaggcgccugcuuuuggggucucuuuuaguuucgucuccucuuuaacacuguaagacgcccguacccuuuugauggaggaggguuucuguuccuuuccaacaggcccacaaggaccuggccucuuucucaccuaaaaggucuuaucuauugggcucuguccuguuggggcuucuaggucaaaccuguuuggucugagcaccacuacuggcguuuuaaugucuaguguguagcaagcuccuaacacuugacccaguuaacaggaaggcuggcaggccagccaggccugaggaccucagccaaggaaguugccaguggggaaaucccugugcggacgccucccuuccagcaagcagaggaagaggccagcagugcagugugguaaggaagcugccacuggcuucuguuucaccagggcaagagcugguggaguguagggagcccuaggaacacagaaggaagcuugggagucgggagucuuaacuggauagacucuccuuucccuuccagcugaaccaaaacaaccaacugcaaaaacgccaaaggacagcuuguaucuguccauuuccuaccuauggggccaucacugcugggggcacaaaggggcgcccagaacgcgcauccuaaacaauaaggaacaaauccacauccgagcucuccaacaugcaggucccuacucccaagagucaaauucuccaagcacuugcaucccagagggguucacucacugccagaguccugcccagaacaugggucaaggugucuguuuugaacaacucugugaacacaucugaagauucagaccucucccacagaccccacccccaucccaccuagugcugccucuuacauuucagggacaucaucucugcaggaacccugcuaccgcuugagccagcacaggaaugaucccccugacuuucuccucucuacaucuacuuccagguucuuuuuuuuccuccaguugagugaaaacacaccauuugcaauaaagcugagaagagaaauaaauacacgugccaggaaugcugacugccagaaaauuaagacaaccaguguggaaaaccuaaagagggaugcucuucccuggacgguacaugggauuguucuugucagugacaacguccuuuggagaugcugaaaacaucauuaggaccugucuuuuaaagaugagcuuagccaaagaugucaaaagaggugaguuccagggccaagcagggcucaaccuucaugggguuugcuauugguaggcuucaugugaugucaguggugaagaugguuuauccuaagaacaagcccagagguaggugugcagcucacgaaggccuuacugcccccaccuccgugaagccugguguuccuggcuggcagugagucccagacacacggcuggcacugucacuggaaaggcaugcuuaccaugugaacgcauggcauuagucaaugagaauggagcugccaaaagagcagggauaucgugggaugggggccaggucccgccuucgcuucugugccuucccccaaaguccucacccugucuggcgccaaccucaacaguuuaaccugcucuacaaacuggaggagacaguguggccucaggucaccugucccacccugggcugcuucuccagcucacuggguggaggccuucuagaaaggcuccuccuggcuggggacagacaaccuggcccagcuacaugcugcuucuaacuuggggaauacacaggcuugcagccacauguaggcagguauagaauggcauucucuccauuucuucccuuaccugcccuugcuaacggcaugcugggggccuuguuccuggagauuuauucaccaagaacugugagauggguaugccagcauuucacacaggguaagcaccuugcccaaacccagacaccuggcuugaagaaccaggguugaacucaagcaguauagauucgaaaggauaggaggcagcucauuacugacccaacuucuuucccccauuuaucuaacuuguuggcacuaugugauguagccuugagccaggcucaaacacugcauacccgggaaggcagagaaggauguucuccaaggagacggauuugcucagggaccuaugcuaagccucaagaagaccaauguauaguuuaguuuugugugcucaugugcaugucaaagacagaggacagccucagguguuguucgccuuauuuuuaaagacaggaucucuccuuggccuggaagucaccaaggagucuuggcuaucuggccagggagcucuaagaagcuacccaucucugccuccucuggacuaggacauaacugaaucacacuagcuuucgggaacaauguuuucauuaaugacuacugggaagcaaacacuggcucagugguggucaagauuuacagaggcaccaagcuguaaccauuggguacaguaugcuggggugacacuaaaggcaaaugagcucaacugugucauucaguccauagcuggugucauagcaaaaagucagaguguuucuggggccuccccaccuugccagcuccugugcuucaacacuuuaggcaacagugagcauucgacacacucagugacugagaccaguuuucuucaucugcagccaucacccuuugauucugccaguugcuuuauuacagcaauucugacucaugggcgugauggagaaaucacuaaggugagugacauuaggcuguggaacaaggcuuuagagacauguucaaacacagcucagccaaguggguacagcacugugcaaaucagccaacguagauaucaacagggggcuuccuuauucuggguuuaaaacaaacaaaaaaaaaaaaucagaagacacaagagcagugucugcaauguauucuggguggcaauacuggaaaggguacccacagaugccaagugucaggacuaaaguaggagaugauccuauuugcagcucccaaacuuggaugaacauaauggaaaaccuuguaagccuauguggcuagcucaacucccuacguucagguggcuuggcugaggucacaacuuuccuguaaggcuucagguggacuguggagacagcagccaaauguacccgucucugaaugaaugaaugaaugaaugaauggugcuacgcuguucugccagcacaugcagccucugcagauuguggaucagcugucauguuuuucaaguaugaacauguguaaguacacaugaaagccagaagacaaacuugagggucauucuuagaaguguucuccauguccugugaaauagguaauucucaauggcuucuagcuugccaguuaggcuagacugaaaggccacccaccggguugaaauguaccuguuucugccucccuguaggagggucuggggauugaacucaggcacuugugcuuacaaagcaaguucuuuacccacucugcuaccucccccagaccacaccaugaggguuacagucugggguacaaacccuuagugggguuggucaucaccuggcucuacaaaguagcccuucucucucaguagauucuaauugaucauugcaacagcuccaauagucacauuuuaaccgaaacuuaguggaguuaguuuccuuagggggucuuugaaguggaguagcuuucuuuucuuucuguuaucucaccagcugcguuucuguauagcugucagggcuguggcaggugcugggauagacacaugggauaggcgggugcuacaccaagcugacccaaguaaugauucaaguuccuauuuccuucucaggaaacugcaaaaggacagacaagccagagaacccucaguucugacuuuaggacagcccuggacuuuaacacugucccugacuugccagucacuagaggguuauaaagacgaagagaaaacaugcaugaaagagccugacaacugaacucuauaccagggagagacgguaaaagcaagaggaauacagaauuagaacaugaaggaaaguaccugaagaguaauauauaucuuuuaagauggaaaggaauccguagucuggucacaacucauuugggaagccgauuucaaagucucggggguuaugguuuagcauaucuagaaccuuccauaagcuucccggggcucugggucagacacagaaugguaccauucaacacuccagcaaaacauuccccucaccuaagcaggucacuuagagcucggaaugucaccccagugagacgguggcucccagugccacuaaugggcuuuugagaauacacaugcuuaaggacagcaacagaagugauuuugcacagcaguuacuuugauccccacgacugggcucaaccugaccaccacuggagacaagcagcagcagggguuucuucagcagccccuucccuccaaaaguccuucagugaccaucgccacgagacugcucaaagcacuuccaauccacuucacauggagacaguuccugaaugucaccuggcagguacucagcgacaccacccaagauuacguuacuuugguacuugacaccaaguggguguugacagccgcuaccaggccuucccaggagccugugucaccuuuauuaacacucgaggccaccacgaguggaggccuuguccuuacugacagaaccaagggaaucuuagucguucagcuggaaccagcuccaacuccucucuacugaaacaaaaccgagcuccagacagugauguaugugucaagcuuagagcuauagaaaugauuuuaauacaacuguggcucagcacagcagcuucaucagacuuuuggggugugggguccccuuacaguaguguggaacaggauccaagugcugucaccucucccucuggguugccuguacugagaaucuacuucccccagaucccaggagaacagagagugagguuccauuauacacuuuauacaaggaaacacacuggcuacuuuugcucaacaggauuagugcauuccaggcaucaucucuaagcccaggggcacagggaugcucuccggcuccagaguaagauauagaauauagccaaauaccuggugauccacgccauguucucugacuggcaggagcuagaggccagacugaacacauccagucaguaaaugaaaacagaagccaucugaaaugccacugcuuccuagcugcgcuggcaguggcuggcccugguuauaagugagaagaggaugcuacgaccacaaaacuaaauccaagaggcuuacaugacuuuaccccagcaaggaauacugaaauaucucucagcagaaaacagcucugaaaacaauacagggauuauacccgaagguugacauacauucuugcugcucaugucugcugcaaauucuacgucuccaugacaagaauccgguuuaaaauuuacauuuagauugaugccgacucaauacauuauuaaaguagaacuccaguagauacagucaaugucuaaauacugacaggagaucccugcucggaacauaaacguacgcuucagagucccagacucuguggcucccuaccuaaaugacauuacaggucuugcuccguucgucuguccaacaccccaaagagcacuuaucacaagauccccagagaagcgguuucuuuagcaagcuuucggcucugcuuuguuggcuaaugucuucuuuaagauguuuaugucccuugugacaucugccuggauuucuuaucacuuuccuucagaggcuuucgaaggacaccaagccagcacaagugaggcagaaaacacaaguauuuucaagaccuucauggcucaaaauugaaugacuuuuggaaucacuuuaaguacucuaaugcagucacauaagcgugaccccaccccaucucuaguucucaagauuagugagaaaguaagugaagcuuacagagacccuuaaggcccuaacacucuuguuacaauacaggggagggaaaggcugguuuaguucccagcacaugacagcucacaacuguucgaagcacaggcaggcaugcacugcacauacauaaacacagguaaaacccucacaagacaaacuucaaaugaccuuuaaacauacuauaggcagaucugaguuugcacuaggagcaguuucuggggugggaggcggcucuacuggccuuccuuugggguuaacacacagcugacuaucaucuucgggcugacuucuuaagaaucacugucaaaugcaaaaggugugaugcuaacagacuugauuauaugcgaaugcacuugguuccuguugcagucaacuguugaugaagcaaaggguucccccugagaaggacaguguggugacagaccaccuagucugaagggaggacaggaggacaagggagguggggcagaacugccaccuagggcagucccucagccauaguguuccuuuaagaugacccaaggggauggcuccuagagcaacccuaauacuucuggaaaagggacgggguacagggaauggagcaccauugaguaagaaaugagcaguggccccaaggcacaacugagacuacaguuuacagcagcugaugccuucccuaaucacacagucacaaaccccagguuuuguccuauucauuauuccccuguaugacacggacugcuucuuaaacgggaucuuaaugcaacaaagaugucaucuucacccucaaucuggaucuauuauuugauacugcacagcacuguucacuuaagguccuggcagguagaccuaagucugaggaggcugugguuguccacgcuccccuaggcucugcacacacacccuagcccugugccaccaaagcauguacacccccacccccacccccgguucagaauccagaguucaagaaugacuccugcagagcucuggcucuccagacauguccugcaggauggccacgaggcaccaggagguucuagagcccagauccccaaggacugagcuacacacucaacucguguguguguguguguguguguguguguguguuggcugagggacagcucuucaagugaacugcagaagccccaggcuaggccagaaggaaugugguucucucauaauggccugcccacacauucuagcagaaaugucacugagcaugcgauaguggggcaucagggaacaaaggcuaaaggccuuucucugcaucuggaaagccaacagagaagacucuucuuggucaucaggcaaguccugagggcaccugaaagguggccugcauauucacaggacccucuucaucuagcgagguucuaauccauuuucaaaguaaacugccugcccucuauaaaguuucuuauggacaucagucaagucaaagugaagcucaauauccaaaugccgcaaguguaaaaugagcuucgaugucaguaagcauuuugacccaaguaugaacaucugcauuucugggacagcaacacucaaacauaaaaguugguuacaucuuuccugucacucgguuuugggacaauacuccaaauacuaagaauuuaguugacauuuaauuaagaggaacggccacuaggaaaaacacaggcucacagcaguuuugcuuguuuuuccgagacagggucuuaccauguacucuuucuagucucaaacacagaggucugucgucuccccacccccaccccgccuacggaaugcugggguugaugaugugcaucauggaccuuccuggggcaaucugaacucaucacuggaaaugacaugaggagccuucaaacagugaaagggacagaaggcuccaaucacugagcuuucuaauguuuagaaaauauuucauucugcauaaaggguaagagcucuggaacggagcggcuccuccagacggacauggauggcauaguuucuggggaacuauuccaauuuggcaaaugcgugugaggauccagcgccugucagagcgagggaugccauggagacagggagaagaagcacacccugcucuguacuagugugggugggaccgcaugcagacccaacagcgauccacucuuugcuuucugcguacuggaaacguaaagaucuagaaaacagcacucacccaaggcuaacccagcauacaccaggaaagcacgagggugccacgaguggaugcuaagcaggcagguggaaggggcgcugcuucucuuucucggaugaccucccagaucuggcuuccuggcggggcacugcaacgcaccugcaugcaucuagguacaaugccacaagaacuacugcugaagacauucccaauuuccauuacccuccccuccuccucaccggguuuccuggaaccucguagguagccuugugacuaucuggacacauugucaggccugcaguccccucccuagaggaaggucagacagugggcucucggaugagagaugagugucaagacuacaggaaaugccuccuagccacacaugaaaacaguccuuggaagaaaguuaacacaagcguccuugauuccugucagucugcaaacuaaacugcaggcagcacagaagcagcugagaucugagguuaacaacucccccaguccucuguacucuuucacacuccacaagguacuucuugauccagcuaaguaucuaccaucaaagaggaagcaacuacaauuagcaaaacuugguugaugccacgcagacacagguggagagaggucccaggucaacggcugacuacccgucuacauaccaaacaagguccaaguggccuguuuccccuuuauggacaaaaugcaguccuuucacaaguguuuacaaaguguuuauucguuacaaugauauagauuguaucauccaagucuccccuaguuaucagguauuuuaaauaacaugaaaaaagagcuuucuuagacaucugacaaacagaggauguguccaugcuaacagggcaaaguagcaaacaucacucuugugugucuguaauaaaaacucugucaaggcuacauugguuaaaaacaaugaacaaucccuuuuguaugucaaauuauaaauuuuaauguuuucauuagaauaaucuuuauagcacuuugcgacaagaagcaauaaaauaacuaacagcaaacuucaguacagcagacaccuuccggauuaacaaugcaaacacaaauguaagcucuaaaucacagaauacaauugaagcacccaaaacaauuuaaauaauuuuaaauauuuuauuuuuaaacugcuacaaaugcuuuauacaguauuccaacauaaagucuccugaacagaaagguaacaaaaugggaaugguagugaaagguuaaaguggcacaaauucaucacacaaguauucaacuacaaaguguaagagguagauuacuuuuaagguugaguacaaaacacaguaugaauaaaauguagccguuuuccaccaccucggucauuacucugggggaagcaucagcacucauggagaaguggugcugacccgcuacaaaaggaagaggcugaucuguugcuuugaaucuacugagacaagaguaaggccuggugugcagauaacaaacagcuauacaggccuggaugcuuuccgugcacugauacacugcuacacagcaucucguaauauaacagcuauaaauuagugccagacagugagaggguaacguccaguuggacacacaaacacuaacagaggcaugagaaggaguccuauccaaucugggauccucugcauuacgcuggcaaucugcuuaugauuuuuuuuuuuuaaaggggagagggauagggaucaacuaaaugccucucuguauaauucacaugaaagaaggcaucgagggcugguguaacgcaagcguuuugaggugggcacacccgaucugucaucccugaaacuaggaccacucauaaaacaagggcacuugcuuugcaagguucaguucaauugcucucuuagcugcucucugccagacucaagggccacacucagagcugagcugccaguccggugaugaggaagagccaguccaucuagcccaucuuauggcacccuucucuuuggauuucaauccccugagagcccagcacacacgugagcuccaccaaagagacggaugccugacacuaaccagggcaagaagccugucgguaagcagcuguauguuacagcuuuugagucagcuucaacuggucuugcaagcuggguagauuucguauccuuugccguagugcuuauccuaaguugagcaugcaauaucuuuuagucaguuaagguuuguuuugugggggggacuuuucuacaggaaguuccuagaaaauaagaaaacugaagauaaaugacaacauacacaaccuuguaugaacugaccaauuaaagaaaaaggugaggagacuguacgacaaaugucaccaagacagaaacacauaaacaacucuaauaguuagaaacuccacuccugcucccaagacacagggcaguuucccacgcacaguaugcaguggggguaggggcaccuggugguggcagugaagaaccugucuuggacuugcuucuucucuaacuucuggacacagggguagugggcaucaugaaaaauggaaacguugcuuggauagaacagcucucuuuggauuacagggaagaacauggaagagucugcucuucucucuagaaaggaaccaagccaaaggcaauagcaggaagguccaggcagacugggacagacucagggagaggcucaccggcuuuucugauggcucuuuauccuggaaugguaaaccagcuggugcuucaggaagugaccaaccggcaaccuguggagccugugcucaaugcuguucuggcuacagcuauguccuugaaaaucugcagaacccuaugcuggcuuucaagugucaagugucugauacuggacaugacuuauaaccauaguuugcugcaaucaacaggcagggaaggaacaagcuauguguucuacagagcugaggacagaacauggaagcuccaggcaugacagcuccuuccauuagucuccuuuaagccaacugagacaaccaccggagcugaggaccucugucaguaaacacuccucccuagucagcacaaaacacacaagcacugaaaaugagcucaggcuagucuguagcagcccugaguuagaggacccugguguguggaugcuaguagccaggaauccuacuguugccuauauguuugcuagggguacuaaugacugaaauacacucugcagaaauaaauacccacucucaugucuagauagucaaacacgauguucaauuggacauuugguuuuuaauuguccaaaacaacucacaaggucauaaucucuuggaaaguuaucuuggaugaugucucucauucugcagaucugucuaaaacacagggcaguaacucgccaaggaaaaggauuagucacuaggaacaacucagugucuguaacugagcacacuauucaugauuucguuaucuguagcuuuaaguggugcuuuuuaagccaacuuuuaacuccagcaauauaauucuguuaacuaucaaaauaguuuaaaauccacuggagcaagagaagagacauguuuugggacacauuuagccuuagggagucuuuaaaacaccagguaagagugaagcaagugaacuuuauacaagcacacucagcucuuacguuuucauacguuuaccccugaaaagucuacaggaucuaguacaaaacaguuaauucuuuuagaaaacacuggaagaaagcacacucuaaaucaucagucaccuacaugcuaauccaggaugguucaaaaugcuaaggugguguggaauucccuagagcagaggccaguagcagguaaggagcacuggcggcugaaagcagugcuguuccucacuacagccaacucaaccaugucgcccaagcaccuguguggcuaaauaugaccagaucgacagcaacuaacacucagaacguuucgaagugccuuccaaaagagcucaauccuucagcacuacagggaacuguugugcccaaugucuagaacuuucuuuugcuaugcuucaaggcacacagcaccaagaacuuuaccugagugacacuggaaccuugguaugcuuaggucuucucuccaaaacaagucacuccacagcugucccuaacucuguuugcuuccaauacccagaauuacagucaugacaacccagaaucaagacaggcugcauagguguccaaauauuugcagaguaaccuucugaugauggccacuaaccuguggacauuauuugggaauaagaaggaauuccaaauguauaucaacucagcuugagaagucaauauaacaggcuauccuagggccacaucacugucccugagaaccauguguauauggggagaauauggaauaaggcaguaaggucagcucagaucuaaacugagaaaccuaacauuauaggagaagcacugagccccagggccuggccugcucuucuuccccauuagaaccucaauugcuagucucucuauugcuguaggcagagggcuagaggggaauauaaggcauuuuaaagauauauggugauuuuauuuuaagcaacguggaaaaaauuuuaaauucaaacacuagcaaauggaaguauuaacauuagauauuuagacaucauuaacuaugcuuaagucacaaacuacuaaacaagagagcacugagguugcuacuggacuugucgucacccacuuaacccuaaggagcaaugcaggaccaggaaccaacacagguggccuuggaacacugcccaagauguaaauuaagagaacuucaucuuuucacacagggaacuggguucaagcuccauucagaaauuaaagaaaugguaccacuuugugagcacuaagucugaaaucauuguauuuauucaucaguacagcaucaaaguagcaaggguaugccacaagauuaugccagugccacucugcuaaaaggacagacguccuccaggccagcuacagcucuccagcaguccucaccuccccgagcucugggcuuaccucaaguccuucagcucaugccuggcacugcuguccucucuccugcuuucacucagguccgcagcagcugccagcugaaggcuucgggugauugggcccccgcuccgcucucuagauuuuacuaugaaccggucuguucuuuucuugcuggccagggcagucuugcuuuguagaacagcuuugcucuucugcaccuucacgugcaggcuucgggaugcuuugcuugagagcugaguagaaugacucuuggcaacagcuuuggauuuuuugcccucaacaugaguaaucuuagccauucuuacgggacuagaauuccucaaggaugaagagcuugcuuuuuuggacuugacugaagcugcaaacuugacauucugucuggaucugaaggaugaggagggcagcgaggcuugggcagggccuguacuccgagcucgggucuugcccaagggugccugcaugcucugcaucuugaucuccguaucugcggugcgccuccggggauugcuacuacuguuucugucacugcuggcagaugauguguggccaccuuucuuagaugaaugagaaacuuuucuuuuggaaggagaaagggguuuuuuaggacagcugaaagcagcaugcuuauucaggcugccgauguacgugaacucccugucacaguaagggcagauaugugaggacgccucggaagugucccucaggucugccuucugcuucgcagaucuguucuucugaaggaucgcuuucuguaccagcugauuuuuuuucuucaaugcauuuagcuugagcuuauuuggagacauuuugcugaguucaacauugaagcucagucucuuaggcugccccauccgucugaaggcauuuuucccagaguugucuaaaaccagcacuccauuuuugggcugcaccgucugucucagcggcacuggguuuuucuuaggaguguaccucuucuugucacuugcagaugcacacgccaagaugugcuuaugcagcucaggcauguuaucaacacucuugccacacuuugugcagcggauggcaguagugaaagucugugggauauuguggguggugaaguuuguggcuguuaccccaauccccauaggguuucgauggugguacugaaauggagguggcuuaaagcucggguaaugcugguugagaccaagucgaacaucuggcucuuucgucuuuauuccggaagccauuauuuugauggucguguaaagcucuucagaggagucauuuaacuccuccucucuagaagcuuccgcaggcucuucuggcaaacucggcauaugcuccacaugggccuugcuggggucugugaaguucuggggccucagggucccacuuucaaacucguggugugugcauaacucaucuggguggagaucacgcugaugcugcuguaaauugcauaagaaggcaaauucuuucuuacauacagaacacacaaagauauuuccgacuccaugaagcagaaaucggugcucugauagaucggucuuacccuuaaaaagcugcacacaaaacucacauuugaagggccauucuucagcauggacagacaaauguuugguuaggucuuuaauggaaagaaaaggugaugcgcacacauugcagacgaaguuucugcugaaugucucuuggacagcgcucugcccaccugcagcuggggccucuuccuugcguuucagaccuucacucucugacuccuccuguuugagaguuauugcagggagagaugcuuccagguuguccccagaggacaccacagaugacacugcugagagaggggguggugagggggaggaggaggaacaugaagaggaagagaaggaagaggaggaagaggaggaggaagaggaggaaagugucggaggaccaggggaagcagcagacaugaguggcucuacaggaggaauaggagagggagagggggacacuguuggggagagaaucggaagaggagacugagcaguggcauuugagaauggagaggggcacuguugaggagaggcaucacaagagggguuggggagagggacagucggaaggaggggaggugguggaguggcaacaguuaacacaggagggcagggcggaggggaagaaggcucuguggggaucaagagaggaggcagcugaccagaggacagggaggcugccuggagagggggugaugaagggccaacaaccucagguggagacucagcagugggggcugagcaacucgagucaguagcaaguucaggaucuggcugugugucuggugauuuacaaggacuugggcuccuggucgccucuggugugcuuucuguagguaagcuaacaccauuauauucauugagaagaaccuuuuguagcaugcaggugguugguuuuuucuucuuugcagccggcugugccaaaugguucucuuugaauuccuugccuucagaaucacaaggcuuuuuaugcacacugagauccaauacagauucccaugggacuggagucuugccugugcccucugacuucuguuugacaccgcuggauaaauccaacggcuguugguugcacacgcugcugaaaguagaacuggcugcccauucuuuugauauuuuguauucaucaaaacaaggagggcuuccaguuucucucucaucucucccagacaaacuccacgcuggugagucacuacgacuuucuaacuucgguuucuuggaagucagagcugugucuguccaugcugcuuucccaucacucuguuucccaaagucucgaagggcagggcugugcuguggagaacuggggggagagcuggugcgucucuuaaaccuacuagaagucacagcuaacauggaugcaggagcagauacacacacgggaccuaacuuaggaaucucagcuguugaaaucccugcaggaggagucaguuuguccugggucugaagaagcugcuugagcuuugaagacaaauagacacccuucucuuuauggaaagacaccaccucuguuguugauaugcucagaggcagacuuaaggaacacgagggugccguggaaucagaaucugucucugcuuuaauuuuagggaguacagguggacuggcaguccuccguuucuuagacucgcaauuugugcuacugggagacucuuuaagaagaucaucugucacagagcccugagugcucuuuauguuuugaguaaucucuacaguuacuggagugagcagacagucuaugccauacaagugugcagaguuagacuccaucucaaucacaucacaaucacuagugcuguuguuggucugaaucuuaccaucaauauaguaauuuagguucucagagauguugcuagaaauguccaugauauacacaucaucugcguccccguccuccucgggcucugugcuugguacauagacauucugggagggcggggccugcucugcagguggcugcggcucuucuaggaggccuccuuuucgccggacaccuuugggaaucagguggcguucgugaacucuacgcugaugucgucucauauuggugugaguuccaaauaccuuuuugcaguauuugcaugggugaaguucuuuaacuucaccauucucuuccacaaaagaugaauucaguauuuccugugagguuuucucugaguucaauaucaaacagucuugcccaaguugagguggacucgacucaucuuuagaaguaacauuuucccccuugccaucgucuggguccucugaggauuguaaugccaugcugggucuucucuucaacccuguuucguggcgccuuucaugccgccuccuguugaucugugugccaaaugguuucccacaguacuugcacuugaaagcgugguugauuguagaaauguggaugugcaugugacguucuagccccugcuucguugcaaauuuccuuucacaaugcugacauggaaacaugaauguuucaagccccucgccguuggccuccucucuagcccugggagcguggggaggagggguggcgccuggggagccuucagaaguuucaguuggcacacuccguggcucuuccaguaaaucuucuggcuuuucuucacaccguauuucugguucuuucacagagcuuucauucggcaugucugcuucuuccuccccaucuucucccaacuccuccuccucuucuuccucuuccagcuccuccuccuccuccuccuccucuuccuucauauuguugaccucacagucugugacuucuuguuucccaucugccccuggcugugacucgcaggcaggaagagggauggccaccuguggaacugcauccuggcuuaccaccucuggcagaagggcuggcugcucaggugcagaagccaaaggccucucauccucuucuuuuggaccuaaggagcagaagcacagagaugaagacacagcgcuugcucuguaaucaacuccuaugacucgauugcuagaagcugcuaagauaugugaacaaaauuauuucauuuggagguugagcugggugcaaaucccuuccauuaacuuaauuaacaaauguagaagacugcuaaggaccaggcaacacucuauagacacaucaugacaagcaugcccacaggguacuaagcuuuucggcuuauaaaaacuagugccuauaacuguguuggaauagccaacauuaacuaaugagccugguuacaaauuccaauuucucaugauucaaacuaucagauuagauucuugaugguguaccugaaggauggaacuuguucuagaugaugaaauccacucugcuagucaaacaaacuuccuaucucucagcagccuaaggagcaguuuacugaguaaaacagccauccccaaucacuugucuauguucaucccccugaauuagacaggccagagagggcuugcuaaugaggccacagcugaucagagacauuuaaaaaaaaaaaaaaaaaaaaaaaaaaagccaugcgggagccggaaagauggcuuaagagcacugacggcucuuccagaggucuugaguucaauucccagcaaccacaugguggcucacaaccaucuguaaugggauccgaugcccucuucugguaugugucugaggacagcugcagugugcucauauaaauaaaagaaaaauaaaucuuuuuuuuuuaaaaaaaguuaugcaaucaccugguagacaaaaugccuugggcagaggaagcagcaaauaaaauaccaugagcuaucucugagucaagaugacccuaagcagguucaaagucaggaaggcuguagagaagaguuggaaaaggccaggagaugagacuagggugagccagugcugaggauaagauaccaugagaagcugcucacugccccgagucaaagaggaguucuaacagagaagucauccagccccacugggaagaaaauggaagcccuauggggagaagggaaggaggugggcaacaagagcucacugcuccaggagaggugcagguagaaggcuagggaaguugguagaaguaaucagacccugagaacuuguauuuuggaaaugaagcugacaaaaugugcuugcugaccaggugugaugagaagccaaagaggacugcaagaaacugcaauaauccugcuuaccaaaccaaagacugcaggaggaacaggaggacuauaaacacauggggcagaaaaaaauuaacuuaagaugagcugaugggaccucauaaaauugcaaagcuucugcaaagcaaaagacaccgucaauaagacaaaaaggccaccaacagauugggaaaggaucuuuaccuaucccaaaucagauaggggacuaauauccaauauauauaaagaacucaagaagguggacuccagaaaaucaaauaaccccauuaaaaaauggggcucagagcugaacaaagaauucucaccugaggaauaccgaauggcagagaaacaccugaaauaauguucaacauccuuaaucaucagggaaaugcaaaucaaaacaacacugagauuccacuucacuccagucagaauggcuaagaucaaaaacucaggugacagcagaugcuggcgaggauguggagaaaggggaacacuccuccauuguuggugggauugcaagcuuguacaaccacucuggaaaucagucuggcgguuccucagaaaauuggacauaguacuacuggaggaucccgaaauaccucuccugggcauauauccagaagaugucccaaccaguaagaagaacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggaggguaucauccugagugaaauaacccaaucacaaaggaacucacacaauauguacucacugauaaguguauaauagcccagaaacuuaggauacccaagauauaagauacaacuugccaaaugcaugaaauucaagaagaacgaagaccaaaguguggacacuuuacccuuucuuagaaaugggaacaaaacacccauagaaggaguuacagagacaaaauuuggagcugugacgaaaggauggaccaucuagugacugccauaugcagggauccaucccauaaucagcuuccaaaugcugacaccauugcauacacuagcaagacuucgcugaaaggacccagauauagcucucucuugugaggcuaugcuggggccuagcaaacacagaaguggaugaucacagucagcuauuggaugggucacacggccccuaauggaggagcuagagaaauuacccaaggagcuauagggaacugcaacccuauagguggaacaacaauaugaacuaaccaguacccgggagcucuugucuucagcugcauauguaucaaaagauggccuagucagccaucacugcaaagagaggcccauuggacuugcaaacuuuauaugccccaguacaggggaacgccagggccaaaaagugggaguggguggguaggggauuggggggguggguaugggggaccuuugggauagcauugaaaauguaaaugaggaaaauaccuaauaaaaagaugagcugaaauuuaaaguaugguaguaugugucucagugaggagauuuaguagaauuucguaagaucuuaggucaauacagaggcugcaguaccugccucaggagagagaguucaugaacagugaauggcacacuaccuagaaaguggacagacaaggaaggauuauaucccagacgcugagaggcuaagcaucuuucauagcuugccuuaccugggaagagggaaucucagcuggggaagagccucuauaacaccagccuauaggccugucuguggguauuuuccugauuggugguuaaugcuggaggguccagcucacuguggucccaggcuaugugaguaagguagcagacuaucagcucuaaagccagccaacacagcagggguccuccacagucacugcuucaguuccuuccucggcuucccucaauaauggaccauaacucacaacccaaauaaaccaguucuuucccaaaguugcucuuggucacuguuuuaucauagcaacagaacacaaacuagaacuuaagaaugaggaauggccaagaaacaagucacaaggaaggguaauaaacaucaaggauagagaaaaaggcaaaaggggguaaucaaaaugugggauaaagagcauccagugcgccaucugaauacagcagagucaucugggacacgaacuacgcgguagauuaagagauugagaaaaaggcuugaauacugagaccaaggagagcgugguacuguuggacaauacuccaugagacaaaggcauaaaagaguggcucaacugucaugauacaacaggcuguccacagacagggaacagugggggagaagaugcuaaagaguagccaaaugcuacagucucuacaaacacgaguuaggaacauaagcucacuuaaacacccagaccucagcccucuugcuguuuccuagaaugagggcccugccucuaccaucuguggcuacuucauuagcaguuagccucuguuucuaaauagaaaucaaaauguucucccuuggacacauuugauacuuucuaugugcuuucaauaagccaggacagcagucaauggcaguaauagcacauuucaaaugugcucuuagacacauuuucaacagacacccaacacuggacaaaaaagccaacaaaggauaacagaaauaggcuagcucaagaugucuuucuagaauuuguuuucugugauaaucugugguuuccuuaguuuuaaaagcugcucccuacaauuggugaucaaucugauuugaaacuauuucaaugguucucaaccuuccuaaugguguugacuguuuaauacauuucuucauguuauggugacuccuaaccauaaaacuauuuuauugcuacuucauaacuauacauuugcuacuguuaugaauaguaauauaaauaucugauaaaccggauaucuaacacgcgauccccagguuaagaaccacuggucuaaaguaaggaauaggagcuuaagguguacaaccuuacuaacaagccaggucccaaagcacugccuacuuucuugggcuuucagacacagggcugggagaccuccggucaucagcuacauuaggcagagcagcccuuauguugacccagugccaaacacugggcccgagcaucaaauaacuuuuucauuaugguagagggaaaaaaaaaaaaaagcccagaacucuugaguuacuaaagagaucucuuaaaauuucaagcucuauuuuuuguuguuguuguuuauuuuuugugucucaagacaugguuuguguguguguauggcccuggcuguccuggaacucgcucaguagaccagacuagccucuaucucccaagugcugggauuaaaggcgugugcuaauccgugcucaccuucaaagucuaccuuuuuaaaaaaaaaaaaaagauuuauuuauuauauguaaguacacuguagcugucuucagacaacccagaagagggcaucagaucucauuaugaaugguugugagccaccauguaguugcugagauuugaacucgggaccuucagaagagcagacgcugcucuuaaccgaugagccaucucuccagccccagagucuacuuuuaaauaaaaauuguuuugcaucuuuuuguauugcucaaacaaaugucuuaccaaauuugcugcucucaggaggcaaaaguuagaccuaagacuaagaaacauacuugucccacuuccuacaccgugucaagcacagaggaagggcggggguggaagggcggggcugcccuccuuccaguuaaauccuguuuaaaaaaaaaaaaaucacacugaccuucuaccugacucccucagccauacuaaaggccauguacacaucacucacaaugaacccauccauucuugauucucaaaagggcauaaaaccuaugauucuuuugauguuaucacaaacagggcaaauuaaauggccauaaaagguauucaaaauacugaccuccccacugcucacacacacacauacacacacacaguguguuuucguuuuuguuuuuuuuuucaagauucacaagucuauauucugaaaucugccugucugugucacaaucaacaacccaaacaagcuccugucucuguguaaauucgucuguaacaaacugaggcacacagacgucccaaauauggagacucagcuaugcugagcagaguaagguaagugauuuaacuuucaaacugcuucucuguaaaugcucacaucaugaaagaucuagaguaucaauguucagaggcaaaaauaacauacaauuuuaaaauucuggcacuaaguagaagcacuuuucauucugcuauacgguauggaaaaugucugauauuuguaaguaaauguuuaacugacgacacacacacuaauacagauaaaccacagcuguaucacagacaaauuguucccuauguaaauacagcccuguacucacugagcagguaggucagucagaaugccacacugcuacuagccuagucuuuguuuuuaaaacagucaacauaugucugcccgucuaucuagaaaaaauguguagucggucucacuauauaggccuggcuggccuuggacucagacccaccugccucugccucucucgugcagggagucacucugccuguuucccuuuaugaaaagaaccacguuuaaggggagaauacuuucauucugaagaggaaguaggguuuggaaaguucagcuuacuacaguaaacacguguguucaccaagcauggccagcacugaccuucugcagagccccucauguuugcagagguggaguccagcucgcucgccuuccgcgcugcagccuggguucugacgccuuuguuuuuauucuccugugauuucuucuucccugaaacacagcauauauuuauuuacucauucauucaugauacucugguccuugagacaauuaacccaagcaaaguagacugaauuuguagacaacuaucauuuugauuuccaaagaaaagaaugaauagugacuaaaaauaucaucaaaucugucagaaaaaaaaaacaaaaaccaacaaacaaagcucguagguccugcauuuuuagauguuugguccuuaguuucacagcauaguagcuaucaaguuaaugaacacuguauucucaaaaaguuaauaauacuaauauaaaaaacucuagaaucaaaaaaauuugaaaucauauaaauaauauggaaaauaccuauuagagagaaacaauaugucacaauuuaaaacauuuuauugguuaagauaggauaauccaggacuacaacuucaacuuugaaaguaggcauugcacugcauuauaagggauacauauggucucucucaaaugcagagaaaucacaagcauggcuccuauugaauuaauaacauggaggcacacaaaguucagaaaauacuaacuacacgcaaaugaucccaaacuauagaaaguuaaauuaaaccaugaccucucuugagaagcuacaacaaugaacugaagccccaaaggaacacaguauauugcaguaguggucccaaacuggucaccaagguuaccagauccgggugagucucacgucccuucccaagcacuuccuucucgucuggcacuauucuccucacacacaagccaccuccacuccuagagaucccuaggacaagcucccugcuuuuccugagcaagacuucugccuccuccauaaccaccuuauccaaagacaggaaagacaccacucaugacuauggaacacagagaaaucaaauucuacagagucugaauaguggaugaucaugagagaaacacgaucagcuaaaaugaagacaacggauaguuuuaaugucagaaacacaaaaaugucauaauugagaagaucauuagauuaaaaguacagaaaucaaccauaauauaaaguacuaguuuaaaggauuuugauaaaaaucuaacagacauaacaagaaaacaauuuguuagucuuuuaaggggaaguacuaauauaucauuuuaaagugcccaauuuuuuagcuaguaagaaaacaggcuugguguguucuguuuccuuugggaguguguguguguguguguguguguggggggugucaacaauauguucccaacaguauggucacauguuccuuuccacaugcaccuuaagaacauaagcacacacaugaccaaaagcucaucuacucugauaugaagcagagggcauggcaaugaaugaacgaucccaucuccagaugaagacucauccuaucugguaccacacgaggcagauagauacacaggcaccuuccacaguagcucuucacacucuccugucaacuuccuccuguuuagugugagccugguaauugcuggcucaagcuccugaaggauacguguugaacagaaucuaauucucucccuuccugucuacgucuauacccuuccugugugugugaugcucagucugaaugagauuaguaacuccaaacgaaacgcaugcuaaccacaaacaaaaacacaaaugacaaucugcugauauagugcaaccgaacggcugagugucacaaagccagcagcagaacccucagacauuccacucaaaaguagaagagagauccuuuuccccaacccccucccccaaucaaaaccacaucuuuuucuaacuaccaguacuucguguaaucaguacuaccccacauucucacacagaccaagaaacaggacccuuuacuauaacuguuuacagguuuuuaaauggaaaauuauaauuuaaacaugcccucugcaauaagcuucagauacauuaaaaauaaagcacauuguaaaauuuaauagaaacagguaucaauuuguugaccaaaauacucuggcgaguauauuauuauaauuaaacaaguaacaugaugaacuaaaaauguagcugcuuaagcaugugaaaggcaaaugcuauguuauaccauauucuguaccuuaaaacaaaacaaacacccuuacuacaacuaggccgugccacaugucccccucugaacuccucagcacaggaggaguuuacuacuccccagguauccacuguaaagccacagccaccauggaaaugcaauccauugugaggacagaucuaucaagauaggcaucaggaugaguacccaccuccugugccuuucucagaggacuaacaagaguuacaaacagagaguuaaccagccugguuucucaagcagaacacaaaugacacucuuggucacacaacugucuguuguggggauugcugauucaccagaguuuguuucacagcauacugcagagggaaagggugcucuacccaguaugugacagccucaaauugaaaacacagcaaagucuccgcggugcucucucuguggggagaucucucaaauaucagagcacuagacuaauguacuuacuauauuugagguuacuacaaacauauguggcucuacagucuacauauuuauuaaaaaucaugcuaaaaacuaaaauaacaccaauauaaaaauucuaaagaugaagaaaugaaaccaccaaaguaacuuaggaacaacaaugaauuuauguggcaaaagaaaucuagcaaaacuaucauggagcuaugacaucaaaauuuucucaaucagagccauuuaucaagauacuuuugaagcccucugacuggagaugauaggacuaccaaaaagaaccaaaaaacaaaaaacaccugucugucccaucagagugcuauuuuguggaugaaacugaaggcucagacaacaaacaaaggaacaaacacaucugugacaaagaacaaauuaaacccugcuccaacugauuugagugccugguaccacaccaguacuguuggauacauuuccuuaaacaguaaaguucuuuccagguacuugguuucggugugcuacauugaaagagcuuaaaagagaaaacaauauugucuaucaggacuuuucuaaagggaaaaggggacuuguagcuucuuagaggcaagagguaccacuggguggcuggcaaguacacaagugcacuuaccagggguuccugcaggguccuacauggcgcuacugccagcuggcugcuccacuuggucuagacaagaaagauacaggaaugaaacaugaggagagugaaauggaaaugacaaagaguagcaugagacauagcauguguagaggaagaaaugugcacauaaagaugaagaaaaaacaagacagagcaauuaucuacugcaucaagucucuuauauauccaaaaaaggccacuccuauguucuuaauugcucaaguuaagauccauguauuaggcucacugucagguuuauaccaugccuauguuauaagacaugaugcucacgcuaccuacaaaccauucuucuagaagaccuuaaaguaccaacccaugccugaaauaaagacacccacagaucagagaugagaggugucuacccaggucucacaacuauagcucuagcaccauaauuaaugaagauaauaccacucaaagugcuccuucuccugcagccaucuccucaugccucagucagcacaccccacucuuggcacccauucauaaccugguacacgaagcagauacauuaagacuucuacacacucagcauaaggaugccagucaaguuggaagggagcacucuuccauuuucauuuuaccuuauaucaaaaacuaucagucaacagcacagaucucuguuccaaacaaauaugauucagcaaggaaacaggcguuucuaaucaaacagcugccauauaaagacacucaacagcugaaauggcugcucucuagacaauggacagccuuauacugcuaguguccaaggugggaguugcaaaaucaaaauugcuuaaggcagcacauuaauaauuuaacccagaucuagacuauguucuacuauuugaauaaacuagaaaacaacaggaaauacuagagaauaauguuucacuuaaaaauguucaggcagcaaagaaaaugcaaaauuccagguuugcucaagcaacauuaaaaauucagcacaacagugaaguuccugcauacgaucguuuaagggaacuaauuuuagaaauccauagaacucuccuuguguguugccuccucacugaggaguuagccaucucuucaguaucaacagaauuagggcagcacaaaagccaggcccauggaucuuucuuuggaguucauacuguccccguccuuggauacaaacaguuaaccaggauuauugugagacucuacgcuucaccauaaaaggucacugaaggucugaguggagaccaacaguaucagcagaggccaucaaccugggcuguccacugccuccaguccucaccauucagccagaccaacuucucagcaacucaacuucuguugccaccacuccagcaaaguccauuucccguaauuaccacuaaagucauaauuucaaguucaaugucccuucuguuucuuuugucuuguauucuuccacugacaaugggguaaauaaaguaucuuccaucccuagaaucccucuuccuaaucucacagcauuaccauccacuaucuccagcuucugcaaggucuuucuuucuuccugucccucggggaaaucugacaacuggaaguaugcuucccuaguaggcuacagaaagacuuccacaaacacauagagcuaggcuaagagaggcacaaaggcucagugagcacacagaggguaauaggugugggagagcuguuuagucaaaggugagagccaacagagcaccaugaggaacuuugaagacuauuccagcuccccugaccucaaacacagcuuucaacuucacauuauugugugaacugccccaagucucagcacaucaagucaggaccauccuggaacuuugauucucauccaauucuccccuucauccuuugcguuccaagagucccguuaaugacauuuuccagguucuaauuucacucuuaaaaaaugagacacaaugaauccuucuauaucucaggcaaagugugagcaauucauuaaaucacuuaagcucauuauacacuuuuucccacauuucuguacagcaacgucggcugaugagcagcacucaggaaauauagcuaagauacaaacuuggguucugaaaaccagaugaaaaguuuaacugggaaaaagcacuaaguacuagcucggguggacuguuaaaaguaaagcuaccucugaucauguuaacaagguagaagacuagacagguaauggcgacaucaguaccuuaaguagccaguuacguuagagaguagugagcaggagggaaaacaaugucagcacugucuuccacuggaggugacugaauggucuacaguggguauagagacagcagaaaagcugggaacacuuaugaaacuaaguucuucacaaagaauuccagccaauuuucuguaucuguagacuuguaggucaccaaaagccacuggaaggagacucaggaagcugagaugacaggauugauggggcccagugucugagauguggugcccagagggcucuguaaaggucaccaaacagcacuaugucccuggaacaaggucagaaguagcucccagggaagaggcccugucagucuacccgcuuagcuugacacugcuaagaggcugggacucgcuuuucauguuauaaaaaugaaagaaacaugcuacacacgucucagaauuuuuuuuuuaacuuaacuucuaauuuaccugagaguaaaaaacugguaagcuccuucagaacaauuacaccucuuuuucuacagcuaaggucacuaagagcugccuguaaucacugaggcaaauuaucaaaauaaaaccuucaugacuuuaacuuuguuccacauauuaaacagaucucuccaacagccuccaacugccuaagcucugcagcuuugcuguguaaauuucuaaugugccugcuccuuccagggugcugcagagccuaugugagacuucaggcucccccacuuccacacaagcauacauagauagaugcuucuucuucuucuaccaaucaggauaaaggagagugcugacccuaagggugggaggaagacuaggaugaaggcuugccagaccagguuuagaacacaaggggccucugaggcccgugcucaugguugagggaaaggggcucugucauucucaacccaggcccucauuuuaccuguucccaguagauguuccauguacaaggccauacaucuuucucuuuaagaacugagcuaaaucaagggggcacacuuaaucaaaaggucuucagaaaaaauaaccugcaaacccgaauggacauacugcaccgcagcucuugggcaugaugagagaaguaagaacugaccccauucauugcaagcaaacaggaacuaccuggguacagguuggugguccagcaaucugacccugacacugagaggcaagugagaccaagcauacaaaggaagccuguuccacccuguaaacagaaucaccuguaagagcagggcagugguggcgcacgccuuugaucccagcacuugggcggcagaggcaggcagauuucugaggccagccugcucuacagagugaguugcaggacagccagggcuacacagaaaaaaaacaaaacaaaacaaaacugucuugaaaaaaacaaaagaauaaaaaauaaaaaaagaaucaucuauaaggaguacccaucagauucuacucaaaaaacucuggaauccuccgaacuuagaacucuaaguugucagccuauguucugucauaugcacccucuagcaaaugucuacgucagccguuuguguugguccuuagguuuacacugaauaggaacagagguaauuauggauaugugugagucuaaugaggcaggaaagaaaaaguauucccaauacccauaaacacucuaucagugcaggccaaugcuuuagcaguauaagauacaagugcagucuacuuuuacaaguauaagauacaaguacuaucuauucuuacggauuuuauuacucuuaacaaaucuuucaaucugcuuuucucuaucuugaacauccguuuuacauuuauuuuaaugugugcaaugugugcgugugugugcucaaguguguguggacuugagaggacaacuuucaagaguugguguucucucaccaccacgugcauccacagaugggacuaaagucaucaggcuuggagggaaacacuuuugugugcugagcugccucuuuggcccccaaccuaaguucuuuguuuuguuuuuaaauuaaacauauugagguucacauuaguaguuuuuacucuuuagagaaggacacccuggacaccuuugaaacccagguaaaaccuaaggccucucucccaaguuccuccauuacuauggaauaaacaccuuagucaugcugggcaugagcacauuuuguaguccacacuaaggucugggccuccucuuacuggaaagcggcuguaagugcacacaagcagugcccacuccacagaagcacaccuguguagucucuaacuucucagaaccgucaaaucccuuugcuccccucaaagccagauucaacaguaacuucuaagaaagugguucuucacauuugaguacaaaaaaaucugaaauguauucaguuacuuuuaagacuaaugauuucugagaaaauguauauaaauuucauucaaaaugucaaacacauaaaaccugguuaaaaggcacggcagucaggaguguugugaacuacacaggguagaccacagaagacaaaccuucauccaacaagccaacgauguucgacacauacaucaaaugccacaggucaucuggccacgcccaagcagcacaggugagcaaguuaagguaacaaguacaaccaggcagacuacaaguaggacugcagguaagacuaccucucgaguaguuaaaccuaauaguuaagucugugucucaaaagcaaaacuguccauuucuaaagagcauguuaaaaaauguugaagcuugacuuguuagaugugugcugguaaacccaagcacugacagucaguacagaauugugcugcuuccuccauuacuguggaauaagccaaggaucaggagaugcacagcgagcagcaagggaggagccauccucauucugcggcugcugcuauucugaggcaaaaguucucccuuuacauccuaggccggcucaggggccacgagcuaccacaacgugcucaucuaucuuaccccagcuuacagggacuuucacuacaaggcaagaacauggaaagcaacacuguuacuaaaacaaagagucaauuuggccuucuuuuuauuuucugguuuuucaaucuggcccuacuaauucuaaggcuaugcuauuuaugcucacugcaaacaguccauucuucacauauucaacacuugagguacagagaucugcaguaccccuaccaccacuccccacacacuucagacgccauuugaagaaguuacucauucgcaaaguauagauuuguauucaacaaggaagcagccaacagugaaucugugcaucccugcaaugugcauuucugcuuggcuuaggauaaaaaaaaauauuuaggucauuauuuuaacuuguacuuuugacaauuacccaagagauguguaagacauugucuccucaaagcuuaaccagaaacagaguaaguacauacaauuuaauacugucuacacuacauuggaaauauaugcaacuaugaauuuacuaccuuagcauacagaauagguuuuuuuaaucuucaacaguuuugaugcaauaguaacugcaaugcgacacuuagacuccaucuuaucauuaagcauucccauaaccuaaguaacaagcaaaagauauuuccuggaauaauucguguaguugcugguaaaauuccuaauggugaguacacauggcacuuugggucccuaaaaagaaaaaaaaagucaaccaacugcagcuaaugacagacuaauccuccuagaucuagaaugugugggugccauugugaacugcauaguacagccucugaaaacacaccaggagacugucccacauuggagaaaucacaagacaaacugaccgccagggccacucauacuucaaaguugucuguuuauggacagacuccacacugcccccugccugugagcacucacauccucacagcaaaggacccaaggaggaggcacagagugaagcccccauucuucuccuagacuuuggacuuuaacuuauagccagcagucacucuaucccucaggcaaaggggcucugacaaucucagauuaaaaacacuaacagcuagcagguccagaaaggcauauucuacaucucagccuggcaagaaaaugaaaacuaaaccugagaagucaguaaaaacaacaaaagacccaaagacugaaucgucguccauucucaacuguacuagaacuucaaaccgugcccauaauacuguucuuagaucuaaauacgggcaaacaaaccaguuugccuucaaccaguuugccuucauuuuuuuguggcacgugaugucaagaaaccuacaaaagacuguaccccaagaggugggauuauaaacacaggaguaaagauuaucacuauagcgugcacacucacucucucacucucucucucucucucucucucucucacacacacacacacacacacacacacacacacacacacacacacacacagagcuuaagcauauuuauucacuguguuucauuuuaaccaaugcagagacaaaccccuacuuaauuaacauaguguccauucauuaaaugugaaauuggucuugggcaagacaccauuaaacuaguaauauacauuugaaaagguccaggguaucaugugagcaaagacgccaccucauuucagaaaccagagaauuuuuauauaccacacuaauacaauaucauugcuuuaucauaaaauuucuuggcucugaaacuauauuccugucuauucaaaauaagugugauaguauacuuugaauauauaacacguaagguaaccauccauucaccggcugauaauuaaaacgucuaugaagaaguacucugaagacagaguggcaguagaguacacaucuuuaauauccacacacugggggauggaggcuggagaauuucaaguucaaggccagucugggauaacaaugagucaaaaaaaaaaaaaaacacuuuauaaauuuccagaucaugcccucuuuccuuuuugucaccgccaugccauccagacuaaggaagaccuggaaacuccggggccacaugagccacagcagcaucgguaagcacaacaagcacccaggaggccauggaaaugcucgaggagugcauuaccacagacucaacuuugacaaauaucauccagguuacuuugggaaaguuggugugaggcguuaccacaugaagaggaaccagagcuucugcccaacugucaaccuggaugaauuguggacguugggucagggagcaggcacuggucaaugcggcaaagaacaagacuggagcugcucccaucacugauguugugugaucaggcuacuacagaguucugggcagggaaagcucccugagcaacuugucaucaugaaggcuacgugccucagcagaagagcugaggagaagauuaaggguguugaggugccuguguucugguggcuuaaaagccacucugaagguuaaaugcuaacauuuuccauguggucugaguagguucuuugcacccucccuugucuacauguuuggaaucugccuaacauucuaggaagacgugaggugugggcccuugauagagucagucugugauaauaaauguagcccaacuucacacaauuguaaauuccuacaucccugugggcucuauguauggucuugauguucaaagaauugaugaaugccacuacuuucagcucggcaugaagaaaccuggucucagaaaauccugagaaccagaagcaagauggguuuuccugaaaauguaaaguucuaagaaaaaccuugccauccagaugcuagcaguugccuggcuuuguaagcuuacuguaauggacugggccacuuauuaccggacagcuuaguauggaaacuuaggggaggagguaguggcugcauccagcuucacuuucugauggcauccagguguuguuccuaggagcacgccugccugcaagaggacaucagcacagcacacugacugggacacuugacaaccaaagcuguggccuuugaacuacuggcaagaugaaacuuuauguagagaacuggaggaaauaaaacugagacccugaucgucuacaucuuuaaaucuggaacauuaaaccaaaguuaacuccugagacuuuagggagugagggagacugggcgugcuuaguacugacgcugcuuuaguagucaagugcaugcuaagaggcaucacuuaauacggaaaaaaucauuuuaggagguuuuggaggauaaaagccuucuggcucuagagcuauaguacugugugucacuccuaguacuacuagggguccagaugguguaucuguuaugggauggauaagcauguggcagucaggacaacuauagggucuguaacaugacauuuguguaaccauaguaauucucuauaugaagguuuuagacauguggcuucacuguuaucuccuaaauaaagcauauauuuaaacagguuuuuauaacaaaacacuaaaaaaauuuuccagaugguaaccagaguuggaaauaauaaacagcuacaaucacugguucaaaguuccccgaguucucucgucucccacucacauucuacuagggcuuaacaugcacuacuucugacacuguaagcaauaucacuuccucagaccuucuggagaaaauaacagaaaggaaauauuuaagacguuuagaaauugagugcaaagcuaccucugcgcugccaaucaggcacggcugccacaggaucgggggggggggggggggacacgacacacaacugaacagucucagccggaguucccagauucacguuuaucacauuguauuauuuaagcaagaaaaagauaaagacucuacagugggccaagucaggauguaaugauguagucaguaccccagcagcaugguaaaguacuucagcaugucuaagccuagaucugaguccaagguccggugcuccaaacaaacaaaacacuaugcacacagacauaagcauauaaugaauuaaaaacaauuucucauuagcaguguacacugugaucacagcaaaugggaaacuuauaaauuaaguuguucauucuuuugaguauccaaaaguaaacaguuuacaaaauacuugcagcuuacuucugcagacacguuugcugaugugggauuuguugacuacuuuguauugucucggcccugucuacuuccuggcccgcuuuacucuuacugauuaguucaaggaagaggugcugaugcgcgcagucuccuccucugcagcacacugaggccuugucacugccgcacugguucaugaacuuuaagguuuccuuaggccaaacauuaaggacccugaacaggaucuaauauaaaaauuaaaucuagaaacugauuuaguggaguucuaauucauuuuguggcuguaguagaaggaaguaaugaugguugcuucuuuccuucccugccuuaggauguagguaaguguucugguuuuucuguuuguuuugucagauuauuaauuugugaaggguagugucucgugguucauuuuggcuuuuuggaacacaaaugcacuauuuugaaguggcaucuccaaagguuugguuugcugacgaagcuggucccguccuagcugccugacucauucuguaggaaaggcaggagaguggacuuguuaggaacaguuuccccagucuggacccaggcacagcaccccuucuuccucuuuauuuucucucuuauugccuuccucuuaauggacuucucacgcaguccagacuggauuguaaauuucugaucugccuccaccuccuaagugcuuggacaauaggcaugugcuguuaggccuggcugaacuaacugcaaagguaacugaguuuucuuaaggagugcuggaguucauuucuucauugugcuuauccuacaguacauuuuguuuuugaagaugaucucccuaugugguuccugcuagccuagaacuccaggacagccagggcuacacagagcgggagagggaggauggggggcacaagugcuuucaguaucuuuuucacuuagaggaagcucuugcuucuguacuguaauauaagcuccccuaaacuauuaaugcuacuaaagaccaaacuccagaucucucuggcagcauguaauacacauagggaauccaaacuacacagcuccaggcuguuaaccuggacugcagcuuucagcucugcaugcagccuucacucaaagugcccaucaacagucaauccccaguuaaccaaccaagcuuuccauccaaucaauuccuaguuaauuuuuauuuauucauucauuuguuuacuaagacauggucucucuauguagcccuggcuguccuagauagaacucucuuuauagaccagguuggccucaaacucagagauguaaacucagucucugucucccagauacugggauuaaagacaugcacuacuacaccuggcuccugcuuucguuagaggcaacuucaaauaugaaacuacacccuccucuguuagguuccacgcucaggaacaccaaguucccguaucuaaacaccaucugugaacuggaauacgaaacugccuaggggagagaagcacagcuaguuuuaaaccaauuuaaaaaucaguuauuuaagcaaagaaccugguguucauauauuuaaggaaacaacaaaauugaggguuuuaacauacaaguuauagucagauuaaaaaaacuaaacuaauuugaacucauuauaagggucuucuagaaaaugcaauuauaaucaaacuuuuuuuucugguuuagacaagucauagcuuccaauucccuuuuagacagaauacacggcagcacaugucaagaguuccuaacacacuccaucagaugucucaaauaguuuuuuuauauuaggauucuaggcuggcaagugagauggcucagcagacaaagaaagguacuuguucccaagccugacaaacugaguuuaauucccagaacccacauuguuaugaucuuuacccuacucugccucuggccaugugcacaggcacagacacaagcacacaaacauaaagaaauguuugugaagaacauuuuauaaaauucuggcuaauccacacaauuuuucugugaacaaggcuacacauaauuaagaaucaaaggcacagaaacaguuuccaacauuuagcccaaaucuggagccccucagugauggcucaaguaaacagaaaaaguaacacaaguuuucucccuccuggugaaaagcuuaacugaaaccauccugagcauagacacagcccacagcaggaaaggugggcaggacaugcacugcucgaugaaggcaucucucagauggauggcagcuagggcuucaggagacaccgcuguuaagacucacuauacacuuugccugccacacagccugacuuaacaagucugaggccacaagcacaggaacacauugcgucuggcuccacaccugucaagaggugagggcccaguuaagucuaccuaagaacugccuaccaccaucaggccucgaucacucagcuccagucaggaauaugcaacagagcugccagcugcuagaagagaccaagugaucguuucauguaagccagccuguucucugcuuuuauaaaguguacuuuugaauagcuaacuucaaauccuguacugcugcccacugcauuuacaaaagcauggccaccuccccagcccaaaccaucucccaacccauacuaaguugauauccuucagcagaucaccaaucucaaacaugcucuugacgcucgccugagaagugcccauucuucaucuggagcuaggacaaaacacuccagagaugcaagaugagugagaacacuggugggggggcucagcagucugcaacucucuucaggaggcugggcacccaccaccugcacaccuuuccuucuacacauuuccaacaagccuaacagucuucuuugaugccauauaucccucacagggaaaauucauucauugcucuuucucaagauccuucucaugacaaccaggaagccucaaggggccccugcugacccacaugaacaaggagagacacuuaguauggcuugcacuugauugcaauuauguagacgaggaacuucacagggcuggcauuuaaugccuaauuuagccagcuccugaaucuccccaaccaaugcaaacaugguaccuugcagaaaagaggccaauauagccauguauagagcugaguuucucaguucaagaaauucucacaugcauggaguauaagcuugucuagaucauaugccucuucucugccuggagcccucagcccccuggaacuucaugucacuuaugacacaggugaaggaaggcccugacaggaauugugccacaccccacacagauguuaugagcccuuggccaucggacccugugagagcagaaaccuuaucucaucugcccccgccccuaccuggacugcguucucugcaugugaaacuuuucagcuguucuaaccuggccugagcugcucagcaccucuggggaagaaugucaaguaugcucaauuucaaaacacgucagugcucuucauuacaccaagaguauuccuuugaacaauuccaugcagagacagacgaagcaauuccuucuuaagguugacuguaauuuaaauguuguauguuaguugaaagucaccagguaacuagcugauauucucagacaggacagaaccuuaaugaacauaauccugugcagcccauuaaaggcuauaaacuuaagucuucaaccacccagcucucagagccaagggacuucuugcuccuauaaauaacucuucucuccuaaccugccugaaaugggaggucaguggguuagauagcuacuaauaagggugaaugggagugaggcugaaccuagugaagaaaacagggaagaauccagcacuuagguagagcucuagguggucauaaacauucacuggcuggaggagccaccagcucaguaaguccucaacaagaaacccacaagccacauuagaaucuaguuuccagcccggcaugguuggcgcacgccuuuaaucccagcacucgggaggcagaggcaggcggauuucugaguucgaggccagccuggucuacaaagugagcuccaggacagccagggcuauguagagaaacccugucucaaaaaccaaaaaagaaucuaguuuccaagugucuucaauuuucagaaaacacccucccccuuuugucaucccacguguuccucagugaccaagagguuaaagaugaagcuacagcuagagcucauguggcuucacaaucacccacuguuaaagcuggaaaagugcaccucagaacagugucagacugggccacagucccacaccagggagagugagcccuagguaccucacgucucccauuccuuccagcaaacccaucugugcaaugccacugaugcuccuccuucagguagguaucucuguacacacacugcgacugcagugaaguuccaaagccgcacuccccacaacuggguuuagugcagugccgcagcgcuugcuuauuagcaccacaagacccgagucucaucuccagugccacuaaacaagcaaagaaagauucauuaacaguuauuacuuaugguuagcaaacucaauugcauuucucagucaugaguaggagacagaaaucaagaaggaaauaaaaauucucaauguggccuuuucuguuccauuauaaucuauacaacucauacuuaaauagcuggagaccuucaacacuaaaccuuccacuuuucuaccugaaagcuuuaaccuguccaaaccaagccacuucugacauucaagcuuacagaggcugcucagacaugcauacgauucagcagaaauagaaagcagaguuccagugaaaaaugccuagugcauguacaccugcaaccacgggaaacacugcaugcuccuuggucagguacaauaugaacugccaucucaaagcacuauguacuguucuuccuuuauacauugucugaguguuggcugagggccagccaaccccucaaacacugaucacugccuuccuggugugcccauuucccccaagucuagguuacccaaggaacuacacaaauggccagaaaguccagcacauggcaggacuuaacaaacauuaaugagagaaagaaacaaacaaaaagagagagggaaagggagggagcagggaaggaaaguagaaagguagguagguagguagguagguaggaggcagguagcagacacaggaaccagggcuucuaacuaccuaauacacccaaaaguccuuaugauccaccaacaaucugaugaugaguucugaaaggucccucuuggcaacacacagcugccaugcaaaggagcuaagguccagaaccgugaagaacucaguccuuuguuuccaaaguacaagguuaugccaaauaucaaucuacuagacagcuguagauucccaacaucuggcuuucagaaauaguccacacugucuaugaaucaauuuacuuuuauucucucugauacuauuauuuaaaaugucuaaaguuauacaauauaaaaaguucugccuucagaucuuacaagcuguuaaguuagauuucacagcauaauuuaaaaggcuugauucauuaaguucuccaaacucaaggucacagacagcaaacaggccuuuucugagauaagcugccuagagaagagaggcuauauguucuaagaaugaacuccacacgagucuuuucauuaaagcucaacaaagacucagugagcugucugcuacucagacucuuuaucaaaauaauggggcagaaagaaauauaauuacugccaagugguggugguccauggccuuuaaucacggcacucuggaggcagaggcaggcagagcucugugaguucaagccugguuuacagaaugagucccaggacaggcaggaccacacagagaaacccugacucaaaaaaacaaaaacaaaaccaacagacagacagacaaaagaaaagaaaaaaagggcaccaaacaauauaaaaccagcaaucuugccacaaaauguguacauuuguguaucacuaauaaaacaaaaagauuauuuucagguuuuuccuccacacugaauugaauuuccacaguaaggacuaauaauaauaauaacaauaaaaauaaugaaacaguucugaauacacacaccaaaguuuacacaaagccaaguaugacuaccaucaaauuacagaucugauaaaaugucagaauuaaguauagcugcacaguuaagaaaguccccauauccccuaguuuucagccuccacaagucauaccuucucuaggaaggcugguagcaugacucuugcuuacaaauauacauuaaguacagaaacaaggcaaauaauggcguggaaucaaaaugcugagccuuggcccaacaaaaccucaauguagaguuaaaacacuugagagagggcuggaauuuucuggacucuuucuuaucuucugacccagaaucaaaguauuuacugaccuaaaacaacaacuaaaucaccgucaauaaacagaaaaaauguauucagcaagcgacccaccagccuucccuugggugagccuauuucacuuugcugugaaaugcaaaggauauguaauugaaaagucacaaugagcucaucaaauauggcuugagaguuuuccaaaaccauguuuaugcuuuuauuuauagccucacucccacaaaauacaaugucugggaaaagaaaaggcuuguucagauuuaccaagauccaaggggagagcaaaaaacaaaaaacaaaacaaaaaaaacccaaaguucuuaucaaaagcgaccaccacaucgugccuuggccuguauucaaaguagacucaaauaaaagauccccaaauucacauuaaaaguuuuucguaaaaauauuccagcgacguaucggcaugccagcuggaaauaugauauagccaaacuauuuuccuacccacaaauuauccccucccuuuuauaagugacugacuacacucuagcuucuguucaaaacaucuuuaacacagaucugaggggacggcaagccuccuaaacuuccacaaagcccaacacauucugugcggcagccuaccucccucgguucccggugcaccccaucuuugucucucccagguccgguucucccuucccgucucccuccucugccgcguccugcgcugucagccgggccggaaggcgcaggcggcccucccucgcggcgcggccagcccuauuccgggagcagggccgggcccgcacucggcggccgcacgcgcacuucccgccgcgcgggcgcucaggcacaaguucgcaaacagcccgaacgcgcugggauugccgugauucagcagcgggccggguggagacggcgggcagagcccggaaaaggucaccgcgacgcuacgggcaacgcccggaccucgacccuuacuuaggccggcgcgggugcggcccgggcccggcggcggcggcggcgauuccuaccucuccggcucuucggggagcuccgcuugcuccgggcgcuggcucgcucuuccucaaucgcagcugcuaucucgggguugucuuccccauuguaccagaccaggagcuccucgccaggcgcgauuggcuaccaaagagaagagacaaggggcagaccaaucagaaacgcgguuguuggcgggggcggcacgacagcgggcaagagcggcgcgccgaccgcaaacagcugucgggagggcgccgccgccgcgggcacgcgcggagggaggcggggccagggcgcgcgcggggaggaggcggacccuacgacguaggcggggcagaaggcggagccgcggccagggcuagcagaaaauuccuuggcuggcaaggccaaggcagggcgcuccggacaagcaggacaaccuggcagcuugucacagaggcucgcaggaaugcacgcaccggcugaucugggccuagugcucagccuccaucaacagauucuuuuuuauuuuuuucgagguaggguuucucuuguguugcucugccuguccuggaacucacucuguagaccagacucccucugccucccaagugcugggauuaaaggcgugugccaccaccgcccggccaucaauagauucuuacagcuagucccaagccucaugccaacaaagcaaaagagaaaacaugagaccauuuugcccaugaaauuucauugaaugagaaauguaaagugcuacuaagcaaauggcaugagagcuagcagcauacguuuuagauuccaagcacaaguuaagcaggaacguugugcaccuuuauccaugcacacaaccacuauguuaaguauuuuaaagcucugagcucagagccuaagauagcauucucaaugcagagucaucaaaguagcgcaggccucugaaaacacaucaagaguguauaucgcaacuucuaguuacagaaauccuaagaauaccuuccaugaauuaugcuccuaaaacauuaaauucuucacagucacaccaucauauaacuacaccugcaacauccugaagaaauauuuugaguagaaaagugaggccuaaacagaacugggaagguagcuaauaguugucuuucauugucaggaacccaucuguucagaaaguucaaguaaagcccaucuaaacccacaugcugacaccgaugaucacaggaagagacacacaaaagggaauguuuuugcuuaguguagaaugagugggaaugaggcaauuaaaauaacccauauugcaaucaucaacacagauugauccagacaaggcuccccaguggaccuacuguccuugggugagugugagaaguaucagaacauuugcuuccugucaaagccucugcccauaaacagcuaucagccacagauggaggaagagucuuuauaaugagucagauggacagccccugccuccugagaccacgcagaggacagagcccgucuuggaugcccaaaggcauaaguggaaucuaaucaaaaggaaggccaaacugagucuccucagaacugaaaaguuaucaaagaccaaaguaacugcccaagccuaggagacaaaugagagccagagcucugucuccaaggaugugacugaguaggcagaucagcugauagaauacugccauggugcuggcuuccucgugugcagcauacuggggcuauggaagaguuugguccuagagguuuuguuugcuguuuguuuuggcuuuuugagacagggucucacucaacuauguaaccuggacuagccugggaacucuaguagaccaggcuagcuuugaauuuaagagauccaccugugcucuaccucccaagcucuggcauuaaaaguguguacacaacacucaguccuuauuuuuguuuuaaagcagaaauucaaacagaaauguucaguuuagacagugugaugguuuguauaugcuugguccauggaguggcauuauuagaaaguguggccccauuggaguaggugugucauugugggugugagcuuuaagacccucucucauccuagcugccuggaagccaguauucugcuagcagccuuccuuggggcaagagcccacccagcuaauuuuagguucaggcaugguaguacaaaccuucaacaccaggaggcaaagacaaauagaucucugaguucaagaauagacugaacagagcaagcucuaugcgagaauaaaaaaacaaaacacaaacuuaaauccagguuugguggacuacaacuuuaaucccaguguuuaggagacagacaugaagaucuccaaguucaaagucauguacagagaaaguuccagggcagccaagcuuagguaguaaaggaguuggaaaacagaaagcuggugauaauguaauagaacaagggggccauguuccaaccccugcaagcagcagaauuuggcagcuuuggacacauggcucuggcuugagaguccagaauagaaaggaauacugggacaauugaagcugguuagcugcagcuaaaaaauuaguggugauuaagaagagaccaguaccagucaaugguggcacaugccuuuaaucccagcacuugggaagcagaggcagguggauuucugaaucgaggccagccuggucuacagagagaguuccaggacagccaggacuacacagagaaacccugucucaaaacaaaaacaagagagagagagagagagagagagagagagagagagagagagagagagagagagagagagagagagagagagaacacagcaucucuggucuucugggaaaucuucugggaacuauuucugagagcucaaagaagcuguguucuagagauagucaagguuguuuuucauaguacagcugaacuugguauuguguaagagucacccaaaugguacugguuuugaaggcaugaaggggucaugaagagcagcugaggcuaggcacugugagaggccagggaaggccauggugaagguacagcuucaguagcaguuaauggcccaggacuaaagggggucaugcaaggaguugagacuuggaaucaugaagaaagccuaugagaggcuauuggugaagccuagcugcagcagaagaccccagcguauuggaggucucagcaccaugagaugaucaccaagaacagcaacagcaguggaguggaucaaccugagcuuagagugcuacaaagggcagagcuggagaagugaugcuagcccuuuggagaaggcacagaagaucauauguggaucccagacacugaaacaagauguaacacuuaaguugccuuggagacccaaagauuuuugagaugccagagcugugggcuaucugcugaagaaagcugcuaacagggaguggaaccagcccaggagaaagaaguuugcugcagucaacaaaaguaaaaaaggaguuggaaaucugaaggcugcuuugacaucagccuuaaagauucaaaguuugaaguuugcccaguugguuuccugucuugcuuuggggauuacaguuaagugauugaacaaaucucagaagagacuuugaacuuugaacuuuuaacauuguugagacugcuauagacuauggagacuuuugaaguuggacuaaauguauuuugcauugugcuguuuagcuuuggcccucuuagacucaaguguaugaacaagccuaugggggccagggaguggaaugugaugguuuguauaugcucagccuagggaguggcacuauuagaagguguggccuugugaauuaggugugucacuaugggugugggcuauaagacucucucauccuagcugccugcaagccagauuucugcuagcaaccuucagaugaagauauagaacucucagcucugccugcaccaugccugccuggaugcugccauguuccugccuugaugauaauggacugaacaucugaaccuguaaaccagccccaguuaaauguccuuguauguguugccuuggucauggugucuguucacagcagaaaaacucuaacacuuuguuucacugucuacagaacucucauuauuucaaaguauucaagcugaguucaauucccagcaaccacauagugacucgcaaccaucuguaaugggaccugaugcccucuucugcugugucugaagacugcaacaguguauucacauauauaaaauaaauaaaucuauaaaaagaaaugaaaaaauuaaagaaccagacacuguuuacuuuguuccuccaaaaauagcuaaaaucuaccacuuuacuguuuuugaaccaaugucucauauguuuucuugagucagcuaaacuuaaccaaaaucccuacuuugacaauccauucaugagcuaaaacaaccaucacaaacaccuuuuggcacucugaugagcuaaucugauuuguuugccuuccaaaauuaaauuguuuuuagaucauauaaauuuuaguucaguucuuuuuuuuaugccauauauaauagauaguauuauuaaacauuaucugaaaugauuaggacccuagaaaauauaaaauacaagcaaaguuuaaaaguaaaggggaauuucucucuccagcagccgagcaagaugcccaaagggaagaaggugggcccggcccuggccgucgucaagaagcaggaggccaagaagguggucaacccucuguucgagaagaggcccaagaacuucggcauugggcaggacauccagcccaaaagagauuuaaugcgcuucgucaaauggccccgcuacaucaggcugcagcggcaaagagccauccucuacaagcggcucaaaggcccuccugccauuaaccaguucaaccaggcgcuggacaggcagacagcuacucaacugcuuaagcuugcccacaaguacaggccagagacaaagcaagagaagaagcaaaggcuacuggcccgugcugagaagaaagcugcuggcaaaggcgacgucccaacuaagagacgccuguccucugagcaggagucaauacaguuuccaccuugguggagaacaagaaggcucagcugguggugauugcccaugacguagaccccauugagcuggugguuuuccuaccugcccugcgucgaaaaaugggggugcccuauugcaucaucaagggaaaggccaggcuggggcaccugguccacaggaagacaugcaccacuguugccuucacacagguuaacucggaagacaaggguguucuggcuaagcugguggaagcuauuaggaccaauuauaaugacagauaugacgagauccgucgccacuggggaggcaacguccuggguccuaagucuguggcucgcguugccaagcuggaaaaagcaaaggcuaaagaacucgccacuaaauuggguuaaauguacauuaaauuuucuguaccuacauauaauuacaaaauuaaaaaaauaaaaauaaaaaauaaaaguaaaggggagccuuuaaucccagcacucgggaggcagaggcaggcaaauuucugaguucgaggccagccuggucuacaaagugaguuccaggucagccagggcuacacagagaaacccugucucgaaaaacaaaaaaaaaaaaaaaaaaagcaaaggggaaugaggacaaauguauaccaugguuuccaucacagcacagucagaacucuggccagaagcaagcaggagacacccaggccucuaagaacaagaguccuguaccuagcuccuggcuuccuuuucauugcucuuggguaucagcagagauagcuuuacuucacacagagaaaaguuaaacaucucacagagauaggggugaagcccuggguuugagccuugacaccaaagauggagagggcagaaauaaauacaaacuccucauacagaagaauacuuauguccacucaaguuagucuuaauggaaaacacaaccuagaaccuguguguacugcaaaucgaauaagauaaccacuuacguguugguagacuggggaaaugcugaggggagcccagugugcucuguccggaacagcuuucagugcugucagugacugagauggugcuaugcuauggagcugcaugcuaauagacacucucuuacaagaaagaaaagagguauuuuuauuuuguacuccuuagcauuuucaagaucucuugcaauaaaccaaagaagaguucagagccauuccuuguaauucauuuacaaagccugccucaggaaugcugaauccuggagaacacagcagcagagcacagcugagggauccaaaaggucucaaacauaccggaacaacugccaaaggucaggccuucaggugcacaaagaucagcuaugcucuaccaguacagcucauuagcccacacguggaauaguuauuaacacccuacacugaccacagcauacugucugcaacuauaugaauuaauuuuuuuauguuaaauaucuacucccaguacaaaacucugaagccggaaaugcuccaaaauuucaaaguuauauguggugauauaacccccacaaucaaaaccaggacaauagagccccugcauaaaguuccaguauguccacuugucucagauguaucugagauauaagucaauucuguauuuucaggugggucccauccuaaaaaacuaaguguaugcagauguuuaaaauccaaaacacuuugauacuaagcagugcaaauaaggaacgcuuuaccuauacagcuaucuccauccuuagcuuacuuuacacagcugucuccaucccuaguuuacacugccuaucucacagccacguugucucuacaaggauucaaccuugccaacagaaccaguuguaucuccugcuugagauguaugugauaaacaaaaugaauccuuagugcucuuugaaaccaggcagcaggucuauuagaacagccuauagcuacaauucagcagaaagaaauggaaaacaaguuuugggcugccuaaguaugaacauggggggaaaaaauccaaauucugcaaaaccuagaagccagguuuagguauaaacaugucacagcggcaaaguuaggaaaauacaauugaagaacauuuaacagcuacacacuaacucaacuugcagaaggccuuaugcuacuacacacaccaugaacucaggacacugcccgaaaugcucaagaguucucaacucugugaagauuuaaaaaaaaaaaaaaaagaaagaaagaaaaaaaaaucuauagacuuguccuugacuuguaacauagauagaggaaccaagugaaugaagaacuauuuguuugucacagcaauuuggacagagguaucuauuccaaaagaggcuaccaucaucuaucuuuccagccccaagauuccauucuagaacauuccauacauggaauguagaucuaucugcuacagaaacaugaccagugaaaaccaaagagggagccagaaucuugcucgccacagaaacaugcuaauaugaaaagcauccuaguaguaaggucccaaaugcacuggguaccuucaucaccagcucugaguaugguccucuucaccucugcaaucaauuuucccaagaaauauuuugacaggaagaacuaaaucccaaauucuauccugaauauaaucaaaggaaaggaaaagcuaauccaaggcuucacgcacucuaaacacugcgagugcgcuuucuguuacaggcacuaccaugguaccacguaacagcgacgcacagugggcuaaaccugccagucaguucccagugcaucugugucagaggaagaggaggggagcagaugccacagauaaucaauaguaugaagaaagaugcagucuauaauuacucaacacagucuucuugcucuaguucuccaauauaugcaaggccucaugaaccauguguuuaacauagaguuuuagguguguggaugaaccacuucaaacacaauccauucuaggucugggaaguuguucuuuucaguuacaauuagacugcauuuagagaaugcaugcaaaguagcuaggaguagacuaacacuaacacuguuaccuuuaagguuuuauaguaaauggcucuguugauuuccaguggaaauaaauucuguucuucuccugagcaagcccaguucacauagcggagccaguugcccuucuccggaucaguggcaucaaugcacauccaccccaaauuuggguaguacaccuagggauggagaagaacaagcguguauuaagauaggaaugccuaaaaacaguuucaucuucaacuuuccaaacagcuuuucucacuauauaaaagcacucuaaaaagcacuucauagaagcaauauagaaaaauacaagcagaaaacagaagcugucaaaucuuagucuuucuuuaggcuugguuuccccucccaccucccgccaccauaugagggacugaaggccacuugcuugaucuacaaauguucccugggcauggaaauaaguaaccacuacauucucucaagugugacuuaacaacaugccuucuaagauacucuauugguccaauccaggucuguacugcugaggacacaguucaguggucucuuucuggcaugauuuacagagaugucagaaaauggacacacgugaaucaaucauguaggugauaacuguuuucuaaacuucacugucccuuaacaccuacuccauccagcauauguguuagaacuaagguucagcaaacaucuuugcaaaguucuaggaugcagaaaaaaacaaaagaacaaaaacaaaaccagaaaagccaggacacgggaacauucaugcuuguucaacuccuccucugagaugcugccaacaaacucauagcuggucaugccuucauuugaaagaacaugaacucugcaaguagucugaaguuuacucccucuuucucacugaacggaugaggcaguaauucuucuucaagcagagcauaaaugucccacaacuuaauuuuaauucuaugaauaaugcagucauuuuaaaauaugugcauacagauacguuuauaccccaaaaccagacugcaaaacaccuaaguaaauugaaccagaacuacaaauaggcauucuuuuuaggaagaaaggacucucucucucacacacacacacacacacacacacacacacacacacacacacacacacacacacacacacacacacaccuugacuccuaccauuuacuccuucuuuucucucccaccaccuucaucacugucauuaggugacuuucccuuagaacaaagguccugcucucagcugauggcuaggaugcugacuuccugagcaagucugggucccugagguuucuucucuucccaccagcaaccaagccucccucagcucuuacaggaguagacagacagacagacagacagacacagacacacacacaccgagucugucucucucccucucucccccucccucucucuccaaaucaaaggacccccucaaaugguauguuugaagccauugcaaacuucaauguuaaacauaguacacaaaaugacaaaagcugcuuuccaguguuuaagagcucugauugucccguuugcugaaaguggagugaaggacagacacaugaagguuguaaucaagccucugguuagcucacugacucacacagguauuaguauuacuuugccccuggccucagagauagucuuuuucuuucuuuuaauuuuaauguauauuggcagacaccagggucucacuggaucaccccccacacaguagcagugcugacagguaucaaugggacuacagagagagcaguaggaagccaggaaacccacggaauagaaggcaaagguggcaccuugacuacacgucugcuguaacaacaucugcuagaacuuccuggcucuuaagucaaaacaaaucguugcaaaaauaacaauguuccaguugaguaaacucuuuauuuaugcauauuucauuguaacucaauggaaagugaggaaucuucuaaggcacaaugauguauauaaagaaaaaagucccauagaagaugaauaugucaggggauuuaagagagauguguuugcauuuggggggcauguuucaguuucuguuuuguuuucugagaaaggaucucacucuguagugugcccauccauacacacacgaaaucacacaaugcugacuauguaaaaccacucauugauaaaaaugaucuauuuauuuuuaccuaaaauguaagaauauagaagaauauaugaagagaaaauaauuuaaaacuaaauaacaguuuucucugagaaaaugaaauaauucagucauuuuuuucuuuugcuuauguuaacuuucugccuuuccuccacuggaauaccauuacacugagguggggugggggaaaaggcagugcuauccugaaggucuacaucuacaugaugucugcuggaugcccagggaaaccacaacaugguuuuccuguugcucuacacuuuaaaacaacaacaaaauaaaaaacaaaaacaaaaacagcagcagcagcagcaaugacagcaacaaaaaacagcugggcuugguggugcacaccuuuaauaccagcacucagcauuugggagguggaggcaggcagaucucugugaauugaaagccagccugggcuacauaauauguuccagaccagccagagcuacauagaccaugucuuuaaaaaauuaaaauuaaaaaguuaaccccuccagacccuaugaaaugcuauuagucccuuuugaaaaugaggaagcauagcagaugggcaauuuaggagaauaaacaagccacugaaaaucacagccaagacucaaacuugauccucucauuuauuccuuacaccaaaaugaaacagauaagcaggcagagagcagggaaggggagcccuuacgaacacuccuaaauccuucuucugaugguuaggguguaacucauaguaaaguguuuguucagcggcugacccaugucaccuccagaagcacugaacaaaaggacagaccuuucuccccaacuccugauaccuucagguuaggguugaggaaacccuacuccgcugggcgugguggcgcaugccuuuaaucccagcacuugggaggcagaggcaagcggaucucugaguucaaggccagccuggucuacagagugaguuccaggacagccaagacuacacaagagaaacccugucucgaaaaaccaaaaaaaaaaaaaaaaagaaaaaggaaacccuacuccuucccucuuucucacugaacagaugagguaguaauucuucuucaagcagagcauaaaugucccacaacuuaauuuuaauucugugaauaaugcagucauuuuaaaauaguucuagaauaaucuaaauucaaaaugcaguacacaugcccacuuggcaugcaaccuucccugguaugcaggccuauguuuucugugaagauuugcaagaggguacuaaggucuggaugagaaucaaagagccauauguauuguauagucacagucuucuagcaggugcuacugaggaauaauggaccuucaagauguggggccugguagaaggaaggcccuuaggccauuggcacucagaaggaacuguaggacccuaucuauccuucugcuucugcuccagucugagauagagaacuuuggcuccugcaugugcuccugccaggagacaccccuguuaccuuaccagaagcccagccugcacgacugcccaauuguggaugguuacucaucaaaccgugcgccaaaacaaaccuuuaaaauuucagauaacccgucuuuggcauccugucacagugaugacgauacacaagggucuacauuacaaaacacucuaugaucuuugcuacaggaagauuacugauggcaacccagaggcuuagucugauuuugacuccgguauagcagcuugaaguccucaaggagcuacuaggaauccaaacuuaucaucuggaugauucucagacuccagaccaacuaccuccaugagauagagccaggcuagaagcacauguugcuaugccaagaucaaugcugcaaaacacacagaaaaaggccuaaugaagagacauuaaauggaugaguaaauaaacucccaaggggggaaaaaugcaccauacuaagaugcuaaccuaagucaaaguaguuaaauugugagaaauuauuuaaucaucucuacuucaauacccucaacuauuauaaaacucuugaaacagcauauauuuggcucugcuguuacuaugacaaccauucuacaguugaaguaccaaguucugcauagugcuguaccccacuggguaaaccauaacaccagacaccuccacauucacuccucuggcuuguuccccacacugccaagacacaguaaacuuuccauagaguaaugugaaaguauuugggggaggggggcagacaggaaauauggcccaggaguuaaaaagcucuuccagaggacccagguucaauuccuagcacccacacagcugcucacaacugucuguaacuccgguuccaggagaucugagacccucuccuagccucuucaggcacuauacacaaauguugcucaggcacacauguaagcaaaacuuuccucauuaacugaaauuuguauuucaugguaucuucaugugccaugguguuuaaaaauauaaagaugcuccuuagguuuuuuuggguguuuguuuguuuguuuguuuguuucaagacaggauuucucuguagagcccuggcuguccuggaacucacucuguuugggagcuuuaaaacacagugcgcaaguuggaucuagagacacucugacagcuggacaacagcagcgagcaugacaagcacccugugaaaccaggcucugcagaaccaacuggcagcuuccaaaugacauccaacuacaaggacacagccagcacuagcuaucgagcucacacacuaacauuuauucacaauguuaacuuauaaaaaagggggguuuugcuccugaaaaaaaaaaaaacccuguauuacgaacuucucaguaugcagugaucauuucuguaucaauuucuauugauaagaguucuagcucuucccucuguccucuagaauuuauugccaagaugaucaaaaugcaauagaagcagucaguaaccauucacauaaaagaauaguuuuuuuuaaagacuauuaaaaagauaagcaauauuaaguuucaaaggccuauaaaaauauacucuuguuggucuuauaagucuuucuaagugcuuuugggcaaaaccgaccaaaaauguacagaaguuuacauaacuuuugauuuaacauuuacacuucuaggaauguaucuuaaagaaaauaucagacaagucagaauauugcauguauagugaguuuauucuuggaagaacuauacauacucagcaaaggauuaaagccauuuaaauguucaacagaagguaaauauggauggcagacagacaaacgaguuaugagcagccacacacacacacaaaaggcaaacacaaagcaccugacacaggcagagacacaguccugggacaugguuaggaaaaagcauguuccacuccuacaagugguguggggauggguacuaguguugaagaggcaagacgggagaggcacaaggcagagaaaagacagccuguacuacaugagauucugacccaggcaauuccucacuagcuuaguaaacucuuacuguagaguuaagaaugcucaucaaugccgggugcuaggaguuuacgugagcuuuaccuuucggugagcuuuuuauauacucucauacaguuuuaugggaaguauauauuuuucuuuuuuguuuucuaauuucaguguagggggggucuucuuccaucaugugggugcagcgauggaauuuaggucauacaguuggguggcaccaucuucaccuagugagguaccuugcuagcacuguuuaaauuuuuaagacuuauaacuggaccagguacacacgucaugaaucccugcacugaaaaagggguuguguacugaauaccagagauacugauggauggaaaaccuuugaguauucaggucaacuggguagaaauggcuuccaaaugugugugcuguguagagacacaggguguaaugggcguucggguuguaggagcucuggcucuguggauggaagggugcagguuauaaauggcuauagcuuuccucucaagcucugccuucaucuguaauagauuaagaagcgcucaucagauacauagcgcucuuuguucuuggaccucucagccuucaugaugagcuucuguacguuacacaggcucugguaccuuaucauagcagaacaaaacaaacugaaacagaaguauccaaucaauuuuucucugagccuaacacuguucuaaaacaaaucuaauuaggagcuggaacagugguaugugccuauauuaucagcacucaggaggcuaaggcaggaggaguuugaauuuguggcuaauuuacaaccaaggcucugugucaaagcaauaaaagcaaaauaaagcaauuuauccuuaaaggguuauuagaauaaaucuugcucaaaaaauucuuuuuaaaaaaaucuguuuuuggcaaucacaugagcccaaaacuugaaaggcuuuuuaucagcuccaggcauacaguaacccgugcucaaaauucuagcacaugggagauagaaguaaaaggagaccaguucaaagucagccuaggcuacaaagcaagacucugccuuucaaaaggaggggagaacuuuguaucgggaaugguuucaaaauccuguuacugcucaacacaccaggauggucaaaagaaguguuacagacagcccagcaugucagguccccacaguccugcugagagcaggucaaagcaagcucuccucucucuagagcacccgcuccaugcacucaccccgagcauccuucaucuucaucuggauuaagagggaugugaaugcuuucagugaaaccuuggggccuggcaagauggcucaguggguaagagcacuaacugcucuuccaaaggucccgaguucaaaucccagcaaccacaugguggcucacaaccacccauaaugagaucugacggccccuucugguguuucugaaaacagcaacaguacuuaucuaaauaaguaauaaacagauuucugggccugagggagcgaggcugacuggagcaagcaaaggucugaaauucaauucccacaugaaggcucacaacuaucuauacagcuacaguguacucauauacauaaaauaaaugaauaaaaucuuuaaaaaaaaaaaaggaaaccuuggagaacuuaaggagucagacagucaagggcucaagaaaggcaacugaacacuuugucuuaggugagcacacaauggucuacgagaugggacguaagauuccacugcuaagguauuuuaagcaggucuuaaggggcuuugauggaagaacaaucaccaagaugcaguucugaugauaaacucuuucuauaauauugggaagagauuuucugauacaagucuggggauaagaccaauaaguuaauuuuucaauuuauuuaugacaaauaugcccauuacuguuauuauuccugauacuuugccauacacaaaaauauacaccuaugucaccuauauccuaucuuaacacuucuuaaaaauaaaaagcccucucagaugugagaccuaagugagcuucugacuuuucuuccuuguaaggaaagucagucuucacaagaacaagauguaaacuugaaccugacuauaaagaagugguauuuucacaaggaguuccaaacugaagccuaucuaugcaaagaaucuuaacuaggaugcuacguguagaggaacaugagucccuaggaguucucggcugcacaucacaauucugagcacacuacacaugaacuugaaugcaggugauaauugucauaagacuugagugauggcuuacacagcauggccaauaucacacugcuacacugguuacaaggugccgcugcauccccuuaggcaaugguggcaucugcucuacucggcacuauccacagacuguaaauaagcaugugauucccugacauuccucacuuagauuacuaaccaagccaagcuucccuguuagcuucuuuugagaaacuuuuuaaauuaauaaagugcuuuauuugagagcaauaucguacaagcaauacauuuuuaauaauacuaaaauaaagguauuaucuuuaguaaugaagacuuuuugugaccaggccauuuuuuuacaauuacaaagcucuuucacuuccaaacaguccugauccuugagguaaauucuuguuucccaaagcucccaggguuugcagucagauacuaucacaaacaacuaacucuuaagaaagaauacaaaaugaugaaacugucagaccaagcuauaaccuuuauagccuuaagaacugcccccucccgaugcccugagacucuugggagguaccugccuacacauuucacugucaggcuuauauaugucaacaaguaugagacagauaugacuccuucucauucaaaacggaacuuguaaaggagccaccccgaggugcuucccaugcaacacccuagugaaacguuuucaguaccccacucuuuaauggaaggcuucacggcaaaguuaagucagagaacugcuguagaagcagaauccgccccggcaaucugggagaauaugcguaacugucccacuguuuccaggagauguguguggcucugacuacaucugcccuccucaggccugaacguagagagcaaagguugccuccccaucacugaaagcuucuauaaaaggcugccugccacuucccugcuuuguccuccgggauuguugaagauaugugaaguagaagaaaauccuuucauaaaaaaaaaaaaaaaaaaguuguauguaaaugugccaugugcuauacaugucuaccuccgaauauuccagggacauagaaacuacuuucuaacauacagagacaaaucuaagacuauucuuugcagccuuuggaguauguuuuaugguguaucugugucauuuauaaaugacacagaggucacggucucagguauaaggcaaaaugcccugaacaaaaaguacaaaacacagaugugccauuuaccaucaaagacaauggggcagcuucaaacuacacagacaugcaaacaacagucuacccagaaaagucauuuucucuuuaacgaaaaacuuuuaaagaacacauugaaauuacuguuuuaacuuuaacccaucagauccugugaaaacagggagugggcucuugaaagugcuugaaacucucuuaccucccacauguauacauuauuccuaaccugggaucucuucuucuuaucaccaacaaauggcccaaacuuuuucccuuuuaaaauugguuuaguggcccagacaccuagaaaauaaaaccaguauuuuuauaauguaaugugguuauuuuaaauaucgaaagcauuaaugucauucaguuuuacaauacaauuaaaaagcuagguugcuuaacagcaaaguaacugaauucaguucaaucaaaucaacuaaaguccuccaggggauucugaguguccuucuguacgcccucagcagcuucucaauagucuguaaaggaucugcauugauuacaacuuuuuaaaagcuuauauuaacuuucauguguaaaauagagcauauguaguacaaucauaaacacuugaaaauuaacauaagagaaaauaugaauggaauaaagcuauaaaucauucaaacucuucauucuaucucucuacagaccucaaacuguccuuacuaaacaaagucauucuuacaauucucuuauaaucaggguuaggacuuggguuuuauaaauaaauacuucugaaguugauuugccuaauuacaguggagacauaguuuccacucauuagcuuuguaacacaucguucaugagacaucuugucuugcagaguuucagagucagcauacaugcuaaccuauggcaucuccuauuuaccugauauaaaaccuaucagaaaguacagcaaaccaaugaagaugcagucaguagaaccucaggaccccugcagucaagaacaacacauucuguacggaacaggaggcagaggcuagucuugcugcguguggcugggacauacacaccccacucccaccuaaagucagcuaggaauugcaucuauaaacacuaacaaccaguuaaacugugagacagaacaauauaauaaccccagugcucaguaagcaaaguuccagugagaauuagaagacaugcaagucauauuuacagcucucaucagaagaacaucuaaaugacaaaagaauagaagcaugaccuauucaggaguguguucuuacaagagcucuacaacuuacucuuaguguuguaucuaaaucuuacaucacagacacaaaaaucaaauacaaacaagcuuuuauacucaacaagaaauucuagccagcuuauaucauucauucaaauacccacaaaggguccuuaaguggaaaugguagggcaauggguaaggcagacugucaguaacagaaacagauguaaagucaacugaaaaguaaggagauaaaugugucucaaggcucagugaaaucagaggaaaccucccacuguguaggaugaggcccgcggagaugcagaggagggcacacuggaacacagaaccuaggaucgaauaugcaagaggaagcugguuuccuuucuauaacccaugucuacccuggauucuuauguagaaagugcacacacaccacuuaaucuuuuaagugagggucaagcuuucccuuuuuuuggcauaaugccuaucuagcaugauccuugcucccccagaaagcagucuacucuuugcuaccugacuccuacaacaagaguacucaccaauccgagucuugucgaccgcagaugguaaaagucuuacuuccucuggaaguccucgaagcacguguucagguaccucagccagagucucagugacugccacagacucaguguucugcaaggcaaacagcagaagggucauagcaaaaggaagaaaaccagcaguguuuuuuauuuugcuuugcauugcucuacugaaccuggagugcacaaagcagaaggggacaggucuggagcugcuguaucacuugcugagccuaguagugaaacacuagcaaccuucgaaccagggucuggucuguuccagccaccuguauccacuuucaaaauauguaaguccccaacacugcacugcucucuaacagugcucccacagaacugggcagcagaacacagcuuccaccuguuacuaaaucaaaggcuaccagcaauacacuacaacccuaaaaggauaauuuugccacacuccaugaaggccauuugacccaucagaugcugccucccuccuguaucccuccagcaaccugaguagguuggacauucuauagagagugacagcucacuguuagcccucacuucaagugggacuuuccaaggagcaauagcugaccguuguguaucaggccacugaacagcaaagaucacaauaucucagaguugacagaaauacagaauuaugccucaaaacuuagcuggaauucaucagagucuuaaauaagauuaguauuaaauguuuauguaaggaauaaggauacugguaucaacaaggaaaaccaggauguagcuuuuagaaucauuuccaaaucagacugaaaacuaaagacuaauuuucuuacagcaaugaagcauuuuuaauuuuugauuguuuuucaagacaaggguuucuccguauagcccagaguauccuggaauucacuauguauaccaaauugggcccaaacucagagauccaccugucucuucaagugcugggauuaaaggcauguguaccaggcuugguggagcacgccuuuaaucccagcacugggugacaagaggcaggaguaucacugugaguucaagaccagacuguucuacauaucaaguuccagacaaacagaaacauagaacagaaauaccuugucucaaaaacagcaacaaauguuaggcgacaaaccaaagcaaacaaacaaagaaaaacaagccacccaaacucaaaaccgccugaguuucaauauuuauauguauauauauauuucaauuccaacaauuccaaucaucguuggcuguccccuggcuggcuuggagucagaaagcccaagagggcaucuauagcuguaucaccucuggggcaaggccgagcuaccagugcgcuugcuucagaagcgcagauacuuucucugcuaugacuuacauccuuuucccaacaaauccuccaacauacuuucuaaaaauagaaguuucaaauugcccccagcaaauagccuccuguacuucuaauuagcuaaaaauaucaauaaacuuaacagacauuucucacuucuauauaugcgauucccauuuuaaaauguuuuaauacagaagcuagauauuuggaaaaaugaauaagcuuuuucugccaaaaggggaaaaguacugaccugacaauauccuauggcaccaauaaacagaauaauaccaauaaauauuagccagaauuaugaguguguguguagggcuagccacuuagaauaaucaaugagagccuucuucccuuuccucagcuguagccuaccuauccucccugagagguagccccuacagacagacagacagacagacacacacacacacaccuacauacacacauacacacauacacacacacacacacacacacacacacacacacacacacacuucuagaaaacugaggcuuagaaaaguggcguaucugacucugaacacuaguuuaacuuuaaagcccaaauccauagucacuguggguuuccauuaagacuagcuggaaucaucagagagccucugcccucaauucccagacucaugggaaggcagcagaagguacccaaggcacggauggucuuccauaggaaauguguggcuucacuggagacuuacuaaaacuccugaaacaccuguaaauauagaagaccccagcagagcugcuggggggcgggagggggguugagaggaacuguuugugggucaaccacuuaucuagggugugucuuauguuuugguuugcuuauggucuugcaaauagccuugacucaagauuuucccaccucagccgcugauguacugggacgaggaagaugagacgccacaacuagacucaaccacgauuuuaauguggguucgucuuuauaguagaagcucuuuuuucuguucacuguacuugucuucagugaaaauaagaugcaacuaaacucacagcagaacacucuagaaacugucagccauggcuucccccucccaucuggcuaauugcuggaacaucuccacggcugcaaacugcucaacacauucuuagaaaagcaaaggcuugagaaguagaaggcaggcucaauucaaacacccccucucucccuauuuuucuuuuaaaguucuuaggcaauuuuucauaaugauuuguauagcuauguguugaauugugcaucccugugagacuguagcagacacacucugugucucucauucccacuguuggaaagucgaaauaguuguugcauuuacauaauugaauaaauauaugauucucuauaaaaugauuaauguaaaaucuuucuucuucuucuuuucuucuuuccuccuccuccuccuccuguaugcgugcuaugaaccaaacucuuauauuuuugguuuuguuuuguuuuuaaagauuuauuuacuuuauauauauauaugaguacacggcaccuaccuucagacacaccagaaaagggcaucagaucucauuacagaugguugugagccaccaugugguugcugggaauugaacucaggaccucuggaagagcauucagugcucuuaaccacugagucaucucuccagccuccaaauguaacauuuuuuaaaaaaaaauauuugugcugggcagggugguacacaccuuuaauccuagcacucaggagucagagguaggcagaucucuaugagcuggaggccagccuggccuacagacagagcuccaaaacaacuagggcuaaacgaagaaacuggcuccaaacaccaaaaccaaaccaaaccaaaccaaaccaaaccaaacucuguguguguguguguggguguguguguguguguguguguguaugggugugggugugggugugguugucuacacguauacaaaugcaccucaugugugcuuugugaacagaggucaaaagaagaugccagaugccuuggaaccagaguuacagacaguugugagcugccaugugugugcugggaaucaaacgcagaccauccccaaaagcagcucuuaacugcucagccaccuccaucaccaucacccgaccucucuuaagacagacagacuuaaacgagcagggucaucucucagaauacaguuuucaauguaugccagaauguuuuggauuuguaauagauaauccauagggcugauacaguuguccccaauugguccagaaucagaacuuauccuacucucaaccacacaucugcaguaacaaaguccaaaagugcucaaaguuucuuauaugaauagcacaaaaugugcauaugaucugcacacaucuucuuauauacuuuaaucugcucaguguagguuaaacacuaugucaguacaugguauaccuuauuauuuagggagcacaggcaaaaacaaaacaaaacaaaaacaaaggcuguauguguuaaaugcagaggcaagcuugccuuccaaauacuugcaaucucaacuugauaaagucuagaggagcagaaaccauaaauacugagacuuacuacacaaaaauccuuuuuauuagaaaaugcaguuuuagccaggcaguggugccuuuaaucccagcacucaggaggcagagacagguggauuucugaguucaaggccagccuggucuacaagugaguuccaggacagccagagcuacacagagaaacccugucucaaaaaaccaaaaaaaaaaaaaaaaagaagaagaaagaagaagaagaaaguagaaagaagaaagaagaaagaagaaggagaaggaagaaggagaugaagaagaaggaggaggaagaggaagaggaagaagaagaggaggaggaagaggaaaggaaaggaaagaaaagaaaauaaaauacaauuuuagaaacaaacaauucagaaauaaaccuuuggagcaaaagaauguuuuuuaaaaaguugucuccccacucgggaggcagaggcaggcggauuucugaguucgaggccugccuggucuacaaagugaguuccaggacaaccagggcuacacagagaaacccugucucgaaaaaaaccaaaaaaaaaaaaaaaaaaguugucucccgaagcacuuuuaagcuagacacuuuuguacauuuacuuaagacaauauuagauguauuuucauacuuugaacugaccugccuugguucuuacaugaaacaaucacaacuguuucucuuuccagucuuaaucuaaaagaaacuacaauaucuaucuacucaauauuaaugcaucacuauauuucugagucccuucugggcguccccuuugccccaacaaugccucuauguaguaagaagagucaaaaaugcaaaauccaaaaaguacccaaugcucagaguccagaucaaguguagaagaugagcggggaggggacugaaguccaggggccacgucagagaaaaugcuucaagugugacgaaugcagacagcaacaguagaaaccaaaucacgauuaggaagaagccuggugaacucagagagcagaaaggcaaaaaggucaauguguucccaacggaggacaugagagagagccggagcuaaggcaggaaccgccagaggcgagccuggagagcaggauccaccagcaugcagcgaaaggcaaaggaggcaaacagaauggaugugcucagcaagccacccacggcuuccuuagacucgcaggccuaaagugucugucuguccuugcugcugcugacgauaggcaugucccugcuuugggguuaaugagaccucuguguucuagauggaagaugucaccagauuuuucuuucugcuuuccuauaaugaggaucagcaagccagaaguuuaaugugguaaguuagugaguuacugagucuuaacuaauugacuaauauuugucaaucugaugcccucaacuuucuacucccucaaaccaaagagagccaguuguccccaacugauggucacaggucucccuucuucauucaaucauuaacaaauccuuccaugcuggcauugugcugaguaggaaggaaacaauggugaguuaacaccugccaaccuccugcucauuaagccaucuaugaggaaccucuguccccacugccuaacauacaaaaaaaaaaacccaaaaaccuuaaaaaugugauguuccaggucugaccucacugcaaagugugaagaaccauaugcuuuucccugcaucuaucccuuggcccagguaacuuacucauguuacaucauacaugggaugauguaggauuccauggugauguugcuaaucugagagaacaaauuagaacguucuaggauguacugcuauguuccagaguccuaagcacagugaucuuucaucagggcugcagucaggcccaggagagacgagaaaacaacacaaaagagguccccuuccccgcugucaggcccaggaaggaagccauaccucacaccagaaccagcaccuaaaggugccgauuuguauuuguacugcagccucuacgcuuccccaggaucagccaggccucaagucugucuccacuuuccucccuacaagacuccuggggcuggaauuuagugagcccuuacuggccggugugucaaucaagagcagguuuaaggcauguacuccucugucuggugucuuccccaggcuaggagacacagaaaagggagggcuaugaacaaaugagcaaagguccagcuucaacugccaaaaggucugagacacaaagggauagaugaagaguacguggauuccuggaagugcagaaagaguucaugggaaguagagaacucaagaugccauuaucccagagugaagcagacaaagggagaaauagguccuuguauuaggagccauggcagagacagaggaauccaugaaauaacgucaucaaagcagaaaggaauuccagaaguaauguguccacaaaccaagaugacugaacuuuuucaaucuaucguaccugaugcucuuauccacuccacugcccuaacgccugaaauagcaaggcaaucucuacuacacccacacaugcacagugagugucccaugagccaaugaaguagggcgggucugaccagucugcagcacccaggcugacacacacacacacacaagauccugccccacggaagacaaggucuaaauugauacuuuaauuuuaaacuauuuuuaucaagggcagcaaacaaagucuacagacacauugucagauggaguuugcuuggucuacugugugcuuuaaagagaaaaagagaaacaaacaaaaaucccacaauucuguggggggaaaaaaagguugccaucuugcucuggccggugacaacagcaggcauagccucuguguucuuccuccucuggaucaaggagucuaucacaaggcagguuuucaugcugcugcuucuccuaagccuccauccuuccagccagucagugucuucuucaucuuuccaaguucaguuugaaucccagcuuacucauaaagagaaacaacucacugugacuacuccuuuugaguuuccaucacuuuucuaucguagacacacaggacacaagggccauggagaagcugucagcagcacaacuguaccagaacaagcaaaggucugaguucacauccaccaugacauguaacaaaaggcauuagaggguagcaagacagcucagcagggaaagcucuugucaugcaaacauguccugaguucaaaccccagacucuacaguggaaagaaaucagacuccucagaguuauccuccaacuaccuguugcacgcauaccuccccaagcacacaguauacaccuacacauaguaacaauaaagauuguuguugucaacaacaagguacuaggaagcagaaccacaauguagcugcugcuggcugaaguagcagcaauaaucuacaguguucccacuucccaggugcagcccagaggcuucgcuuacccauuuaccaugacuguaaccaccggccuaaccuuuaccuaucaggaugcaagccugucagucacagagggagugaugcucacaguugagcauggggaaugaaucaaggaccauaaagcuaaggcagucaaacagcccuaagucuugucuaccauaauccaugcccaaacaacacaaaaaagcaaagccuuccaauuauuuaaagaaauacaauccaaguuguuuuuuuuucaauuuucagauaaucuaaucauuucauuaaaaaaaaucacacccauguuuauaaagauuauuauauaucuagcagaauacuagauuuaaaaggagauuuaggugccauuauuagaauacaaauuucuuaagauaauauuuauugagaucuaaaucauaacaacuaggaguaccuuauggaagucuuuuuaaaucugaaaauuuaaauuuguaucuauaauuauaaacacuucuuugcuccauaauuagcauaugcugaaacagucuauuuuuagggucagaaaaaaaggaagaagauaaugaaaaugaaaucaagaagucgccacaguguuaaccaccugguagaaucauaccuuugaacggagugggccaaacucagacagucuuuaaaacauaaaaaaauuaaaaauaaaaaaauaaaccucugcaaagaaaaugcagccacuaagcagcaacaacccggauggaugaccaagucaugggaagauaaacacaggauguacuccgugggacugcauagcuaugacacuagagaacaggacaguagagacaccaaguucgucagcagcugccucuugugaaggacuaaucagcaagggaagccugggacauugcaaugucccacagccagcaaauggccauaucuccuugagugcagaugugugucaaauggguacaccaugaggcacacaaaucacaccucagggguuaaaaaaucuagaaaaaaacuggccuaggagucucauuuaauaucaaacaacuuaaaauuuaagcucagagauaaacagcugagguaaaauguuaacaagauacucagaaaagagaaaaccagaaaugacauacaacuacaauggcaagcuaaggcaaacaacaagaguuuaccuaacagcagaaaaacaguagcccagagggcagaguucagcagcccuacaucuuaacaagaacuaaaaugaugggaaaauacuuaaaacaugaagagggaaaagaaaccaugaaccagugucaaacuguaaaaauaccacgacuggaauaaacacagugucuauaguauuaaaaaagaaaggaaaagaaaacccaaguauguucauuuaacaccucuuugcagcaaacacuaaaccgggcuggagcuggcucuggacgccagcguccccagcaggaggcucggaagcaucuguagcuccagcugcaaggccuccagggcaucuacauacagacacaugcacacacauacaaacaauauuuuuuuuuuuugagacaggguuucucuguauagcccuggcaguccuggaacucacuuuguagaccaggcuggccucgaacucagagauccaccugccacugccucccgagugcugggauuaaaggcgugcgccaccaugccuggcuacaauaaauauuuuuaaacguaugaaacuaagauagaguuuuaaauacuuucuauuuacagauagaaaggccaacuuacaaacacaugaaaaucuagcuaaccucauaauuaauaauccuaaauauuuauuaaucauuaaagcaaaaugaaccuuuaagucaucagacuuaaagaacaggaauaucaguauaacagaacagaauguaucauuuuaauuaauauuuauuaacacaauucaaacauuccuauacucagaacugucccaaacucccccaucccucaagcaaacucuccuccgaucuuuaacaaggcccaugaaacugaccuuguaccucuuugccuggcuucauguggccucaggaccagccucuccuucccuaccacagccccucucuucacacucucugccagcugacagcugcuacugguaaaauggcuauuauagaagguugcauucacuauuucacauaagcaauauggauuaauggcucugauuuuuaaaaauauaaggacuggguauggugguacacaucuuuaaucccaccacuugggaggcagaggcagagggaucucugugaguucaagacuggucuggucuauauaguaaguucuaggacaaccaaugcuauguagagaaacuuuuugccaaaauuaaaaaauaauaaauaaauaaacacccagaaaacaaacauauauacgaauauucauacauaauaagcaaauuuuacuggcuuuucaugagaagaaauauaaauaagcaaauccacgucuauacuuuacccauuugcaauaaaauauaaugaagcacggcccugcccuuugcacacuguguuucuuucagucugcccauuacuuccuuuccuguauuguugugcaccuggauucuggcugugucccaccuugguucugagaucaguggcuguguaacacagagcacuuccucuagcccucccugccacuccuccucacagggacucgcugcuucacagcacuuucacuauccucuggaaccagccuugccugcuuuucugagcaucaagacugcagagccucauccacgugguucucugcaguguccaugacaugcugggagggguucugugcaugggaacaaauaaacacccaggacagcagagcuacgagaacugcagauggauuacaacggugcucacaagcuucuuuccuuguuuuacuggucuuuaaaacuagcacagaaagcaaaacuccccugcuacugguuaauggcaguaguaacacaggccacugcuuagaacagagagcuguugugacuauaguuccuauacugccagaaaagauuccagggggggaaacuauguaacucaggaaauuaguaauaaagguagucccaggaaauccucauagcuguccucaaauacuuugguuuuucucugcuaccagaugggaucacaccccaccaccacauuaauuuuaaaugacauaugccaacgugaguguggccaauuaaugucacauaccaaaaguccacgaucccuuguuccuguguaacuacaauaggacagcaccacgacaauccagagugugcagcaaagaccagggaauaagcuggggcuguguuaagccacugagcugggcagcuguuugccacuucugcaaaccugaguauaccugggcugcuacagugagaggcuuuauacaucugacugcugcugacugcaaagcuccuuuuuucacucuggaaugaccaucucuugguccuaaagucuuccaucacaaagugggaauucuaaugccugcauuucauagguuguuuuuauaagaggagaauauauauacuuaacaaagagcuuggcaacugugcuaagaacucaacagauacaaaauggaauuaaacuguagcauaucuaagcuaggcuacuuugagccuauuuacauugugccacuaaauaaccuaggaaacaggaaaauaucacagagaugaucucuaauucacaauagucuaagauacaaaagaaaaaaguuguaauugcguuggcuuuaccuugaguuuaguaggauguaaucacauuguaagucuaggagcaacuguauuggguuaguguggaauaguagugaggaaacaaaggauagcuaugaccuaaaaacagaaaauacaacaugagggcaaaggugacuccgacugccagcuaggcacggcagugaggaggaacaaggacucaccugcauagcaaacuaugcucccucuugggaggagagagacagcaagugaguggguacugagugacaaacaggggagagaaggaaaaacaaagaacucauguucuggggguguauggagccccagaaauggcugcagagggagagccuaacaagcuaccucuggagggggaacuugggacacgcccacacagaagagggguguguucaacacgggcaugcuuugagagcuaucaccccuccuagaggauucucauaagcaacaugacccgacccagaucauccccgugccucaacuggcucauucaugggaaagaaaagagucugugcuagugucucagagaccacagccaucauaggacagcgcuaccugcuaagccgcaaccgagagaugcuaaucauuuccuggagagaaaauuccacccaaccaagaauaacuucacgauuuuaauuauaaguuaguuuuacucaaguucaaacuuuuucuacccgaauugugucauguaguuauuuagaaauuuuuaguacaaucugacugacaacaagagugauaagugcaggaacaaaacuauaaacuacucugaauuuuuuuaauuacaagaacaauuguggaugaauguaguguuccaauuuaauaaagaaauuugaaaguacuaaaaguuuuagucagaaaaaguuaaacagucuuauauucaaaauaaaacuuuccuuauugucagagcauuucaaucacacacgagucagacaugcgcugcuuguuagagcacuuacuuuccuccugauccuuggcgucaaaggaagcccugcacaaaucuaagacuaagccuugucacagguaacaugagauugcuagagagccaaaagcugcaaggguuaguaugacaccucuccugaaauagcaugcacacuuuuuguuugacacaacugggauguacguuaaagcagaaguauaaaauaucagaaacuaauaaagucuaaacacacuugguucguauagacucaguaggacaugagaaucaauggacaguuaagccuaagcuuaccgucagcuccucagauaaaugagcacagaauaccacaccaagaacaaagucugcauucaaauuccacuuugggaagucaccaucacuccgcccagaacugacuccucuaacgagccccagacgcugaaaagccaaagcugaugaccagguucacauuaagaaucaaucuuaaguuaggaaaauaaaugaaaugcauacauaaauauaccucugauggaugauccccaaaaacacauucugcuuuuuuccuaacugcucaccauuucaacuauaagcugccuucaaaagcacgucaguaaaucuucaccuauuacuguaauggagaccaugugcccaugugcucgccagauuccuguuuaugagguacauacaguccuguguauuaaaauaaacuuaucauugauaaugaaagcaaugaaaagaaaucaaaaugacccacuccaacaauucaucucucucaacgcaacaugggacagaauuuauuaaacuucaucaccucauggaauuaugcuugggcuuucuaguuagaaacaccuggaaaugauuuuuuuuuaaguaucuaaaguuucaauugauaagauacaaaauguuuucaagucuuaaaugguuuaagcuaugaaguaauauauauauauauauauauauauauauauauauacacuuuauauuuuuauuuuucacaucuuuuaaaaauuugcuuauaaaaaauuuuaggauaauguuucugacauccauauuggauuucuuuuuuuguuuguuuauuuguuugguugguuugguuuuuuugagacagggucucucuauucuguagcucugguuguccuggaacuagcccuguacaccaggcuagccucaaauucacagagaccuaacugccucuaccucccaaaugcugggauucaaggcaugcuuacaaaaacuuuuaggagauuguuucugacauccaugucuguaacuaugagaaugagacaaaaaauaagaaaauugcucuagaaugcauuaaaaucacauagcuaauaccacugaggcuacguuacagaaauaucccauagcagaauaguuuaaucuccugguaaacacacauccuccugcaaaagaaaacaucuuacauuucaguaucugcauucugugcuuuauacaaagaacuuucaagaacaagauacuugaaaguuuguuugagcauuagugucucuaaaauugauuuuuaaucucaguaaauuacaaaauaaaaaguucagagaacaaaagauugauauguaacaaacaaacaaacacaaaaacccuaauucuaagugcggcaaaagaggaguuaacaaaggaaaucugagcuaaaguuccugaguuagucucccucaggauccaaagaaacaccaacacacuucaaguaaugcgcaugcuacaccacacacaacucacacuacgcaaacaaaggcagggggguaacgguguuaggaaacaaaagcaaacauacaggaggaacgaaugaaggagugugccuguguugcuaucuuuaaaaaucaauagcuuaccuaacaucuaggucaugaauuuguauaaauuuuuauuuuuaaacucaccugaugcauuuucaauuccuguuguguucuguaaagauacacacaacaaagaaacuucuuugauuacaugagcccuaaaaagaaaaacagacaauuguaauauucaccugccuauaaguuuacagugauuuaaaaccacauaugaacuacagaaugugcugcaagggcuauucauaauccaugccaguuaagcucaguccacacugacaacuaacgucucagauucauuauaacaauagauaaaugcccuucucgcuaaaccuuacuaggauuucaguguacucuaucaucaaagcaguaucaucaggaugacauauuuuuuuuauuaagaauuauaucacuccuuaggagaaaucaauuagcuguguuaauagucagaaacacaaagccugaaggagggaguaaguggugugcaaugaagauaaccuucuuuugcuuucaguauuugcuacaugcaaacacaauuagacuccauuacucuguuuuucaagcuccugaagcaguaagguggauugacuacauggaauucucuucaaagggaagaauaaaaagcagacaguaccaugcaaaggcuuuuuuaaaaaggucuggaaagagcuacaauuauaucucuagaguguuacguuugacauagucagacaugacaacgaaaguucuuguaaauacauauggcauacagucauauaccucauaacaauaaugcaaucaaccacugaccacauauacagugaggagccuaugagauuguuuuguugugucgugguguagcacuggucucagcaaugguguaccaguacauacugacaugcagaaacaaaacugcccaugauacauugucagaacauucccuuaagucacuuaugucacuguauccauuucuaaauaauaaucuacuagagagguauggugucacauugugauuccagcgcuuagagacaggaagauucagaguuuaaggucagccugagcuauguagcacuguuaucuuuaaagucaaugcagggcuggagagauggcucagugguuaagagcaucgacuacucucccagaggaccuggguuacauuccuagcaaccacaugguggcucacaaccauguauaaugggaucuaauguccucuucuggcacacaggugcacaugcagaaagcacauauguguguguguguguguguguguguguguguguguucauauacauauauguguguguguguguauauauauacaucgccuacaggguaacuguccgaugugacuauaaauaacgcaggggcgugugauauaaugauacacauuuuagacgggaaggguaagaaggaacagugcuuugauaagcuguguguguguguauauauauauauauauauauauauauauauauauauauauuuuuuuuuaaaguugauacaguuguuucuauauaauauaugccauuauaggcaugaugguucauaccuguaaucccagcauuuaaaaaguuaaaucaagaguucaagguuauccugaguuacaugagacagcauccaaaaaauaaaaauaaauuaauuuaauuaagaauuaaaaaaauaauuaaaaaauguaaagcuacaacauguuuuaagugaauuuaugauucuuauauacaaauuauaacuauucaguagacucuccacuguagcacuguaaaugucuccaguaagcacauauaaacauaccaugaaguauaagagaccaagacacaggauuuuucccuguccaauuacauuacuuccuugaucuaggagacaucgccuacaggguaacuguccgaugugacuauaaauaacgcaggggcgugugauauaaugauacacauuuuagacgggaaggguaagaaggaacagugcuuugauaagcuguguucuuagcuaguucuaaggggaguugccuuucuguucuucccugagcuguugggaaccaucauggauggcuuuuuuuuuuuuuuuuuuuuuuuuugguguuuuugagacaggguuucucuguguaguccuggcuauccuggaacucacuuuguagaccaggcuggccucgaacucagaaauccgccugccucugccucccgagugcugggauuaaaggcgugcgccaccacgcccggcucauggauggcuuuuaacaagcaaggucuuauaguuaaaucuggacaugcucaucugaacuaaguuuuauguuuacugugcccgaggaauguauuccacagcaugccaucuuguuacaugggucaguucugguuauauucaauagauaaaaugugaagguaacuuaaacaucuuucucauagauauucaauaagaccuucccuaggauauguauaaugcaguaaacacaacugccccuauagccugagacuuaaucuguuauccuauuugaauguggcucugggguaugaagaaguccuaaggcccauggucucuuagauaugcauaccugaggucacuggcuacuaucaguuccucuaggacugugugacaucuuaggcuccaguuuucuguuaccuucuucaagcuuuuacauaugaguuuauaaauucugccaugggaacuucuuugaaaaaugagaaaaauacuaccaccaacuacaguauuuugcugagagauauuggaagguaagacaccugugccauuuuccuuagugucacuuuucauucuccuaagacucaacagcaucacuguaacuaucacaaaugaagcuucuuccagggacagcaggccugugccaucuucacacgcuuccuuuguucugagggaagcauuggcgucuucagcuucaggcagaauuagaaaaccuggccauuguguacaaaccugcuuccugcuauuaguuaauuguguggugcugcuguuugauuuuguuuggguuuaugcugcuguaauuuaacagauuuccugggcuauucccgugucaugugacugacuccauugaaauguacaguucaagaguauuuauggacugagagaugauggcucacuuguugcucuugcaaaagauucagguuccauucccuauaccuaaaaguggcucacaaccuucuauaacuccagaucuaagaaauucaauacccucuucugaccucuguagacaaccagacaugcacauacacauacauguauauauguacauagacauacaugcaggcaaaacacucaucauccacauaaaaugaaauaaauuuuuaaaaaagauuuaguuuauguauaugaguacacuguagcugucuucagacaccccagaagagggcauuggaucccauuacagaugguugugagccaccacgugguugcuggaaccucuggaagagcaguuagugcucuuaaccacggagccauaaaucuuaaagagaguauuugccauacuuauagaguagugcaacugucaccacaauccacagauguuuuugucaacacacacacacacaaaaccuuagcagugacaacaccugccccaacuccuccugcgcagccugcagcaucagcaacaacugacaacuuccugucauauauaguuaucaguucugaacauugcacuucgucaaucaagagaagucauggcaaugaaugaccuuaaugggcuuuaguuuacauuccagaaauuagacagcacuuaguuccacacaagcagguaaguggcccuucaccugcgcacuacuccuuccauccugagcacuagugggccacaaacaggaaguucccugaccucuagagaaggggcccgcaaugagcaaauaccugaaauguggagaaagugcuauacagaaaagcagagaaaggucugcaucacaaucugccuguccccacacaggcaacugcugccaauccaacaagcugcucuggagacaggaagaagagcugggaccugagaaggugugggaagaaagaggaagaacacaagagacuccagaauaugagcucgaagucuacaccaagguggucacuacuugcagguggcagugucaggggcaaagacagugcagagugcugguuauggcauggugaaaaagaaggaagaagugacuggguccuggauaaguuuaccaacgagccuguaacuuuagcugccugguuagagaugaguuaggaaagaaaaagcaaguggagaugaaccuggguccccacguuccguucccagaagggagaauguggcugcugcuugcaggggugcugcccuccccuugugucuggguugcaguugguuuccccucuuuauuucacauuugucuucuuuccuuuccuuacccuuuguaguuguuaacccacaggcacaauucaaauagcagaauuaucugcuaucugacacuggacagauaaaacaguacaguguuuaaaacauuucuuuuugaugcauuuagcuuaauaaauggcaauuuuuuuucuaauuuaaaaaaaaccuaccguguaauaugaguugguacacgaugaagcacagucuaagacuuccuauaccucccccuccauguccaaacaaaaacccauucaucauuucuuguuggaaaaaauaaggaucuuaaccuuuucuuuccucuuuucuuugcuucucuuucuuucuuccuuccuuuuuuuuuuuuuuuuuuuuuuuuuuuuuuuuuuuuuuugguuuuucaagacagaguuaguccuggacgucccaagugcuggggcuaaacguguguaccaccacaccacaccacuggcuuauacuuucacuuuuuuuguuguuguuguuguuuuuuuguuuguuuuguuuuguuuuguuuuucgagacaggguuucuguguagcccuggcuguccuggaauucacucuguagaccaggcugaccucaaacucagaaaucugccugccucugccucucaaguacugggauuaaagacguacgccaccacuaccuggcucacuuuuuuaaaaaaauauuucuuuuuaaaugaguacacuauagcugucuucagacacaccagaacaggguauuggaucccauuacagaugguugugagccaccaugugguugcugggaauugaacucaggaccucuggaaaagcugucaguguucuuacuuaaccccugagccaucucuccagccccacacuuucuuuuaaaaguucacuacauagucauguuuacuggacccucuucucuguuacuucuaauccuaaccauuagaaaacucaucuuuguagguaagggcacuugcugccaagccugauagccugaguucaauccccagaacacaagugaauagaaagaaccaauucucucaguuguuuugaccuacacagacacacagacacagauacacacauagacacacacagggggagggggaggggguacucaugcacccauacauaaauauucacaaauacaauaaauaaaucuaccuuuaaaaaaauauuuccaaauaacagaauuauuacaaaaccaauaguucuuagcugauuuuuuagcauguguacaugcauaguauauacaagcaugugcacacacauguucacaugugaggagcacaccaguauguaagugucuauaaacuugugugaacacacacauggaggucaacagguugacauaugaugccuuccuuaguggcucuccacuuuauuuacugagugaggauuucucacugggcccagaacuugguaaaucagcuagucuaaguaucuggccugcccugggauccugcgagcacuuccugagggcugagauuacagagaggcgagccacuauuuuuauauuggugcugggaaucugaacuccagcccuuacacuuuugcagaaagugcuuuuuauccacggaggcaucuccccagucuuccuuuaaaguaugcuaaaguaaagccauguaugguagugugugccugucacccuagcuacucaggauagcaagaucacccuugagucuaggaguucaagacaagcuagaacaaccuagcaagacccuaucuguaacaccaacaccaacaacaaaaacaacgggaaacuguacugaacugaacagcuccuagccugagacugugucuuucauuaugggcauuuagcacuacccuaggccaucaaugccagcagugccucaaucauuuucacaacugaaaacaaaacaaacaaacaaacaaaaaaacccaaaaaacuaaauaccuuccuaaacacacgcucaggggcucagaauaaucacgugacuaguauaauaacaucacaugugcuaccuauagcaaugacacacugcaaacacuauucugaaguauccuucuuaaggguccaccagcacugcucacaagcccuaaggcccuggcgguacucugaguuaacacuggcuaagacagcaucacuuucacauucccacuuagcuaguguauggcaucucaaagccaaaguaauccacaagagauccgcaauggauccuaucaggacagagaagaaucuucucacacagaucaucaaaaccauuccagcaaaugcuuuuuauaauuuuuuuaagauuuacuuaugggggcugguuggcucagugguuaagagcacugacugcuccuccaaagguccugaguucaaaucccagcaaccacaugguggcuuacaaucaccaguaaugagaucugauguccucuucucgugagucugaagucagcuacaguguacuuacauauaauaauaaauaaaaucuuuuaaaaaaaaagauuuacuuauaugugagacuguuucaccugaaugcaauguaugacugccacaugacugccuggcacccacagaggucagaagcaggcaccggauugccuacaaguauaguuacagaugguugugagcaccaugugaguacugggaaccaaacuccaguccuuugcaagaacaagugcgcuuaacugcugagccaucucuccagggcaucaaauucuuuuuuaauacuaaaaauucagugcuucugauuuucuauuuacuagcaaauacugaaaauagguagaaagggaacaguaagcagauacauaagcuuugaaccugucaaucucagucaucaguuguucacaaauagcauagaagcuugaaauggcacaagcuucaacaccaccauagguuucuaaaguucuaaccacaugcacacacuuacucuuuuuagauauacuuauuucauucuauguauacggguguucugucugaacguauguauauaccauguaggugucugguguucacagagauuagaaaagugucagaucccuuaaaauuggaguuagggguggcuguaagccaaaucuggguccucuccaaaugcaauaagugaucuugaucacuaacccuuuucuccagcaaucuuuuuuuuuuaaauagugucuaaccuaugcuaacaguucugaucccccuaacucugacuucugaguguugggauuacaggaguguacugccauuaguaguuuauagugcuagggagaaaacccagagcuuuugccaugcuaggcaaagucugggaacuuggcagcauucagcuguccuuuucaaagauauuguuuucaaauucugcaacaaucauccuuaccaauauuaaccuguuaauauaagggugacuugauuacugaaggucaguaccaaaaaaacaaugaaaaacgacucaguucucaguaucaaaacaaucugaacaacuaaaaagaugcuccaaagaccugacaauggagcugaguggcuaucuugacccugggugugcacagucaccauccacucaccauccucugaaauuagaccaaucuaggggaagacacacuagcacaaaccaaacagauguggcugguuaugcugucuuugugcacaugugcaaacuugggacuuuuacaaagcuaagggaaaagcaauuauuuuuaaaguaccaguuuaugucuaggagaaaggaagaaugaugaaaauauuuaauauauucaaccauaaaucacucagcuauuuuuaagaccagcuuagaucucuuguucuuauuugaaaaauacuguaauuaacuucaaacuguuauuuuaaaauuacauuaauuuauuguaugcauguguauauguauguaaauauguguuugccacuaugcguguguaggggucagaggacaaccugcaagagucaguugauucucuccuuccauaaaguuccaggaaccaaacuuuuguugcccaagauaauggcaaaugcccuuacuugcuaagcuaucucucuggccuaaaagucauuccugccacacguguaccaccaaguagacaauuacuauauauguuacagagcucugaggucaacagcccauggcucuagagggccuuaagcaauuaaacaccaucauauuaaaauguccaguaggagaccagcugauaucauaggaaaguacuauaaaucugcacuuagacugcgggcacccagggguuuuccaaccaaauggaauuuuuuucuaacuuuaaaacaaugguucuugaccugugggucacgaccccuugaggguugaauaacccuuucacagaggucaccuaagaccaauggaaaauacagauauuaaauuacaauuacaauuauggaaugcagcaaacaauuuuauggcuggggucacugcaacacuaaacuguuguaaaggaccacacacugacaaagcugagaaccacuaccugaaaacaaaaugggcuggggaucacucaaucgauaaagugcuuguugcugcauaagcauggggaccugaacucaaucacccuuguuuaaaaagaaaaaacaaaagcccagugccacagugcacacacauacaauccagugcugauacagugccacagugcacaugcauacaauccagugcugauacagugccacagugcacaugccuacaauccagugccgauacagugccacagugcacaugccuacaauccagugcugauacagugccacagugcacaugccuacaauccagugccgauacagugucacagugcacaugccuacaacccagugccaauacagugccacagugcacaugccuacaauccagugccaauacagugccacagugaacaugccuauaauccagugcugauacagugucacagugcacaugccuacaauccagugcugauacagugucacagugcacaugccuacaauccagugcugauacagugucacagugcacaugccuacaauccagugcugauacagugccacagugcacaugcacccacuugaaugcaccuaugagugcaaacaugcacaugcacacacaugcgcguacacacacacaaucaauccaucaaucaauauaaaaacaauuaaugggaaauucuucauaaaacauuacucccaagcuggggauggagcucggugggagaguacuuaccuaagaaguaugaaauaaugaguucgauccccagcacugcaaggggaagaagaguuccuagcauccguuaauagaaaaggaagagccugccuuuucuagaagcacugcaguuguggcugccauguccuauacgcguuggguggcagagaggacagaagcuaugucuaugcucaguguucugacugaugaauaucuaaaugauuaguagccuaaaauuccuugaagaaaggcaaaccugagaggaccaccggucuagcacugcacaggccuugauggcucccaggacacagagcaagccagugacuagaaaaacccugcccugggucugaggcccugggugguaaugagccccagaucccucacaugugaucacuugaggucacugggcauggagucaggcaggcagagcaaggaacaaaccugagaugaucgccagaccggcgccauggggccuggacagggaucuagccuugaacaaccaccaguugggcacugcacaggccuggagguaggggggaugacaccaugcccaacaugaccccuguccaacacuauaauucauaagucaggcacuccugagcuaacccuagacacucagagagcccaggcaccaccaagagaagcaagugguggagaaagggaagagaaaaagaaacagaaggaugugggcacaugaagagaggcagauuuagagaccugaagauaccugaugugaauagcuggugauaccaccuaggaccauggugggguccuagccuguucugccacuggagagaccaggccugggaucuauuaccgcccucuuccuucaucucuugccaucuacgacaggcacaagagcuggccccagggucgugagagucggagaacugaccaugccccucaccaacugcagcacucagaagagugggcccuguaucucgccaggcagcaggauagagcuggcccugguugggggugaggagguguugcuggugacccagacccaaaggcaugagggcaugagagcaggagagcuggugggcuaaccagcucggauacuuguccagguaucuuugaauuguaucuuugaauuggcccaccucaacaucuaucccauggaugagugcaugaaggggccaauccuacagauccaaaacuauacaaucuccaugaccagggcaacaacaggauauccaacaggaguaauagcagggcuccaguaucaaguagaguagcaaaagcuagaggccacauacaagccaucacaaugaacaugugcaagcaaggaaguguggaccaagggggauacugugggacacacugugacacacuacagcuuccaucagacuuuuuuccucuguugcgggggagagguugccagggugaagagcggguauggggagacugggaugcauggugugaaauucacaaagaaccaauaaaaaguuaaaaaaaaaaaaaaaagaaagaaagaaagaaaagaggaaaaggaaguaaaaucaacucuucacuaauccucaaaauccagccucaagaagaacgucuaaagcaaggagugauguuaaugcucauuccacaguuaccuacaaagauuuaguugaucacuuugagugaccuuuucccaucagaguucccaaaacagcacuacuuuugugguucgacucugagaaauauucaggauucuugccuaagcguuuccugaaaagcaaaaaaaaaaaaaaaaccuacagcaacacagacauggugaacaugauccacauaaguuucauuuggucaugcuucaaacacuacaugcagcccuucagauuuguccaacauacugcagaaugcaagacagcucaucuuggacauaacucacaccugugaugggcuucccuacacuauaggugaacagcugagaacugcagccgacaccagacacaucaccacuggcacugugcuugcucaagguacuggccacguggacaccacaagguucaccuaccacuuuagugacuagauuuuuuuauuuggagugggaguuaacuuguauaaucugagguuuguauuuaggcaauaaauguguaacaacuguucucaagaccacuuacacacaguaacaguaccuacuguuuacaaaguguauacacugcucuacaguuuuaaaaagcccuugaaugcauuguuguuguuguuguuguguuuaagaaagacgcauuucuucaaaauaacuuauuuguaauucucaauucaacauaaaagcaaaugucuaggaauuuaugauaaaaacaugaaaaaagucucuucauauugguccacuauuuucaauaaaauaguauccccgaugcaagggucuagaaaguaagaacaaaacagguagggacaguucuaggggccuuuggaucucagguuaaaucugacuuugaccuugugguaaguguccuaguuugcuuucugaugaccaaacuuggggaggaaaagauucauuccaccuuacagcacacaguccaucaccaaggaaagucaggacaggaacuuaaacagagauuguggaggcaugcuauuuacuggcuugcucauuuuggacuaccuguccaaggcuggcacuauccacaguguacuggcccucccacaucaaucaguaaucaaauaaauguuccacaaacauaccugcaggacaaccugguagaggcacuuuuuugauuaagagucucucuucccagaugcccuuagcuucugucaaauugacaaaaaaaacaagcagcaccauagaacucaucagagaguguugcccucugccugcucccaagcccuggagauccaucuguaggcuaagucagaggugggaaugcugaaaagcagagccagcaucaccuacaggacaaauggcuugggacagccauaaggaaggucuuauccaccugggaggaucaacaaagacuuucuggcugaggauaaacccuaaacaaaauaaagccucauauauaaggaaaauguaagcaaggaaccccaagcuaauaagcaauuagagccguuuuaaaccauggaagguaacuaccaaggagggccauaaaaacaucuacaaagcaagcagccaggaacagggaugggacugggguggcaugugggauccaugcuggcaucugaugcucagaaggcaaacauccccaaaaaaagccacauccaucaaaggggaaaacugguccccacacagaagggcauggaggucagagauagagaugcagacauuuuuagucucccuaggguaccugaaggaagagaacugccaagaggagaaauaugucuauaguaaguagaugcaggacuugaaaucgugaaacugaauggaggagucaccucacacuauauccagagagggaaauauccuaacaaggucuaaggacaauucucucaacaacagauaaucucucucaagaccugcugugcuggaaauaucuaaggaaauguuaguuuuucaaaaauauuaaacuacuugcgggcuggagagauggcucaguggugaagagcacugacugcucuuccagagguccugaguucaauucccagcaaccacaugguggcucgcaaccaucuguaauaguguccgaugcacucuucugcugugugucuaaagucagcuacaguauacucacauuaaauaaauaauuuuuuuuuaaaaacuacuugcauuuuuaaaauuuccuaaaucauauaguacguguacgugugugugugugugugugugugugugugugugugugugugugugaaggcaucucaggucaaaggaacaaaucuuggguuauucucuuuccuucugcuggauccuggagagccuuaacauacuaaccuaucuugcuggccuugcuugcauauucuuuaccuugucagcucaaaauaccccagugaaaggcaaaaguaguauuuguccccaguuugcaaacauuaagaggucagaagaaaugcuaccuacaucccccucacacaccaccaccaccaccacacagagcuauguggucccaugauccugucauucuguaugcugagguaggguucugcuaaguaacacagggcuauacgcaaacacugccuccaugucuucuaacauaaguacacaucuacauuuaucccaagagccuucauuucaaaaccucuacuugcaaguguaucuuaaagccaacauuugcugaauuauggcaaagucuuuaagucagaaaaucaaucugagugucauuuguaugcuuaacauacauagucugaauaaggucuugaaaaauauacaggauucaugcugaaguauguacagguuuggagaaaucucacaguccuuuucaaauuuugaaugcaucauuuaaauuucccaugagaguuuaagaaaaucuuagaaaaacuacauguagguacauauaaaauauguagguuuuaccaauuuccagaugggcugcccacagcaaucaagcuaacauuuccacuuaacuuuacacauuucagacaagcugugccaagaaauaauucagcucuuucaaagcaaagccuaacauguaauuuguuuuuucaccaaaauagcugaaaaauauagacagauucagugaaccuuuuuucccauguucuaaggggcuaguaaguaagaacacaguguaaacaggacauggaccaagaugccacuaguaaauacuacacggaauuaagggaacacacacaugcuuauaccauugcaauuaccagguuuacuauacacaagggcucugugcacgcuccagggaggugagguagaaaggaaaagcauuccuuuauugcacugaaaucauuuagauauuccuguaaguaaaaccacucguuaccaaauauggcuccaauagcagauuuuuuucacauguuguauuuaauggugcauucucaauaguauuucacagccaaaacaaacaaacaaacaagcaaacagauaggaaccacagccaauaccaucucuacuuagaauaauuagaaauaaagauuaggagacauauuuucucccccagcagaaaguacuucaaugacauguuuuccaugaagaugcauuaaacuaaacauuucaaaaguaagccuucuuuccuuaggacaaguuuagugcauaaacccaacugguucuuuuugggguuuuuuuuguuugcuuguuuuaaaaaaagaaggaaaaaaguaguuuagaaaaguacaguuuagccaaucuucaaggaguugcuucaagucucauuuucuggaagaguuauuucugugcuauucagcaucauggaccaaauaauuaaauuaugcaucuacucuaugcaaauguauuuaaauuuuauaauaauuuaaucugcauacugggaaugcugaucccaugucaugaaaacgucauaaucuccagccuaccucacacugccauguuucuucccauaaaaggacgucaauguucaacuacagagaguuacucuauaaccacaaaagcaaaagcuagaagaaauuuggaugggaagacaauucccuucuucaaggucuaacccauagcaucuguccucagaguucuuggagacaccacagcugcuucugugauucaaccauccaacaaaggaaguuucauuuaaugagcuaguuuagaaucauuccauuuugucccuccauggcaaugucuggugacuucacagcuugucauaacuaaaggagggaccacugccacuuguggguggaugaggggagcugcuuaagcauuccaccauggacaagagugacauccccaagaaaacuaauccagcccacacaucagcaguagaguggccgaggaacauuguuaacucaccaugcuaucccuaccaacagacuccaguuuccccugaccugcucuaagaaaaucauuuuuuuauagcucuaacuaaaaauuucuaacugcaaaaggcaagcacuaggacaugacaccaggcccaaucccaagcacugugacugcuaauaggcagcaaucaaacuaugaagcccuaaaugcaugucagcaggagcagaagugcucagcaggugcucagcuggugaugucccgguugcaucuagcauucccugaagauucucugcaggugcucucugcaugcaggucugacaugcagcauucccugcagaugcucucugcaugcaggucugacaugcagcauucccugcagaugcucucugcaugcaggucugacguauccccucaaggcccacauacacuuccacuauggaguuugcuagugaaagcugcauauuugcuguuggguuuuuccccuuuacauauauuaaaacuaacacgaaacuagucagaagacaugaaaauagcaaauacuccacagugcucuccacccuggagacugugauuuaacacaccccugaaaggugucuaagucagaucuaaaguugaaaagauaucagcauucugaaaaaagaaaaaaaaaucccauuaauaaauaaauagccaguauaaaauaaucaucaaaaggaacugugugcagauaugugugagcuacagacaccacagagaaaucagggagguuacuucuuagguagcugaaacaaacaaacaaacaaaaaaagauguaucaucagacacuaccaaagcagauuuuccaguuuucacaucuuaaauaguugcagaauuuuuaaauucaucacagagaaaaaacuuccgaaaauuaaugaaaagaaaugucagacuuuagaagccuugaaaaucaaugugggauugguuaaugaaugauggcccauccacauaucagccauuaaacaucaaauugaagaacaguuaaagacauagaaacacacaacagcauaaugaaagacaagccucaucgauauacacaacauaucaauucucuauagacuauuauacagaagugcaugcuucuauaaaugaauguaugugaauaaagaaauacaagcaggcacaccaugagggacugacuagugacaaucugcuacaauguuaacaauggcuaucugaggaggcggaaguuuacaggcgguuucuauuccuucuuugugcgccucuguuuuccaacugucuuccagugcgacuguuuugcuguuuugugcuuacagagcuaauacauuauuacaaaguuacaccuucuuaucccgagcacugcauagaaaauguaaaacaaaccaccucaaaccucaacgaagccaagucuuccaucaacaaacagcgaacauucauugagcauucucauuaugucccugguucuaauaacuuuguaaaugcaucgacggcuuuuuuuuggggggggggggcagggaagggucgagcccugaaauaacaccaaaugcagcugaguguugcuuccaacaauggauuuacagcucucuucccauggcuuggaauaaagggggcuuauuaaaugaucucugaagguuuucaaagcuauggcgagauugcucaugaaaaagaaauuucaucaaauaaagugugugaaagagagcuuggaggguggcagcugcgugcaaucucaaaaacagaacucuauagaacaggaaaacaacagaauaaugucucucaguuccuccucuuaauauccuaaaaccucuuuuccaauaucaucgugggcagaaugauccaacuguagucugugcuauuguagguaaaagaaaaacaaaaaccaaaaaacaaacaaaaaaccauugggagguugucuuugcuguauauauuacuuuaaagaauaaccucgaaguaaacaaaaaaacuuugagauacaauuuuagucauguucuggggacacuguguacuagaaacaaacauucccguguuucauuaaaggguccuaagggcaaggcacuggaacuuggcaaaaggcaguucacgugucaaauacacccaaauccucaauacaugaaaugcggggggugaagggaaaccccauuucucuagguguaaauuccagcuggguaguaagaggcaacggggcuucccggcgaucugugggauuguuuccccagcucgaggcccgaccuaacgguaagugcuaggccauuggccggugcuucacgcguggaucguggaagaacacugaccuguuaaggucuauuucgugucucgcucgucacccucggagacauaguagauggaucuuuugacgaacgcaaaccaguccuauguaugcuagcgcacaccugugacacaugcacguaugcaccagugggucgaugggggacacucgaggagcccacuggcagguuuauagcacacggaaacuauacgggggugaaaaacacaaaggcucgaggcacagaaccaacucgaggauugcagaugcgcucgcacauucaacccgggacacaaaagagcagagaucagcgcagcccugcggauggggaccgcccggggcccacgugcgcuccccgccgaccccgcagccgcgcaccccgaguccgccgcgccgucaccaaacggacccgaaacuuggccgcggggacuuaagagccgcggagcgggagccuucgcgccgccucgcgucggcgccagcgccagccaccgguucccggccguucggaggaagcucgaagggggcgcgucagcccgccccgcaauccccuuagcgcccggcccggucgcccccgccgcgguggccacacuccucacugacaccaagggacauucccccgaggcccgcccgcccuccccggcuccgccgcuccucaccagagcgcgacgugccaacgcuucagcgagcccagagccgcagccgccgccgucgcucuggcgcccgcggccgcgccgccgccaucuuggcuccggccggaagugacgucggcacggcgcccacaacccccgaccccgaccccgaccccgcgcguagcucguggccugcgaccccgaggagcucaacacgacggucaggcgugaccccggcggacugugucgcccucucugucaaucacggacucgccgcucgccccagagcguuauuaccucgaagggaagcccgcgucgccauggccgggccagccugaccacuauagaguuagggcugagaaacucaagaguuggucagagaagccacccuacuucagacgaccgcgac

SEQ ID NO: 2243 - RNA, 2485 nt, Mus musculus
cauccugagucguuuacccucucugguaucagggcuagcaagaucuuccuucccuuggcuuucacuucucuguacuaugagaagccauaggauggaacaauuuuaccuagcucuugauacuuuccuaggaaccugacuuuggguccagagcucagcucaagaacaggcggugguaaaggcaggagucugcaggccuggggaaccaugacuccauccagaacccacuucgcacucguucuccuccauggagacugccuuagucaggggcugguccucucuguccaucaccuggcccuaccacucugcuggacuucucugagccugugcucauguguaaagguugaguguuagcaagagugaccaccuuccucuuucaaaauaagugaagaguggggcugguguguaaaggcacacucuacacaagccugaggacaugagcuugauuccuggaaccucggggcgacaaggagagaacugauuccuuggacaaccauucauacucacguagggacacaguaauaaauaaaauuuuuuaaaaggccgggaagugguggugcaugcuuuuaauccuagcacuugggaggcagaggcagguggauuucugaguuugaagccagccuggucuacagagugaguuccaggacagcuagggcuacacagagaaacccuauagauaagagaaauguagauaggauuuuccuuauaucugaaauucuuagggccauaaguauucagacuuugaggagaggguuguuugagaugaauuuauuuuccccaaaauuuuuauauuauuucuguguguauguguauuuugccagcauguaugucugggucacaugugugccuggagccuguggaggacagaagaggucauaagauccccuggaacuggaguuauagacaauugugagcugcuacguugguguugggauugaacccagguccucuggaagagcagccaauguucuuuacuuuuuuuuuuuuuuuugagacaggguuucucuguguagcccuggcuguccuggaacuuacuuuguagaccaggcuggccucgaacucagaaauccgccugccucuaccucccaagugcugggauuaaaggcgugcgccaccacacccggcacagcagccaauguucuuaacugcugagccauaucucuagccucuuaagauagauucuugucccauaacucaggcugcccuugaacucacaagccuucuaccuuagcauccccacuucugagauuacaggcauugugccuggcuccagacauuauaauguggaauauuauugccaccagucgaacaucucuaaucuaaaacuuuuuguuuuuauuucauguacauuggugguuuugccuaccuguguacgaggguguaagaucuccuagaacuguaguuacagauagcaucgaucugucugccgugugggugcugggaauugaaccuggcuucucugaaagaccagccaaugcucuuaaccucuagucaucucuccagcuuccccccggcccccuuuaucagauuucaaaauugggaauccucaaccugucuucugguuuuuuguuuguuuggcuuuuuguuuuguuuuuguuuuguuuuucaagacaggguuucucugugcaguccuggccauccuggaacacacucuguagaccaggcuggccucgaacucagaaauucaccugccccugccucccgagugcugggauuaaaggcgugugcuaccacacccggcucugucuucugguuuuauucaacugggggcuguugaauuugccagacaucaggaauccugugugccugauaccccagagaagacugauauaucaguccaucuauuccuuguuuuuauagaugcaacuccuuagaaccccauuuaaucuuuggggcucauuuguaacuacuuccagagacugcagaaagcuucccuugucuaaccgaagacuagccacaucuucuaguccaacagccccaaagggaauguaggccccuguccaucuagugcacguguaucuuccauuauaaacacucacaaggagugcuaaaaagcacagcgucaggcugccaaggaugugggauguuuagggaaauggcuuuuuucuccuccucuacuccagacaucuggggugguggcagugaugguguucccugucacugcuguauuaacugccuucauugacagugcauagugacacacaccuggacuccaagaacucagaaagcugaggcaggagggacaugaguucaaggucagccuggccacuaugugguugcuaggaauugaacucaggaccucuggaagagcagucagugcucuuaaccgcuaagccauaucuccagcccuguaaccuuguuauuaaggucugaaugaauuggauuuccauaaccaauaacuucauaaagaucccuuuucccuuccugccuaauuccccuuggauaaauagcugggugacuucauuucuguaugaaaguauuuggauga

SEQ ID NO: 2244 - RNA, 32585 nt, Mus musculus
ugguggcgcacgccuuuaaucacagcagucgggaggcagaggcaggcggauuucugaguucgaggccagccagggcuauacagagaaacccugucuugaaaaaauaaaaauaaauuaaaaaaaaaaaaaaaagaucuuagccaggcaggcaugguggcauacaccuuuagucccacuacuaaggagguagaugcugacagaguuugaggcuagccuagucuacaaaacaaguuucaaggcagccagggauaaccuugucucaaaaaacugaacuccccuccccccaaaaaaaaagaaaagaaaagaaaaauucuaaucucagcagaaaugacaucuaaagucaauggaagugucaaauguuggccucauucuuggacacaaucagguuuuauuugaaaagaugucuacacuguauuggguaccaacacagacgaccaagacacuacagcucugucccagcaacacugaguccccgugucacgaagacuggaaauaucuucuauuaaccgcaaaccuuuacauccaccccauaaaagcaguuaagauuauacaagauuauuuuugcuuucccugucuguccugagaagcagaaggcagguguuagaaacuggucggucugacuuccuauacuaaagccaacaugagucacuucuacugaaauguucuugguucuacagcggcugagccuuuuagcaucuugugacauccaacaguguucucagcauccaggaugaggucucuauuauccagaaagaugcagcugaucugagggcuugaguccuagggagaugaggacguggcuccucaacucaucggaggcuuagagaugguuuggagacuuguaaaaaaaaaaaaaaaaaaaaaagcagugucuucccggaacugaaggcacaguggaugcuuaggacugggcuggaauguguauguaucaagugcaguuacaaguuggcaacugcaaaaggacccaugccucugugauguaacauuuccagacucuaugccucuuaacaguaauagggacuggccagggugaacccaugguuacaguugcuaaagcuggcgauacugucuuggcuuugcuccauuuucuaagcauguugucuuuugaaucaucgaucauaacauuuauguuaaaaauuuaguuuuccaaaggcagaugcuuugaggggcuguggcuuguccuguaucuuuccuuugguacugcuggccaagcggaggggucaccauggcuguggguggggugggugggcacgccaugggucaucuuccuccacaggaagaggauggggaacagggcaaguuggaagcucucuuauuuucagauguguugggagaacaaccuguucuguuuagcucuuuagggccugugaagauaaagaaaauuauuacuuuuacugugacugugacuagucacccccuuucccacugucaauugauccuagugucguuuucuguagcuucaguccuggaaccuggugccacaccucccccucaucucuguauuccccuccacaccuuccauagccaggggucaggaccccagacauuuacaaacaugaugcacagacagcugcaggacagugcgccucccagucauagaugacacauccucuccccuccccacccaucauauuucucugguuuuccucugguccugaguuggaacauucugaauucuaaaggaagcuuaaccaggagucuuucugccuaaagucaacaucaggaggauauaaugagcuacacaguggaaggaugugagggacagguguggggaagggacuuaaaugcaaaacacgcuccgcgccccacaugcacagcguauuuccucagcagaacaggggcuucugcacuaugaccagugcuucccccucccccuccccgcccccagcccaccugcuguugauggcagaggaaggaauuagauuaggaaauaaguuaaaacuugggauuuuucuuccaauuuuugagcaguuggaaaacuaagagaucagaucagaggcugcgucuguagaggugaaguguuucuaagaggaccgugugcagagguuucugcacacgaaaagguuuugagcaguggcaggauugccuacauuuacacgucauaugcagauaagaaguuacuuacgagaaccuuccagaaaucuucuucauaacaacaaugaagaucccuccgacgaagccaauggcuaacaagacgccaacuaugauuccaaccagggugacuacuggcaagccaucugaauggauggggcgggggagaugaaagugugagucccaggaagaaagagaugugcugaauuccaugucacaagcaaguagcagaacugcccugcuguucucguuagggaaugggcucgucuagucucccaaguccagcugagucaaguguggaaacacugagccauuuuucuuggcuugguaccagagagcaaacccagaccuugaguaugcucgccccgcacaguaccgccaugucccagcuccagcccgggucuaaacccaucuugugaaucaagagguucccuagucucuuagauuuaucacacacaacacacuggcuucauuguugaugggcaugcuucucuauggcccuggaaaacucagaagagaaggaacauacuucaacauaaugaaguagguguaauacauuaaaaaaauguaugaaugccgggcgugguggcucacaccuuuaaucccagcacuggggaggcagaggcaggcggauuucugaguucaaggccagucuggucuacaaagugaguucuaggacagccagggcuauacagagaaacccugucucgaaaaacaaaaaacaaaaaacaacaacaaaaaaaaaaguaugaaaaguuacagccaacauuaagugggaaaacuaauuauuaccauaacaaagaagaaagaugagagcuuagucauuauaauagaguaacugauauguuguuauuccccacagcugccauuaaguaaauacaccaaguguggggugggguggagguguguguguguguauaugcaugcacaaauacauauuuauguaguccuggcuucacauacuaacagaguuacaacugagcuaugcccccaguccgauuucuuuucaaauauacaugcuuuccuuuuuucucuuaguaacuagaaagaugaaggugcugggccuggcagagcagucagccugcagaaacuuagugagacugucucaaaguaaaaaguuagaaguggucugggaaugcggcuuagugcuagagcacuggcuuagcuagccuaaaguccuggguucaauucccaccucuucaaagagggaaggaaggagggagaaaggaagagaugaaagagggagagggggaagauguugcauucuguuuacaguuugacugagauccaagaaagaauugaauucuuagaaaaaaaaaagaaaaaaaaauucacagaaauaccaaaggaauaccaaaaucucauuuaccuuucuuaucuguugucugcguuucauccccugcauuaucuauaaagaggaaagaaaacaagaugguagggaauuguaaggauuuaaugauuauaauuuaacaguuggcagauaaauuuaccuuaaguggaauguaacaaacuauucgcaaugaggguaauuuccuugaagacagcccugacagaguggugucuuugugacuauucccaucaauuugcggcugcuacuucccagcuacaggcaccaguuggauuuugucuuaucuuacucucagagccaaggacacuaagucccaggacugugagauaaacgauuggaaaacuuuggcgccacguugagauagcaaaagaagccagguguguggcugccucaccuuuuuaucaagauccuggaaaaugcagagaacgagaggcuucauuugaaaguuuucccagcaggcuucuaaucugggaaggguaaccugcccgccuccugcuaucuacuccacucuucuuugacaucagacuuauguaugcaucauggggcagcagccagcccugcuaggcugagugagaacuggucccuuguggcuuuucacuucuguucuuggagguuuccucuagcaucccaguugggaaacaaugcacacccucuuuacuucgaguucuuccucucaguacuaagauuacagguacccuaugcucaacuacauuuuuuuuuuuuuggcuuuuugagacaggguuucucuguguagcccuggcuguccuggaacucacuuuguagaccaggcuggccucaaagucagaaauccgccugccucugccucccgagugcgccaccacacccagcucaacuacuuuuuuaaacaaagauuuaguuuagguggugaaccucaccuuuaacagcugagccaccucuccagcccaaacuuauuuaugugugugugugugugugugugugugugugugugugugugugugugugugugugugugagagagagagagagagagagagagagagagagagagagagagagagagagagagagugugcacugcaugccugcaguggccagaagaaggugucggauccucuuggaacuggaguuacagaugguuguuagcugcuaugugguugcuaggagcugaacccugguccucugcaacgaacaguaaguguucuuagccacugaaccaucccucuaacaccuaagagaagggugaguagcaggagcacucagagaaaggggaagacggcuuuuucugcuaguuagacgcugaaucaccauagaaaggagaaauccugcacgcuuucgaaauguguugaaacacucccuccuuguucuuuccucccugagccugacuugguucugccugguguuuaacauuaauguucucuuuacagcccuggcaagcuuuucaugcacuucaaagcacuucacaggguguaacucaguggcagacagagcaguugccuagccgaggaagggacuggauuagacccagagcaccccaaaauacccaaccaaucaaccaaacagaaccccuacccagcuugaugaaauaggagcaaaaugucuaaggcaagaaagucauggcauuaauuaugguuuuguguuucauuuugagacaggaccucacuguguagcccuggcuuguccagagcucauucuguaaaccgagcugcccucacauucagggacccaccugccucugccuccugaguccugagacuaaagguguguacuaccaugcuuggccaacaaaaauccuuuuaagugugaauuugccucguguguuuuguagcaugugccagcauuucuuucuauuuuaaagcuaggugauauuccaccaugcguagauauuacauuuuucacuuguuugugaacacuguugcuuccagguguuaaguacuguggacagugauauguacacggugguaugcacaaauguggaagcuuuuguuuuguuucugagacagcaucucauguagccccauguggcuauuuuguaagauaaagucuuacuauguagcccaggcuagccucuaauuagcaaucuuugugccucagaauaugagcauuauggucauguacuaccaagccugggucuaaaaucauuuuuuaaagccuuagacuaagugcuguagaggggcuggagagauggauuaguggcuggauguguuggcugcucuuccaggaccuggguucaauucccagcaccuucauggcagcuugcagcugucugucuguaacuccaguugcaggggauccaacacccguauacaaacauauaugcaggcaaacaucaaugcacaucaaauaaaaacaaaucauuaaaaaaaaaaaguguugaguucagaaggccagacuggcaacuggaccugaagucugcauuaaauaacaaagaacauucagucaggcacagcagccuauggaaucccagcacuugguaggauggucaggaguucaaggccagccucagcuacaaagucaguucaggucguaagcaccagccuggaugauggacaccauccagaguccugccgagucugacuuacaauacccauaaugcaaagcgggaaacuuuaguguagaguugcugcucuugcgugucaacacaggacuuguuaaaaguuuuuauuacuuauucauucuuguaugagggcacugugcuguggggcccugcaggagacauuuuuaggccucaauuuuuugcuuucaagcauguacauuccagggaccgaacucaggucuucaagcuuggcagcaagccucuuucuuuaccugcugaccuacuaagccauagaacccgucucaugcaagauguuuuuccuuuucaaauauguauuuuacuuucguuaugugucugcguuugcgucuggcacucucagaagacagaggcauugugagaugcugggaacugaacucugaaaguauuugugugcuuggccagugagccaucucuccagccccaguacacgguucuuaacgguggguggggcagcaauaccacacagggagccagugacuggucccuguagggagcuaccgcuagguaucauucaagguuaagagauaucuccagaaagccaauaaacuaaaucuaauuugacaguugcuacacuggauucuagauccuucacacaaaaccuggugugggauucuuccuuccuuccuuucuaucuuuuucuuuuucuuucuuuuuuuuuuuuuuuuuuuuccgagacaggguuucucuauguagcucuggcuguccuggaacucacucuuguagaccaggcuggccuugaacucagaaauccgccugccucugccucccaaaggccaagacuaaaggcgugcgccaccacgcccggcccgggcuuuguuuucuuagucccgccucuuggacccaccucuauuggggugacuuguuuucuuguccacagaguggcuagucaccacuuugacagugguuguacucucguguucucugugaucauggucugagguugcugagguggacaguuccucuaagggaggcuucgucccacgcucucucugcguugguaccuguuagaagugaggaaagaaagagagaagauaaauccugaagguuuaaaauguacagugucugccuucccgcaggaaagauguuaagguagcauacauuaaaacaaacaaacagugccgggugugguggcacacgccuuuaaucccagcacucaggaggcagaggcaggcggauuucugaguucaaggccagccuggucuacaaagugaguuccaggacagccagggcuauagagagaaacucucuugaaaaaccaaccaaccaaccaaacaaacaaacaaacaaaaccaaaaccaaaccaaacuaaaauggaguuggagauggauacuaaaaccagguucaauccagaaaugaauuuuuuuaaagauguauuuaaauuuauauauauauauauauauaugaguacacuguaucuuuacagaugguuaugagcuuucacgugguuguugggaauugaauuuuaggaccucugcucgcucaggucagcccuguucgcuucggcccaaagauuuauuuauuauuauaaauaaguacacugucgcugucuucggacacacaugucagaucucaugacagaugguugugagccaccaugugguugcugggauuugaacucaggaccuuuggaagagcagucagugcucuuaacugcugagccaucucgccagccccagaaaugaaucuuaauuguuaagauaaauccuaaaacaagaaggcacggagacugccagaacucacagccauuccaugacaguggaagacuacaaaguguuucuaguuuuaauuauaaaugugugcaggaguugggguagacauacauacgggaauguguguuuauuguucugugacauaagucucucacugaccuggggcuugugaauuaggcuaggcuaacugcccagcacaccccagggacccacuuuucccugccuccccagaguuagggcaaguaccacauaucaucacaucuggccuuuaugggcccuggggauugaacucagguccucaugcuugcaaggcguucguguuaccgagagccauucccccagcccagugcuggcuuuuaaacuuuuucuuuguucaacaccaaggacagagcaaacgauuuggaugaagagauacccagggcgagguuggguaaaacuggcuuggggcuuucauacccuuuucggauaaaggcauugccccuccccagggagcuaccaaaauucccugaauccaguccuuuuuaguucauuugcuuguuuguuugauugagcagaauuuuacuauaaagcccuggcuguccuggaacucacuguguagaccaggcuacaggaauuauuuuacuauuugcaguuuuagcaaccauaucauaggauacacauuuacagauaucugccuccuggauacuagaauuacaggugauauuacaugucccaccucaagguugcaaauacuaagaugguuucuuucuuuuuuuuuuuuuuuuuugguuuuucgagacaggguuucucuguauagcccuugcuguccuggaacucacucuguagaccaggcuggccuugaacucagaaauccgacugccucugucucccaagugcugggaucaaaggcgugcaccaccacgcccagcucuaagcugguuucuugcuauuuugugaagauguggucuauucuuuugacuacugucacucucuucagacaaagcagaagagggcaucagaucccauuauagauggcugugagccaccgugugguugcugggaauugaacucaggaccucuggaagaauagucagugcucuuaaccgcugagcuguuccuccagcccaugagaagauguggucuauuguucucaaauagucugugccaacauagaagcucucuugucccugaaugagacccaugucaccgucgugaaccacaccaccauuuccuuguauggagcuguuuuccuacauaaacauacaucacacccuggcaugugacagccuguuuuuaaggccaacucccccuuuccuuagacacucaccagaggugccuugccaguagauucauuaagcccuccaguagcaccugugguuguuauuuugucuucuauaccugggggcaccaugccgucuccuguaccuggggucacaauaucaucuucauucacgccuauagucccugaaaaagaaaggccagucagggaugcaguaugcaaaugacgagggcaaaaauaauuggcuaccuacagucaugauucuguuuccuacauuguaagauguggucuuuucuguccaaccucuguaccagagccaacaccacuguccuuguggugccucugacacacaccauggccugcuugucuccacuuagaagcaaaagaacauggaaacacauggcgaaggugccagcuagaugcucuggccauggacaugucugcccuucccuuuuuaguagagacagugucuuccguggcuaaugugcucagguggacagaguauuguauagaccagaaaaacucuauagaaucauuugaacaauuucuaaacauacugccgggguccauguucuguccaacaaaauaauugucuguucacuuuuuacaaucaaacucaggccuagcauuauagcccagcaauggagcccaugcuuggaaugucuuaauucccagcaccaaaucauuaaccaguuaaaaacaaacaaacaaacaaacaaacaaacaaacaaacguaugacugguaagauggccacaaagacuugguuuguugccaagccugagaaucugagaucaauccugggacccacaugguggaaggagaaaaccaauuuuggaaaauuguccucugauggucacauaugugccaugacacaugugauauauaaauauauaagauguaauccagaaauauauaagauguaauaaaauuuaaaaguguaucaacaaaccaaaucuccauuacuauuuaauugagaucgcugcucacuuggauaauuaagaccgcuggaucacugacgucauagacuucuuucaacuucuuuuuugagaugggcagggccccucuacauaagcccuggcuguucucuaacucaccagggagaccaggcuguccauaaacucacagagacccaccuguuucagacuccugagugcugggauuaaaggugugcaccgccauguuacauauggaguauggagucagcacuauacuuaaagguguugagaugcaacaggauacuuaguaccaagagcuaaacuuaucugaugcaacuguucuaacaugugguguguguguguguguguagguauguauguguuauacuguguguguagaguucagaagacaacuucaggugucacggugguuuggauaggaauggccuccucagacucauguguuucauugcuuagcucguaugcaaugguacuauuaggagguguggccuuguuggaggaagugugucacugugguuuuugugggcuuugagguuuccuaugcucaagcuaugcccaggguggugguauacagucuccuucugcugccugcggauugaguuguugaaccuccaacgccacgucugccuguacgcugccaugcuuccugcccugacagugggcuaaccugucagucagucucaauuaaguguuguccuuuuuauaggaguuguccuggucauagucucucuucacagcaacuaaacuuuaaguaagacaucaguuccccacuuccaccuugucugagacagagucucuuauuguuuaccacuauauaagucgagcuagcuggcuugugaacuguggacucuccugucuccaucccccaucucucaauggaagcacuagggccacagauggcuagagccacuauagcaucugcuuucaguggguucugggcuuuaaacucagguccucgugcuuggauaucaugugaguuaguuacugucaaccugacacaaacuaaagccaccgaggaaaaaaagaaucuuaacggcgaagugucacugcuugcaucugucuccccagauuccaugugcuagauagaaaucgaaucuccacagucauugagucaaacaguguuugaagcugggaccuuggaaagguacugagaauugaacgaggucaucaggauggggugaccaggaagugacugguggguuaguaagaggaggguagaucugaacugacgcaugcacucguacggcgacaucacaucuuuggcaaagcuaugccauuacaacggcaccggcagaaacaguacugugcucuugaacuuucccaccuccagagccacaaggagaauaacgaucuacgcuuuugauugacgaucuacacuuuugauugacaugcuuugggguauuuuguuaccgcaauggaaaauagagggacucaaacagugugaguagaguugacaagugcccuccucugcugccucugacuaaccguauaucagggcaucugcucuuacuuaacucacguaauccuuuucacgaguuacaaaucugacucacuggcuacgggcuuccucccuagacuggagcagcaauggaaacgccaugccuaaaugcaguugcgaaagaagcacaggcaacgagaaugggagggaggggugcuuggaaagcgcccuguguaauuagagagcagauguuuuccggugacgagccaugcuucccuccaugcguuauucucccucuguuaagacagcccagccaggagcauggcuaauaaacauuugaucauaacuccaagugcucaugccaacggggugggaggccccuggaggaauguugcucuguuucggaggagccuucucugugcagcuggcccuguuccaguugccaacggauggcuuuagaugagcuaccuagcguaggcauccuuaaaacaaaaaaccaaaaaaaaaaaaaaaaaaaaaaaaaaaucucaggaaaagccuuaaaaccuucaaaacucagugcauaccaauaguagaccuccucuuguggucauuugcuacugugggcugagggcagggacugugacugcggaguagacggauguuuaauguccauuuuucagacaaauaaucccuacuuaaaagcuaagcacccccagugaaauagacacuucuucaguggcguugccacuggaaagauacccauacuuccacaagcaaacccucacccacacuccuguaggcagcccuauagaaucucacugggacacacaggcgcacacacacacaggcacgcacacacacaggugcacacacacacacacacacacacacacacagauaugaaaucaggaagggaguaguuuguuaguuuggaagagaaugaaaacuugaaggauugugagaaggaccagaaagaggagaauaugguuagaacacacuuauauguguauaugaaaaugucaaaaugaaacccgguaucauugacauuuaauauaugguaauagaaaacauuaaaaaaacaaaacaaacaaacaccccuucauuccccuggauugaauucaguuuuaaacaucaauuauuaaaagguuuccuggaaccacugucaaaaucauuuuucaucccgugucucuaacuuaaaacaagcccugcuuuaaaaacaaaaguucugagugaagcuggcuucaauuccuucauagagagcucaguucacugagagaguaacucaguaaaaauuccuccuuguucuuuccuccccuuggcccgcggagccaagaacugaagucgcccugaauagacaaaggguguuuuaugaaugaccaugcgugucuuuugucucccugggccagcauucuuuucggcuccaugggaaaguuaucuuuacaagauucucaauuauuuuggcugaaggcuuuccccgguggagagcgucgaccaggccagcugccgaguuuccagccagcagcugacauuccccuuucucuuuucuuguaaucuccaagccguggauugaugucuuugcacucauguguccucccaggagguacacaccagcaugcuggcgcucagggaugcacuucgagcuugcauacaaaugguagguaaguagagagugaggaaucuacaauugcaaccaaugcucucagucuggcuugccaggaaaguucuggaaacaucugugucccuucccagucaccugaguacacuuccugacacacucagcugcagcuggcaugggcaugagacucaauggaauuucuucacaggccagaaauccaucccuuuggauuuuaaagaacagcaguuuugccucuauucuuuaaaaagguaggaggcuggagagaugguaggaggcucagagcacuuccugcuuuugcagagagcucagauucaaaacugccuguaacuucuauccuagggggaucugaugcccucuacuggcuucuguggguacugcaucuacgugcacguacacacaaagacacacauauacauaaaauaaaucuuuuuuuuuaaagcugaguauguccaggcagugguacgccuuuaaucccaacauggggucagcaaaggcagguaauccucuaagugugaggcuagccugaucuacagagcaagcuccaggauggccagggcuacacagagaagugcuaucuugaagaacaaaaaccauaacaacaacaacaauaauacagcugaguauggugauacacaccuguaaccccggucggugcugguggagggaagagagaggguugcuagagcuuacuggccagcccgucuaacagaacuggaguagucagugagauacccugccucaaaaauagauggaaagugacugagaagaaaauagacaauaucagccuuauauaugggcgaguauacagguccacacacccacauaugaaaauauacauauacaucacacacacacacacgcugaauauguuccuuuuuuagaugguacagccuguuuuucuuuuuuuucuuucuuccuuccuuccuucuuuuuuuuuuuuuuuuuuuuugguuuuucgagacaggguuucucuguauagcccuggcuguccuugaacucacuuuguaggccaagcuguccuggaacucagaaauccaccugccucugccucugccucugccucugccucugccucugccucccaagugcugggauuaaaggccugcaccaccacacccggcuacagccuguuuuucuacuagugaguauccgcaucuguuagguuauuugacuauuuauuccugucuguuuccccaagucucuguuugcauacuucaucauuugauucuucuguguuuucuugaaaugguccauaaaacagggauauauaugcaugccuuacauaacaagauucaguccauuacaaccucuguccggaagauuacuggggauuucaaauguggcacuguagcugucaugugucauggugccacacauuccucuguaucugugggagguugauuagaggggagaugugauuugucauaaaagcaugcgccucuuaggaaggcagcccuuugcugucuaagugaagucagcugucacuauauggacaggagccauagggacugggaguauaguuccuauccauagagugcuugucugacaugucuggguucacgcccuagcagcacgugaauuagccgacaaugugcaugcaacacgacaaaaaaaaaaugaaaaagaacuuuuuuuucuacugggugugguggcugaugccuguaaucucacaagcacccuggaagcugacauaggaaguuugugaguucaggaucaccccgagccccuguuagaaacccuaucucaaagcaaauagcacagauaacucuggcucucuugugguaccacaacugugacugacaguugugucagaaugaagcugaaucucuccuucccagucacagccgucucagacucaucgacaugaacgaggaauacaaacuuuggccuuucuaggauaaauaagcgaguggccacagaaguagcugcucugaugcucugggugaagagcggaagugguccaaaucagugcgaacgacaagcaagauuuucucauaaagcgagguuuccugacccaggcagagugggugagcuguugaguagggggcauucuuguuauagaccaggaagaaccggagacagaagagcaagucuucucuguggaacgcauugugaaugcucuuuccuugguuauuguucauaauaauaauaauaauaauaauaauaauaauaauaauaauaauaaugagagaaggauguuugugccuggacugacagauacuacucugucuggugguugggacccaaaagagcuagcagaaucugaaaacucuuccaaucucucuaaggaagaugacgcuaggcaauuugcaguccaaaugcccuuaacaaagaaggucagacucccaggacccaaguuucagcaucuugcaugucaccuauucugcaacacaaaugcugacauauugcuuugaagaaugugugugccaggaaagcacugggcaggcggugggcagggggccauggcucucgucacccugugauggacagagacgcauauacuggucaggagcuggagcugagaacucagcuuugaugcuaaggccucccaggaguggcucuuuuccacacaaagccagccgagcuugaaggagccacgcuauguuacuugugaggguuuccuccuguuucuaagugaaguugaguucagcagcuccaauucuuuuuccaguuccacuugaugagcucguauagcuuucuuuuuaucuucuaaaagaaacuuauuacaaucacauacuuacauauuugcuugggguggggagggggugaguugugcuaucaaaggauaacuugcgggagucaguuucuccuccagugcgggucucagagaucaaacucagguccucaggcaagcaaaugagcagcaagcaccuuccccccacccuccagacagcuuggacugucccagaacuuauucuguagaccagacuggagucaaacucagagauccaccugcauccuccucccaaguauucgaggcaugagcugccaacaccacuacccuggaccuacaccccaucucaccaucuacuccaugauccaacugaucagccugcaacuuuagaaucggaccaaucuugaaaugguaaagaugauuuaaaaaaaaaaaagaagaaggagaaggagaaggaggaggaggaggaggaggaggaggaggaggaggaggaggaggagaagaagaagaagaagaagaagaagaagaagaagaagaagaagaagaagaagaagaagaagaagaagaagaagaagaagaagaagaagaagaagaaugcagcucaagagauggcucagcgguuaagagcaccgacagcucucccagagguccugaguucaauucccagcaaccacgugguggcucacaaccaccuguaaugggaucugacgcccucuucugcugcgucugaggacaguuacaguguacucauauacauaaggcugucuuuugccuucuagguugcuccauaucucagugcacagacaugccuuugaauaguggugaucaaguggcuuugaaaugauuuuuaugguuauugaggaaacacaauacuuauaaaggaaauucuagcaaguucugguuuugcguuuuaggacaaacaguaggcuaaauaaaacaacaagaagcaaguacuauguucccagcuacauucaaaauagagagaugauuuugaaaagauuuuaagaaacaaaucuguaaaaaauauuugaaaaagaggccugccagguagggcacaccuauaaucccuacacuugaggcacuuggguucagacaggaggaguucaaggcagcccaggcuacacaggaaagauucuguuucuaaacaaacaaacagccguuuaugaaaugucagcuuauuaaaauaauucaaaagcuuugucuacccaaagcaaugucuuuggaaggcauucaucagcggccuuggaggugguaccugccugugauccaccgacuggggaggcagcagcaggaggauccugaguuugaguuuagucugggcuacacaagaagagccugucuuaaacaaaacaaaucaaaccaaaacaaccgcccccgaacaccacaaaacacuaaaaaauaaaguuccuuugcaacuggaaaucauuauguuuagugacauaagccagccucagaaagacacagaggcagaagaaccuaaauuuaaauggcgcgcgcgcguguguguguguguguguguuuauguguguaggucacaaaacuagaaagagaguugugaggagaaggggagaucuuagagacggugcagaauaaagacaguaaggaaacaugauuaauaaggaaagcugaggaggaacaaacugggaggaggaggaggcgggcaguaucgaggagugugagagcaaagcagaaugccacguguguuugcagaugccacggugacgaccacugcuuccaaugcuaaccugagauuuuuaauuaggaaaaacauguccccugggucugugaaauggcucaguggauacagaaacuuuauagcugaggcaugacuucaucccuaggacccacauaggaaagggacaacccguuucccaaagcuuccugugaccuccaggugaaugcugucacaugugacugccccuucccaguaaauaauuguuuuuuuuguuuguuuuuguuuuuuguuuucaaaaaugaaguccagaccugggggagauggcucacuggguacaauguuugccacacaccugugaaguccucagaaccccaagcguaaauaaagccagugcggccgugugccugcaaucaaagcacuggucuagccaaucagugagcuccagguucagggaacagacacuaucuuggaaaaaaucagguggagggggcuggagagaugguucagugguuagagagagagaccugaauuagucaguucucagcauccaggucaggcaacucacaacugccagaaauuccagguccaggggagauuaauucugacucuaaggacaccuucacucaugugcacguuuaaaaaaaaauccaggaaaaaaaaaccgacauguauguuuggccuccauauauacagugacuacacgcauccacacgaacacuuccauacaucacacacacagaauccauauuugagaaacacgcccucuauucuguucuuuuacccacauaaaggcuuuugcaucuuauugcccuauccugucccaaauugucccaagucacagaaugaacauaucuaaugcuuuaacagugucaaaccugcugacccaggagcgccugccucuucccucagcuacccggaaguggguuucugcaacaaggaggggagccuggugcucucuugugcugacuagggcuuugguagucagugucccguaaggugggcugguccugcugcuggcccugcuuuuggccuugauugaagucauucuuuggauuacagaugcaauggcagauauuuauaaugcucugcugguaagaaaagccacucaacacggcgaggauuuuuuuuuaauguuuccucagucuugccacacaucuuggcaaacugguuaccagaucaaaaaaccagcgcuggaaaacuuccucacugcuuugagagucuguacuugugccaugaaggugcgcgugcucgugugcguguguguguuuaccagaggucaaucucagcaucauucuuuuuuuuuuuuuuuuuuuuuggguuuucgagacaggcuuucucuguauagcccuggcuguccuggaacccacucuguagaccaggcuggcuucgaacucagaaauccgccugccucugccuccuaagugcugggauuaaaggcaugcgccaccacugccgggcaguaucauuuuucaggaugcuaucuaccuuagucuuugaugaaaacuugccaauucugcuaagcuggcuggccaggaagcccuggagaucugccaguuucuuccuccccacucugaacccuaaacucgaaucaccaugccugacaguuuuuaucuuuuacauaaauucugaggcuugaacucugguccuuauccuugcacaccaagcacgcucuaccaaucgagcuaccucuccaccuccagcccucucugcuuuuuugagagaagcucucacuguguauacaggacaggcuaaucuugauuucucccugccauggacuuccaaacacugggauuagaggcuuguguaccaaccaacacaccugggcuaaacagcucuuuauuaauguagacaacucuuggcaggcuuggcccugccaccccaggggagagcaugguaucccccuaacacaugaccagcaucuggagccauuugcugagugacugacgggcaggcacaauccuccuuggauuuaucacccucucacuguacaguggcuuucacugcagagcaggugaacgcccuucccuacuguagggcagcagugacaggacccagaacaauucaccagugagggugaacucuguguggcccugccugucauucgcugucacggguuuugccauagaccaagcucguuuaaugagaugggacacgacugucaggcugcacgaugcugcuggcagguaggaugugcauuuaagagaggggugucggaacugagguaagcggagccaugcuccuagcuccucugaggaacuccugcauguaaauguuaggagccuguucccuugaccucacagugggugaaggguuguacaugacacuucuggcuggcuggccccagugggcuggaagcagcuuuugaaaguuguuuuuuuuuuuuuuuuuuuuuuuuuuuuucguuuguagcuggaccagggcaaggaagaaagagcugggguauggcucagugguagaguccaggguuaguauacagcagcccugggaucauuccccagagucaaaggaaggaggaaugaaagacagggaggggaaaggaaaagaagaaaaacaaagguagcuaugggggugggguggggaggggagagggcaggggugggaugggagagguaggggugguauuguaaucucagcacuugaaggacugaagcagaaaguuccugagcaugacauaucccugggcuccaggaagauucugcugagaaggaauaggagaaggaagaggaggaagaggaggaggcagagaaggaagaaagaaaacagaaaaggcagcaggucuguggcugcuaaggacuuuuauuuugacagcuagaagucaguaagugacugggcaggaggaagggggagggauacuccaggccacccaagcacacccuccccuccucuccucuccucuccucuccucucugaaggguccagggggucaaaguaguuacuucugacugaauuuacacaagaaugaauaaaaccuacaaccgggaacugggcgugguggcacacaccuuuaauccagagcacucgggaggcagaggcaggcggauuucugaguuugaggccagccuggucuacagagugaguuccaggacagccagggcuacacagagaaacccugucucggagaaaaaaaaaaaaaaaccuacuaccgggugcuuuccuggggucuuuacaaaacuccugcaacaaguaccauuccugcuuuucaggaggauagugagggugagguggagaguuagggggccgucagcucagugagcagguggcaaugguggcuucagucagaauccagauccaucagagugcaaagcccacucuacuuaaagauugauuuauucaugcaugaguacacuguagcugucuucagacacaccagaagagggcaucugaucccauuccagaugguugugagccaccaugugguugcugggaauugaacucaggaccucuagaagagcaaucagugcucuuaaccgcugagccaucgcucuagcacuuacaaaggccacuaugucucugggucacucuugccucacuccuugaagguucucccccucucucccuccuccacgccccccccccccgccccccccccccguccauccuuggauguucagacacaugcgugagcacaugugggcaggugugugcacauguauguggaagccagaggucaaccucaggcacacuuccuagauagaaacugucuucugccuugucuucugagaagaagucucucuaggacccagaauuugcugauuacgcccaguuggcagcuggcuagugaguuccacccagggaauccuccuucuucuccccccccccccccgcccccccagaccaggagacugcaagcacuugccaccaugccuggcuuuuugugugggugcugggaacugaacuuagguucucaugccugcaagacaagcacuuuaccaacacagccacuccccagcccugagccuguacccuuuaaggaaaaggcuggguacacuguugaccacggaugguuucuaauggagcuugaagcugggcugcugagguccaucucccgacacugcugcuacccaccccaaccuucacccauugcccaggggaaagccccucucucuacagaaaagccaggaggaaguaucuccaugggcuuagccauacugggccauucacuauuuccucccuaugagguucuagaacuuucuuuugagcaaacugcuguucugcugaguuuacugccccgccugaagacacagaaugaguaggugaaugacagugacacuuuuuaggguuccaggaagugaaucaguggaccgcacacucuaaacuccucagcagugagacagaaacagcugagcccagcuuucaucauaauuacucaacucggggagaccuuuuuuuuuuuuuuuuuuacucuugacuaacagcagacgguuuuccuguaaaaggggaaaugaauucuguuuuucggacaggaaucguaccuccuaagaauuuuuuucuggaaccuagcaggagcugcaggcaccuucuagggaaaaagccaccuucuagggaagagugacaagcucauaggauguuugaggggcgcugccuggaguaucacaucagagcgggguggaaagcacuugccuucugccgggaacugagcagagucugagcucugauuacucagggccucagcugaguggcugggauuucguaagaguggaagaugagccccuucagaucugaccugccgugcagacagcccagcugugagcacagggaagccuucggcuaugugaagaaugcggccauccuuggccuugauccucagccugguuuggaagcugcaucuugggagaauuucauguugcuuuuggauaaucuuguuuuuugugcuggagagucaaacccagggccuuguaugugcuaggcuaccaucugugagugagugaacuucgucucagcccuugguagaugaauuuuuuuuucaaggcugcuauuggcuaguagggucucuuuggaacuucccuugcugucuuucucccuuucuccuugcaugugggaaacucaagcacacagucccaucccuaggcucaccguucagacccucucagcacacuggccccuacaugcccacaagauguaucuucuaucaccucauagucuaacacagagaugcaagugucugcggugcuuagcaauucauuccuugccucucaccuaccccaccugauuuccacagauaaugaacguggguaugugugugucauugugugugugucauuguuugacuggauguaaagucaaguaggagacauaucuauggguaugucuguuuauagagauguguagaccaggagagaagaugcgccuugaaugaggcuggcagcaucuguguguggcagaucuaggcugaauaaaaauggcaaaggagaaaguaggggcaccagcaucucucucucucucucucucucucucucucuccuccccgacuguccaugcagucagcuaccucacagcacuccuguccugugauggacacucucaaaccaagagccagaauaaacccuuccucuccuaucuggacaccguggugaaaaccugaccauggcaucugcccucuuuuaaaggagauuuauucuuaugucgaguacaugagugcuugccuacacucaauguuggcuauguguaacccgggccuggggcugucaggcaucagauccagaaccagagaaguucaggugggaacccuguccucugcaaaagcaggaagugcucucaauugcucggccaucucacccaccccacacuuucuuuauugccuuucucacccaaagguuuggauaauaccaaauuggugcucuucauccugacagauggugacuauaguccaaccagauguuucuacacgagggcucccuugccagacaaauggccuacuucugagccacacgccagcaguccugauaaaggaacaucucauaaguccaggaauucaaggccaguguaugcagcacagagagagcccuaucucagggaaaugauaaaacauacagagcauguggcuggccugugcuuuaauuuccagcaauggagaaacauuuuuacaaaugacuuacagauuucugcaugagcgagaucauguagaccacagaacagaguggagagaguucagacauaaaccuuuauacugaugggcagcugauuuagggcaaaagcaccaugguaauucagugggggaagaguuaucuuuucaucccagaagguucuagaacaacugaagagagccacaugguaaagaauggagcugggucgcuauuucauggcucacacagaaguucccugcaaaggcaucaaagccugacugucagaauuaaaccauuagaccguaagagucgauguuugcagccccgggguagcagugacuuccaacacugauaccaaccaacagcaugagcagaaaaggagacagcucagacuucacgcucuuaaagaggugugcucuaaugaacacuauaacauaaaauaacaagauagcccaauucauagauggaaaaauguccucagcuauccaauaauaguccagcucgcucuuucucucucgcucgcucucgcucucucucucauugguugguugguuuuucgagacaagguuucucuguauagcccuggcuguccuggaacucacuuuguagaccagguuggccucgaacucagaaauccgccugccucugccucccaaguucugggauuaaaggcgugcgccaccaugcccggcuguuuguuuuuuuuuuuuugagacuggaucuuacucuaucauccuggcugacuuggaacucacuauguagaccagaccaggcuggcuuugaacucacagaaaaugcuugcuucuucuucccaaguucuaggauuaaaagcaccacuuguccaguaugaaaaauuauuaaaguaugauuuuuaaccaacaauuaaaaaacaucccauuuauaaaaaaggugcuucuuuuauugaagugaaguccacagaaacaucuuaguauucaaaaauuuuuuuaaagaaucauuuguuuauuuuauguauauucauauacuguaggugucuucagacaugccaggaaagggcaucagauccuauuacagaugguugugagccaccaugugguuugcugggaauugaacucaggaccucucucuccagccucagcauucacaaauuuuaagguggguguaugugcaaugugcaaacaauuuaucuauucauaaucacuugacuuaguuccuuuaaaaaugacuccagcaccaggcuucucuuuuucuccuauguguguguuagauacuaacuuuaauuccuuacuugacaaaaaagcaaaaauaccugaagacaucucaauuuaaaacagccaaguguuugaacaacccccccacuccaccccaccccccaccccccgcccaagauauccagccugagaagguguucaaguucaauggucauuagggaaaggaaagauaagucagaacuauuagagauccuuccuacucaguaaaaaugguaacagagaaagaggaagggggaaaggagagggagaaggggagggggagagggagagggagagggagagggagaaggagagggagaggaaguugcuugcuuagcauguacaacaaacacuccagguuucaugccuggcaccucauaaaccagcuggcugcggcauacaccaacaauccaagcacgcaggagaugaaggcaggacgaucaggggucuaagggcaucuuuagcuacagaguggacuccaggccaggcuggauguguaagaccuuguuucaaaaaacaaaaacaaacaaacaaacaaacaacaaaaacagggugugggggcuagagagauggcucagcaauuaagagcauuugauacucuuccaaagggaccaauuugcauuucagucgugcccccccccccaaucaggugacucacgacuucuuguaacuccaguuccagguguccacuauacuuuucuggugugcacacacacacacacacacacacacauuaaaaagagggaaaguggaaauaacgugaacacaguacucaugaaugaaauucuuuuuaaaaaagaauaaugccaggcaugguggcgcacaccuuuaauugcagcacuugggaggcagaggcaggcagauuucugaguucaaggccagccuguucuauaaaaugaguuccaggacagccagggcuauacagagaaacccugucuggaaaaaccaaaccaaccaaccaaccaaaacaccuccaccaccaccaccaucaaacauccauaggguacaguacaacauuucaauacuuuccuacuguaugcaacaaucagcgugggacugacugccggcuucugucaccucaaaccccuaucacuuguaucagguacacuaacguccuccccacugcuacacaucaacauacacacuccuguguugucaaucauagcuaucccacugagcuaugggacacaagaacucauacucacgggcuggugagauggcucaguggguaagagcacccgacugcucuucugaagguccggaguucaaaucccagcaaccacaugguggcucacaaccaucuguaacaagaucugacucccucuucuggagugucugaagacagcuacaguguacuuacauauaaccaauaaauaaaucuuuaaaaaaaaaaaaaaagaacucauacucacaaguuacaugccuguaccuaucaaccauucucuuucccccucugucauggucacuuuucuaucucugugacaaaacacuaugaccaaaaugacuuauaaaagaaagcaguuaauuuaggggcucacagcuucagaggcuuagaauccauugcuauuaucucagggagcacggcagcggggagucagccauagcacugggguaguggcuguuuagaugagugacuagggaugugugcccagacugugugcucuugguacacuacauacaaugcuugaauucaaggucacuguugccugaugacuggcuuuguccaaaccucucugagccucuuaacucaucuauuaguugcaaagaguuccuaccuuguaguugugcugugaggaccaaaggaaacagggcuugugagcggcugacacacucuagcucagccaaugguaaaaguuacaacauacuucucgcucuuagccccuccccuuccgaauuuaggguguggcuuuauggcuucacauuuaaacuuauuguggacugauaaacuuauuguggacugaugggcuuagguaaaguugaccucacaagguaccaggaaccaagggguacuaagaaugagacacgggagucuggggagauagcucagccaguggggugcuugccucgcaagcaugguaccugagcacuuuucuaaugcugugacgucaccaugaccagagcaacgcucuauagaagaaagcguuuauuuaggacuuacaguucagagacccaugaccauccaacauggcacuaggcagguagaaggguuggagacauagcucaguggcugagagcuuguacuacauuuccaaaagagccuugguucccagcacccacuuugggcuacucaggcuucucaguaacuccaucuucggaggcaguugaucucuucuggcuucugugggcaacugcacucaugugcacaugcccugacacagacaggcaugaacacacauaauuaaaaaaaaaaaaaaagucagcaggucggugguggcgcacgccuuugaucccaguacuuggguggcagaggcagguagauuucugaguuugaggccagccuggucuacaaaagugaguuccagacagccagggcuacacagagaaacccugucuugcuuggggugguggggggggaaucuuaaacgaaagaaaaaccaagucugaugagauagauauuuuccucugcccccuccccccacacaagugagacacgcuuuucugcacuuuauacacauauguguucccugugacaggcccuucccaauugaaaaggguuccagagauguuugguuucccaaagaacaaaagcauuggauggaauguguguucccagaucaagggauuaaagauuucucuuucucggggacccacccuaacugaggucagaauccccaaggcugccaagauagaggacuucccgguaggagcucaaugcuaugcucggaugccugaacacacagcaagaacucaauaaauauuugucaaauaagcaaauuccuuggguggggcagcuuucgugucaacaaacgacauuacuuaucuuucucucucucucucuccuuuucuagagacuccaggcaagcuaaguccuuucucccuugggugggcucuccucgggcuugcuugcucuuuucuucucccuuauggccucugggaaauacccugcucacagcauucuccuucucuggccuccuuggcauucccccgcacccugccaauguaacaggggcucucagcaccgcaguguggcaccgguuggucugcccauuccucuccaggcacuucugcaauuuauuggcacuccagauuagaagccacaagcucaucuucaucuggaaaggcaacuguccauuccggagguuuuuguuuuugaaaccgcauccacuuugccuugccugaaccacagacugucuucuguuucuccaccuaagugaucaacugcccaaggucgaaagccucccucugaacuuagccugacucauugccaaauacagacuguucuccaggcaaagucacuggaccagacacaaaugcagacauagcccucucccucucucccuugcugugugugcccacgugcauguguaggugcacaugugcguguucaaaugauaaccuuagauaucauuccucaggcacucuauuuuuugagacaggauaucucaguggcugggggcuugcugauugggcuagacugguuggugggagagccucagggauaaggcugucucugcauuccuagcacugggauuacaaaaaaaacccuugcuacagcaggccagcauuuuuuuuacauggguucugggaaccaaacucagguucucaugcuggcccagaugucucuccgacccuggucuacucuaucuguugauguucaagaauuucccaccaccuggcuggcuaugaacagucugggaugauggacagcuaaggcacugugguuagacaugugggaggaaacagccaccuucauuuccugcccuggaugaacuuggcagcaugucagcuguuuccuaaccuggcucuauccuaccuuagaucuuggaugaaaagccuagucgcuuuccuuccccagaacauuccaggggcugggaagagggcugccagugaaauguucuccacacaaacaugaacaucugagcuccagcccccaaacucacauacaaugcagggcacaguggugugcaucuguuaccgcaacaauggggaggccgaggcaaccggaucccuaagggcaauggcccaucuaagucuagugauccgugagcuccagauucagugagagaaagagucucaaaaaauauggugcagaguaauugagaaagguauacuugauucucucucucucucucucucucucucucucucagaacucuuuugagaaaguucuuaaaauugcaggcaagggaaacuguaucuguugugugccucacacaaauccuacaagcaaccucuuaucuugaccuccuccaaaucacuggacccucuucuucuaacaagaccgaccacacaacacaggcuccuuuccugagagaugucaggauaucagagcuuccuugggggauggguugggcaagguaaggauccucugcaagguuccuggcuaaacuggugcuugaguuugcuuccuccuuggccucccccaaaauacuuccacaagcuguaaccuggaacgccugcucucagaagccagaaauaugacaaaaauucagauaagccagugcaauccagagcacagguucauucuugguuggcaaggguggcagagcauacucucggcuaggugcuuuccugcacccagcaacccgccccacccucuugggagaggucuagcgccugugugcaagacaaauuaaggcaauguauuuuaaugcgccaggccaacuccacucuuguauggggaguguguaauuuuuuuuuuuauucauguuuaaaaugaauaaagugaagucuaccuucagucucaagucagucuuuuuuuuuuuuuuuaauucaaucauaguaaaaagcuuaacuuuguuucugaaucaaggucccagcaacuucugggauaauaguguauaauuuacaggagagguuggggauuaaaggagguaagccugcgacauuccuagaauguggugguggugguggggggggagggggggggaaugcaaggagguggugucccgcccacuagucagggccauucucugucauaccggagacuugggucucuccauugccagcaaagucaauggugggugagcugaguuuugucuuguugaucguggcuacccucagccuucugcugcugcacucgcaucuuuaaauguguuucccucuucugaacucaguuugggacccuaagccccagcuucccccgcagaaccucuaacagaaucagcuuuauucaaggccuccucagcuacauaagcccucagcagcuugcgaggauuccagggcccccgaaaacuggcaagaacuucagggaaaucacaggaugauuucugugccacaugauuaauccugcucggacuggucccggaagagcacacauggguuagcggcaagcagcagcuugccgagaaucuuauaaaaagccacugcuaacgggcgaguccugggguaccggcuuuggaugucaguucagagugaggguggggccuggcagugggggaggcugccagaugugaggacaacaggccucguuagaauccacgaacaccuuggggauugcagaggggguuggguuauaacccuaaaucaguauggcauaugacucuaauagaauuagcacaccacaaucaccccugccugaucuggcuccccaguaauagcuuaacucaauggaguuaacucauccauauucauuauucucaaacaaaaacccugcaggcucaaucuugcugcagagcagccuggauacaacuggccgcauggccaccucucugaacaccccuguaccaaggcuuuuucuucagcuguacaguuucuacucuaacugagugaugacuuuuucuagacaagaccaaauaccagcuacauuuuaggagcauuuugggagcuggcuugagacaguugcagccuacccuugccuuuggaggaugccagccuccgacuuuccuaggaugugguuuggggugggugcuuccccucacuuugcgcuggugagugaaaagccauguucuuaacacgcacugucucgccaugacggaaauggaaccgaaauacagaacuguauauauauauauauauauauauauauauauauauauauccuagcguaagaaguuucaaagauaggacugccaggaauaccccugaacaccauaaagaauagcuucgucucuuugaagcaaguggacaaccucgcccaugcacucuauauaauuucccuaacacuagguguugucuguggagaauuauagaagccuaggcuaggcccacccaucucacacaaaccacuccuucaccaggaaagacaguccuacaucucugaugaccacuagccuucauuuagugagcaacugagacugucccaugacuucuuggcucugggaucaagauuagagcuuagauuccaccaggaauauagauacaacuuaaaacaucaaagcaagaaacaaaauaacaggagacuguccuagaccccagccauagaucacccagacagaagacaguaauucagaagaggaggacgugaugguggucccaucaaucuguuucuuucuagucagggucuuaaagcccagucugguuucaaacuccuuauaccccaagauaacccugaacccucucauccuccugccuccauuucccagugcugacacaguugagcaucaccauccuggcuuuugcaucuugcuggggauggagcaugagagugucucacaugccaaacauggacucugccaacugagcuacauucucaggcuccauucgucuuuaauuaacacuaauucagccacugaguccuuggccaaguucaauacauggccucaaacacacuugcgcuucaacgcucacggcagcccuccagguuaggagguacagguccguggcgcccuggguuccauccauuuccaguguagggguguggggaggggaggaaagaaagaggcagagacaagaaugcuagaaagauagcagcuugcgggucaagcuguuccaccgucccuuccagcuaccauccuaauuagcgaagccucuucaggucuauccccagccaggggugugacccagaguuccaaccuacguccuccuaucuguuccucuuuuucagagacauuaaucauuccucuaacacacugcuuuuuugggccaguccagucgcccuuggucaccuucccaucccguaacacuagcccccggggcgguggggguuguuagggccauucuguaccccuaccaccuguggguggacccccuaccgccacacccacuuggcuguuacaggagacuuagccccaucuaagcuaccccaccgcucucccucccuccccccgcacucgcagaucccaggcccaagcaucccccgccucccuccauccccaccaacaagugcugguugccaaucaugcauggcgcuuaccucccugcgcagagucccagaaccaaacgcuccccaaaacccagaacaacacuggcacgguccacaucuugaucucguuggagccucagcagcuaguggguuuuuuuguggguugugaaaagaugaaaaacaaaacaaaacaaaacaaaaaacuucgaagccacaggcccagccgggaagagcucgggaggagguuggaaggcgcugagcaaaagucucagcgccagagagugcccgggcuuucuggacucgcagaggcagcaagcacagcaaacuuggcagcuggcaaccucucggcacagucggcauuuaugucuccggucccggggcgggagcgggugggcgucagguggucccggagaucuaggaccgcccccgaacucuguuuggccagcaucacaagaugaccucaggccagguuuaaaguuacagggccucagccacuggggcccagcccag

SEQ ID NO: 2245 - RNA, 1462 nt, Mus musculus
guuuuugagaaaacagacccaaaauguuaagauuuuauuuacaaagcuuuuccauguuguacagaaaguaaaaacguuguuacaaucacaguguaacuggcaaccaggauggucaacucaccaaucacagcugucacgauacagcaagagucuuacacgaaaaccuaacaacguuuacaauuuuguuggggcgaaguccccaggcuuggugguggauuaccaaggggcuaacggaggaaggcggaaugucgcgggaacuauucuuuggcucuuuggguggggguguccuggggcuuguaucacagcuaccuuuuuaaaacagcuaccaaauccaugagcaguccaaccaauacucaacaguucuguuucuugcagguuguuucgggucuuaaucaucgucuccuucgucaucuguuucucucucuuuucacccuucccacuuucuuccuccucuucauccucaucuucuucaucuucaucaacuuccccaucguguccaaauucuuccuccuccccacugacuucaucuucaucaucuucuccuucuacauccucaucuucauccucuucaucuucaucuucuucuuccucaccauccucaucuuccucuuucucuucaucuucuccuucuucauccucuuccucuuuguccacaccauccaccuccacaucugagucgggggcuuccugguccucucggucauagccauccagauaggacagcuggggcaggagccugaagacaguuucucgguaaucacucugguuagugaccucacagccaaacagauccaggcuuuucagacaauccaaccuuuucaacggcuccaaggugcugauaucuuucagguuauuuccacuuggguucagaugugugaggcuuggaaguucuucugcuagucuguccagaccuccgaagauucuauuuucacugagcucaagcuucuucaauuuagguagcuucgggaggucugaaacugaaaacaagccuacacuuauuaaacugaggaacucuaaguucacaaauucaucuguuaaccccuccauuuuuccauccauugcuuugcaauuguccaagacaaguucucgaacggcugccgggguccgguuccucagcuccagguggauccuccucuucauauccauguuccccucguccccccucuccaaacuuaacuuuccgcggcgggggcggaggggggagaggcgacccggccugcgcggcgagggccgucggagggaggcggcuggaggaggcggcggcaugguccccgggcggcgugcgggcgagcggagcccccggagccaaguuacucgcaggagcggagagaaaccauggagggaaaagggggcuggagcgcggcucuggcuucacuaccgccgcccccggccaaggccccgcacugcgcuuaaaccggcgacgcaacgcggcggcugcugggcuccacuaggcccugccaga

SEQ ID NO: 2246 - RNA, 5721 nt, Mus musculus
ggccacgagagcgagcgcuuccugucaggucucugugaguuugaggccagcgggggagacagagggaccggagggcuccggggcggcucggagacaucuugcuucuguccaucucugguaagccauuuugucccucaguagcagcagcagcgggcgaggccggaggaucgcuucaacccuugguaaaaaaaaaaaaaaaaacaacaaaauaaacgccccacuccgugccaucaccccgugcucuuccagacacgucggggagacuugacuaacgggugcgcugacaggauaaggccguucuuucucacucugcuuuuuuuugaaguaggccuucgucugugagggccccagggcccgccaggaaaucagugcgucguuucgggcuucaaacacuuccggcaugcuaggauuaagugccgaguuaucgagccugugugacugacugaagaauaacuugaguguggcuaggauuaggagugugugcucgcacaccuuguuuaucaaugcauuccaucagccagguugcuuccccccccagucagagauugcuucuuuugaacuuugccacccccacccccccccaaggcuaacaaccguuuuaauucgaaguuccucacuagaucgggccuuccgagaggauggggguaggcugggcccuuaggcagucaucugggcaucuggccuagaugggugggucacauccugcguuagauucauuacauuuacgaaguaguagugaaaugcuuuuaaggguguggguguguguguguguggggucccagcauuaggaagguuugagaauugcugugcaaagcuggguggguggugguggcuccagcacucaagaggcaaagggccagccuggucuauaguaagccaaacuuggguagagucacucaugacuuugauuucuuguuggaguacugucugagauggguagauauuuauucauauucucucaauuuacuaggcagaccagguuagauggcauaggguuuuaaugaguuguagacagacuuuuuaaaagugggcauagugccaaaugcccuuuggggagguggguggagguugguuugggguuuuuuugaggcaggguuucuguguauauccaccauggcuguccugugccaacacacugggcagccuggaacuuauguagaucccucuaccuuaguuuugaguguucugaugauaaugugagucaccgcucuagacuuagaagaaacuuuucuccuacagaaauucaacccuuggcauuuaaaguuuuuagucaggugugauggugaauaccuuuaaccccagcacuugggaagcagagacaggaggaucucugaguucaaggccagccuaguggacuacagagugaguuucaggucagguugggaaaccaugucuacaaacaaacaaagaaagaaaaaaccaaaacaaacaacauaacaagugauaaaauguuugaaguuuagugauaguggcucauuaguaaaaaugcccuaacauguaugauacucauguucagugcuaagugcuacagaauaaacauuuacucaaauauuuccuucuuucuaauaguuauugcuauuuccccgaccccaugcucccaaagcugacccccaacugaauguauaucucugccuccucagugcugggguggcaucugccaucccuaccaccugcugccauacaggaucuugaaugacacauuuccuucagagagcuggaguuuaacuucuaggaugcacaggacucaguuccugcugggaguggaauccauugccuaaacuggaaaugggugguaauaagauguacuguggcaguggauauuugagaccauaguccuggggccaacagggagugggaugguguuguggucaguguagcacagaguagaaggaacuagauugaggucucugucacucuuggaacagugacugugacccugaccuagcuccugucucgggugaggugagucucagcacuuaucuuuuuucuaaauguugccccaggaauccuuccugaagauccaucaggaugagcugcaagacuccacccacacuccaggaacuggcagagaacagccuccugaagaaccaggacuuggcuaucucugcucuggaugacauacccucacuuuucuucccaucacuguucaaaaaggccugcagaaauagauauguugggaucauaaaggcgauggugcaggcguggcccuuccccugucuuccucugggggccaugaucaguaggaagacugccuacaggagaaucuuagagauuauccuguaugggcuugaugccuugcuuucccagaaaguuccccacaggugagugaaacccagaagggaauacaagcagagacaguuggggucagguugaaugggggagacaagguagacaaggauggaagggaggcuuuugauggccccagcuuggagagcuacaggggcuuuuuggccauugcugagccaucugggaaaggacuguggagugugcaggguuuaucagcaguggcugaaguacucugccccuguuucccauggggacuggacuggauucauggacaagggcaugagagucagaaugugguaaaugccuaggugcugagacucuucuguuucacccacagcaggugcaagcugcaagugcuggauuuacggguuaugccuuugaagcuguggaacagguugccuguguuugggacugcuggcugcagugagaauccagcaguggugggccauucgggaacagaggugaaacagccagugaaggugcugguagacuugguccucaaggaaagcccacuagauuccacagaguccuuccucguucaguggguggauaacaggaaugguuuggugaguuugugcuguugcaagcugcagaucugggcuauguccauguauuaccacagaaaacuuuuggagauuuuggaucuggacucuguccaggagcugcguauguacugcaucaguaauccugucugccugcuuaacuucgccccuuacuugggucgcaugaggaaccugcgcugccucauccucucucaccucuggcagaccuucucgaugaccccgguggagaagcagcagguuauuacccaguucacgucucaguuccucaaacugaaaugccuccagauccugcaucuggauacugucuucuuccuagagggucaucuggaugagcuauucugguaaggagggguggucagguuucucauuagaguaaagcgaagccuuggcauuuagacauuagugggcaugagcucucugcagcuacugggagauugacauuaccgaggcauuagaguaucagggcauuguuuugugucugcugucccagagagagguggucacauagccacuaauacaaaggaguagggucaagcuggaguugauggcuuggaaaggguguaccaugcuaggaagccuucucaguaaugagaucaagugagaauggguucuuaguucuuuuuuagcaagugucuaagggaaauuggaaaagggaaaaggaaggcauugaagagggcuguacugcacaccugcacaguucccaucaaagacaggcuaguuuuugagaugaggucaucacauguaguacagauugggaguaagauuggcuuguacuucccauaauccuccugugucuggucccuagugguaucauaucacagguguguacugccauauccguuguugguuugaccucaagcagaggucaaugagcggaugggaaaugggacauuaugccuagguuggucuuucagguguaaaagggacuuguagucuuggauugagcuguuccuauagugauggugacaggccucaguauagauuugaaugugcagagucuaguuuagaauaucauggguauugugauuagaaagaucuugaaccagaugcauauucccagaaaugucuucuuguuuccuuuuuuuuuuauagguggcugaagacacccuuagagacccugucugugauugauuguaaucucucaaaaucagacugguuccauauaucugaguuccagugcacaagucagcuaaaacaccugaauuugaaaugggucaaacugacccauuugagcccagagccccuucgaguucuguuacuaaaaucugcaucuacccuaacaucccuggauuuggagggcugucaaaugauggacucucaacucagugccauccuaccugcucugagaugcuguacacagcucaccaaguuuaauuuccaugggaacuauaucuccaugccuauccugagggagcuggcauauaacguugucaagcagaaaucccaacagucaaagauacgcuuuaucccaagcuguagucaucacaguggucuggaguuugaggccauuucucagccucauauuguguuuguagauguggaucggacuacuggggagcaagaacaagucuuguuuuaugcuauuuguucuggagaauauguguuaugauaucucuacaauguauuaggacuuguuagacuccuaccuaaugagauacagauuuaagcucucuuguggacacugggaugugucuggucagaguaugcacaacacaugcuuuuagacugcaguucuugcgagugagaagagaaaguugaugcuagagugcaaacaagugagaguauuugacauagggaaugugggacacauugacagaagucaugggaguggguucugguugggcagguacaaaagggcauuccuccagccugguguuuuuuugauuuuuguaguaaaaaaugggaccaucuguccuaccuggaugauucaaauccugugacugcuaggaacaaacuuguuuuaugcuauuugcugguucuucuacuuugaucuucugagugcugaguauaggcuuauagcaccagaccugguucccuguaguuccuuuaacauguggcuauaccucucaucuuucuagucaaacccaguauuuuauauaguagcaguuuuuguggggcuagagagauggcuuaucaguugagagcacuugaugcuuuuguagaguaccuggguuugauuccccucauuuacauggugguucacagucauccagaacuacuuauggggugcaugaggcaugcauguagugcauagacauacauguaggugaaacacucagacauguaacucuaaaauaauuuaaaaauugauuuguacugaugagacugaaugucuaguugaggcagccagcacccaguauuucuaugacagacacugcuaagucauguauuuauacucguaaaaugcuaccuaugagcuuagcaaauugaaccaggaauauauggaugaguagacaauaaacucuagcaggaaaaaccccaagcuuuuaugacaauauuaaacaccccagaccacugaaggaugcaauccccaucccgaaucaucuaaagagggacaucagguacugagccaucagacuggguugaaaugagcuccugacucugucccuaggcuacagcacaacugaaccccacugcugaaccucuuuaauuuuuuuguggucaaugaacugugucuacaaaugaggcugugguuaaacgucaggugucuguguaucuugcucuuauucacuugacaaggcuuucauggaaccagaagcuugaugguucaccuagaccuaggacuguuagccagagggcuccuauaggucugccagucccugugcuggagucacaggcucaugcaucuauggcugaccucuucucucccccu

SEQ ID NO: 2247 - RNA, 1133 nt, Mus musculus
accucaaagaaggucuaaguaauuuauaucagugcucaagaaaaauuuuggacauuguggcucauggccuggagcugucuguaaaacuauggauaauuucaaugggcuugguuagacugcguuuuuccaugucuuguuuguuugauaaagggaagaacagagaaggggagaaggaagaggcaagaaaggcugguagacagcaagaaggcaggcaaagcugcugugaacacgcugcucguuaacaagccacacacauacugcucacauuuucaucaucuuaaguacauuaucauaacauuaaaaagagaaaaaauguuaggaaaauguaucuaauccucaaaguuaucacaaguaugcuggaauuguuuggcucuuuaaaauuauaaauaauaaagacacuaacuuuuuugugcuugugaagcuaauagaucaucuucaagaaacaggcagcaaugaugaauugcaauauguuauuacugaagggaaaagguucaagccauauucacacugcugucaaugaaagaguauggggccaaagcagugagcuucugcagaaggguugaaagaugccagggggauuaggaguaacagccgccuucauugacugguugcuccugaggauuuuccaguuuuaugucaaucaugucuucucugauucuguccugugugcuuuccauuccagguaaagcugcagcaacacacuggaaaagcugcuuuacaugguauccugcuuuugcauugguuucaauaaacauaacauucaucucuuuggcuuuccucucucccuccucaauugacacuugccucuuaucagcaagaacuguuuuauuuccuacuagcaugauaaugacaucacuuccucucucuguucugacaucaucaauccauuuuguaguuugcuggaaugaguuaacauuugugauaucauaaacaacugccgcaguggagucaugaguguagcuaggaaucaagcuccugaaccucucuugaccugcugugucccauaauugcaaucgcacaguucgauccucccaguacauuguuuuuuauaagaagucaaugccaauuguugccugauaaguguugucaaaacugucauacacgaaucuggugaucaaggacgucuuuccaag

SEQ ID NO: 2248 - RNA, 1847 nt, Mus musculus
cagacucucuucucagcauccaagcucgcuuggucagaacccuuggaugagccugugggacccuuccuccuagcccugugguuuggagccggaggcuuugggacugugagaggauggacaaagauucucaggggcugcuagacucgucccugauggcgucaggcacagccagccgcuccgaggaugaggagucacuggcagggcagaagcgagcauccucccaggcccugggcacuauucccaaacgcagaagcuccuccagguucaucaaaaggaagaaauucgacgaugaacugguagagagcagccuggccaaauccuccacccgggugaagggggccggcgggguggagucaggccgcugcucagggagcgagcccuccucuagugagaagaagaagguauccaaggcucccaguacuccuguaccucccagcccugccccaaccccugggcugaccaagcgugugaagaaaagcaaacagccacuucaggugaccaaggaucugggccgauggaagccugcagaugaccuccuccucaucaaugcugugcugcagacuaacgaccugacaucuguccaccugggugugaaguucagcugcugcuucacccuucgggaaguucaggagcgcugguacgcccugcucuacgacccugucaucuccaagcuggcuugccaggccaugaggcaguuacacccagaagccauugcagccauucagagcaaggcccuguucagcaaggcugaggagcagcugcugagcaaagucggaucaagcagccagcgcaccuuggagaccuuccaggacuugcugcauacacacccugaugccuucuaccuggcucguacugccaaggcucugcaggcccacuggcagcucaugaaacaguauuaccuacucgaggaucagacagugcagccacugccuaagggggaccaagugcucaacuucucagaugcagaggaccugauugacgacaguaagcucaaggacaugcgagaugaaguccuggaacaugagcugacaguggcugaccggcgccagaaacgagagauccggcagcuggaacaggaacugcauaaguggcaggugcuaguggacagcaucacaggcaugggcucuccagacuuugacaaccagacccuggccgugcugcggggccgcauggugcgguaccuaaugcgcucucgugagauaacccugggcagagcaaccaaggacaaccagauugacguggaccugucucuggaggguccggcuuggaagaucucccgaaagcaaggugucaucaagcugaaaaacaauggugacuucuucauugccaacgagggccggcggccuaucuauaucgaugggcgaccagugcugugcggcuccaaguggcgccuuagcaacaacucugugguagagaucgccagccugcgauucgucuuccucaucaaccaggaccucauugcccucauccgggcugaggcugccaagaucaccccacagugaggcgguagcagaaaccaggguauucuccagccucaguuucccugucauuccagcucccuugagcugggaacucaggcuccuggaaaacccuuguacccagaguggggaguggaggcccgacugcuggcccauugauugagccuuugaggcaagguggggucaccauggggaagccaggagaggcugggaccccugugccuccccagagccagagcaccaccaucgccaccauugucacuccugugucuccagugagucagcuuuagacuccuuuuuguuuuuguuuuuguaaauaaaaaguacugaguuccaaaguaaaaaaaaaaaaaaaaaaaaaaaagaaaa

SEQ ID NO: 2249 - RNA, 1847 nt, Mus musculus
uuuucuuuuuuuuuuuuuuuuuuuuuuuuacuuuggaacucaguacuuuuuauuuacaaaaacaaaaacaaaaaggagucuaaagcugacucacuggagacacaggagugacaaugguggcgaugguggugcucuggcucuggggaggcacaggggucccagccucuccuggcuuccccauggugaccccaccuugccucaaaggcucaaucaaugggccagcagucgggccuccacuccccacucuggguacaaggguuuuccaggagccugaguucccagcucaagggagcuggaaugacagggaaacugaggcuggagaauacccugguuucugcuaccgccucacuguggggugaucuuggcagccucagcccggaugagggcaaugagguccugguugaugaggaagacgaaucgcaggcuggcgaucucuaccacagaguuguugcuaaggcgccacuuggagccgcacagcacuggucgcccaucgauauagauaggccgccggcccucguuggcaaugaagaagucaccauuguuuuucagcuugaugacaccuugcuuucgggagaucuuccaagccggacccuccagagacagguccacgucaaucugguuguccuugguugcucugcccaggguuaucucacgagagcgcauuagguaccgcaccaugcggccccgcagcacggccagggucugguugucaaagucuggagagcccaugccugugaugcuguccacuagcaccugccacuuaugcaguuccuguuccagcugccggaucucucguuucuggcgccggucagccacugucagcucauguuccaggacuucaucucgcauguccuugagcuuacugucgucaaucagguccucugcaucugagaaguugagcacuuggucccccuuaggcaguggcugcacugucugauccucgaguagguaauacuguuucaugagcugccagugggccugcagagccuuggcaguacgagccagguagaaggcaucaggguguguaugcagcaaguccuggaaggucuccaaggugcgcuggcugcuugauccgacuuugcucagcagcugcuccucagccuugcugaacagggccuugcucugaauggcugcaauggcuucuggguguaacugccucauggccuggcaagccagcuuggagaugacagggucguagagcagggcguaccagcgcuccugaacuucccgaagggugaagcagcagcugaacuucacacccagguggacagaugucaggucguuagucugcagcacagcauugaugaggaggaggucaucugcaggcuuccaucggcccagauccuuggucaccugaaguggcuguuugcuuuucuucacacgcuuggucagcccagggguuggggcagggcugggagguacaggaguacugggagccuuggauaccuucuucuucucacuagaggagggcucgcucccugagcagcggccugacuccaccccgccggcccccuucacccggguggaggauuuggccaggcugcucucuaccaguucaucgucgaauuucuuccuuuugaugaaccuggaggagcuucugcguuugggaauagugcccagggccugggaggaugcucgcuucugcccugccagugacuccucauccucggagcggcuggcugugccugacgccaucagggacgagucuagcagccccugagaaucuuuguccauccucucacagucccaaagccuccggcuccaaaccacagggcuaggaggaagggucccacaggcucauccaaggguucugaccaagcgagcuuggaugcugagaagagagucug

SEQ ID NO: 2250 - RNA, 39578 nt, Mus musculus
uaggcagaaaugaagggaaguuccgacauuucaucauucucuuuguuucuuggcugccucgugguaaggaacuacuggaggaagacucaugccuaguauuugcugaaccugaaaacuucuuuaagcugcaguuguugugcuggccuccuaggauauucagcagcugguccugucaccuuccaggucagaggagcuguugggcugggaaaugggcaggaacaagaccagcauguggagcaggggugcauuuucugcagccacucuuacaauuuuguuguggauaucuugccauugucaggaaguuugagacccugugaauuggguucauggugauguuuuaauuaauuuuaugauugccagaauauuuuuuuuaauaaccccguagauccuuggccgucucuguaguuuguauauaagggugguugucuuugcaaaagccuuaauaaagcuccucgaauucaaauucauucaugcuuucuuaacuccccuguuccuccauuugccauuucauuucccuuucuccagggaacuaaauaggcaucccgagagagcuuuguagauaauugucauauggggaccagugcagauuugauugacuuacaaaauauucguuauaaaguaccaucauauuacuguaaauauuaacauuaaccuagcaaaauuauagucuccguuaguuuagcacugagguauauguagucuuugauguaaauacagcauugagaaaugugucuucauaggcuuaguuacucauuagguuugaaugaaacaauaagacaggauugcaguaagguacgacugaggagaaaauauauuguagguucucuuaacccugagugucgccagagaaaaacucauuguaccaucugggcaagugauggauuuggucacaugcuacaggcguuuguauuggccauuauaguuuccuaugagguuucauuauuuucuuaagacaugaaaccugcagcauuacaagaagauaugugauucuugagugggguuaauuuuuggcauuucagucccagggagaaagcauucagagaaaucugguuggguccagacugaaccaggccaucagguguggggaggggaauugaggaugagauggagcauagagggccaggucaaaagauaaccaggagccaagaaaacaucuaccuaacuaugacuuaauugauauguuaacaggcaucccaguuagccauuccucuugaauuucuuugaauccuuccaagguucagaccagcaugcugagagagaaugauuucaggccaagauauuuuggggggggggggguuggagacaggguuuuucuguauggcccugacuguccaggagaucacucuguagaacaggcuggccucgaacucagaaaugugccugccucuuccucccaagugcugggauuaaaggcgugcgccacaacacccggcaggcaagauauuuuaguaaguggaaaacuuacuauggauuaaaacaaaauuagacagcaccuuuugaguaauuaugauugcucacuuacauaagaaaaaugacuccuugcuucaugaaaagcccauauacauucaugguuuguucugcacuguggacuugcaggugugggaaugcuuggacccugcauucagggcuuuuuuuuuuuuuuuuuuuuuuuacacaccucuugcuggagaaguccaacugucuggauaguguggaucagaauaguuuacuuccagucuucccuggucuucuuccuuguugcuuggaaaaggacucuauguguguuaacugugugacugacuugcacaucucuaggguaaacugaaauacucagagaaaaaagagacauuuucauaauuucuucccuuucccucauguuuauccuuuuaucagguauugacaucucucauuuguguuccaugaaaaguucagguucauucugaacaauauuuuuccauuuucagauauucauaugcucagccaaaucugcauaacuguaaaucaacacuaagagcaguggaagguuaaagguaaaggagagucucacaaaggauccagguauguuagagguauuggagggguggaguggggcucaccuguuaggagaaagaggacaugaauuugauuuugccagauucuauuuccuuaaugauucuggaaaagaguaauauuagaugugaugauauggauuucccaugguaggcagugcugucagcguucacuugaugucaauauuuaauuaauuuugaugcuggaaaauuguuguuacccauugaaaucaaaguuucuuuuacucagauugaaagcagcaucaggguaugggugugacaagagcaauuuauacauaaagcaaaugucagcaguagauucccuccuagggcccaugaccuuccuuaugaauuuugaggcagauuuucauuauaaccaacguauuuuuuuuucuuguguugcuugaaccagaaaaccuucuguuacccacagauaguaaaaacuuccaugccuugucuggcagauucagauugcagcaagcagguugcaaaccugaguaagacauugauaacucugcuuccugccccaauuugccuagcaguuuuugucacuaugaaaguucccaccagggugucuaagauguauguugagagugaauggccugauaugaggugguuuucuccagaaggucuacuugcuuucugaaucaccuauucuguccacucuaaauguuuuccuguccuugaccuguguucuuauugaugcucuguguugcauuaguccccauuagaguggaguaauuauuuuuuaccuucucuguccuguuugcuuuaguuuugagucugcuugccuuauuucugugguaugcuucuucucuuauauucuugagaacuuuuauacugagcagugucuacuuuuuaccacagggcuauauaaguaaguuucauucuccuacugucaguguaauuugggaguauuccugccuacaucuauuaaccuaggccuagucauguaagcuucuagucuccauacaguauuaucuaggccugguguguuuucagccucugaaauuugcugcugaauaagcucccccucucuuauuccuucucaaugcuuaccuggcugauucaacucaguuuuuccagcucuaacuccucucccagcugaguucuucucucagacacugaauuacuccacuuggccuuaaauuuacuguagaaaucuuuauuaaucuucuggcuccuacucuuucuccuguucauucugucuuuaccugugccuagcauguucucucuucagccugagucuguaaaacucucccaguaaaacuguguccuucucccucucuguggcucuacucucucaacuguacuguacugcagcccaugcacucuacuguauuccuuuaccauucucuucuuccuguacugucuuucucucccuuaaguagcuucccuguccucucauuacagcaaaguugggcauauccuauucugucagaucuuucucuaauauuccauauuuucugucauucaauuagacaccacuuccaaacacgaguguguccuucuacauauaaacuguaguuuugauauuuuggauuaaagugaguacuaaggccuugccuguacuaaaaccagagugauuaauguugugugccuugggcugaaccacacccuaagucacaacagguucaaguaucccuacccaaugugaugucaguuuaguucuguacaaucucuucuuccugaaaugaaaaccaagauucacauauacuacacuucaguauguugauaucuguuucauuuuuucugacuucuacuagggauuuuauuauauguucuuugaagaucagucgaugauauucuguucuuuaugagauuauguuccuuaggauuuuuaaucuggaagauuuugcuggcaguguagguggcaaaguaugguucacuuuauucucaauuccuugugcgcaauagagcuuuacuguguuguauaugaggaguauuuacuaguucuccuguauuuauucauucuuagcaagaaauuucuuauuuccuaugaccucaugaaaaaugucugccuuauuuuuuuuuuuuuucgagacaggguuucucuguauagcccuggaacucacuuugaagacaaggcuggucuugaacucagauaugccccugccucugccucugccucccaagugcugggauuaaaggccugccccaccacugccuggaucuaaguagguuuuugacucaaaaacauguccuaaugaauuacuacauucaaguuuacuuuauauacugucaauacuaguagccucuuacuuuggguugccaguuauugucucucagggcuugagaaauauuauuccagugacuccugauucuaaucuauguguaucuauuaguauugcaugcaacuguaaugucgccacauugaugguaagggacaggacaagacaauacgaaaagagauguacacuguuauagcacuuagaugugacaaaaggcagauacaucugggaguagagaaagccaaucuguaauagccuucccuagggaaugcuaagcuagaaugcuauguucuucuucuacuuaagagucccagugucugaacacacuacccauuacuauuauaguuuguccaccuucaaaauauugggaugaaacaagugauaguaaaaaauggacuggaaggcugauaaggacagaauaaaguuuguucagaaucagaugucaauuugaggaaauaacagugucaaguuuuaaagucaaagcccuaguguuccuauugacuucuugguggcugugaaaccauggguuauucucuccauccuagaaugagcucuuuuuuagucuacaugagauggaagauguacuuuuccuguuauacacauagacuaaauaauucccugauauacauugauuccauguauuuacuauucuugaaacuaaagcccaguaucuaucacugguacaggaauuuaggaucuguugcuguaaaguugacaauacucaaccuguaugucacaggcaagauucauaaagugacaugcucugcaaaaaauguccugauuauucccugaauauuuaugcauuccuaugccuaguuuuuuucuagcucacuuaauguugucuucaaaugccugggucguagagauuuacauauuauaaauuuaugacagcauuauauuuucuccaaaucuacauuucuguugaacagaaauucuuuuucuuuuuugauuuauuuauuuauuaauauguaaguacacuguagcugacuucagacacucagaaaagggcguuagaucuuguuacagaugguuguaagccaccauaugguugcugggauuugaacucaugaccuuagaaagagcagucagugcucuuacccgcugagccaucuuaccagcuccaaaaauucuucuugucacucaauuuuccaucacaugaauuagggauuaucuucauuauuuaugcauauuacaacuguuagaauauuuacagggaaacauucugguagaguauuuguacuauccauuuucuuugcuauugcagauauuagaaagcuccuaaaguuuuuuuaaucugugcuaucuaaaucuccugguacuagcauuuucaggugaaugguguuuguacaaaaucaguguggaggcuuugcacauccuugucucucucuaauuaguaggauagaaugaugacagaugucuucaguuuuuguagugauagguuuaagaugauggcuacuauguuuauuagacucagugauauuauuuuucucucuuuuuuaaagauuuauuuauuuuauguaugugaguacacugucacugucuucaaacacaccagaagaggacaucagaucccauuaaagaugguuaugaaccaccaugugguugcugggaauugaacucaggaucucugagugauguucuuuuucuuccacauucuucagagauuucauagugauccacugugauauuuuguccuaggccuuucuuagauauauugacaugguugagagccuucucucacugauucuauguacuuugugccuugaguuauuugguuuuugcuucuugaaacagucuugcaucuauggcaugaaaucaaguugaguucauuuucuauauucauuagagagaauuuuuuaauuauuuuauucaugcauauuuuuauggucauuugccuuugcaucccgguauagacagcuuugugugaugacugcaccacauucucuuucuuucuguauucugcaauguucucugugcaagaugauugugggauuuucuaacgaaauuugugaauacagugaugcaucuauguaguucucagacaguguuagaagacacucugcaggccuggguuuccacacuugcuuaaugccuggccuaguguuaggacauagaaaguugucuuguucacuucuuccuaggauaucauuuuuccccuguuaguucucauuaauuguguaugacuuucuacagcauuccaucaucugcuaugucccaguuucaauauaaacuaaugaggcaucaauacaacaggguacauauaguacauagauacacuguaucugccugcgagaaugaaauggaaucucaucauaggguuaggugugauauucuaguaugaugucuaaugaaacaccauucaauucuaggcaucauucaugguaggcacuagccauuuguccuugacucuagucccaggaagauaaguucucaguaacaacccugauaauaguguuuuacagccuggaugcauaugcucuguguuuaugccaggugcccacugaagucagaaagaguccucagauuauacuuauauuccuuacuacacuaaauaugucacuccaugcucucaugucuguagaaauguuggcaggguuccuuguaucauuuugcuuuuaauguccuuuuaugugguuuaucauuguuuauuacauaguuguaguaauuucauuuuuguauuuuucaaacccuguugugaaacuucaagaagaguuccaauauuucaaacugggagaaaaaaaaaaaggaugaguucuucucuggcaaacacuccacaguuuagugugcuguccacauuucuuugaaaaauccuuuuuucauucaaaccauuccauaguucuguuaaucuauauguggucauauuaucuaaaaggauuuuuuucuaugcucuucauuuucuucuggguugaggaauauuuaaugguuaggucuuuuuacuuauauaauaccauuauauuuuccaugcaauuuccauggacugaaaaccucaaaucucaaagguaaucuauuguaaaugaugcucaaaaaauauaucgauugggaauuuccacuuuggauggaguuuuguccuuuuauauaaguguggaaggaaggucucaugugucacuuaauuugcauugggguuccugugcucagucugauaguuaucugcaagcaccacgaaugcauuuguauuggucagacuguggcauagccucaggggauagcucuaccaggcuccuaucagcaagugcuucuuggcaucuguaauagugucugggguuggugucugaagaugggauggaucccuagguggggcagucucuggauggccauuucuucaguuucugauccauucuuugucccugcauuuccuuuagaaaggaaccauucuggguuaaaaaucuugagauggguggguggccccuuucuucaacugugguccuugccuaugcacuggauauggucucuacagguucaguccccccuuuguuggguauuucagcuaaugguaucacaguuggguccuggugaccucuugccuuccuggcaucugggacuaucuaguggcuacacccaguuccgcaccccgcagugcuacacaccuccauucaauuuucugacucucuguacuucucgccugucuccucccacuccugauacuccccccaucccauuucucuccccuccccucacccccccccgucccucccuuugcuucccuuuauaauuuuucuccuaaguaagacugaagcuuccacaguccuucuuguuaaguuucauauggucugugaguuguaucuuggguauuccaagcuuugaggcuaauauccacuuaucagugacuacauacaauguguauccuucuuaggaugauauuuucuagguccauccacuugccuacaaauuuaaugaauuuauuuuuuuauuagcugagugguacuccuuucuguaaauguaccacauuaucuguaucaauuccaguguuaaaggacaucuggguuguuuccagcuccugucuauuauaaauaagucuccuaugaacauaauggagcaugcguacuugucauauguuggagcaacuuuuggauauaugcucaugaaugguauagcuggguccucaaguagacuauuuccaauuuucugcagaaacacuagacuguuuuccagaguggucagaccagcuuacaaucaaucccaccagcaauggagcaguauuaucuuccccuuugucaacauccuaaccagcaucugcuguuaccugaguuuuugaucuauuugcauuucccugaugacuaagaaugucauuucuuuaggugcuucucagccauucaagauuccucaguugagaauacuuuaucuauguauccuauucuuuuuuuguuguagguuuuuguuuuuuaccaugugucauuuuuuaauuaguuauuuucuuuauuuacauuuccagugcuaucccaaaagucccccauacccuccuaccccacuccccuacccacccacucccacuucuuggcccuggcauuucccuauauugaggcauauaaaguuugcauguccaaugggccucucuuuccgcugauggcagacuaggccaucuucugauacauaugcagcuagaaacaugagcuccagggguguacugguuaguucauauuguuguuccaccuauaggguugcagaucccuuuagcuccuuggguucuuucucuagcuucuccauugggggcccugugauccauccaauaguuaacugugaguauccacuacuguguuugcuaggcuccggcauagucucacaagagacagcuauaucuggguccuuucagcaaaaucuugcuaguguauucaauggugucagcauuuggaggcugauuaugggauggauccccagauauggcagucucuagaugguccauucuuucauuucagcuucaaacuuugucucuguaucuccuuccauggguguuuuguuuccaauucuaagaaggggcaaaguguccacacuuuggucuucguucuucuugaguuucaugaguuuucacaaauuguaucuuauaucuuggguauucuaaguaucugggcuaauauccacuuaucagugaguauguaucaugugaguucuuuugugauuggauuaccucacucaggaugaugcccuccuggaccauccauuugccuaggaauuucauaaauucauucuuuuuaauagcugaguaguacuccauuguguaaauuaccacauuuucuguauccauuccucuguugaggggcaucuggguucuucccagcuucucuggcuauuacaaauaacucugcuaugaaccuaguggagcauguguucuuauuaccaguuggaacaucuucuggauaaauaccccggagagguauugcgggauccucugguaguacuuuguccacuuuucugaggaaccuccagacugauuuccagagugguuguacaagcuuucaaucccaccaacaauggaggaguguuccccuuucuccacauccucgccaacaucugcugucaccugaauuuuuuaucuuagccauucugacugguaugagauggaaucucaggguuuugauuugcauuucccggaugauuaaggaugcugaacauuuuuucaggugcuucucaaccauucaguauuccucaggugagaauucuuuguuuagcuuugagccccauuuuuuaaugggguuauuugauuuucuggaguccaccuucuugaguucuuuauauauauuggauuuuaauccccuaucugauuuaggauagguaaagauucuuucccaaucuguugguguuuuuuuugucuuauugauggugucuuuugccuugcagaagcuuugcaacuuuaugaggucccauuuaucuauucucaaucuuacagcacaagccauugcuguucuauucaggaauuuuucccauguucccaugccuucgaggcuuuuccccacuuucuccucuauaaauuuaacugucucugguuuuauguggaguuccuugauccacuuagauuugaccuuaguacaaggagauaagaauggaucaauucgcauucuucuacaugauagccagcaccauuuguugaaaaugcugucuuuuuuccaauggaugguuuuagcucccuugucaaagaucaagugaucauaggcguguggguucauuaauggcucuucaauucuauuccauuggucuacuugucugucacuauaccaguacuaugcaguuuuuaucacaauugcucuguaguacagcuuuaaaucaggcauggagauuccaccagagguucuuuuauccuugagaagaguuuuugcuauccuagguuuuuguuauuccagaugaauuugcagauugcccuuucuaauucguugaagaauugaguuagaauuuugguggggauugcauugaaucuguagauugcuuuuggcaagauagccauuuuuacuauauugauccugccaauccaugaacaugggagaucuuuccaucuucugauuuuucuuugauuucuuucuucagagacuugaaguucuuaucauacagauauuucacuuccuuaguuagagucacgccaagguauuuuauauuauuugugacuauugugaaggguguuguuucccuaauuucuuucucagccuguuuauccuuuguguagagaaaggccauugacuuguuugaguuaauuuuauauccagcuacuucacugaagcuguuuaucagguuuaggaguucgaggguugaauuuuuagggucacauauauacuaucauaucaucuucaaaaagggauauuuugacuucucccuuuccaauuuguauucccuugaucuccuuuuguugucgaauugcucuggcuaggacuucaaguacaauguugaauagguagggagaaagugggcagccuugucuagucucugauuuuagugggaaugcuuccagcuucucaccauuuacuuugauguuggcuaccgguuugcugcagauugcuuuuaucauauuuagguaugggccuugaauuccugaucuuuccaagccuuuuaucaugaauggcuguuggauuuugucaaaugcuuucuccgcaucaaaccagaugaucaugugguuuuugucuuugaguuuguuuauaugguggauuacauugauagauuuccauauauuaaaccaucccugcaucccuggaaugaaaccuacuuggucaggauggauaauuguuuugauguguucuuggauucggauagugagaauuuuauugaggauuuuugaaucgauauucauaagggaaguuggucugaaguucucgaucuuuguugggucuuucugugguuuagguaucagaguaauuguggcuucauagaaugaauuggguagaguaccuucuacuucuauuuuguggaauaguuugugcagaacuggaauuagaucuucuuugaaggucugguagaacucugcacuaaacccaucugguccugggcauuuuuuugguugggagacuauuaaugacugcuucuauuucuuuaggggauaugggacuauuuauaucauuaaccugaucuugauuuaacuuuaguaccugguaucugucuagaaauuuguucauuucauccagauuuuccaguuuuguugaguauagccuuuuguagaaggaucugaugguguuuuggauuucuucaggaucuguuguuaugucucccuuuucauuucugauuuuguuaauuaggaugcugucccugugcccucuagugagucuggcuaaggguuuaucuaucuuuuugauuuuucucaaagaaccagcuccucauuugguugauucuuugaauaguucuucuuguuuccacuugguugauuuugccccugaguuugauuauuucugcagucuacuccuugggugaauuuucuuccuuuuuuucuagagcauuuagguguguugucaagcugcuugggugugcucucucuaguuucuuuuuggaggcacucagaacuaugaauuuuucucuuagaaaugcuuucauuguuucccauaaguuuggguauauuguggcuucauuuucauuuaacuccaaaaaguccuuaauuucuuucuuuauuccuuccucgaccaagguaucauugagaagaguguuguucaguuuccacgugaauguuggcuuuccauuauuuauguuguuauagaagaucagccuuaguccauggugaucugauaggaugcaugggacaauuucaauauuuuuguaucuguugaggccgguuuugugaccaauuauacggucagauuuggagaagguaccaugaggugcugagaagaagauauauccuuuuguuuuaggauaaaauguucuguaaauaucuguuaaauccauuuguuucacaacuucuguuaguuucacugugucccuguuuaguuucuauuuccacgaucugucuauugaugaaagugguauguugaagucucccacuauuauuguuugaaguggaaugugugcuuugaguuuuacuaaaguuucuuuaaugaaugugccugccuuugcauuugcagcauagauauucagaauugagaguuccucuuggaggauuuuaccuuugagaagaaugaagugucccuccuugucuuuuuugauaacuuugguuuggaagucaauuuuauccgauauuagaauggcuacuccagcauguuucuucagaccauuugcuugcaaaauuguuuuccagccuuucagucugagguaguaucucucuuuuucccugagauggguuuccuguaagcagcaaaauguuggguccuguuuguguagccagucuguuugucuaugucuuuuauuggggaauugaguccauugauauuaagagauauuaaggaaaaguaauugaugcuuccuauuaauuuuguuguuagaguuggcauucuguucuugugacugucuuuuuuuuagguuuguugaaggauuacuuucuugcuuuuucuaggguaugguuucuguccuuguauuguuuuuuuuuucuguuauuauccuuugaagggcuagauucguggaaagauauguauaaauuugguuuuguuguagaauacuucgguuucuccaucuaugguaauugaaaguuuggcuggguauaguagccugugcuggcauuuguguucucuggggucuguauaacaucuguccaggaucuucuggcuuucauugucucuggugaaaagucugguguaauucugauaggccugccuuuauauguuacuugacccuuuucccuuacugcuuuuaauguucucucuuuauuuagugcauuugguguucugauuauuaugugucaagaggaauuucuuuacugguccaaucuauguggaguucuguaggcuucuuguauguucaugggcaucucuuucuuuagguuugggaaguuuucuucuauaauuuuguugaagauauuugcuggcccuuuaaguugaaaaucuucauucucaucuacuauuaucuauagguuuggucuucucauuguguccuggauuuccuggauguuuugaguuaguaucuuuuugcauaucuuugauuguugugccgauguucucuauggaaucuuuuacaccugagauucucucuuccaucucuuguauucuaugguuccagauuucuuuccuagguuuucuaucuccagcguugccucacuuuggguuuucuuuauugugucuacgucccuuuucaggucuaguauuguuuuguucauuuccaucaccuguuuggauguguuuuucuguuuuuuuauacggacuuguaacucuuuaguagaguucuccuguauuucuuuaagugaguuauuaaaguccuucuugauguucucuaccaucaucaugagauaugguuuuaaaucugggucuagcuuguguugggguacccaggacugggugaggggguagugcugcauucugauaauggugaguagucuugguuucuguuaguaagauucuuacguuugccuuucgccaucugguaaucucuggaguuaguuguuauaguugucucugguuagagauuguuccucuugugauucuguuagccucuaucagcagaccugggagacuaacucucuccucuguguuucaguggucagagcacucucugcaggcaagcucuacucuuacagagaaggcgcacagauaccugguguucagaccucccuccuggcagaagauaaaggcccaaaacaggaccugucccagaagcuguguuagcuucuguaguccacacucucaccugcaaagcccuccuggacagagcggauaccucuccucuggcagggaaggugccuguauguuuggagccugaaaugggucuguuucagaagcuguccucuagggaccuuggggguguccgaugacucugcgcccagguguccaagugcuggcgccaaccggaagggacuugugacccuggucagguuggguuuccugcuucucuaaugcugucucaggucccaaacgauuggauuggaacagaaguuuuauaccacucaucggugguccuaagaucguguggagaguccucuagggggccuugggggugucugccgacuccaugcccaaggugacacggugcuggcgcagaucggaagggacuuguaacccuggucaggaccuguuuuuuuuuaagacaggguuugucuguauagcccuggcuguccuggaacuuucucuguauaccaggaaggccuugaacucagaaauccaccugccucugccucccgagugcugggauaaaaggcauuugccaccacgccuggcucuauuuuuuuuauuacauauauguauguuuacauauauguauacuuacauauauguauguuuacauauauguauacuuacauauauguauguuuacauauauguauguuuacauauauguauacuuacauauauguauauauauauuuaaauauuuucuucauuuacauuucuuuuuucuuucuuucuuuuuuuuuuuuuuuguuguguuuuuuugagacaggguuucucucuguagcccuggcuguccuggaacucacucuguagaccaggcuggccuugaacucagaaaucugccugccucugccucuagagugcugggauuuaaaggcaugcuccaucaccuccuggcugagcaucuacuuuauuugccaggaacuggcauaacuucagaggagacaggcauaucaggguccugucagcaaaaucuuguuaacaguugaaguagugucuggguuuggggauuguuuaugggauggauccuuggguagggcagucucuggauggcccuuccuucagucucagcuccaaacuuugucucuguaacucguuccauggcugaguacccuauuuuuaaaaaauauuuauuuauuauauguaagugcauugucgcugucuucagacacuccagaagauggcaucagauuucguuacggaugguugugagccaccaugugguugcugggauuugaacucaggaccuuuggaagagcagucagugcucuuaaccgcugagccaucucacuagcccccauguacccuauuuuuaauaggguuauuugguucucuagagucuaacuucuugaguucuuucuauauaguggacauuagcccucuaucagacagaggaaugguuaagaucuuuuaccauuuuguggguugcuguuuugucguauugacaguguccucugcuuuacagaagauuuuuaauuuuaugagaucccauuuguccauccuuugccgauguguugaagggguuuccccccuuucucuuauauuagauucaguguaucugaaucuaauauaauuuuauguggagguucuugauccauguugacuugagcauuguacaaggugguaagaguaaaucaauuggcauucuucuaaauguggacugacacuugaaccagcaccauuuguugaauaugcugucuguuuuucacugggagucuuuggccauauauuugcuucuguuuaucuguuugggguguagauguacaccaacuuuguaugaugucuuucuaguguuuuucuucuuugccuuuuacuuaauauuauccuuuuggcaauaguauaagguuugccuaaggaaagaagaauuccaugcuaaucugugcaguucucagauacugucagaggaaacucuuccuacuuuauucugacccguucuugauguguguccuacuucuguaauguagaagguugauauuuuuuucuaggacucaucaugucuucuucaauugugauggguuuguguauaccucucuacaguacugcauaagggaacacuggagucaugucauacauggcagugucuccuuuuuagcucuagcucucauccauacacaaaccuucuuuuaauuuaaauaagcugaacauuauuuuguuaggacuuuagugucuucacaggaacaaguccauuauauuaaaccauugcauucucuuugagucucuauucauuaauuucuaaauaaccuuauuaaugucuuucucuguacuauuuuccgagugacucauuuucaugcuuguuagcccucacaauauguaauuaugugaaaguaucucacugccauauuucucaauguaucuuuaccaccccacuucugugcaacugucuuccugacugugcuggcacugacccugacacucuaagaaaguauccuucaugcuccauaaauucugucccaauguuuauugauuuauuucuccauaguagcuaauuaagaaucaaagcuguggcucugcaguuaaggguacuuuuucuugugguauucagguucaguuuccuguaacuguguggggacuuuucauccuuccaggacucuuuuuuccagaauaucuguuaucauuuuugugugcuauagcuucuacauuucugaagucuacagaguuacauggaggcaaagguaacuuuccauauaaaauuaaaauuaauaaacauuauuuuaaaauuauauaugaucuggaaguauugaaaggacacaaaaagcaguccaggaaaaagaaugagaggaaaugugaagccugaauauguuacagguuaucugacccuucauaucaauauuuuaacaauuaggaaugaccccuauguaugauaaaauguuauguauacauggaccccagagcuggagacucuuauuuguuaguuguaaugugagaagagaagauuuauccuauggaugauguauuuagguauuaacuuuuaugaggaggcacccuaauugugaaggaauuuauaauacaggaaaaugcuguuauccaggaucccauuaaccaagaaaucugcuccagaaggaaaguuaauuguaucagauucuaccauuuucuuacuguaauguguauccgugggaccuagaucuuaauccucaucacugaucaaucaggugugauguagaaaggacaugaucccacucuaaauaguucauggucaguaaacaagacucauucauuagaaaaagaaauuggauuacaugugcagagauagcugagauaauaugaagagaaguuguugcucuugcaaaggaacaggauuagauugcuagcaccacaucauguuccauaaccaccuauacuuacaguuuguggguaucugaccuccucuucugaucucaauugauacuaagcaugcaagugaggcacauacauacacaugcaggaagaacagucacaaauaaagcaaaacaaaguaaaauauaaggagugaauuuaauuuuaaaauugucuaaauacaguuuagaagaauagcaugacaugcuucuguauauauaugggaaggucuuuccacaaaccauagggaauugaagguuguuuuuuuuuuguuuuuguuuuuguuuugccuaaucagcuaagaguccauuuauuagcucauaauggaucuguuuguuggaagcuuguagaggaaucaggaagaaagcagaucuaagagaggauauaaucacuaggacaugaugaacaggaugcucuuuggugcuaaaagguccugaacauuaauuucucucuggcaugcaguaguuggauucuccuauacuuccaacaugaucaauauguauuaauguugccuauaaugguuuagcacucaaaugaaguauuaaacagauuuuuauuaucuaaguuguaacauucuaccuuuuaaauagguucaaguaaguuucaauugauaaaugaucucacacaaaguuuuugcugggugacagaauuagacuauguuuccuuucaggaauaacaagugcccuuuuccccugagucaucuccucaguccagggguuuacauuucuagugcacuuucaugacagagccuaaauauagcccugaguucuguuuuuugaaaaaaaaaaaaaagaugagggaagacuccuaagugguacuuaucugugcagccuccaaccaucuuagauggaugagcucaaacaauaaagaaaauaauagugaugaagucagugaaucauagaugguucuuaucuguguagauauaaucauguuagaucauugagcucuaauaauauagaaaagaauauugcugaaaucaaaaguuucauauuuucauuugggccaguaauagauucaugagcaauaauguauccauaaauaauaaagaguuaguauaauucucauaugucuuaauauggucauuuccauuauugaaaaucauucuacuuuaucacuguuuucucauaugacacuuauacaugugcuucuaagcagucugaagggaaaccauggucuaauuuaugaaacaauuaucuguaguaguuugucacguagcagaaaauguuacaugauauuaaugcuaucuaaagcuaacuuccuuauuuauuucauuaaauauucucaaauuaauucuucauuaaguauuauuaauucuucuuuaugaaaauaucuuaugaaaucacaucacaauguauuugauucuaugucuuguuuuuaauuuuggauguagacacugauuuuacaugccuuaacugguaaagaaagaaaacuauuucuuuugagucauucuuuuuuuuuuuauuauauuuuuguuuguuuguuuguuuuuucgagacaggguuucucugaguagccauaguugaccuggaacucacucuguaggacagucuggccucgaaaucagaaaucugccugucucugccucccaagugcuagagagauuaaagggcugugccaccacuuuuggcauuuaagucauucuuguauuuggucuucuauacucuauuuuuuuuuuuguucuagaaugguagaaacauuacgaucccaacugaguauuuuagacuagagucaggcuguugacaccaaacugcagacaauauaguuacaggguucauauuugagcaaaacugaccccuguagaauuuggaagcauaguuuuacuaaacaugacuuuacuaucugagaugugucacuuggaucauucuuguuauuaaaaaacuguucuuaaaaauauauuccugcugggcgugguggcacaugccuuuaaucccagcacuugggaggcagaggcagauagauuucugaguucacggccagccuggucuacagagugaguuccaggacagccaaggcuacacagagaaacccugucucgaaaaaccaaaggaaaaaaaauauuccugcaucuagaccuuaaauguauacauuaaaauaucuaaauguaugcugugagaccauuaugucauguacuuuuacugagagaagagaacacaauauagacuaugaugauuucagaugauaucguuucuuaaaaugaccucauaguucccaugacuuaacauacauccuguucuugauuagguuuccgaauaugacaugaauucucucucugaaagggaaccuuaaauccaaucagaauauguuuuacuauauuuggucuguauuuuuugucuauugcuuucauuaagcaccauguucaaggaaauuaauagaagaaaaagacuacuuuggguaaugcuuccagaggauaaccaucaaccauggcagggaggacugauagaacauugccauguuguugaaauagaaaggugaaagaucacauccucaaccccaaucauuaaagaggaagagagaauuaagauggcuuggaucuauucucuuuccucauagccaacccccaguguuauacuuuauucaguaauguuccaacaacuaaauucaucaaaacguuuuaaccaacugaggcuuugacuuuaaaaauauuauccaauaggagauuuauucauucauaccuauauaaucagucuucuaauauccuuguauguuguguccgaccagcggcucacaugucuggguucgguucugggaaggcaucuuggaaucuggaagagaagagggagcuagguggacaagagaaagaugaagcuaagacaaaaauucugaucaaagcucaauuuuacuaauucgugcaccaaguuaugaaggaggggaagggggccgauucccgccaaaucaucuuacaggugaacacgugauagcuccagaacagcuucuuggcaggcagcagcagugggaguggcaggacgauagggcugcaauucuucuguugagggacaucuggguucuuuccagcuucuggcuauuauaaauaaugcugcuaugaacauaguggagcauguguucuuauuaccaguuagaacacauucuggauauaugcccaggagagguauugcuggauccucuaauaguacuauguacaauuuucugagaaaccgccagaaugauuuccagagugguuguauaagcuuguaaucccaccaacaauggaggaguguuccucuuucucugcauccucuccagcaucugcuguccccugaauuuuuuauuuuagccauucugaguagugugagguggauucucaggguuguugugauuugcauuucccugaugauuaacgauguugaacagucuucuaggugcuucucagccauuccauauuccucaguugagaauucuuuguuuagaucugagccccauuuuuaaauuuuuuuuuuuauuuucuggaguccaucuucuugaguucuuuauauauauuggauaauccuccccuaacaucauuuuaauucaucaucuucuuugacugaggcauccaucuccucuaccuuuucuuuaagucugauaaucugucucccacagguucucuauguauuauuuuuauuugccuuacugcauuuuguuuucagggucuuuuggggaggacauuucuaagcaccuauugaacucaauuuaaauauuuuauauugucgacauuuccuucaggaaucugguauuauuuucuuguucaucauucauuuucuuccucucugaguggauuuucaugguuuacaaacuuuaaucuccuugaucaugacuguggcuuuucaauucuuuaucuuggauaucauguaaauugugcuccuuauaggguacauauaugguuugaaguuugagacaaggacauuuuaucguaguuucuguuuguuuuggguucugagcaucagaauuuagaggaauugcuuaauugugugcauuuuuaguccagagggcuagacucaaaauaugagaaguuaggaaggauccauuguaucugaaggguucagaacccaggugcaguguccuacuacauccagcucuggucuagucuggcagcaacuuuguggagaagcugugcagaguagguccagggaaguugugugaaaggcagccugcaacagaguugggggagggguuccugauggggacugugggauuccugcaugaauugaugaguuuaaggaaaagacaaauuaaaagcaaaggaaaaacaagcaagcaagcaaacaagcagaaauccaaaacaaaaaaauugcugugaauaacugggaagcuaaugaauuaaaagguccggaaguaggugggccuagaagaauuccaggaagcuguugaauauugggcggguccagaaggaggggcuaggcagaaguaaaaggaaguucugccauuucaucauucucuuuguuucuccgcugccucgugguaaggaacuccugguggaagagucaugcccaguacuugcggcaccugaaaacuuccuuaagcagcuguuguugugcuggccuccuaggauauucagcagcugguccugucaccuuccaggucagaggagcgcugggcugggaaaugggcaggagcaaggccagcauguggaacaguggugcauuuucugccgccacucuuacaauuuuguuguggauaucuuaccauugucaggaaguuugagacccugugaauuggguucaaggucauguuuuaauaaauuuuaugauugccagaauauuuuuuuuaauaaccccguuagaucuguggccgucuccauaguuuuaaauagggauguaaauguauauagggaaauguaaaugaggaaaauaccuaauaaaaauauuuuuaaaaaaagaaaguuacugugagggugucuuaagaugucuguugagagugaauugucugauaugaggugguuuucuccagaaggucuacuugcuuucugaaucaccuauucuguccacucuaaauguuuuccuguccuugaccuguguucuuauugaugcucuguguugcauuaguccccacuagagugaaauaauuauuguugaccuucucuguacugguugcuuuaguuuugagucugcuugccuuauuucugagguauguuucuucucuuauauucuugagagcuuuuauacugagcagugucuauuuuuuacuguauaaguaaguuucauucuccuauugucacuguaauuugggaggauuccugacuacaucuauuaaccuaggccuagucauguaagcuucuacucuccauacaguauuaucuaaggccugguguguuuucagccucugaaauuugcugcugaauaagcucccccuuuuuuauuccuucucaaugcuuaccugaaaugaaugaaacaccauucaacucugggcaugauucaugguaggcacuagccauuuguccuugacucuagucccaggaagauaaguucucaguaacaaaccugauaauaguguuuuacagccuggaugcauaugcucuguguuuaugccaggugcccacugaggucagaaagcguccucagauuauacuuauauuccuuacuacacuaaauaugucaugccaugcucucaugucuguagaaguguugacaagauucuuuguaucauuuugcuuuuaauguucuuuuaugugguuuaucauugucuauuacguaguuguaguaauuucauuuuuguauuuuucaaacccuguugugaaacuucaagaagaguuccaauauuugaaacagggaaaaaagaaaaaggaugaguucuucucugguaaacacuccacaggucagugugcuguccacauuucuuugaaaaauccuuuuucauucaaaccacugcauaguucuguuaucuauauguggucauauuaucuaagaggauuuuuucuaaucucuucauuuucuucugggaugaggagaauuuaacgguuuggucuuuucacauauauaacaccauuauauuuuccgugcaauuuccauggacugaaaaccugcaaaucucaaugguaaucuauuguaaaugaugcucaaaaaauauaucgauugcgaauuuuuauuuuggaucgaauuuugaccuuuuauauuaguguggaaggaaggucuccugugucacuuaauuugcauugggguuccugugcucagucugaugguuaucugcaagcaccacaaauggauuuguauuggucagacuguggcauggccucaggggauagcacuaccaggcuccuuucagcaagugcgucuuggcaucuguaauagugucucgguuugguguccgaagaugggauggaucccuagguggggcagucucuggauggccguuucuucaguuucugauccauucuuugucccugcauuuccuuuggaaaggaaccauucuggguuaaaaaucuuuagauggguugguggcccuuucuucaacugugguccuugcauaugcacuggaauucacuuuguaguccaggcaggccuugcacucagaaauccaccugccucugccuccagagugcugggauuaaaggggugggccaccuagccaggcucauuuauguuucaaaugcuaucccuguuccuaguuuccucucugauaauccucuauccucucccaccucucucugcuccccaaaccacccacucccucuuucuggcccuggcauuccucuauacuggggcauagaaucuuuguaaguccuagggccucuccucacacuaagccuuccucuguuacauaugcagcuagagacacaguccaaucauguguuuucuuugccuggugguuuaguccaagggagcacuguuuguacugguuuguucauauuguuguuccuccuauaaggcugcagaccccuucaucuccuuggguaguuuccguagguccuucauuuggaacucugugcuccauccaauagaugacugugagcauccacuuucuuucuuucucucuuuuucucucucuuccuuucuuccuuccuuccuuccuuccuuccuuccuuccuuccuuccuuccuuccuuccuuccuuucuuuuucuuuacuccucuccucuccuccccuccccuccccuccccuccccuccccuccccuccuuucuuuucuuuucuuuucuuuucuuuucuuuucuuuucuuuucuuuucuuuucuuuucuuuucuuuucuuuucuuuucuuuucuuuucuuuucuuaagacaggguuucucgguauaacccuggcuguccuggaacucacuuuguagaccaggcuggccucgaacucagaaauccuaaugcgucuaccucccaagugcugggguuaaaggcaugcuccaucaccuccugguugaacauccaguuuauuugccaggaaaugguauagcuucagaggagacagguaugucaguguccugucagcaaaaucuuguugacaguugaaauggugucugguuuuggggguuguuuaugggauggaucccuggguagggcagucucuggauggcccuuccuuuagucucagcuccaaacuuugucucuguaacuccuuccauggcuguguacccuauuuuuuuuuguuuuuaauauuuauuuauuauauguaaguguacugucgcugucuucagacacucaagaagauggcaucagauuucguuacagauuguugugagccaccaugugguugcugagauuugaacucaggaccuuuagaagagcagucagugcucuuaaccgcugagccaucucacuagcccccauguacccuauuuuuaauaggguuauuugguucucuagagucuaacuucuugaguucuuucuauauaguggacauuagcccucugucagacagaggaaugguuaagaucuuuuaccauuuuguggguugcuguuuuguccuauugacaguguccuuugccuuacagaggcuuuuuaauuuuaugagaucccauuuguccauaguugaccuucgaacuugagccauuucuguuuuguucaggaaauuuuacccuuugcagauguguugaaggcuuuuccccccuuucucuucuaguagauucaguguaucugguuuuauguggagguucuugauccacguugacuugagcauuguacaaggcgguaggagugaaucaauuggcauucuucuacauguggacugacacuugaaccagaaccauuuauugaauauggugucuguuuuucacuggaaggcuuuggccauauauuugcuucuguuuaucuguuugggguguagauguacaccaacuuugugugaugucuuucuagcauuucucuucuuugccuuuuacauaauauuauccuuuuggcaauaguauaagguuugccuaaggaaagaagaauuccaugcuaaucugugcaguccucagauacugucagaggaaacucuuccuauuucagucugacccguucuugauguguguccuacuucuguaauguagaagggugauauuuuuuucacuuuuuuucuaggacucaucacaucuucuucaauugugauggauuuguguauaccucucuauaguacugcauaagggaacacugcagucauugucauacauggcagugucuccuuuuuagcucuagcucucaucgauacacaaaccuucuuuuaauuuaaauaagcugaacauuauuuuguuaggacuuuagugucuucacaggaacaaguccauuauauuaaaccauugcauucucuuugagucucuauucauuaauuucuaaauaaccuuauuaaugucuuucucuguacuauuuuccaagugacucauuuucaagcuuguaagcccucacauauguaauuaugugaaaguaucucacugccaaauuucucaauguaucuuuaccaccccacuucugugcaacugucuuucaugacugugcuugcacucacccugacacucuaagaaaguauccuucaugcuccauaaauucugucccaauguuuauugauuuaugucuccacaguagcuaauuaagaaucaaagcuguggcucugcaguuaaggguacuuuuucuugugguauucagguucaguuuccuguaacugcguggggacuuuucauccuuccaggacucuuuuucaagaauaucuguuaucauuuuuugaguacuauagcuucuacaguucugaaguccacagaguuacauggaggcaaagguaacuuuccguauaaaauuaaaauuaauaaacauuauuuuaaaauuauauaugaucuggaaguauugaaaggacacaagaagcaguccaggaaagagaaugaaugugaagccugaauauguuacagguuaucugacccuucauaucaauauuuuaacaauuaggaauaccucuauguaugauaaaauguuauguauacauggagcccagagccggagacucuuauuuauuaauuguaaugugagaaaagaauauuuauccuauggaugauguauuuagguauuaacuuuuaugaggaggcacccuaauugugaaggaauuuauaauacaggaaaaugcuguuguccacgaucccaucaaacaagaaaucugcuccagaaggaaagugaauugugucagauucuaccauuuucuuacuguaauguguaaccaugggaccuagaucuuaauccucaucacugaucagucaggugugauguagaaaggacaugaucccacucuaaauaguucauggucaguaaacaagacucauucauuaguaaaagaaauuggauuacaugugcagagauggcugagauaauaugaagagaaguuguugcucuugcaaaggaacaggauuagauugcuagcaccacaucauguuccauaaccgccuauacuuacaguuuguggguaucugaccuccucuucugaucucaauugauacuaagcaugcaagugaggcacauacauacacaugcaggaagaacagucacaaguaaaucaaaacaaaguaaaauaaaaggagugaauuuaguuuuaaaauugucuaaauacaguuuagaagaauauuaugacaugcuucugcauauauaugggaaggucuuuccacaaagcauagggaauugaagcuuuuuuuuuuuuuggcuaaucagcuaagaguccauuuauuagcucauaauggaucuguuuguuggaagcuuguagaggagucaggaagaaagcagaucuaagagaggauguaaucacuaggacauaauuaacaggaugcucuuuggugcuauaagguccugaacauuaauuucucucuggcaugcaguaguuggauucucaucauguuagaucauugagcucaaauaauaaaaagaaaagaauauugcugaaaucaaaaguuucauauuuucauuugggccaguaauagauucgugagcaauaauguauccauaaauaaugaagaguuaguauaauucucauaugucuuaauauggucauuuccauuauuaaaaaucauucuacuuuaucacuguguuuucucauaugacacuuauacaugugcuucuaagcagucugaagggaaaccauggucuaauuuaugaaacaauuaucuguaguaguuugacacguagcagaaaauguuacaugauauuaaugcugucuaaagcuaacuuccuucauuauuucauuaaauauucucaaauuaauucuucauuaaguauuauuaauucuucuucaugaaaauaucuuaugaaaucucaucacaauguauuggauucuaugucuuguuuuuaauuuuagauguagacacugauuuuacacuucuuaacugguacaauagaaagaaaacuauuucuuuugagucauucuuuuuuuuuuugauuuuuauuuuuuagagacaggguuucucuguguagccauggcuaugcugaaacucacucuguagaacagucuggccucgaaaucagaaaugugccugccucugccucccaagugcuagaggauuaaagggcugugccaccacuuuuggccuuugagucauucuuguauuuggucuuccguacucaauuucuuuguucuagaaugguagaaauauuguauauagaccuuacaaucccaacugaguauuuuagauuagauucaggcuguuuacacacaacugcagacaauauagauaccggguucauauuugagcaaaacugaccccuguagaauuuggaagcauaguuuuacuaaacaugacuuuaccaucugagauguguuacuuggaucauucuuguuaucaaaaaacuguucuuaaaaauauauuccugcugggcgugguggcacaugccuuuaaucccagcacuugggaggcagaggcagaggcagauagauuucugaguucacggccagccuggucuacagagugaguuccaggacagccaaggcuacacagagaaacucugucuugaaaaaccaaaaaauaaaaaaauauauauauuccugcaucuagaccucaaauguauacauuaaaauaucuaaauguaugcugugagaccauuaugucauguacuuuuacugagagaagagaacacaauauagacuaugaugauuuuagaugauaucauuucuuaaaauggccucauaguucccaugaccuaacauacauccuguucuugauuagguuuccgaauaugacaugaauucucucucugaaagggaaccuuaaauccaaucagaauauguuuuacuguauuuggucuguauuuuugucuauugcuuucauguucaaggaaacuaauugaagaaaaagacuacuuuggguauuuuguuccucucugucaccuaugacuuccucaacugagccagcuccuucaguuucauugacaggcugauuuuuuugauugaaugcuguaucuucauauauuggcccucuacugaguuaccauuaggcuuacaggguucauuucguguuucauuucagauugagcauuccuuagaguuuuauaccucuggauacaauguucacauccugcauuaucauaauuauuccuuuagccacucacaggaguuaucuggucuuucauuaaguuuguuucugccuucuuugaauuccugugauugguccucuuuaugucauuugaccacauugaaugguguucagagucuauuuugacuucugucucuugaguuuguuucauaauucauuuugucaugaguauugcuauuauauuagugauuuggguagggaaauuuuauuaacauuaugaaauugcuuuagcuacagccucucaauuuucuuuucuugugugucauuuaggucaggugacagggauuuccauaugagguguuuugaauaaacuuugagaaucuagguuggugggcaggaacuagguuacagguacacucuaaauauaucauuacuugcuuucguggcuguacaaauguuuucuagauuccugguaucauuuugcauuuaauuuuuuuaaaauaugcuuuagcauugucuguaguguaguuguauuuauuucaucuuugaaucguucaauucuuuuuuuuccuuuuuuaauauuuuuauuagguauuuuccucauuuacauuuccaaugcuaucccaaaagucccccauacccucccccccccacuucccuacccacccacucccacuuuuuggcccuggcguucacuuguacuggggcauauaaaguuugcaugaccaaugggacucucuuuccagugauggccaacuaggccaucuuuugauacauauguagcuagagacaagagcuccuggguacugguuaguucauauuguuguuccaccuauaggguugcaguucccuuuagcuccuuggguacuuucucuagcuccuacauugggggccuugugauccauccaauagcugacugugagcauccauuucuguguuugcuaggcccaggcauugucucacaagagacagcuauaucagggugcuuucagcaaaaucuugcuagugcaugcaauggugucagugcuuggaggcugauuaugggauggaucccuggauauggcauucucuagauggcccauccuuuagucucagcuccaaacuuugucucuguaacuccuuccauggguguuuuguucccaauucuaagaaggggcaaaguguccacacuuuggucuuuguucuucuugaguuucauguguuuugcaaauuguaucuuauaucuugaguaugcuaaguuucugggcuaauauccacuuaucagugagaacauaccauuugaguucuuuugugauuggguuaccucacuaaggaugaugcccuccagguccaaccauuugccuaggaauuucauaaauucauucuuuuuaauagcuaaauaguacuccauuguguaaauguaccacauuuuuuguauccauuccucuuuugaggggcaucuggguucuuuccaacuucugguuauuauaaauaaggcugcuaugaauguaguggagcauguaucuuucuuaccaguuggaacaucuucuggauauaugcccaggagagguauugcaggauccucagguaguacuauguccacuuuucugaggaaccgccagacugauuuccagagugguuguacaagcuugcaaucccaacaacaguggaggaguguuccucuuucuccacaucgucgccagcaucugcugucaccugaauuuuugaucuuagucauucugacuggugugagauggaaucucgggguuguuuugauuugcauuucccugaugauuaaggaugcugagcauuuuuucaggugguucucagccauuugguauuccucaggugagaauucuuucuuuagaucugagccccauuuuuuaauacgguuauuugauuuucuggaguccaccuucuugaguucuuuauauauauuggauaauagucgccuaucugauuuaggauagguaaagauccuuucccaaucuguugguggccauuuugucuuauagacggugucuuuugccuuacagaagcuuugcaguuuuaugaggucccauuugucaauucucuaucuuacagcacaagccauugcuguucuauucaggcauuucuccccugugcccauauuucgaggcuuuuccccacuuucuccucuauaaguuucagugucucugguuuuauguggaguuccuugguccacuuagauuugaccuuauuacaaggagauaggaauggaucaauucgcauucuucuacgugauaaccaccaguugugccagaaccauuuguugaaaaugcugucuuuuuccacuggaugguuuuugcucccuugucaaagaucaagugaccauagacguguggguacauuucugggucuucaauucuauuccauugcuuuacuugucugucgcuauaccaguaccaugcaguuuuuaucacaauugcucuguaguacagcuuuaggucaggcauggugauuccaccagagguucuuuuauccuugagaagaguuuuugauauccuaaguuuuuuguuauuccagaugaauuugcagauugcucuuucuaauucguugaagaauugaguuggaauuuugauggggauugcauugaauuuguagauugcuuucgacaggauagcccuguuuacuauauugauccugccgauccaugaggaugggagaucuuuccaucuucugagaucuucuuuaaguucuuucuucagagacuugaaguucuuaucauacagaucuuucacuuccuuaguuagagucacacgaagguacuauauauuauuugugacuauugagaaguguguuguuucacuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuauuauaucaucugcaaaaagggauauuuugacuucuuccuuuccaauuuguauccccuugaucuccuuuuguugucaaauugcucuggcuaggacuucagguacaauguugaauagguagggagagagugggcagccuugucuagucccugauuuuagugggauugcuuccagcuccucaccauuuacuuugauguuggcuacugguuugcuguagauugcuuuuaucauguuuaaguaugggccuugaauuccugaucuuuccaagacuuuuaucaugaauggguguuggauuuugucaaaugcuuucuccacaucaaaccagaugaucaugugguuuuugucuuugaguuuguuuauauaguggauuaugcugauggauuuccguauauuaaaccaucccugcauuccuggaauaaaaccuacuuggucaggaugaaugauuguuuuaauguguucuuggauucgguuagcgagaauuuuauugaguuuuuuuuuuuuuuuugcaucgguauucauaagggaaauuggucugaaguucucuaucuuuguuggaucuuucugugguuuagguaucagaguaauuguggcuucauagaaugaguuggguagaguaccuucuacuucuauuuuguggaauaguuugugaagaacuagaauuagaucuucuuugagggucugauagaacucugcacuaaacccaucugguccugggcuuuuuuugguugggagacuauuaaugacugcuucuauuucuuuaggggauaugggacuguuuagauuguuaacuugauccugacuuaacuuugguaccuuguaucugucuagaaauuuguccauuucguccagguuuucuaguuuuguugaguauagccuuuuguagaaggaucugaugguguuuuggauuucuucaggauuuguuguuaugucucccuuuucauuucugauuuuguuaauuaggaugcugucccugugcccucuagugagucuggcuaaggguuuaucuaucuuguugauuuucucaaagaaccagcuccucauuugguugauucuuugaauaguucuuguuuccacuugguugauuucgccccugaguuugauuauuuccugccgucuacuccucuugggugaauuuccuuccuuuuuuucuagagcuuuuagguguguugucaagcugcuagugugugcucucucuaguuucuuuuuggaggcacucagagcuaugaguuucccucuuagaaaugcuuucauugugucccauacguuuggguauguuuugucuucauuuucauuaaacucuaaaaggucuuuaauuucuuucuuuauuccuuccuugagcaagguaucauugagaagaguguuguucaauuuccccaugaauguugguuuuccauuuuuuauguuguuauugaagaucauccuuaguccauaguggucugauaggaugcaugggaaaauuucaauauuuuuggaucuguugaggccuguuuuguggaaaauuauauggucaauuuuggagaauguaccaugaggugcugagaagaagguauauccuuuuguuuuaggauaaaauguucuauagauaucuguuaaguccauuuguuucauaacuucuguuagugucacuguguccuuguuuaguuucuguuuccacgaccuguccauugaugaaagugguguguugaagucucccacuauuauugugugaggugcaauaugugcuuugagcuuuccuaaaguuucuuuaaugaauguggcugcccuugcauuuggagcauagauauucagauuugagaguuccuccuggaggauuuuaccuuugaugcguaugaagugucccuccuuuucuuuuuugauaacuuuguuuuggaagucgauuuuauucgauaucagaauggcuacuccagcuuguuucuucagaccauuugcuuggaaaauuguuuuccagccuuucacucugagguagugucugucuuuuucccugagauggguuuccuguaagcagcaaaauguuggguccuguuuguguagccagucuguuaguccaugucuuuuuauuggggaauugaguccauugauauuaagagauauuaaggaaaaguaauuguugcuuccuauuauuuuuguuguuagaguuggcauucuguuauuguggcugucuucuuuucgguuuguugaaggauuacuuucuugcuuuuucuaggucgugguuucuguccuuguauugguuuuuuucuauuaucuuccuuugaagggcuggauuuguggaaagauaaugugugaauuugguuuugccgugaaauacuuugguuucuccaucuaugguaauugagaguguggcugguuauaguagccugggcuggcauuuguguucuuuuagugucuguauaacaucuguccaggaucuucuggcuuucauagucuggugaaaagucugguguaauucugauaggccugccuuuauauguuauuugaccuuuuccccuuacugcuuuuaauauucuaucuuuauuuagugcauuuguuguucugauuauuauaugucaggaggaauuucuuuucugguucagucuauuuggaguucuguaggcuucuuguauguucaugggcaugucuuucuuuagguuugggaaguuuucuucuauaauuuuguugaagauauuuacugacccuuuaaguugaaaaucuucauucucaucuacuccuauuauccguagguuuggucuucucauuguguccuggauuuccuggauguuuugaguuaggaucuuuuugcauuuuguauuuucuuugauuuuugugccgauguucucuauggaaucuucugcaccugagauucucucuuccaucucuucuauucuuuugcuaaugcucgcaucuaugguuccagauuucuuuccuaggguuucuaucuccaguguugcccuacuuuggguuuuccuuauugugucuacuucccuuuuuaggucuuggaugguuuuauucaauuccaucaacuguuugggcguguuuuccugcaauucuuuaaggaauuuuugugcuuucucuuuaaggucuucuaccuguuuagcaguguucuccuuuauuucuuuaagugaguuauuaaaguccuucuugauguccucuaccaucauauaaguuaaauccaggucuaucuuuucagguguguuggggugcccaggacuggguggggugggagugcuguguucugaugauggugaguggccuugguuucuguuaguaagauucuuauguuugccuuuugccaucugguaaucucuggaguuagguuuuuuuguuguuguuuuguuuuguuuuguuuuguuuuuucgagacaggguuucucuguauagcucuggcuguccuggagcucacuuuguagaccaggcuggccucgaacucagaaauccaccugccucugccucccgagugcugggauuaaaggcgugcaccaccacgaccagcuuguuuuuuguuuuuugauuuuuuuuuuguaggaguuaguuguuauaguugucucugguuagagcuuguuccucaggugauugauuauguuagccucuaucagcagaccugcgagacuagcuuucuccugaguuucaguggucagaguacucucugcaggcaagcucuccucuuccagggacguugcccagauaucugguguucgaaccugccuccuggcagaaguuguguuccacucaccagagguccuacgauccuguggagaguccuguggggaccuuggugguguccucagacucgcgcccaaggugagucagugcuggcuccaaacagaagggaccgaauagucaauucuugaugugaaauuucaagaagaauucaaucuuuguucuucacauaaaaccugggagaaguucaacaaaaagaaugugugucucugcuaaacaugccacaggucaguguccuuuccacauuucuuuuuuuuaaaaaaaaaaaaacuuuuaauucaaaucauccaaaaguuuuauucuccauauauggaauguuaucuaaagaacuuauuuucuaugaucuuuauuuucuucuguaauaaugaaaauuuaauguuuuggucuuucauguauauaacaucuuuauauuuuaacuugauuuuauauugugaggacauauaauucccuuggacuagcuaccugcaugucucaaaaaggaucuauuggaaugaugcucaaagaacauauugauggauaguuucuaugcugaauaaguucuguccuuuuauguuagugugaaguaaggucucuucugccauauaaauugcauuucagggaugcucagguuucuaaaacacaagcuugugaaugaggauauagaaauaaguauaaauucacaucacuaaagaagauaugaaagaguagaauuuguagaagcuaaaauuacaugaaauccacugucuuaaauacuaauaguaaauauauuauuagcucccuagggucacaaaugauggaaggaaaaugucuuucuuuuaccauuauugugauugugagcugauauagauuucaguauucucacaacucuuuuuucauggcucauaucacacaguaaucacuguugacaccugaaaucuauuugucucaagagagauacugucccugugguaaauuuucaauauagaaauuguuauuuuccucucuuuuugguuucaguccuguuuucuuaaccuuuguauuucaucacaugaacaauauuaguaaaaauuuucuagagaggauaacuauggugcuguacauaaaccaucaauuuacaaacauaaaugaauguccuuucuuuuuuuuuuuuuuuucuuuuuuuuuucaagacaguguuucucuguguagccuugacugucuuggaacucacucuguagaccagucuggccuugaacucagaaauccgccugccucugucucccaagugcugggaauaaaggcguucgccaccacgcccagcaagaaaggauaucuugauuacuucuuuuuuaaauuaaaaaagcauuuuuuuuuccaguaucaaguagguaguuuuccauucccgcgucuguuaaccuucaaggccuuggacuucucacuugaggaaugggaaugucucaguuuugcucagaggacauuguacauggaugugauguuggagaauuacaacaaucuguuguuugugcguaagaaugaacuuacuguugaauuccuguaucucucucugaguuuuccuacuauguguuuauguaaaugcucugagauauccagagacccuugaaugagggaaauucuaguuaaaaucauaacuuuuucauuguguuuccuuuacauuucucugcuuucuuuggaaaaguaacuagugcuauauucucugagaucacuccuuaucacuuaucaagcuucagucaagauaaaaaaguucaaguaaaaauuuaaauauccagaagaagaaauuauauuucuauacauacaauaguugcaauuuuaaaaucuuacuauugcuuuaaaauguucccuuauuuaugaaucuaaaaauauacaagguuucaaguggauauagagcuguugguuuggccaauauuuuuuuuuuuauuuaacuuuuugacauuugaucucuguguuuagaucuaggacaacgugaucuuuauccuagcauuuuggauguugaaacaaaccuauuuagugguuucccugacacuaaugguuauaucauaaauuuauaccugaccaaauuuauaccugauucagugucacucugaaucaaacuguaaccauaaaauuagagauauauuguuuagaauucuacuuucugaaaauucacuacagauggaucauuauuugucccaacuuaugcagaguacaauuuucuguuuuauuggucauuuuauuuauuuacaugucaaauauuaugccccuucuccauucccugucuggaaacucgauaucccaccccucgccccagcuuuuaugaugacuccccucccaccaauccaccuacucccaccucauaucccuaggauucuccuaugcugggauauugagccuucaugguaccaagggacucuccuccuguugaugccauauaaggcaauccucugcuauauauaaagcugcagacauuuguacuucuaugugaacucuuuauuuggugauuugacccuugggagccuuguguggucuuguuguuugauauuguuguuccuccuacacaguugcaaagcccuucagcuucuucaguccuuaccuuaacuccuucauuuuaguccccuugcucaguccaaugguugguacagguucugcaucucuuugguccagucucugaauggccuuaccuucagccucuuuuccauucuuugucccucuuuuucuuuaagagaggagcaauuuugggucauuauauuugagguggguaugaugucaaauuugaaaauaaaaguuggcaggcuuuuaucauuuccagucauuugauauaaaucauauuugagguucuucugaggauacauguaaugauucaaaaaaaaggaaaaaaaaccucuuuugagaguacaaauccaugagaucacugauuauugaaucccuuacuccuuauauaaguaaaucaugucaccucuaauugccccccacccguuuuuuuuuuuucaggaaaucauugcauauauggaauguaugggaaggucauggaucaagacagccaguacauuguucuugaacacaugaauauucaagagaagucuucuaaauguaacaagccuagcaauguguuucuagaauccccccauuauacaccucacaaauguacugaaugugacaaaugcuuuucccaaaaaucucaucuuaauauucaucagaaaauucaugcaggagagaaaccuuacaaaugcaguggaugugacaaaugcuuuacugaaaaaggcagucugagaaggcaucagagaauucauacaggagagaaaccuuacaaaugcagugaaugugacaaaugcuuuacuagaaaagg

SEQ ID NO: 2251 - RNA, 3760 nt, Mus musculus
ccucuggcggcccggacgccagugucccgcaggcccaagccgcuucucucggcgccgcgccugcccauggccgcggcgggugacgcagccggaacaugucguccgcgguggagccuccgccgcucccgccucccaagagcgcgccuuccaagcccucggcgcccggcgggagcagcagcggcaacaaaggcggccccgagggcugcggacucgugccccggccccgcggacaccgagauggaggaaguauuugauaauggaucaccuggaaagcaaaaagaaauccaagaaccagauccuauauaugaagaaaaaaugcaaacugaccaaggaaauagauuugaguauuuauuaaagccgacagagcuguucgcucauuucauucagccugcugcucagaagacuccaaccucacccuugaagaugaaaccagggcgcccacggguaaaaaaggaugaaaaacagaauuugcuuucaguuggagauuaccgacaccauagaacagagcaagaggaggaugaagagcuauuaacagaaaguuccaaagcaacuaauguuuguacuaaauuugaagauucuccaucauauguaaaaugggguaaacugagagauuaucaggugugaggauugaauuggcucaucucucuguaugagaauggcaucaaugggauccuugcagaugaaauggguuugggaaagacacuucaaacaauuucucuucuuggauacaggaaacacuauagaaauauuccugguccucauaugguuuugguucccaagucuacauugcacaacuggaugagugaauucaagagauggauaccaacacuuaggucuguuugcuugauaggagauaaagagcaaagagcugcauuugucagggauguuuuauuaccaggagagugggaugugugugucacaucuuaugaaaugcuuauuaaagagaaagucuguguucaaaaaauucaacuggagauacuuaguuauagaugaagcucacaggauaaaaaaugaaaaaaucuaaguugucagaaauagagaauucaagacuacaaaucggcuguugcuaacagggacgccucuucagaacaaccugcaugagcucuggucacuucuaaacuuuuuguuaccagauguaugacuuugauucagcugaugacuuugauuccugguuugauacaaauaauugccuuggggaucaaaagcuaguugagaggcuucauaugguuuuguguccauuccuccuucgucgaauuaaagcugauguugaaaagaguuugccuccaaaaaaagaaguaaaaaucuaugugggucuuagcaaaaugcagagagaaugguauacucggauauuaauaaaagauauagacauauuaaacucagcagggaagauggacaaaaugaggcuauugaacauuuugaugcaguugaggaaaugcugcaaucauccauaucucuucgauggagcugaaccugguccacuguucacaacagauaugcaucuaguuaccaacaguggcaagauggugguguuagacaagcuacucccuaaacugaaagaacaagguucaagaguacuaaucuuuagucagaugacaagagucuuagacauuuuggaagauuauugcauguggagaaauuaugaguacugcagguuggaugaacagacaccccaugagagacaagacuccaucaaugcauacaaugaaccaaauagcacaaaguuuguauuuaugcuaagcacacgugcugguggucugggcaucaaucuugcaacugcugauguaguaauuuuauaugauucagauuggaauccucaaguugaucuucaggcuauggacuaugcccauagaauuggacaaaggaagacuguccgaguguuucgcuuuauaaccgauaacacuguggaagaaagaauaguggaacgugcugagaugaaacuuagacuggauucgauaguaauucaacaagggaggcuuguagaucagaaccugaacaaaauugggaaagaugaaaugcuucaaaugauucgacguggugccacacauguguuugcuucaaaagaaagugaaaucacugaugaggauauugaugguauuuuagaaagaggugcaaagaagacugcagaaaugaaugaaaagcuguccaagaugggugaaaguucacuuagaaacuuuaugauggauacagaguccaguguuuauuacuuugaaggagaagacuauagagaaaaacaaaagauugcauucacagaguggauugaaccaccaaaaagagaaagaaaagccaacuaugcuguugaugcauauuucagggaagcucuccguguuagccuaaagcacccaaggcaccucgaccuccaaaacaaccaaauguucaggauuuccaguucuuuccucuagguuuaugugaauuacuggaaaaagaaauucuguauuacaggaaaacuauuagguauaagguaccuuggaguccugaucuaccuaaugcagcacaggcauagaaagaacagcuaaaaauugaugaagcagagccccucaaugacgaggaguuagaggaaaaagagaagcuucugacacagggguuuacaaauuggaauaagagagauuuuaaccaguuuaucaaggcuaaugagaaguggggucgugaugauauugaaaauauagccagagaaguagaaggaaaaacuccagaagaagucauugaauacucagcuguguucugggaaagaugcaaugagcuucaggacauagagaagauaauggcucagauugaaaggggagaggcaagaauucaaagaagaauaaguaucaagagagcacuagauacaaagauuggacgguacaaagcacccuuucaugagcuaagaauaucauaugguacuaacaaaggaaaaaaacuauacugaagaagaggaucguuuucucauuucuaugcugcacaagcuuggcuucgacaaggaaaauguguaugaugaauuacgacaaugcauccgaaacuccccucaguuuagauuugauugguuucucaaguccagaacugcgauggagcuccagaggagguguaauaccuuaauuacuuugauugaaagagaaaauauggaacuagaagaaaaggagaaggcagagaaaaagaaaaggggaccaaaaccuuccacacagaaagguaagauggacggugcccuugauggccguggaagaaaaaagaagcugaaacuaugaaugcauuuuugucuuauaaucacuaacuaguaguucuuuaauuuacaggucuucauaagacgugcuggacagugcucaacuguuaugucauucagacaucagguccaucugcuuacugagauagaaacauaguauguaguuucacuuuuuuuaaaugcaacagcugugcugaaauuuuuuuaucauuaacaauugaaguaauaaaacaggcuucauuuauuuuaaaaaaaaaaagaauuugaaaaguuuaaucaugagaaaaagcaaugucauuguaacagggggcacagacugggaucaaggugaccugagccaccacagcuuaucucagaaacauuauuguaaauauuucuuuuuguaaaaagacugcagauaaagcugaugggaauaauauacguuguuagagugaaaucacuccauacacaagcagaagaugaauuaagaaaaguugcuuuagugacugugugcauucaugacaggcuaauuaucagacuaaucagucuagcauaaaucugaauucaacauaugcugucagccuuaag

SEQ ID NO: 2252 - RNA, 1178 nt, Mus musculus
acuucaugaugucauuuuuuuaauauacauuauuuuauuacaaauuuaaaaaaaaaacaaaaaaaugcaacauccuaaaaaauuuuuuuacugguaauacaaauuccuaugaaguuuuuuuuuuuuuugcuagcauaagaaauuaaaaaagccauuaaauauuuagaaacauucaacaucaaaagcuuuaaaucuaacuguaguuguagccccugaaaaagcuacaaacucuucuuaaaaaguauuuucucuacaaagaaucucaucagcuauacaaaaaucuguacaguuuuuauacugaagcuaauguugagcugcacuugaauuucacauucuuagcaaaauaauugccugagcaaauauacuccacacuuuaggacagccacuuauucuucauccuccucuucuuccucuucaucuuccuccucuuccuccucuucuuccuccuccucaucuucugguucguucuucuuugagccuguuggccuaccaggacccuucuuuccugcuucacuuuugcccuuggcacgguaugcagcaauauccuuuucauacuucuccuuuaguuuagcuacuuucugcucauacgguuguuuaucuuuggcagauugcucagaccacaucucacccaguuucuucgcaguaucuccaauagacaggccuggguguucaauuuugaucuuugggcgauuuucagagcaaaacaggaagaaggcagacgguggucucuucggagcauuggggucuuuuuucuuuccuuucuuauccccuuugggaggaacauaguucuucaucucccugucauaacgagcuuugucgcucuuggccaaaucuucaaacuuggacuuuuccuuugaagacauggucuuccaucucucggagcauuucuuggagaacucagcgaaguucaccgacgagucgggaugcuucuucuugugcuccucgcggcaggucugcacgaagaaggcgcguacgaggacauuuugccccgcggcuuguuggggucaccuuuauccaugaugacggcucggcgucugucuaccugcugcgagcgcugcuucccucagaccuccgcagagagacuuccuuccccaagcuccggcgagaacugguuucuugcuaacgcaauccccagccucuuguuuugcagaguucuccgcgccacggcaacuugacca

SEQ ID NO: 2253 - RNA, 7038 nt, Mus musculus
ucuuucuuucuuuuuuuaaaauacaaacauagacuuuauuaaaugcugcucaauuuccagugaagaucucucauuauaaaacaguuuuccauacaacugcgaggcaagaggcuggaauggcacugguaacaacagugugaaaaauaccugaccagguaaaaacagacaaagcuucuacauagucaacucugaggacaccugcugcaguucccuuacauaaagccaggcagugacagcuagcagucugcaucacacugugggagggacccagagcuccacccugcaggcaggcaggcuggccuggggacuggcauggugaggacugggaaggcccugccuccagccuuggaggagaggaaugaaggaggugagccucggguccacccauggccugugcugcucugcacacgcuccggggugcugcugcagaaggggggauuugggaacaucagaauuuugguuuacuuucccccaacuuuaauacuuugugcuucagaagccuggaaaugucagauguuguaaaacccagaguauggcagugucuuuaaugaggcugggcucuugucccccgcccacaccucccuaggagaugugagggaagggcaacaccuccgcuuaucuuaugaggcucuuuccucagauguacucaaggugugcagcaccaaggugugcagcacggugaaaacacaugauaaaggaaguaugcagaggacgacuucaucugugugugcagcacaaccgggcucaagucgaaacauacgcuugccacucccaccaucaccucacacaacagagacagugacacaauccaugauuagacagaguuuacaauauacuuggcugugauacagcacagggcuauguuuuaguccauaauucuuuugcuuuuacgcuugccaggaaaaacuggccuccuaauuauauuauacagaugaggucugcucugaaguuuuuauaucccccccaccccaagaaaaaguguacaaaacuaccgcccagcagggagagcugaucuuuauuuggcacugguacugcucugaagaauacugugcauguuuuaagcauuguucuguuucucuagagccuucuucagcugcagcucuucuagcuuuuuccauaacucuucccguuccaguucuuucuucuucucucucugucuuucggcuuuguaggaacuaguaagguugucaaaaagcuugccguucaucuccaugaggguuuucagcacauuguacaccagugcuacaguaggcugauuccaguguucuuuggaaauuuuauacaagcuggcaaacaugauuggcaggauuuuaucuauauucucuucaaucaaacuaagaauauauucauuauuccagaauuacagugcucuuucugcaaccuggaaaugagcuggagacacacuuggauaucugcuuaaaaagcagcucuucaauuuuuuugaauuguguugguucaaugacaucuaagacaucuucaauuuuuccuaaaacaucaccucuuucugacugcauguuuuuggccgaaauuucaguaguccucugaucaccggcucugucagcguuguggcuuucuccaggaacugcacaacacaguacgccagcugugcauaaaacaaggccaauccuuuugcaguaugcauaggaauaaaaaccuucauuagaaacugcuuaugcucugcuuucacuggcaaugcaaagccauugaugauacuucccaauauuucaaggagcucagccacaccacugaaauguuccguuucauauauaaaccugaggaaaauguuguuaaucugcuuucugaugaacgcucucaggccaaggaacuugccauaaaucugauuuaggacggucuucaggaagucgcgcucccguggaucuucacuaucaaaaagcuccaggagcaguuggacaacuucugaucaauguaucgcuuugcaaugcuggacuggaaaucagcacucuccaaaaaucuuuuuuuuuuaaagauuuauuuauuuauuuauuuauuuauuuauuuauuuauuauauguaaguacacuguagcugucuucagacacuccagaagagggagucagaucucuuuacggaugguuuugagccaccaugugguugcugggacuugaacucaggaccuuuggaagaucagucagugcucuuacccgcugagccaucucaucagcccacucuccaagaaucuuaagaagaauucauacaccaaacuguaagugaggucaaaaggccucaagugugggcucauccuuuuccgggucaaaaucuggauuaucacuuggaggaaguguccggaagauguuagcacugaucauuuuuacuauaucagaauacgcugauucaacaauuacaccacgauuaguugaaacauacucaaccaguucauucagugucgcucuuuuaauuucuuugaucuucaagucugaaacagaguccaugaaaucaaacaguacacagcacuguuguagcuucuggcagaaacgcucuuccuguucauuugaaguggcaucuuugagcuggggcagggggugcagguccgccuggcugcccuggcugcggaacugcgaggagcccugagagcgcuucugccucugcgccuugcgcaccgauuuccgggucaagccauccacuuuauccgaggccgagaugguggcgcaggcaacuggugcgggcggcgacggcgacgacaucucggcgacccgggcgcucggcgccucccccgguggcuggcccgggcaaucggcggagcacaggcacgacgggccugcgccccugcgucccgggccggccgugccgcccucgcgcuccgcgagcugcuccucacccgacagcgccucacugccgccuccccgcgccgcgcugccgccucccggggcuggcgggggcgcgcgggccgcacaaguuacugacgcccggaagagggcggacggaggggaacccgaaguguggaccgcuggggcgagcgcgcgggugcggacgccgggcaggccugacggccccuuagcgggcggaguccggacaggucuucagcagcugccgcccgcgcuguccgcccgagccgccgccgagcgcucguucuccugucagcgauggccccucaucgcccggggcggccacccgcaccccgauccuuggauccuuggauccuuggagcguugcccucgcucagccucccgcgccuaccggccgcccacggagcacgcccgggaagcaacugcuacaacuugagaggguggcuggcuccggugaggggggacucugugcgcgugcgugcgcgcuaccgcggcccggggggagguccucgcgggggggggggguggaggaaggcguuugacugacaaguuacgcggggucacacuagccuccugagucuccagaggggggcggggcgcgagccucccucuguuucuuaaacucuuucugucuccucuuucaugggguuuccuaguggacugucagucaaagaagauauugcuugguaauuccuacaaguuuugugucaccauuccacuagcauaucuuguaagcaggguaccuuuguagacaguggugcuguggcuggguugaugcuuacaagucucuuuugacagaguauagaggacuuuccuguaguauagaugcuguguugauuugaauaugcgugguucauaggaaauggcacuauuaggaguuguggccuuguuggaggaagugugucacuguguaggugggcuuugaggucuccuccuaugcucaggcucuauccaguauggaugagaccuggcugccugcauagaagaguuuccuucuggcuguuuuuuggaucaaaauguagaauucucaguuccuucuucagcaccauguuugccugcaggcugccaugcuuccugccauggugauaauggacuaaaccuccgaaacuguauuuaaauuaaauguuuuuuuuuaauuuauaagaucgaauuaaauguuuuccuugauaagucuuggucaaggugucucuuuauagcaauaaaaccuuaacuaagacaaaugucaaaaaguguagagggucuuuaagaucaugcaguagucaaaauuagggacaugauacucagggaucaguuaguuuuggauccuguucuuuuuguauuggguuguuuuuuguuuguuuguuuaccaguuguauuaucuguugagaugaguugggaucucgcugaccauaucacuuuagaagcacugaagccauuucuccauguugacuauccccuuuggagaaugaauguugaauagagucaaacaucaggguuuccacagcuucucugaccaaggagacagagcugcaggaccuuaggagagauuccucaugauuuccugggaccugguugaccuuggaaggcaaagaucagaauacagugacuuccauuuaguucuucuguccacauugguacagaccucccacuuaguuacuuuugguugcuguaauaaaagaccaugacaaagacaacauacagaaaaagaguuuauuuuguuuuaugguccagaaggguaaugugaugguucaaaugagaauggcccacauaggcucaucuauuugaauguuuggucuccaguuugcagaacuauuugggaggacuaggagguauggucacuggaggugugucacuaggguuagccuuucaaguguuaaaagcccacacuaucauaguuagcccccccuucucucugcuucaugcugaugaauaaggauauaaacucucagcuacugcuccagugccauguuugccugcugcugcuguuuucugcaccaugaugguaauggacucacccucugaaacuguaagcucccaauaaacucucuuauuaguugccuuggucaugguguguuuucacagcaauagaaaaguaacuaagaaaguuaaauguccauaugauggugacaggcagggcagcaggagcaggaagcagagagcucacaucuugaacaacaaaacagugagugaaccauaaguaacauggagauuuuaaacacucauauucugccucccaugucauaucuuagaacuccccaaacagaaccaguaacugagaauauccaaacauuugagccuuugggggacacugcuauucaaacuacuguauuccacuuccuggccauaucauaauguuuucuaggagcagaacguuccucaacacuuuuuguuucacaaguuguaugcuuagcuaagugggauuuugcucugaggacagccuucccuuuguuccagggcagagcaggggcucauuuauuuguuuguuuguuuguuuguuuauucauuucuuacuuuaguuguauggguguuuugccuccauauauacccaugugaagguguuagaguuacaguuugggagcuucuaugugguuggugagaauugaaccccaguccuuugaaggacauccagugcucuuaacugcugagccaucucaccagccccagagaugcucuuguuaauagcacuuaugcucagcucuuggcuguaaugcuuaguucaguggugaucauguucucuucaaaacuacauuuguauuuccuuuuauuccacuugcucuuuuucauuuauugcuaauaauaaccauguugcagacuaaauauuaugcuuucuugaaauuguuuccauaaaaaaaaacauaguguguuacuuuaaauuuacucucagacaauuuuuaggaaaagugcaaaaggcagccaaauucuuugccaaaucucacagguguugucucuagcucugcugcugaacuuguucccucugaaaccucauugggccuccauaguccacauugcuaccaauauuacugucuuucuguuuccuauaaggauggcccaauaagcacugcuuacaucauucaacugcuuuuauuuuccagaguuccaaaauuucuucauuccuccagaaccuaauaugguuagguucauuacagcagcgaucuauucucuggguugaguuccuauauuauauuucuguaaucauuuaaaaacuauuucuuaacaaaaucaggauuuacuuuaaacguuuaguuuuacuuaagcuuuaccuaaauggaacacuaaaguuaaaaauaaaagauugauguagccuucuggauguugaauaaacagauuugggggcuguaagaguuugaaugaggauggccucuguagaucagagguuugaacacuugguucaaacacacgccacaccaugacuguggcaacuuauccaaacacaaauaaauguuuauuuuggcuuauggcccucaaguuuggaguccauaauggugcggauggcauggcagcagcaggaagaggaccaugcacaucuugaacugcaacacaaagccacguguggcauggaaucuuuaaaaucucaaauccccgggcuggugagauggcucaguggguaagagcaccggacugcucuuccgaagguccagaguucaaaucccagcaaccacaugguggcucacaaccaucuguaaugagaucugacucccucuucuggugugucugaagacagcuacaguguacuuacauauaauaaauaaauaaaucuuuaaaaaaaaacaaagaaaaaaaaaaucucaaaucccucuccagucuauaguaacacauuuucucccacaaggucgccauucccaaaccuucccaaacagcaucaccaacuggagaccaaguguuggaacauccuuuuuccgcuuauacagaggucauccuuguucaaacuauuaaagcuuccaagcaugucuaaucaacacugagaacaucaguuacaucaaucuuguacuuucaacuguaguguaacauuuggauaaagcuuaaguagaaccaaacauuucaaguaaauccugauuuuguuaagaaaguuuuucauuaucuugauuagacaguuuuuaaauccuuguaaauguuacaaaaaauagaucauaagagaaauauacugauuuaaauagaacuuugcuauuaauaaguucaguuuugaucucagaaaauauuauacauaucaucuguuucauuauuuauauaccucauguaacuuacuaagaccuuccaug

SEQ ID NO: 2254 - RNA, 2193 nt, Mus musculus
aauggcaggcagcucucuaugccuagagguaauccacagaauucuggagaugucucacaccugauugcuugaaagaaaaaaaccuaacauccaauuccugggauaagaauuggaggguggaauuucuggauggaaaaagugauguagggaagagaaagcagguggaagagauuaagugggagaaagagaagagaacagauaaaugggaacaggggcagagagguaaagagcaagcuacacaugaggucauaggcuugaauagucugaaauuuaaaugaucggugguagacugcuucagugaaaggcuuaugguuuaaacuauauaaaaaccuccuucucauuauuuauaacacugguguguccacaaguacucccacuacacucacauccauaugcaauaugcauauauauauacauauauauauauauguauauauauauaugcacacacauauauaugcacaaacacacauacacacacauauauauguaaaacuuuucacaagggugcuuuggguauuuaagucaaauuagauauugauugguuauucacaauaaauucaugacaucauugaccuagcauauuuuggaggaaggacaaauuuuagaucaaugucuuuuugguugguucuguguauguauuucacuuuuuguagcuugcaaagcccuucccauaacgaggacuguggaacguaagagccaauguucuuggaggcaccagcuugaccucuuuauacacagugaguugugcaagucugcucguuagcaaugaagacuuauugucaguuuguaaaaagcaacaccuuuuguugucggugcccugcaguguucguuuauuuuuaugaaaccacuuuguagaacaacucaguugauaaaacacaguggaaaagacaagaucaacuggaacuccaucucuuucagaauucagagacuuaauuauaaucaccuucauacacuuauaagcugguucuuuaaaaaaaaaaaauccaaacaucuuacuaagaauacagccagccgaacuccauggaguuuuguaccauggggcuuuccuaugcauuggcagaaccacaaguguggcaaugcaguauacaaaaguucuuaccuucuaauagauggugacuuuucuuggaccuuacaaccagaguuaaugcaacuugaagaaauuuaaaauuuaaaacugcaguccuacuguguauucaaauuuaugguuuagcuuucuuuuucaaagaacaauguaaaaacaaacauuauuuuuuccuuguauuucucuugugaucaacuuuuaaaaccuaacgugaugcauugguacaauaauaauuuauugauacaaugguaauuuauguacuuuuucaagucauguccagaacugccugagugucauuuguugaaagcaugaaaugcagaggcucagugcaaccuucuaaaaugaauauacuauuauguguacugacugauaaacagugaugucuguaaaugcuuguugucuugaucacuuggagccaguuaccucauccuuuuuaaaacucuguuaaagauuucuguauacuauaccauuccuucuccauguaaugggguuuucuugguguucccaaaaauauugcaaaggucuuucuuaagaccagcaauggagauacaaaagccaacagacauacauacagaguacacagauagacacaaacagggagacagaaggcagacacacauguagagagagaugcacaaggcaguauucagcauguuacagauuuaaauuaacugaauagacacgcaggauggaaggcucagauaagagaaaguagagaauucaacuuuggacucacacuuaguuaaauuaacuaaguuuaauauguucacauaugcacaaucaauuaacuugugaccuaauuuuccuaucuuuuuuuuuugcauaaacacaauaugggaaaauauaaaacucaccacaauggguaacaaguagcccugcauucuuaaagguguccgugggcucagaacccuguucuguaaagaaagaccaucaggucugggcuugugcuucugagcucucacuuccaugcuggccuagaauccauuuuaacucucaccgucaucacaacaggauuugaaccucagaggucacaagagaauccuggaacucauuacuuucauuaaaagaguugacuucaugccauauucucuaaggugacuuggguaauu

SEQ ID NO: 2255 - RNA, 1569 nt, Mus musculus
caaaugcuuuacccaaccaucccaucuuaguauucaucguagaauucauucaggggagaaaccuuacaaauguagugaaugcgacaaaugcuuuacugacaaaugcacucugagaaagcaucagagaauucauacaggagagaaaccuuacaaauguagugaaugcgacaaaugcuuuacugagaaauucacucugagaaagcaucagagaauucauacaggagagaaaccuuacaaauguaaugaaugugacaaaugcuuuacugacaaaggcagucugagaguucaucagagaauucauacaggagagaaaccuuacaaaugcagugagugugacaaaugcuuuaccaaaccaucccaucuuaguauucaucguagaauucauucaggagagaaaccuuacaaauguagugaaugcgacaaaugcuuuacccaaccauccccucucaguauucaucguagaauucauucaggagagaaaccuuacaaauguagugaaugcgacaaaugcuuuacugacaaaggcagucucagaguucaucagagaauucauauaggagagaaaccguacaaaugcagugagugugacaaaugcuuuacccaaccaucccaucuuaguauucauuguagaauucauucaggagagaaaccuuacaaauguagugaaugcgacaaaugcuuuacugacaaaagcagucugagaguucaucagagaauccauacaggagagaaaccguaccaaugcagugagugugacaaaugcuuuacugacaaaggcagucuuagaguucaucauagaauucaugcaggagagaaaccuuacaaauguagugaaugcggcaaaugcuuuacugacaaaggcuaucugagaguucauuauagaauucaugcaggagagaaaccuuacaaauguagugaaugugacaaaugcuuuacucacaaaggcucucugagaguucaucauagaauucauacaggagagaaaccuuauaaaugcagugaaugugacaaaugcuuuacccgaaaaucacaucuuaguauucaucagagaauucauacaggagagaaacuguacaaaugcaaugaaugcgacaaaugcuuuagugacaaacacagucugagaaggcaucagagaauucauacaggagagacaccuuacaaauguaaugaaugugacaaaugcuuuaccugaaaaucacaucuuaguauucaucagauaauucauacaggagagaaaccuuacaaauguaaugaaugugacaaauccuuuacugaaaauggcugucugagaauucaucagagaauucauacaggagagaaaccuuacaaauguaaugaaugugacaaaugcuuuaccugaaaaucacaucuuaguauucaucagauaauucauacagaagagaaaccuuacaaauguagugaaugugacaaauccuuuacugaaaauggcugucugagaauucaucagagaauucauacaggagagaaaccuuacaaauguaaugaaugugacaaaugcuuuacugacaaaggcagucugagaguucaucagagauuucauacaggaga

SEQ ID NO: 2256 - RNA, 1169 nt, Mus musculus
ucauuuuuuaauauacauuauuuuauuacaaauuuaaaaaaaaaacaaaaaaaugcaacauccuaaaaaauuuuuuuacugguaauacaaauuccuaugaaguuuuuuuuuuuuuuuugcuagcauaagaaauuaaaaaagccauuaaauauuuagaaacauucaacaucaaaagcuuuaaaucuaacuguaguuguagccccugaaaaagcuacaaacucuucuuaaaaaguauuuucucuacaaagaaucucaucagcuauacaaaaaucuguacaguuuuuauacugaagcuaauguugagcugcacuugaauuucacauucuuagcaaaauaauugccugagcaaauauacuccacacuuuaggacagccacuuauucuucauccuccucuucuuccucuucaucuuccuccucuuccuccucuucuuccuccuccucaucuucugguucguucuucuuugagccuguuggccuaccaggacccuucuuuccugcuucacuuuugcccuuggcacgguaugcagcaauauccuuuucauacuucuccuuuaguuuagcuacuuucugcucauacgguuguuuaucuuuggcagauugcucagaccacaucucacccaguuucuucgcaguaucuccaauagacaggccuggguguucaauuuugaucuuugggcgauuuucagagcaaaacaggaagaaggcagacgguggucucuucggagcauuggggucuuuuuucuuuccuuucuuauccccuuugggaggaacauaguucuucaucucccugucauaacgagcuuugucgcucuuggccaaaucuucaaacuuggacuuuuccuuugaagacauggucuuccaucucucggagcauuucuuggagaacucagcgaaguucaccgacgagucgggaugcuucuucuugugcuccucgcggcaggucugcacgaagaaggcgcguacgaggacauuuugccccgcggcuuguuggggucaccuuuauccaugaugacggcucggcgucugucuaccugcugcgagcgcugcuucccucagaccuccgcagagagacuuccuuccccaagcuccggcgagaacugguuucuugcuaacgcaauccccagccucuuguuuugcagaguucuccgcgccacggcaacuugaccau

SEQ ID NO: 2257 - RNA, 6798 nt, Mus musculus
uaaaauacaaacauagacuuuauuaaaugcugcucaauuuccagugaagaucucucauuauaaaacaguuuuccauacaacugcaaggcaaguggcugggaugcuacugguaaaaagugugaaaaacaccugaccagguaaaaacagacaaagcuucuacauagucaacucugaggacaccugcugcaguucccuuacauaaagccaggcagugauagcuagcagucugcaucacacugugggagggacccagagcuccacccugcaggcaggcaggccuggggacuggcauggugaggacugggaaggcccugccuccagccuuggaggagaggaaugaaggaggugagccucgggaccacccguggccugugcugcuccgcacacgcuccggggugcugcugcagaaggggggauuugggaacaucagaauuuugguuuacuuucccccaacuuuaauacuuugugcuucagaagccuggaaaugucagauguuguaaaacccagaguauggcagugucuuuaaugaggcugggcucuugucccccgcccacaccucccuaggagaugugagggaagggcaacaccuccgcuuaucuuaugaggcucuuuccucagauguacucaaggugugcagcaccaaggugugcagcacggugaaaacacaugauaaaggaaguaugcagaggacgacuucaucugugugugcagcacaaccgggcucaagucgaaacauacgcuugccacucccaccaucaccucacacaacagagacagugacacaauccaugauuagacagaguuuacaauauacuuggcugugauacagcacagggcuauguuuuaguccauaauucuuuugcuuuuacgcuugccaggaaaaacuggccuccuaauuauauuauacagaugaggucugcucugaaguuuuuauaucccccccaccccaagaaaaaguguacaaaacuaccgcccagcagggagagcugaucuuuauuuggcacugguacugcucugaauacugugcauguuuuaagcauuguucuguuucucuagagccuucuucagcugcagcucuucuagcuuuuuccauaacucuucccguuccaguucuuucuucuucucucucugucuuucggcuuuguaggaacuaguaagguugucaaaaagcuugccguucaucuccaugaggguuuucagcacauuguacaccagugcuacaguaggcugauuccaguguucuuuggaaauuuuauacaagcuggcaaacaugauuggcaggauuuuaucuauauucucuucaaucaaacuaagaauauauucauuauuccagaauuacagugcucuuucugcaaccuggaaaugagcuggagacacacuuggauaucugcuuaaaaagcagcucuucaauuuuuuugaauuguguugguucaaugacaucuaagacaucuucaauuuuuccuaaaacaucaccucuuucugacugcauguuuuuggccgaaauuucagcaguccucugaucaccggcucugucagcguuguggcuuucuccaggaacugcacaacacaguacgccagcugugcauaaaacaaggccaauccuuuugcaguaugcauaggaauaaaaaccuucauuagaaacugcuuaugcucugcuuucacuggcaaugcaaagccauugaugauacuucccaauauuucaaggagcucagccacaccacugaaauguuccguuucauauauaaaccugaggaaaauguuguuaaucugcuuucugaugaacgcucucaggccaaggaacuugccauaaaucugauuuaggacggucuucaggaagucgcgcucccguggaucuucacuaucaaaaagcuccaggagcaguuggacaacuucugaucaauguaucgcuuugcaaugcugggcuggaaaucagcacucuccaagaaucuuuuuuuuuuuuaagauuuauuuauuuauuuauuuauuuauuuauuaauuauauguaaguacacuguagcugucuucagacacuccagaagagggagucagaucucuuuacggaugguuuugagccaccaugugguugcugggacuugaacucaggaccuuuggaagaucagucagugcucuuacccgcugagccaccucaccagcccacucuccaagaaucuuaagaagaauuuauacaccaaacuguaagugaggucaaaaggccucaagugugggcucauccuuuuccgggucaaaaucuggauuaucacuuggaggaaguguccggaagauguuagcacugaucauuuuuacuauaucagaauacgcugauucaacaauuacaccacgauuaguugaaacauacucaaccaguucauucagugucgcucuuuuaauuucuuugaucuucaagucugaaacagaguccaugaaaucaaacaguacacagcacuguuguagcuucuggcagaaaagcucuugcuguucauuugaaguggcaucuuugagcuggggcagggggugcagguccgccuggcugcccuggcugcggaacugcgaggagcccugagagcgcuucugccucugcgccuugcgcaccgauuuccgggucaagccauccacuuuauccgaggccgagaugguggcgcaggcaacuggugcgggcggcgacggcgacgacaucucggcgacccgggcgcucggcgccucccccgguggcuggcccgggcaaucggcggagcacaggcacgacgggccugcgccccugcgucccgggccggccgugccgcccucgcgcuccgcgagcugcuccucacccgacagcgccucacugccgccuccccgcgccgcgcugccgccucccggggcuggcgggggcgcgcgggccgcacaaguuacugacgcccggaagagggcggacggaggcgagcccgaaguguggaccgcuggggcgagcgcgcgggugcggacgccgggcaggccugacggccccuuagcgcgcggaguccggacaggucuucagcagcugccgcccgcgcuguccgcccgagccgccgccgagcgcucguucuccugucagcgauggccccucaucgcccggggcggccacccgcaccccgauccuuggauccuuggauccuuggagcguugcccucgcucagccucccgcgccuaccggccgcccacggagcacgcccgggaagcaacugcuacaacuugagaggguggcuggcucgggugaggggggacucugugcgcgugcgugcgcgcuaccgcggcccgggggagguccucgcgggggggggggggguugaggaaggcguuugacugacaaguuccgcggggucacacuagccuccugagucuccagagggggccggggcgcgggccccccucuguuucuuaaacucuuucugucuccucuuucaugggguuuccuaguggacugucagucaaauaagauauugcuugguaauuccuacaaguuuugugucaccauuccacuagcauaucuuguaagcaggguaccuuuguagacaguggugcuguggcuggguugaugcuuacaagucucuuuugacagaguauagaggacuuuccuguaguauagaugcuguguugauuugaauaugcgugguucauaggaaauggcacuauuaggaguuguggccuuguuggaggaagugugucacuguguaggugggcuuugaggucuccuccuaugcucaggcucuauccaguauggaugagaccuggcugccugcauagaagaguuuccuucuggcuguuuuuuggaucaaaauguagaauucucaguuccuucuucagcaccauguuugccugcaggcugccaugcuuccugccauggugauaauggacuaaaccuccgaaacuguauuuaaauuaaauguuuuuuuuuuaauuuauaagaucgaauuaaauguuuuccuugauaagucuuggucaaggugucucuuuauagcaauaaaaccuuaacuaagacaaaugucaaaaaguguagagggucuuuaagaucaugcaguagucaaaauuagggacaugauacucagggaucaguuaguuuuggauccuguucuuuuuguauuggguuguuuuuuguuuguuuguuuaccaguuguauuaucuguugagaugaguugggaucucgcugaccauaucacuuuagaagcacugaagccauuucuccauguugacuauccccuuuggagaaugaauguugaauagagucaaacaucaggguuuccacagcuucucugaccaaggagacagagcugcaggaccuuaggagagauuccucaugauuuccugggaccugguugaccuuggaaggcaaagaucagaauacagugacuuccauuuaguucuucuguccacauugguacagaccucccacuuaguuacuuuugguugcuguaauaaaagaccaugacaaagacaacauacagaaaaagaguuuauuuuguuuuaugguccagaaggguaaugugaugguucaaaugagaauggcccacauaggcucaucuauuugaauguuuggucuccaguuugcagaacuauuugggaggacuaggagguauggucacuggaggugugucacuaggguuagccuuucaaguguuaaaagcccacacuaucauaguuagcccccccuucucucugcuucaugcugaugaauaaggauauaaacucucagcuacugcuccagugccauguuugccugcugcugcuguuuucugcaccaugaugguaauggacucacccucugaaacuguaagcucccaauaaacucucuuauuaguugccuuggucaugguguguuuucacagcaauagaaaaguaacuaagaaaguuaaauguccauaugauggugacaggcagggcagcaggagcaggaagcagagagcucacaucuugaacaacaaaacagugagugaaccauaaguaacauggagauuuuaaacacucauauucugccucccaugucauaucuuagaacuccccaaacagaaccaguaacugagaauauccaaacauuugagccuuugggggacacugcuauucaaacuacuguauuccacuuccuggccauaucauaauguuuucuaggagcagaacauuccucaacacuuuuuguuucacaaguuguaugcuuagcuaagugggauuuugcucugaggacagccuucccuuuguuccagggcagagcaggggcucauuuauuuauuuguuuguuuguuuguuuauucauuucuuacuuuaguuguauggguguuuugccuccauauauacccaugugaagguguuagaguuacaguuugggagcuuccaugugguuggugagaauugaaccccaguccuuugaaggacauccagugcucuuaacugcugagccaucucaccagccccagagaugcucuuguuaauagcacuuaugcucagcucuuggcuguaaugcuuaguucaguggugaucauguucucuucaaaacuacauuuguauuuccuuuuauuccacuugcucuuuuucauuuauugcuaauaauaaccauguugcagacuaaauauuaugcuuucuugaaauuguuuccauaaaaaaaaacauaguguguuacuuuaaauuuacucucagacaauuuuuaggaaaagugcaaaaggcagccaaauucuuugccaaaucucacagguguugucucuagcucugcugcugaacuuguucccucugaaaccucauugggccuccauaguccacauugcuaccaauauuacugucuuucuguuuccuauaaggauggcccaauaagcacugcuuacaucauucaacugcuuuuauuuuccagaguuccaaaauuucuucauuccuccagaaccuaauaugguuagguucauuacagcagcgaucuauucucuggguugaguuccuauauuauauuucuguaaucauuuaaaaacuauuucuuaacaaaaucaggauuuacuuuaaacguuuaguuuuacuuaagcuuuaccuaaauggaacacuaaaguuaaaaauaaaagauugauguagccuucuggauguugaauaaacagauuugggggcuguaagaguuugaaugaggauggccucuguagaucagagguuugaacacuugguucaaacacacgccacaccaugacuguggcaacuuauccaaacacaaauaaauguuuauuuuggcuuauggcccucaaguuuggaguccauaauggugcggauggcauggcagcagcaggaagaggaccaugcacaucuugaacugcaacacaaagccacguguggcauggaaucuuuaaaaucucaaaucccucuccagucuauaguaacacauuuucucccacaaggucgccauucccaaaccuucccaaacagcaucaccaacuggagaccaaguguuggaacauccuuguuccgcuuauacagaggucauccuuguucaaacuauuaaagcuuccaagcaugucuaaucaacacugagaacaucaguuacaucaaucuuguacuuucaacuguaguguaacauuuggauaaagcuuaaguagaaccaaacauuucaaguaaauccugauuuuguuaagaaaguuuuucauuaucuugauuagacaguuuuuaaauccuuguaaauguuacaaaaaauagaucauaagagaaauauacugauuuaaauagaacuuugcuauuaauaaguucaguuuugaucucagaaaauauuauacauaucaucuguuucauuauuuauauaccucauguaacuuacuaagaccuuccaug

SEQ ID NO: 2258 - RNA, 1175 nt, Mus musculus
gaugucauuuuuuaauauacauuauuuuauuacaaauuuaaacauaaaaacaaaaaaaugcaacauccuaaaaaaauuuuuuuuuacugguaauacaaauuccuaugaaguuuuuuuuuuugcuagcauaagaaauuaaagaagccauuaaauauuuagaaacauucaacaucaaaagcuuuaaaucuaacuguaguuguagccccugaaaaagcuacaaacucuucuuaaaaaguauuuucucuacaaagaaucucaucagcuauacaaaaaucuguacaguuuuuauacugaagcuaauguugagcugcacuugaauuucacauucuuagcaaaauaauugccugagcaaauauacuccacacuuuaggacagccacuuauucuucauccuccucuuccuccucuucaucuuccuccucuuccuccucuucuuccuccuccucaucuucugguucguucuucuucuuugagccuguuggccuaccaggacccuucuuugcugcuucacuuuugcccuuggcacgguaugcagcaauauccuuuucauacuucuccuuuaguuuagcuacuuucugcucauacgguuguuuaucuuuggcagauugcucagaccacaucucacccaguuucuucgcaguaucuccaauagacaggccuggguguucaauuuugaucuuugggcgauuuucagagcaaaacaggaagaaggcagacgguggucucuucggagcauuggggucuuuuaucuuuccuuucuuacccccuuugggaggaacauaguucuucaucucccugucauaacgagcuuugucgcucuuggccaaaucuucaaauuuggacuuuuccuuugaagacauggucuuccaucucucggagcauuucuuggagaacucagcgaaguucaccgacgaguggggaugcuucuucuugugcuccucgcggcaggucuguacgaagaaggcgcguacgaggacauuuugccccgcggcuuguuggggucacccuugcccaugacgauggcucugcgucugucuaccugcugcgagcgcugcuucccucagaccuccgcagagagacuuccuuccccaagcuccagcgagaacugguuucucgcuaacgcacuccccagccucuuguuuugcagaguucuccgcgccacggaaacuugaccau

SEQ ID NO: 2259 - RNA, 7891 nt, Mus musculus
gcuuccggaugcgaagaaacaaauauaaggcguccuggcacugucaauuggccgagcaggacagcggcggaggccccgccccagccuuagccaauuaggacaaccacuggagguuccgccccugcuggaggcggauuccccggcugcugggaaucugggcuuucgggcggagagcguuggcguccuuuuauccauggcagccgcugaucucgggaccacagaggcgugccuucgucccgcuagaccgguagagaaggggcaagcgccuaggccccggugugcacccugccugagugcgcgugagugagaugcuggggucuucucugcucgcccccugcagccugcuccgaaacccaagucuccaggggccuguaggguggcagggcugggaaggauaggggggucugauucggcuggaggagucugggcugggguuguaagagaagugggaagugcuucuuuauauugcagacaucucuuccagaagcaaaagaaagugucuggagagacggcucagugcucuuaaccacugaguucaauucccagcaaccacaugguggcucacaaccaucaguaauggaauccuacgccuucuucugguguguccgaacaaauaaauaaaucuuugagaaagagagagagagagagagagagagagagagagagccccugaguauaauuuuugaggaccaaagcuggccggagaaggggugggggugggguuugugucccagucagggccaugcuuuccuccgugcagacccuucauagggagucaugugucaacaaagguuuauuugccccagagcacagccaacagaacagagaaacgauuccacccaaguguggcugggugaaccaaggaguguacguauuggggucaugacccaaaggcagcuacaucacugacagucccaccgagcacggguucugauccacccccgcgcagcuuucaggcagcuccaucugagaaugcucuccccuggacauaguuuaaaucaaccuuguggagggagcucuaggaauuugcagccuucugaagagauucucuccucccaccaucagggagaaguuugaaagucaggggaaguagccacugcacaacaagcaggaaccuacauuuugguucaaacccugcuuuugacauuuaguagcugugugaccuugggauauacaugcaaauuaaagaaaggaagaaagaaagaaagaaaagcaaagaaaugaauugaccaggagaagacuuguggcagagaaaaaggcuuaaugcuuccaguucuggguucagugccagcuccagauaguaugagaccccgacuuagagcguuucucccuggaagguaaagccccuagacguuccccaagcuuguuuucccugaucucuaaaaaugcagccagaaaaaagcucuuuguucucuauagccagcaaaaagccuuuuuguuucuauacuuuacaaccagagaugccuaccuuccugugccaaugacacggagauaaaaauucagaaagaacucacuccccacuccugccuuguaaauuucaccaaggacacccggaagagaacuccucccaacucuuccuaacuccucccaacucuccucccaacuccucccaacucuuccuaacuccuccuaacucuuccuaacuccucccaacucuccucccaacuccucccaacucuuccuaacuccucccaacucuccucccaacucuuccuaacuccuaucaacucuccucccaacuccucccaauuccucagcuagcuguuaaaagcccccuaacugucaccacucagggucgaacuccccugcccugcacaauagcacaagucauuaagcuuuaaauuagcaugcugcacuagucuuuucuauaugauaaaggagucagauuaauauuaaaaauaaguucuuauauguguggguauagggcaagcacaugcccugacccaugaauguauggagguaagaagacaauucaugagagucaguucucucuacucuguaggcccugggaauugaacucagaucgucaagcuuggcagcaagcaccuuuaucuauugagacgucucacaggccccaggaauuagauuacauagggaaggcccagugggaguugucgucucuuggcaggcaaggaagcagagaggauaauaaguaaacagggugaggcugcagggugaugaucuuaaucuaggccuguguggcaggguuccucccucauuuuucuugucauugcuguuuugacuucagguggaaccuagggucagcaccucugcagcccagagacagugacauuacugugagaagcccgcaugcccaauauggcagagacuaaagaccccguucggcuucggcugcuuagccuggagcuccugaagcagcuuugggcugggcacgaagccaugugucggucgguggugagagcagcaucagggguagguggcuaaacuugguaaugcccaggugucgaggaaagacaguuuaugcugugaugcacccauuucauugacggugcaaaacugaggccuugggaggaagggacuggguugggauaccccaaagccacagcaggguaaauuacaagguccacagcaagccagagugccugggcauuggcugggcugcugccuggguaaccugaccuguuucuuacagucaaacuuggauuguagcagcaacaacuuagagaugccacugucccaagagacuucuuccgcuuccucaguggcccccagcucacaggacaaaagacacauguuggacccacuggacagucgucgagaugacacguuugauguggccugguaugucaaguucaacuccaggauggacucuuuccuaccugccacaggccaacaccaggagccccaggaagaacuacggccccccucaguacccuugcuagccacucagggucugaaggggccagugucuuugggaggaccaaaaggucugggaccugacaagacacaggucccaagguccauccugucacgacuaagcaagccaucuaagguaacuuaaguaguuccuggaaaucauggggagccucaguuucccugucugacagauugucccuagaaagugucccuuuggggggugggggugggguuggggcuucuagaagguccagugugauguuaucauugcuaucaguucuuagucagcacuuugugaagaaggaggcaagucuuauuguacagguagagagacaggccuggagcccaggucuguucaaagccacaccuaaaguggguccaaacugaccuucucguuucugaguuccccagcugaggcuggcaccgagcuggagucuuaagucaugacaaggcauggugucgcucuguaaugggaccucugggccaaaccuucugaucuaaccuuugucuacuuccucagcccagagugaccucccaggagucugcagugccugagagcagcuggcacucuaggccauaccuaggcuaugauuggauugcaggugaggggagggguuacaggcgaugggugggcauucaagugagggaggggugggguuggacuaaucucagccuggacccaaggaaggugaauggaugagcuagugaacugugacugcuggccuauaguagagcauuuacagcagccagguccccgagccacacuaacagaagcaucucaucucuucugcuccucugguuccucgggggcuccugucgucuuucuagccucuucugcuucgucucugaaaacugaguguuaggaugcaugcggcagaaaugaugccauuuuagcuuuuaauuuuaaccauucguauaugugugaguuugccuguauauaugucuguccaucaugcacauaccuagugucuguggaggccacaagggugugggggaggcuggaauuggaguuacagggguggggggaggugugguggggggagggguugugagccauaggguaugggugcugggaggugagucccugcaaaagcagccaguguucuuuucuuguuaguuuguauucacugggucucucugaauauuccuggcuggccuggaucuccauccauacaccaggcagcccuagaacucagagauccgccuccugccccgccuccugagagcugggaucaaaggcaugugcuaucacuccagcccuaccuuagucucuucuuaguaacuuuuuuuuuuuuuuuuuuuuuuuuugguuuuuugagacaggguuucucuguauagcccuggcuguccuggaacucacuuuguagaccaggcuggccuccaacucagaaauccaccugccucugccucccaagugcugggauuaaaggcgugcaccaccacacccggcuucuuaguaacuuuuguugaguguccugaaacucccuaugcagaauagccuuccuugacagcacagggauccccaagacucugccucccaacugcuaagauuauaaguguuucaccccacuuaaaaauuuuuugcucaccaaaacauagaauaaaauggaauuuuggcaggaucaguccaacacccauaaccaagguccugguuuccaccccauccucagugcagccccucuuccugucucuguaaauggcagccucgugaaccuagggagucaagcugugccuugggcucggccuugacuuugucucccuuuuacauauuccauguaccuauggcuaguacagucucuagaacuuccuuaguaccuuucuggaauuuacagcuucucucgcugucucugcuuucucucaccucuucagccucaaagaggaauccuguaaaaacgucucugaccuugucccugaauccucucagccucugggcuccauucccucuauccugaccccucacugugaucuggccauggucucagccugacuguuccucacaugccaagcucccgacuguucggggcuuucacaccuucaccuacugggguauccuuucgauuugucccuguggcucccuagauuucgucucuggucaacuucuagaccucccuuguaauguccacucugugacaugcagccgccugccucuggccuccagccucccugaaggugucucuauucaguauuguaucacagaguuccuuggugacuaacuccucuuucaccucuuuagaauguggcuuccucagagagggaaccuugucuagccucccacucuuucuccagcuaauaaguaagccaggguccugcauauauaaucucugcacugggaaguugagaccaaagugucgaguuggaggccagccuggguuacaugggaacuugucuguagaacagaaguaagcauggagacgugggccuugaaucucaucacuccagaggcauauccaguucaguuacauacguacuuucucuaaacaaaguaacuaagacgagugugugaccccgguuaaggacucugugggaauccagucuguggacugcugacuacagcaaggcaggcuggugcacaaacagagcuggcacuaacagaggguguagagucugaggggcaaggugauucaacucacccacugcugcuuugcccaccccagggucccuggacaauagcucuccagucacuagugagcccgaggccuucuucucuaugcugcagagguuucgagaaaacaacaaagaggauuguguuugcaacuccccugaguaagcagggguucauggggccuguccagggauugggggaauccgucacucauccugcucuucucuccccaaccccagagcuguguucccaggccugcaagagagcagcgguguggaagaggaccacgagugugaguguccacuuccaccaggucgcgcucugagcuguggacucaggaauggcagccugguaucuaagcauugugggaugcacccuggcuuagggcuuugacggccuuugguucuguccauugaacccaccucucuccagaagcugccccugggaggacauuucucccugaccuuucauguggaaccaagacuuugggagggaagaugcugggaacagaggggcuggcuccucaguggacagccuggcuugugaacuagggacagcccugggcucuggaaacaaauccccuaguuuagggggagcugugguaucucaugggccucacagguauguacuguuaccguaucaaccgccggcuguuuccugagccuguggauccaggcgccccuugccgucugugugggauaccccgggaugagaagggccccggaacucugguggagccagugcaagucaggugagugucaauaacguugggauuccugggggucccaguggauggggugcagagugugacccuugcugauuuuggugcugugcccucuuacacagggugagcaucccccuauccaucauggacccuccacaccaguaucgaauucacagaaggaagagcuuugaugcaucugacacucuagcuuugccucggguaagcuuccugcccuaagagguuagaggcagcuggggccaggguccugagcuagccuuaggaagagagcuugcucuaaggauauugaaugcuagcagguuuuggcuggugaaguccucagucccugggcaggugugguaccuuuucccuacauggugccuaagauggguaucuacaugagacccaaucacugagcucuugggugccacauguguagcccuucggagggcuguucuccagagccacagcagucacuaucuuaccucacccacacacgggacguggaggcagaggaggguuggugggagagauggaucugcauccagaccuuuaguuuuccauugugugucucauauccuagucaggaugggagucaaaggguguccuaccuaaaccugguggaggacaaaguagcugcaauugugagaagaggagaaagaccccuuggcuccccuauacagugggaguaaagggaccauugucaguauuggggucucguggguagcuuagugaagucaugcaacuuagggguucaaggccaaguccaacauggaaaggauuccauuaauauccccaucuucuccucccucuuggggaggguugugguggccaggucaacacaaacugaguuuggggugaccuaggguaaacccguggguaaacacagcuuccgccccagggaggggaucaugauggcucaaggaguuuucuauaguaguguaugacagaugccuuuaacauuggcuuuccacagcacugucugcugggcugggacauccucccuccaaagucagagaaaacgucuguccccaagagccuggaccucugguccuccguguccuauggagcagggcagcgucgggaucugucagccacuagcccacccugucagguagggucuagggugugucccaaccuggggugggaaaguguccaggugggacagauccuauugagauggggagcccaggcucugacaaaggugucccauguaacuuugacacuccuugacaccugcuccagucucgccaggaaaggagccugccuccaaguugcaggaggaggagaggcuauuacugcaucucacuuaucccuggggaaccucacaaucuuuuccuauucaucuguccccuaguagcucccaacuacucuccuuccaggccuugccagcacaggucacaccaccucucuggucagagccccagguugcccagcucugucccucccacuagaagcccagaggacagacggcccagaagacaacaguauucuaccagugccaacagccuccccugaggagaagccccugagagcuggaaguggagaagauggagguggcucagcugucucuccuccauuguccccucuguuuacugagauacugaaagugggaaauggggugcagaggggagggagugcucugaguagcgugcuaauaaagcucaggguccuacacuuccugucuccau

SEQ ID NO: 2260 - RNA, 2107 nt, Mus musculus
caguuccucagagaggcaguuugaguugucuucccaauuguaugcuggacauauaagaacauacaugccaagcaagaacaagggcaggagggcaguggccaguagggggaaagccuccuggcuccagaggcugcaggacccaccuuuucuagauagcuggccaaaagcuggcuacuuggaagaccuucuccacacugcuuuccgacccaagucuccacugguuccuccaucgugaggaacucagaccugccuccgucugcugccugcuccugagggccaaggacugcuuucccugaaagccuggccuuaaaccagaaaccagaugccacagagcuucuugguggaagggacgggcccauccccugagugggaucagggcuuccuaaaugcugggguacagaucuacugucuggucuaccucucugcagcacucuggcuugggaggaccuggcucuccugcuguuguaggcugacaagauuaacuguauuguccacacacaggaauggccugaccucuaagggcaacagguuuuguuuguuuuuuucuuaguauguuuuugauauguagcucacaaccuuccugcuucagcaucuuccaugcugggaugacaggaauacacuaccaccaucagccugcugucaaauggacaucugauacugauuugauauugauauaauggaaaaugacauugagggcacggacuuggaaggauuucucauuacugccuagaccuuccccuggccaggcuaccguuuuuggacagaacggcuuggggcuucaggaaucgagguaaccuaccuugcuccugaagaggggcuuggcuccaggcccacaguacucauuauagaugaguuuaaagaggaagagguggaagagggugaugagggaggccacacugaaccagaagaggaagggcaggccgggauccugcugggccaugugcucaucgugggccaggauggccuuaaggugcagcgugugccgcagguccugcagaugugugaggucgguggagauguacaacaguggugugaugggcugggucaccaugacagagaagguguggccuccaggcucugaggucagcucuacggggucauggaggcagccugccucacaggcguagaucuugacggguuggccucgggacuccaaagacacaugcagguagggcuugcccucagcguccaccagcacagccagguugauguggucguucuuguagcggaugccgugaagcgcauagcuguuguggagcaccucggggucggccuggaacugcaggugguuuucugugaacuguagcccgccgaagcugagcaccaugccuugcaggaugcccggagcgccaaccuucaccagccccuugcagccgcgcuucuggagggucaacuuccacaggucagccagcugcaggaucugcugcacugaggagagcuggccaggccacagguucucggcaugcaugguggcauggccacugaagcaguggucuucauaguugagcguugccuccaucugcucgcguucccuguggcucagagaggggcugagcaguggggcuggagagcaggagagcauguaguacagggucagguucacggucaggccagauggcgugugagcauccgugauccucuucaucuccacaccuguaauaccagagguugcacguuagggaggaaggccuggcuggaggcagaagagauggaacaaaggugagagcuacagaagguagagcuuuggaucagcaauaaaagauagcagugcccugggugugguagagcuguccuuacuuccugagauggcccaucuugauugaaugugguaggacuuaaaucaccacagaaacacgcauccgugccugucuacguaagauuuucuacauuagacugaagcgggaagagccaccguaaauauugguuguccuauaccauggacugagauccaagacuguagcuagguaccagcauucaucucucccgacuuccugacuugcagaagccgugugaccaaccagccaccuccuacuucugcuacugugucuuucccaccaugaugaguugccccucuuugaacuguaagccaaaauaaacuuucuucagc

SEQ ID NO: 2261 - RNA, 1756 nt, Mus musculus
cuacagagaaggugcagacauuuuuauucugacuuaagagugaccacaagaacguccaccuuccaaagggccaaauaaaaauagacuuuuacaaauuaaaaaagauaccauuuaucuacacaguggaaucagcuaauguuaccguauaaacacaguaugaccgaaaggcggaagcugcaacuggacagucucugagguccacaggagccaagggcaacucuccuugucaacauggcugggccaggaaggcugggcuggccucuccggaagcuuucuugucaccaaggucugcaucaaacugucacauggcuagcugagucaagcuaauguccgucccagcuggaacugcuuaacaaggucacaugcagacaucucauaaaauacccaacucccacagcaguaccggagccacacaaaugcccaggcgcagaagccagccaggaaacugccucaagccaaccucagugaccccccauggaacugugucugacaaggugcuguggugcauugggggauggggugggggaccaagcuucgacaaguaagagacugagccacuaguucgaagggacugccauggguggagggguccacggcuuaguuauaguucacaggugaaaaagcuguugucuuugggcuuuucuggaaaggcagguucagcagggacccagaaaacugaguguccuagaggagcaugggccaggguggguaugccuggacccuguccacucugggcuaaacugauggucacacacacacacacacacacucgauggacaaaucacaacaggacuggcuuggaggcagggaagcuguggacugagguccuccacaggcuacaauucugcaaacccaccaggcugggaagacaguucuguggugugucacacuuuucucuuagugggagcaacugguuuucuucuugauagagcacacagcagggcaggaauugaaaucagccauaaaaugaagcuggcagcggccaaacacaaccaugcuuagcuauuuucccaacuacuugggaagaguuucaacccccaccccacucccaacccccagucagaaguugaaaacagaguaagucaagcucuuucugguaaaaagguaagcaaauggggaaaacagagggccagggucacugucagcccuaaagauccaagguagccccugaccauggccguggaacaauuucccgagugcuggucagaggacucugccaggccugguggccacacuacuagaagccaagcguaucacagaugccuaccaccaaguuccaugauuuaaaaagaaucuaaaacaaaugaaugccacauguauccaaagaacagcugccacaagggccuuggguugcaggaagaugaaugcaaaugucccuacucagauguugguuccgagaggaccagcagccaggagagaaagaagccaugaaguaaugaagcacaagggcaagagcaucccacuccuaccugggccccgagaccagcagccacacagguuccccuacaaguccucgggaagaggccgagucgggagugcacugggaagcugggcucgaguagcgaccacaacaggggccauuggcuuucuccuaagguuggaccuuuggucgguccuggcucaggacagcuugcuugccagcuuguagagugaucucaaauucaccaggacucugguagugguucugucuagggguuccucaauuuugguugacuuugggaaugaauccaagauaaaguuguggcugucccaccag

SEQ ID NO: 2262 - RNA, 21997 nt, Mus musculus
gaaagagugaaggguagagaauaagaacaggccagagaaacuacaccaacggcaugggcgucacgucccgcgcaagggcucauucuacaaugcuugcuucguucaaaacucaaagagaauauggacggcauuaauucaagcuggccgaggcccucccucggaguccagagagagguuauagaacagaacucuggcuggggcacgcggagguaagcuggaugcuucccgagcccaggcagcggucuccgggccccacccgcugccaccugcaggcgcgguccggcgcggccccacccccggcaacgccucuugucauccugucaucccuccguagccaccccuuccccagccaggcagccgcucaccagcuccucgggggugcggcucucccguucaccgcagcagcaacaccaccggcagcagcagcacacggacccccugcaccccgccaucuuccuccuuugcugccgcuccggaccaccuaggccaaccccccucccacccaggauccgcgccucacgugacuggccccgggagggucacguggcccucucgagcucuggguccggagacagggaguggcugcagacggguggggcgagggcucgcgucacaugacgcaguacuuggcuggcuuccccugagaccucugggcgcggccauguuggggcgggacuuccggccgucgucucgucucguagauguggcuuccgccugccgcucguccuguuucccuuagcaaccgacagcuccgccccgccuucuucgccagcccuagggagguggcacccucgccgccaccgaucugacgcaagagguaacgcaaaaggcuugggacgcugcggauagauucgcagagucgggaacacaccaccgcaagcuagaccugugggcaggcgguuaggugcuggccggcccuuugcacgugaaggcuccuuagggccuaugaauacucauggaggcugucaccccagccccacuaccugcaggaagguaucucaaaguuaaaggaauccuggaucuggggcagugauccagacccugcagccuucugggacccgcauccccgccacggccugugacccauugaccaggugacccgauuaccaucccucaggccaugguggcugccugccauagugucugucugucuagcucucucgcucgcucucugggauuuuguuugguuugguuugguuuucgcgacagauucucuguguagcccuagcuguucugaaacucucuguagaucaggccucgaacuccgagauccauugccuccugcgagcugagauuaaauaugugcguugucaugccugguugccauagucucuuaaacccaucucccugacagcaucuggaaaggaagaguggaccgaccauuaguuucaacgcccagguguccauagcauccugcaguucacaugcaucuaucacaacucuuccgggaguggugggcucaguguuugucagucuuauuuaaaugaucaguagguggcagcgaggcauuuugagauugguguggaggucuuggcaguuuugagcccagugaguacugccuguuuuacuacucugccaggcacuggcgaugccacgccugagacuggucuuucugguccagucacaggcaggggacuggacaguagaaggguaaacaaauuugucgguucacaggcucauccuugugugauuugggagcucaacuaauaauggauagggggugggaacuguuagaaaugcuuaaaccgagccgggugugauggcgcacgccuuuaaucccaacacucaggaggcagaggcaggcggauuucugaguuugaggccagccuggucuacaaagugaguuccaagacauccagggcucuacagaaaaacccugucucgaaaaaccagaaaaaaaaacaaaaaugcuuaaaccuuggagcgguuugcugugccugagucagcuccuccgguuuuguuccagcagugaaaacgaggcauuucccuuggguggaggaggaaggccuuugaaggccuuucucacucuccaugagaaccuggcaguuuuaggucagaacagaagugggacagauagauugggaguaacacuggcacuaagucuggaguccaggaggggaaagagcaauggauuucuuccgauucuugaagcugagacccaaaaugguacacugacuuaagagguggaaguuucuggaaagaaacaaaccugaccugguuucucuguugcuccacgucaccacacagauagccacuacugugcuggcccacugcugugcagugguaguguuugcuucuuuuccagacuagacugcaguauggcccugugcccuguuggaagggcguaugugguagacuguggucacugauccuuuugacuuaauuggcguguuuagggagagcugcuaccagggcaggcacagauggaacaaccuuuguucagaguuggacauaaauccaucccuacccucggugacuucaguccaccugccucugcagcccagcccguggcaaguucuagcucacaacacaacagucuuuuugaaguagugugaucucaggagaucuggcugcuuggccaugcugcagaaagccuauauaacacguuccaggcgaagccagccacagugagcuguucuuucuuuggugggggaaaucuagugauccugaauggcuaauagcuaaucucuaaccccugccugcccacuccuccccucccccacucaucuuccuccuuugacuugcgccugagccuucuccagccgggaaaccuuacucccgccccuuugcguggccccagcuucagcucggggcucuuugucacagcuccgcccaguugggcacacccuccaggaaagguuccuuccccacucacucugggucugagcagaucgggaugaaccaucaaaaagccaagguccucccagcugggcacuguuauccaucccuggggaugugggccucagaggcuggcugcgugaggcuuucugugccacccucuaucagguagcugucgccuacgauccgaucugugagcugaaggacccaagagccgcucagugggagguggucauacaaagaggcagacgacagcaggggcgugggggggagggcaaagcucuuggagccucuggguaggagcugcaagacucucacccgugcugacugaugaagcagugacugccaccggagccgccugcucagguguugggugugcaugggguuuggcuaccagcccucuaauacccccggcccccacccucuacagcaggaauccagccauggugaacgaggccagaggaaguggcagucccaacccgcgaucugagggcagcagcaguggcagcgagaguuccaaggacaguucaagauguuccacccccagccuggacccagagcggcacgagagacuccgggagaagaugaggcgcagaauggacucuggugacaagugguucucccuggaguucuuccccccucgaacugcugagggagcuguuaaccucaucuccaggugaguagggagguuaaucgcgggggucggcaggcucaggggagcgugagcugcccuuuaacccggcaggaaaaggcucuggggagggaggggaggcaggaagaagcagaggcgagacagggaguuuagucugugacuuauaacuucuugucugugaaagucccucugaagcagcauuagauaaguuuggacgaacucucagugagccaaaaauguucauuuuucaggcugcauucuuuggcagagcuuggggcuggcucaugaggagcuuaggaagucaacaaaccgcaauucagggaauguguugagcuagcuggacacagagagagugcuuuuccaaaucaggaaacaccacauguuuugugauagcacuuucugaauuccaguuccuuuucuucaagucagagagugauuuguagaccacaagaccccugggcuacguccugcagcaucacaaaaaugagagaaaggaaagucaggcacacugguauccuuaauaccaacacucagaggcaggaggauaaauaacugugaguucaaagccagccuaagcuaccuagaauccaggccagccagccaggguuauguaacgaugcccuaucuuuaaaagagggaggaguguagcugaauugauggaguaaauagcuugucagaaaucuuaaauuugauuccuagcacugcauagacagggugugggaacaugacugcaaucccagcacucaggaggcaaaagcaagcagaucugaggucaaggauagccugguagagagccaggcaugguggcacacaccuuuauuccagcacuuaauaggcagaggcaggcagaucugugagucugagcucagccuggccuacauagugaguucuaggacagccagggcuacauagugggacccuugucuugaaaacaaacagcaaacaaagaaauacucagcuacauagggaguuugaggucagucuggacuacacgagacccugucucagaaacaaccacaaacauuaaugccuuuuaauccguauuugucacaugcuguuuucuggguccugaaaucaagacccugauguuuaaacacaccauuauagcuuuaacagugcugaugcccacaaaagcuuuugaaucuaguucaggaacugagccuuccucggcaggacucuuggcugaugcaaagaggccaugguggcaacacaagagucuguugauuucucucugccuucccuaaagugaggcucucugcccacccacuacugagauuccugaacccucagcugucaagacucuuaaaaagcuaguguguuccacucugagaagcgcagaaugcuguucacacaaaauagugacauuguuauacaucagugugauaaccauugaggcacucacugagcccgggcccugcucugaggaggcugcacagccaucugacccagaacccugauggcuguccaguagguacugucaccugccacaccugacaaagaaucugcggcuccaugcauuacuaggucaugugccugggaaguacugcucugauaccaacuugccuucucugagcuccuauuuaccccaggagccuacuuaaggaggaaauccccuacagguuugaccggauggcagcagggggcccccucuucguagauguuaccuggcacccagcuggagacccuggcucagacaaggagaccuccuccaugaugaucgccagcacagcaguaaacuacugcggcuuggaaaccauccugcauaugaccugcugccagcagcgcccggaggagaucacaggccaucugcacagagccaagcagcugggccugaagaacauaauggcgcugaggggagguguggcgccagcaccccuccucuuuggguucuugcuuuccugaaggcuucuccuguccccagacaaguccuuuacuuuccuugggcucugcacuaagcacauccagggccagcuugcugcaggaggaucagugaucaaucgcuguggguaaugaguccauugugggugucacacaggugggauggccgugucuacagcuugaccugucuacaguucagcugggacauggcuugugcccaauaacccuguuagaauuacacagggccaucaaucgguuguggcacugucugaccuagucauagagugagugcuguguuggaauuucccaggagcacugggagcuugcuauccucagggcacucaagaguggugggugggagccugggggggggggagaucuguggcuuccgcucccaccacagagcuccucuugaugaguagaaaauccacccaaaacccaggagcucuuccagagcagagaggugggagagggugucugaccacacccagggcaucagggcgaggccaggcucaguggagagccacaccuccucuggucccaccaccaauggggcaccugcagaguaagccuuaguaggcauuugacaacugaccacugcccugcaccuccuacuugccaggugccaggcuagacucacauaauaggaagucucggccuuugagggacccucagccaaguguaggcauagauagagggaacaagaagacucuggaggucaagggacacccagugaccaugaccuccagcaacccugcagacccuguaggugaccacugggaagcagaggaaggaggcuucagcuaugccacagaccuggugaagcacauccggaccgaguuugcugacuauuuugacaucuguguggcagguaagugaggacagagaagggucaggaugagaggauagccagcuagucuuuaguucaggacguguugauuggguggauacagaguggggggacacagaggugaacugaauggcaccaguccuggccaccugcugccccacagccccacacuacucccacuccaaagcuuuccccccucugccuucuguacucaaucuucucgugggggggggaggggggaagggggaggaugugcuauggaagacuccggggacaggauucauugagcccugaaaggugucaggaacugugguccuucauucccucuguguccacaggguccugggcuggcuucucacugugcaucugcugcaugagaggcccucauagacgcacuguccuaggccugaguccugcuucuguguguguguggugucagcuccaggcagcccccacucuaacucuucucaguguuagcucucaguuucuaggaaaugaaacucacacuggcuuagcucuaauccuugcacuaagggaugaggaaguggguagaagagaaggauacaaguucagggccagccugaacuugucuuagaaauccaaagcugaagagggaagauguugguguaggccuuuaaugccagcacuugggaggcagaagcaggaggaucucucugaguucaaggccagccuggucuacauagcuaauuccaggacagccaaggcuacacagagaaacucugcccagaaaaaagaaagaauccagagcuguaguuuggugcuagagagcuuguaugugcuagagguacuaaugugugcuagagguacuagugugugcuagagguacuagugugugcuagagguacuagugugugcuagagguucuagugugugcuagagguacuagugugugccgggucccggguuccaucagagcuugccucaccucaugugugccaaguucuggguuccauccccagcacugacaaaauagauaaaugaauaagugccuaaguuauggaguaacauaucaaguaguaacauuuuauucagcguguguguguguguauauucgugugcucacgaguccaggucagaggccagccuucaggaacaguucucuuucugccaugucaguccugggauucaaacucagguggucaugcuuaacagcaagcaccuuuaccuauugagcaacccaugggcccucaaauaauauaauuuaaaaacaaaguuugcagcuuuagaauauugucauaugagaaugggcuuucuccaaccucccauucgcgcaugcuccucucagcuggcuacauaaccggcuaggaagcacugcuaaagaaucaaaggagcaggcauugccggcagcucugauggucacugcuccugcuggcccagaugcagcaaucuggggaccugugcccacgggcucuagccgugggugugaggaggugaggggagccuagcagagcugcaagcucacaguugucaagugguuuugugcuuugccuauuguaaacugagugguaacacuggcugguuauauuuaccaagcuugggggaugagcagugggucaguggcuaaggguacuugcagcuccugcagagaacccuucuagcacccauacccuguggcucacagauaucuguaacuccagcuucagggauccaauacccuggccuggccuucaugggcccugcacacacauauacacagacacauacacauaaaacuaaaaguaaacaaauaaaacauuuuuuaaaugggcuggagagauggcucagugguuaagagcacuacccucuucuggugugucugaagagagcaauggugaauacauaaaauaaaaauuaaaaaaaaaaaagcgcguuuuuaaacuaccaagcuggucauggcaagaaaagaacauagcaggugauggcagcccagcugugggcccauauggauuugccugcugaugcucaaacugcuuaacugugugguuucagaagcuucccacuggaaagagcuuugcuguucaaaguugaguuucuggcaccuaaucuccacacaauaguuuucccuaucuacccguggugacugugguuucuuaagaacccugaccuuaucacaggaaagcagcuuagcucccggacugcucuggcuucaggcuggcccucugcuuagcucugcuccugguggagcucaggcagaggguuaucucugccucucccccaccccucucugucucucuccuccuuccccucugucccccugccccacucugaggcuaccucaaagcugugccuuccuaccuuucugccuggguaaggcucuucucugccccuuauccuccccacccccaccgaggcugccacaaagcuuuucugccuguuuaaggcuucuaaugaguuuaaucauugagagauggcguuguagaguucacaggccaccagugguccagccucuggugccagucucuguagauuuggaaaucccaucuucuacauggucagcuuaagaucauccuacugucccaacccaacaccgcccauccccuuguguaauuagacugcaaugaaaacaauacucuuugccucuuuauuuuacguguguguguguguguguguguguguguguguguguguguguguuuacagaagaguaaacacucaacugcugagcucucucuagccucucuauucauuucuuaaagcaagauuuuacuuucuucaauucuucacauagugugaauuuuaaaucauuacuuuauacauauguuuguccugucugcauauaugucugugugucaugugcacgccugaugcccacagaggccagaaggggguggucuguaaaaguagugagugcuucuaacugagucaucucucuagccccaacgugauucccauccuuucagauggauuuuagugucauauguacuuuuuuuaaaaauuaaaaaaaaaaaaauacuguuaaggcuggguguggugcuguuuuaggcacagcauuugggaggcagaggcagguaaucucuuugaauucagguuagcuuggucuccagaguucuaagccacucaaggcuacauagcuauauaaugagacccugucucaaacauacacacacacacaaacacacacauaagaaugcuugcuuaacaugcauaagauguuagguuccaaaaaacccacaugaaccaacuccuuagguccaaugcucagagucacaucuggcucccuagaaacaacacaguuaggauucaaugucuugucuguggccacaaagugcaggucugaccugauuugccuagcugagugagacaggacaguguauagcauuuaaaacaguccaccccucuccuagaggcucguccacagggucugugacacagcaguagcuuggacacccacaauucagcaguccaaacuguuucugggaagaccaccgcaugcagugccugggcugaggacugcucaggccccgggcucucugaugucuucacuccuugagcagguagguugagaccagccucccuacucucuugucuccuccugguagguuaccccagaggccaccccgaugcagagagcuucgaggaugaccugaagcauuugaaggagaagguaucugcaggcgccgacuucauuaucacucagcucuucuuugaggccagcaccuucuucagcuuugugaaggccugcacagagauaggcaucucuugcccuauccugccugggaucuucccuauucaggugaggggcuugggaggaccugauucccuccguccagugcaugcggaaguucuuccucagugaugcucagugcccauugggaauuguccacaugcugcauuuggucaccucaucugucaccccuggacagcaauggugucugucaagggcuuguacggagaacaguuauuaacucuugagcggaaguuuugguuaagccgaaccugagguacuuguuaucccagcacucuggagcuagaagaggagcaggaguuugaggcagccuugccuccaugagacauuaucucugagucaaagaggagucccacaacugaguccccagaguccacuccagaaucuaggcaaucugaugagacaaccugugaugguuuguauaugcuuggcccagggaguggcacuguuuggaggugugccuuguuggaguagguguggccugguuggaguagcuuugucacuguggcaugggcuuuaaggcccuacuccuggcugccuggaaguuaguauucuacuagcggccuucagaugaagauguagaacucucagcuccuccugcacugugccugccuauuccgccuuaaugauacugaacugaaccucugacccuguaagccagccccaauuaaauguuguccuuuguaagucuugccuuggucauggugucucuucacagcaauguaaacucuaagauacaaguugguaccagggacugagguguugcugugauaggccuggcugugcuuuucucuggaagaguguggauuuugggacuuuggauuuggaaagcaguggaaugcuuuaaguggggcuauccuaguaggaauaugaaaggcuguuacugagugauuucaguugcauggaccuggcccaagaaguuuccauggagaauuucaguaugggcuuuagagacugcuuuuguagcauuuuggugaagaacguggcuacauuuugcccuugucucaagagucugccugaggccaagugaagagacuccgauuaauugcauugucaaaggaagucacaaaaugcccaacagagacuuuguucuuugguuaaguucgaugaagaacauuuguagcaaacagaggaaggaaaaauacaaaauauauaguuugaguauuaaaggcacaccaagaagagaaauggagcugaaucuuauguucaaagauauuaaauugaauuaagggagaagugaccuuggggcaagaucccacccagguaaguuuagaucuagacaugguaguguaagccuuuaauacaaggaggcaaagacaaccagaucucugaguucaaggccaaccuagaacagaacaaguucuaggugaagaaaaacuuaaccccaggaguggugaaccacauuuuaaucccagugcuuaagagacaggcaugcagaccccugaguucaaagucagucuaugaagcuuaggcagugagggaguuggaaaacagaaaacuggugauaauguaauagaacaaggaggccauguuccagucccagcaagcagcagagcucagcagcuuugguacauggcucuggcuuuagaguccagaauaaaagggacuacuggaacaacugaugcuggucaacugggacuaagaacucaguggugguuaaaaagagaucagcaucacugaggugaaaacuucugagaaacguuuucugagagcacaaagaagcuguguuccagagauagccaagguuguaccuuaugcugcugcugcuggacuugguaauguguaagagucacccaggugggacugguuuugaaggcaugaaggggucaugaagaccacugugaggggccaugaaaggccauuggugaagguacaguugacacuucagcuguaguugauggcccaggacugaaggagucaugcaaaggagcugaggcuuggcaccaugaagagagccugaagggcuauuggugaagccuagcuacagcagaagacccuaguguauuggaaaugccaguaccaugggauaauuaccaagaacugagcucgagugcuacagagggcagagcuggagacgugaugcugcccuuugcuggagcccagaagaucaaguguggaucccagacacugaaagaagcuguaacauugaaguuacauuggagaucgaaagauguuaaagaugccaaagccaugggauacccgccaaggaaagccguaacaaggaguggaaccagcccaggagaaagauguuuguugcagucaacaaaguugaaaaaggaguggagaucugagaccacuuugacaucggacauggagauguuuggaguuugcccagcugguuuccugacuugccuugaggauuacaguuaagugauuggauggaucucagaagagacuuugaacuuuggacuuuuaacauuguugaggcuuuggaaguuggacuaaaugcacuuuuuuauuauguuuagguuuggcccccauagacucauguguuugaacaagccuaugggagccagggaguggaaugugauaguuuguauauguuugcaccagggaguggcacuauuuggagguguggccuuguuggaguaggugugucacuaugagugugggcuuuaagacccuacuccuggcugccuggaaguuaguauucugcuagcagcauucagauaaagauguagaacucucagcuccuccuguaccgugucugccauguuccugccuugaugauacuggacugaaccucuagaccuguaagcuagccucaauuaaauguuguccuuuauaagucaugccuugaucauggugucuguucacagcaguaaaacccuaacuaagacagaaccugaggugggaccuaugaggugggaccuuuaguuuggcagaugauuggcuggugaggcuuaggaguaacugaguuagaugacugcuguguugaacucaaggccuggcuugggcugauggcaggaaugcagcaggccacucccagacucuacaaaugagagagaaaguagggcgggccaaguacugccuugcaauaccaccugccucucccaggcccuuccccaugaaacugacuagccaagagaccaggaaggagauacaguggagcauaggccagagaugaccccaugccccuugugucucggacagggcuacacuucccuucggcagcuuguaaaacuguccaagcuggaggugccacagaagaucaaggauguaauugagcccaucaaagacaacgaugcugccauccgcaacuacggcauugagcuggcuguaagccugugccgggagcugcuggacaguggcuuggugccaggccuccacuucuauacccucaaccgcgagguggccaccauggaggugcuaaagcaacugggcauguggaccgaggaccccaggugagcgguggaagcuggaggcauacccaugagucagagucgcgcaggugcagcaccaaccauacauugaggaugcccucaggaguaacuagagucacccaguuccagccuccaccucagagagagcuuccacaugcaguaauuaauguugagagugaguggggucgcaguggccgagcuugcugugcuccucuagcucagucuaccuaagccuuugucuuuucccucuuccuucccaccaggcgucccuugcccugggcucucagugcgcaucccaagcgccgggaggaagauguccgucccaucuucugggccuccagaccaaagagcuacaucuaccgcacacaggacugggaugaguuuccuaacggccgcuggugaggagagaagccacccccuguuaggaauugcuggugccuggguggaauagggacaagauuuacaacaaagugccuuguuccuuauacuccugccagggguaauucuuccucaccagccuuuggggagcugaaagacuacuaccucuucuaccugaaaagcaagucccccagggaggagcugcugaagauguggggcgaggagcucaccagcgaagagagugucuuugaagucuuugaacacuaccucucuggagagccgaaucgccauggcuacagagugaguggggugaggaggaacggcccagcuuugucucagccuugggcuggacauggggcugagcuaucuccccuauaugagaugugcgccucaggugagggaggcaggguaagagaucccacuuaggagcccguggagacagagauagcugggucucuagaaagacuguacaaaggggaaacggcccagucccagacucagugcugcccucgcucagcgcacccugcccugcagguaaccugccugcccuggaacgaugaaccccuggcagcggaaaccagccugaugaaggaagagcugcuccgcgugaacaggcugggcauccucaccaucaacucucagcccaacaucaacgcaaaaccauccucagacccuguugugggcuggggccccaguggggguuaugucuuccagaagguaugcuaggaugcaguacucucgauauccccagggacugacacagaacccuggccuuucccccgacccugcauucugaaugacuauagagcagggcaaguaacaggcucugugagccccaguuuguccuauaaaauggggcgaggagguauuuuacauucuggggcaaaauaaaaugaagaauaugacaaggucugccuggaggaagaacaaauagucagcucccaggagcucugaccguuaacgagaugagaccacuaacgagaugagaccgcuaacgagacugacuuuaguuccagccccacuggagcuaaauuacuauugagcaagaccuguagccuuggacugggaggaccuggauuuaggugugaccucugcuguuucccuugguaaacacccugcaguauucugaacauucuaaagaaugaaggcagaggcccucugcagacugaagcaccuugcccagcccuauggguguuguucucauccaauuggggaggcuggccugugcuaggccccucccucauccuaagcuugucagaguggcugccucuguucggcuccuaacaggcuucucuuuaguggcuggcugggagagguggcuuguacaaccacuuggaccacuccacacagagacgccucuuuccuucugcauccacccaacuccauggucugcagugcuaccucuaaucccaaagccuucacugucccacacuuucuugauggucuucucccuggauggcuaggaggacgggcaucuggcugcuggcugagggauggcgugggcagaucuagucagauguggagacagauuggagcaggcugagaaggcagagaacuuggcaaguagugggguugacauguuggguguauucucccucaggccuaccucgaauucuucaccucccgugaaacuguggaggcgcuucugcaggugcugaagacauacgagcugcgggucaacuaccacaucguggacgugaagguaagccagcucccuccggcuuagacggcagcaaggcuugaaaacaccuacauuuauucugacaguccucaaaugcccagccuaagccagacauauuguacaagacagacagaccagauggaggcaggcccccagacugugagguagaugaauauaugccgugacaaaucuguguaaguaggaaaggcagauucaguguaggaugcuacaggcuccagaggagagaugucucacugcagagguacagggugucuaugugugcacacacacacacaugcauguucucucaaauggaggccagagaaggaugucugguauccugcugugucacucuuugcuuuauucccuugggacaguaucucucacugaacccagagcugugaucaccagugcuagggugacgggcacaugcagagccauacacagcuuuuuuacaugggauccaaacaugcgcagcaagccucuuacccaccguaccacguccccaggcccuggucugaaucuuuguaaggacaaagacuaagcaggaggagaggcucugcccugcacugccuguggagaaacugcagauggcaggacgugguggcugucaugcuguccugucugaggccuggagacuaccaaaagcaaagggagcccuccuccccagggcacagugccuggcuccacuucuuuuuuucuuuguuuccuucuuucuuuuuuuucuuguuuuuuuuuuuuuuuuuguuuuuguuucuguuuuuguuuuuuugagacaggguuuuucuguauagcccugguuguccaggaacucacucugcagacaaccaagcuggccuugaacucagagauccaccugccucugggacuaaugaugugcaccaccacugcccagcgccucuauuucuuuuuacaaagaucacagcaggcaacuaggagaguggcaaggaccacgggaccgcauggggacccuuguggcccagguagaaagccgggcugcuacuguaggucuagauaagaagccgcagaaaagccuaauaaccccagcacuaggucagccaauugcuggacgaucugaguucaaggccagccuggguuauaagcaaguccuuguguguguguguguguguguguaugugugugugugugugugugugugugugugugugugugugugugugugagugcaaggcagaauagaaguucagucaggaugccucuaggcucugauuuaagcagagggugauggguuuuggcagaccaggagggcuuaugagcagugggagguuucggucacccuccucagcccugccucuguucucagggagagaacaucacuaaugccccugagcugcagcccaaugccgugacguggggcaucuucccgggucgagagaucauccagccuacugugguggaccccaucagcuucauguucuggaagguaagggagugggagggaguggaggacccuggcuaccgugagagcccuggccagacaauagucccaaacacguagccgaaaaccauaccccaggcaggguagacuuggcccugaaggccguauguuagcacaugguguuuauuucugggcuagcuuggaguggcucugucuugcuguuaccuggguggccugcagggagacagcaggggcccagaccuggagguaccagccgugcugacccugcucgugugucucuguccacacguaggaugaggccuuugcccuguggaucgagcaguggggcaagcuauacgaggaggagucgccaucccgcaugaucauccaauacauccaugacaacuauuuccuggucaaccugguggacaacgaguucccgcuggacagcugccuguggcaggugguggaggacacguuugagcugcucaacaggcaucccacggagagagagacacaggcuccaugagccugcaucucucaacaggcacaccauggagagagagacacaggcucugugagccugcaucccucaacaggcacaccacggagagagagacacaggcuccgugagccugcaucccgguaucuuccucaccuggagccccucucccucaucucucuacacaggauaauggcagcuagacuagcaggaagcgucccggcucuggcuggaccuaagaugccccgucgaggaggcugaugcucucugcucaagcccagagcccguguucuugcuguggcaagcgccuccauccucagggggaggagaccagagauugcccagccacugcaccaaggcagccucuaggaggugaacuuugaccuggggucugugugagacagacaguaggcacugugaaauacugaaggagguaggaagagaugugcaaaugaggguacagaaaccuccucccugcucagcggacuacacaccagguccccaagagaggccuggcugguaacacaagccuuucuugccaucuuaggccaaagagugcaggaguucugccucugcagaagguugguugugucuguucuguggcugggaagaaagugccccuucaggguuaaaagcguucuguccucaauggaggcuugcucuuggccuuguuuucuguccucuuagcgagauuuaccugggcagggcccagcucuucccguggcuguaugaagccugcucccuugcuucugagcagacuccugccagcugcaccgucuucucuguugggccuagacuaggggcugucccuggcacuccuccccagucagcccucaggccuggcugccuggggcagugacuggcaggcacagaugacugcucccagccugcuggucuuguuugagucagggaaugggagaaagcgguccguagagcaacuuagggagagcaggggguuccugcccucgucucccaggccugggugacugcaguggagagcagccuuggagagaaugagcagaagcagccaggaggaggagguccuuuuauugucccagagcuccaggcgcuggccccuccaacugugggccuguucccucccucggaaggcugggcuugguucucuuauuucucaggaauauuucauagcugcugcuggccccuacucaccccaugccugcuacaccugagccacuguaaacuguuuccaggagcacaggcugcugcuaguucuucucaugggcucuuggcuaccaaacgcuggugccacuuuucaaaggcuuggaggcagggcaggaaguacugcuugucucaggcucccuccagggucuguacugggccugucagacuugacaccuaagccauguucugugugucucaaccagaggcccuuuccuuugcccuggcagccagcccacccugucucugcccaaauaucuaggcucagaauagacuggacuugugacccgggaagcuaugccccgugaccugcaaacaagacaucuguucuggacgcaggcccugcaaggaccagcauggggagccacugccacaaacagacugguucucugagugagugaaacugauacuuggcugggcuugaggccccuagucaagggcucuaauguccaggcugugugcucuguaaccaauggccaauucaacugaaugaggauagcgcaggguggugagcagggacacccuccccucucccuggcucagccuggagguggcacuggucuuggagggcuggcugggugaaccaagguaaagucaccuggaaaaggacccggcucucuucucucugguguagcuguugagccacccggagcugaaggaccuuuuucugccauguccuccacgccuguuccaggugccauugucugagcuacagagagaguugauagaaaagauccucugccauccugucagcccuggcccuucugcugccaccccagggugaaggagaugugacaaggggccaucaccuaagaaauguuaauaagugaucacaccugagcccaucccuaaggcuuugggcaugaggugcaauuaguaguuagugccuccagcuagccaagggauacauaggaugaguggggaguuguucccagggccucugcuugguacagaggagcugagccucccuaccagagcccaagacagcugcuccacccagugaacaucuacccagcgcugccaugcccuugccaggcuccaggccugcugggaaaccugacuaugccaacacuauagguaccugucccugcaggccaagaacaucuaaccucuucaacagcaaagaacaagaggcccaggcucggccauucugccagaguugaaaaaucccuugccugaagggacugaccaccccucccaugcacagcugguccaccuuugaggagccuggccuuggcccuucagggcccuagucucagagcugcagggcucaccuauuccuguagggggccaguggagggcccgugcaggcaguggcagccagaacucgagggcugggcagaggggucucucugugacaccugaaaaggagacuugggucaggagaggaugaugccuugauuuaaaagaacagaagccccacccaccuaccccucaagucuccaggcugugggcuggcccaaggcgcuaaugggaaaagaagggaauucuucaaguagcugggacacucaagaagagauggacaggggcauuguuucaaaggguguggccugaggacugagacucaaagcccagguugugguccucugugccucuuccauguggccgugccaggcugagcagcacauucucuacagcagguggccagcagcugugagucugaaggaagagcagggggacaaggaccaacugcaaugggcuugacccugcugaccacaaggggguccugccugccuccugccagagcaggcucccaccugcgugcauaauggggcgcuucaccugacacucaggagucccaagacccccagaugaggcaagccacccguaguggcacagcucccucugaccauccuccccguuggcugaaaacaucuaagcagaggcuggcucaguacugcgguggagcucaggccagcccugagauugacauuaugcuccugaauuaagcuuuagauguugccgaagccuugccucucacauguggccugacuccaaggucugggcucccaacuaaugcagcauacacaggggauucacagcaccacagaauggcucgccaccugcacguguugccaggggaaggcuaccugggcaugcaugaaccugugguaaagagcaggacccuggguaccauucucagugucugcguguuucuagaaaccucaguuuaucagcauaucagcccugccuucacuaacaagaagagaaugaaaguacauauacuuuuaaaagguucuaguguacuggugaaauuucacgacgcugaggcaagagggcgagaggcugccucaugagcuugaagccaccuggacuguauaagcugggucuacaaagccuguaacaucaacaagcccaacagcaugaggcccauggugugccagcacccugagcccguacgaggauucugaaacccagcaacgcuagucuugcaauucuguuucaaaggcaaagccacuuugaugccuuauguucuuuccaaaguuaauucuguuccucuggcaucugagcaagagucuuggugaggccagauugucuuugggaacacugucuagccugccagggacuugggcugaguccccuaguuacaucugcagaccucuaggcaguguuguuucuugcaccuggcauuugugauuaucucucuccuccugauaggccuucagccucucacuguugugucagagcuaagaacuucuggucugaaggugacuuuuugguacagaaaagagaaaaacccaaauuucuacuuuauuuucuaaaaugagcacauugcauuuuuccaauuaaaaaaaaauugcugucuccauauagcuguuuuuaaaugcuuagcguaauuuauuuuugugugcaugugugugugugcguguguguaugugugugcguguguaugugugugugcgcgcgcacgugcgugugcacacaccuauggaagccagaacaggccauugagucaacagaucacccggagcuugagcuucacaggguugaaagccaccaauguggaugugggugcugggaaacgaacucuggucccucuagaaagagcaaccaguuaccauggaaccaucucuccagcucccagauggugcuguaacugaauuuaagaucugaagguguagcuuagugaacauuuguccagcgucucucuuaaaaaaacuaugugguguuugugguauacgugucaggaagggcaggcaugccuuggugagcaugacagccagaggacaacucuggaguuuauugucuccuucugccuucacaucaguugugauaaucaaaucaagucauuggguuggcauggcaagugccuuuaccugcccagacacccugcucacccauggauacuuuuuucccccuuugagacaguuuaauuauucagcccuagcuagcuucaaacucccggagaucuugccucugccugccucugccuuccuaauacugggauuaaaggcacacaacaccgugcccagccacaaacacuuuuaaacaguguccaucucccuaauagagacccuuugaaggcagaccugcacagggcugucacucaagagguuugcuaauggauccuc

SEQ ID NO: 2263 - RNA, 748 nt, Mus musculus
cagcaguuugucuucgcugaucggugagacuucgagcaguuaggaugccgcguggaagccgaagccgcacuucccgggugacuccuccggccagccgggccccucagaggagggcugcuccccgaagagcaccugcagcucagcuuccagcagcagcugcgccaucugcaguuggaucaccugccgcugcgccccggcagccaggccugauggcccagauggcuaccaccgcggccgguguggcugugggcucugcaguggggcacacccugggucacgccaucacugggggcuucaguggagguggcagugcugagcccgcaaagcccgacaucacuuaccaggagccucagggagcccagcugcagaaccagcagucuuuuggaccuugcucucuagagaucaagcaguuucuggagugugcucagaaccagagcgaugucaagcucugugagggcuucaaugaggugcugcggcagugcaggauugcaaaugguuuaauguaaucaagaaauucaagcugaagagaugugacauugguucuguauaauugauaguacaaguguggacccuuauauuucuaacaguucauugcuuuggaauggccauggaugcuuacuaaggcuuguauguaguguugguuacugggcaaguguuuggccuccuuggacuguguugugauugugaguuuaaaaaaaaaauaaauugguuauucuggaaaaaaaaaaaaaagaaagaaagaccaaau

SEQ ID NO: 2264 - RNA, 11205 nt, Mus musculus
auacaauaagcuuuaacauuuauuaccaucgagguuccacuauucucaaccuucacuagucccugagucacacacgauuuuuauccucacuuuauuuuacauuuuuaccgugugugcgugugccacacacacacacacacacacacacgccaagugccaugguguuuauauggaggugagaagucucuucuuauacauguccuaggacucgaacccaggucaucagaccuggcaguauguacccucuacccacugagcuaucucaauggcccaucuuauccccacuuuucagaacaggaaacugagacacagugagauuuuuuuguuuguuuuuguugguuuuuuguuuuuguuuuuuugagacaggguuucccuguauaguccuggcugucccggaacucacuuuguagaccaggcuggccucgaacucagaaaucugccugucucugccuccccacagugagauuuuuuaaaacaguuguuuccuauacagaaaucucaggguaccuuuagauuuaauuacguuuauuuguggaggaggcaugugccacaguacuaacauggaggucagaggacaacuugcaggagucaguuccacccuaugggacccagagaucaaacucauauuuuagugacaaggcccuuccccaacaggccaucucacugguccuuugaaauuuaaaacaagguucucugguugcagagagggcuggaccuacagggcuguucuggagacugaguagggcacaccagcaguuuggcagacagaacacugagugccucaggggcaguuucucaggaagauucaacucaacaagcaagcaauagacuugcaaacaggacaagagacuucagcucugcaggcaacagguaagagaccucccaagaacggcaggcucuagacuaaaaccugggggccagccuguuuccaaaccaccacggggccuuguggcacaaaggcaggugcccgugagagcagcugguugaagagccccgucccacaagcacagccuucuggacccugccuggccauccugugccccaccagccugugugcuccucuuggcuuuccagucaguggcaacuacaggguacagccccaauccuacuguuaguauuccuggcuucucucuucggugcaucagcaguucccgcaggcccaccuucagaguguguccaggaggugacaguugucacauucccacagccaacaaguacaaaguauccuucuagggaguaucaaccagucacauucagauucggauaccgaugcaugcucucuugaguucuuacucaguggaaggcaguccccaugguggcucccaaccugcucuucugcuaucugacacuaagcgcuccagccacaccacuuccuaaccacaugcuggccaguguuccaggccagccuuccuggggggcugccccuccacuuagacccucucuagcccacugcugccucuagggcaugucucuucucuucacccaccuauucugcuugccucggggccucuccuccaucagcuggaaguuugucauccacugugggacagccauugaccaaugagaaagcccagcuccccugcucuagucugcuuuuggggcucuuccagagauauuccuccuccaccuuucccuaaggucagcuggaucugagggaugcaggcucugggaccugucuuagcuacuuaggcugagccccugccucaccuuauucgucucugcaagcaugaccuauuccaagagacacggcacugauacuccaggccuuccuucugccuagaaacugcccagaaacaggagaaacacccuggguuuuccaucuuccuugccgcaggccucauguucccuucucccccaaggccucugcagucaggaacuugacaugcaucccagagcuuuuuuguuauuuuuuuguagacaggguuucucuguguagcccuggcugaccuggaauucacucuguagaccaggccuggccucaaucucugacauucacuugccucugccucccgagugcugggauuaaccacccaccaggcagguuuuuaauauucuggauuguuuguuuuuaucuaucuuucuuucuuucucucucucucucuucucucuguuuguguguaaaaccucauaccaugacaagaguauguguggaggucagaggacaacuuucucaagucgguccaaaacuaaacacagauugucacgcuaaguaguagacugacuccuuucaccugcugcugagccucgucucugggccccggcucauguuuuauacugugcugcauacaaccuaaacaaaccuaaggguuuugugagagguugccucacaacuaccucccucuaguggcacacgcugcuccucacucugcucacacugggcucaggaugcugauuguaugggaugcugauuguaugggaugguguuccacagugacccuguccagaggcggggguggggggugggguucacuuuucacagaugcugucacucagccucccugccuguccacaggugugcagacaguccuuucaggacagucaccucagccugugguuccccauaagucuucaaguaucuguccccagagaucuggcaguaagaauaggggcccuggaaccucaggaggcagucgacugugguaagaacgcaggagauagagggagucacccaugcccugccucaugggucaguaucagaggcagugauagucacuuagauucagaggacagaugucuguccacaugccacacugaccguuuggccacagucaggcuccccccacaggcccacagguagcccuuccuuccaucaggcucuugacucaaaggcaaaaaucauaccaagacagcagggugggucugugcuuggagcucaaucguggcucagacacagagcagccacagaaccccugaauuuuuaaugccagcacucugagaggggccucugaagaacuacugcauccaggccugggguucucagacaccaagucaugaggccgugacaggcacaggaacuuugccccuuugcagagcaggcugagcgggaccacaagcucacagagcuucuaggaagggcugaucaccauggggcagcccgagcggcagugaucacuaacccaugaggccuggcuggcccugagcacucugggcaguucaguaggaguguguuauaguuaugggguaggaggggaaaaaaccaaccacagcucuagcccagggguuaacaggugucuugaagggagggguagccuggagaauuaggacugggcucuucuccacugagaagcuagaggcucuugaccuccaagggcacaugacucaggccaccucugugauagggaauggcggaugccccacuguagguccagguaaagaagguuugaacaagaauccugcuggggaccaggacgaccagggacagcuucaguacccccgggggacagcuuggcccuuguucuccaggcuugcaaaggggucugcagcagcgucugaugaugagucaauugucugguaggcacugugcuccugagaggguccgaagaaaucuagaggacagggacaugugcauagagaaaaugagacccugggguuuuugcuaagcacagauggauccaccgucugccauggcuagaguucaacaccaugaugcuaaggacaaugugcaguagcagaagcccagacaccaagccuuuggcaggcagcauccacucaauccuagcaucugauggguggaucugcagaugagagacaucugagggucagagagacaggcugauuugauaucauuuggcuugaggcauaggacacuggguuccagccuagacaucagguccuauggucaguggcuccuggcugcugugccaaaucugccccagaagcacugaugagggaucugaagagggguggcuaguccucagcccacgcacuuuucuccugcucuccucagucaccauuucuagaagccgcagagccuggcauagcugucauagccagaaggcugggcugaggguacagggcaggacagaaggcaccugugucucccacauuucucccucuguacauuuguccuggggccaugaacaagucccaagggcaguggaccuuccuuccuucucccaucccuucacaccaggcaggucuagguuagcaucgagauaaaccagagugggcagccauaggccacucuugcacuggcucaguacuggcuaccuggggaccacacccagcucccauagaauagguucagagagggcaggacaguggcuuggcccaccaccagagaggacagugcgggcugggccagaggcuagaagguuggcacacaggguuccccacacggcaggagagcacacccccagagccagggcuggcuggagacagaaggaagaugucccugcggcagaggcuccaggccacuucugugagccgaaaccucccuggcuccccuugugcucugggccaagggagggccaccaggggaaggcgggguagagcaggacuuaccggggcggagggggagcucacccccucguucacggugcaugugguagacgaggcagcaagagaagggcuucagcagcaagcugaggauggccaugccggcgccgaagcggccaguguccccaguggcaacacucgaguagaagaugcuaauguagauaauguccaggaagaugguggcaaccaagccaccaagaaacugcaagggacaccaucacaauaucauggccacugacucuccagaccccaagcuucacacacacacacacacacacacacacacacacacacacacaccccagccuggugacuggcagccugugacuggcaccuguguggccuaagagcacaacauacaagucuggcucuagccuguugccccagaauuccucagccccaucuccugccauugaggucauaaggggccugucuccagaauuucugagagggacagucccuuggaguccauacuuucuguuuacacugcaagaagacaaggaaaacccccuuuguaauucuccuaaggagccguugggguucugugaccuucccccaugucugucuuggagggggacagcagcagagguggguugcuguguggcuggccucgcuaggcuugccaugugcagaacagcaaagggucggguaugagggagagagaagacacgggcagacgaggggcgcacggccaguuuccccacuucaacucaccaugccuauggcaucuauagagucccgcugggccacagcccacacacccagggccaggauagugaaguugccccaagcauaggagcuugagaacaccaagcagccccugcacagagagacacacacuaucaaucagcuagucaccaacuugaggugcccaccccguccacacaguuccuucccccuguuccagggucuuaaccuccucugagaauagucacuccugcccccugcaggcaguuauugaaauagcaggcagugugaaucagaucaugugacuccuccaagccaaccuucccaccgguuuggaauaagauaccuuuuuugcuguugucuaugggguucccacgagagccccacccuuaccuccuggcugcuacacccuugaggcuucguuuuccugaacaggcagccauuucuugccaucuuaagagcucaaacguugccugagagauccacucucaugcaggccugaccaagcuccucccugcucaaguuuucagaguaucucugacauugccuacuaguuugcuugcagagccggcuuaucacaguuaacacggggcacuuccugggaccugacucugccccacuuguucuaaauucauugguucacagcugcucuuuggagggagguguuguuaacgagucuuauuuuacagacucaaagucaccgacuuaauaggugacuaaccaggucacacagucgcacaaugaaugaccaugaggacugaccgauccuaggaaugggugaggagaagguuuuauuguagauaugagagagagacagcagagguauccgcaaggaucccgacugagcauggccagcaaaaugaguaaggccauggggggugugggggaaagcaucagaggaagagaaagaaagagguugagaggggcagagagauagagugguccagaagaggagccaagggcagaacaaagacagcagguagccaaaacggaaucagaagcuaggugaagggaagcccagaucgcgagcuggagaggguuaggguagggggcagagugagaagggcggggccacggguacugagugaugcugggguaacugggcagggccacagauacugagugaugcugggggaacuggauggggccacggguacguugucuggguuucuuugggacccgaccauuagcagggcugggacuggaacaguggaauuagcaauuaggccaagagguccgauguuuuccagucuuucucggucucgggaaagcaggugugagcucagccuagucaccaauguggagcugcagggaaagugacaccccacucccugcuguuuacaucgcuuacagcaguuggccuggccacugccccucaaagccugcaaagcacacgugaucucagugguuuccugacuugcuuuuggcagcuccaaacacacgaccgaagugacagugaggucaagcugcagcugcacccuggagccccacuuaggggcuugguuaguacgcacugccgcaggggccuguccuuaucccacuguguagauggaagauagauccagcccugcgccgaacgaacugcuaaaugugauggacugaaacagugcagaaugggaccuggccaggcagacaggacccgggagcacugaccccaggugacacaacacacagccagaagacguggauacagccagacacccagagucacuuaccagguugucaacagccagugaaccaggagaauaaccuguagcacaaaaacagggguuggauaagucugugagugcaaaggcacagcacucaggaagaggcaggugggccucucugagucuggggccagccuggucuauaaacagaguucuaggacagccagggcuguuacacagagaaacccagucacaaacaacaacagaaaacaaaacaacaacaaaaaaaagagaauaagccucucaugccucaguuucccucucuuuguaaugggaauauaaucagcccucagugauaggacuuccaagaaagcugcagggagaaagagagccaaguggcccagcccuuccuggaaaugugcagcgggagggaccagaggcuucucaaagagaaacugggaagggcggaauggagcagagccagagcggggggauggggaggggcggggcuaugggggacucucuuccccaaacaaggucaacaagcuagggcagcaggggucacuggugcugguugcggaaugcaggcccucucggugguggagaugguguguguaucacacagggagcaucuaucccaaggggaccuuggcuucagggaaagcaggagcuugccagugcuccucaccuggggggggggggggggcggggauccucacucugaagucauuccauccacgaaucuucugccuacacugccuccagggccaacuggagcagaacucacuagagacucagcacaccagguccaaucagaaaggcaagcaacagcccagcugcaaagcccagaucaaccaccccuguucugagcuugcuuucugucuggcuuuguuucaggggcuugcaaagguagaccugguuucugaucugacgguuguucucuuguuuguuuguuuuguucccuccuuuuuuuuggucuuuuuuuuuuuuuuuuuuuuuuugguuuuuugagacaggguuucucuguguagcccugguuguccuggaacucauucuguagaccaagcuggccucaaacucagaaaucugccugccucugccucccgagugcugagauuaaaggcgugagccaccacgcccggcuuuuuuuggucuuugagacagaguuucucugugcaguccuggaacucacuuuguagaccaggcuggccucgaacucagaaauccgcccgccucugcccagcuggucugaguuuuuaauccccucaucgcccuagaaggcacagcuuguuucccaccucuuguuacagugaacaaacugaugugcagagaggucaaguaaccuccucagugucacacagauaacucugucagagccuggccuuaaaaccucgccccgaagccagcauucucuccacugucaggaucuccaaggucaaaggcagggcagagggaagggaaguuuaacuuagaaaagggugggucagcagaagucuaggggccaagaggauuaauuaaccuuuguuuggggcuauggacugugguuccgugguagaaaacuugccuggccugugguacccuaccacaggaaaacaaaacaagccuuuguuuaccacucccaaaggaggaggggcuggggaugucccagaccucaacuuaaaacauccccguguguccugugcaaacauuuggcggccuauuagacaaggcaguaggaugcccccaggacagcuaaauucaagggcuacccaggaggagaggcagguccucuggcagacuuuggagucagaccauggaacagaucuuaacacauaaacuugggcaagucuccauacauacaacggccaccugcucuucagcgcagcagggacucugugguagaagugugucaaacacucaaacacagcaggccgcaucgcugcccccccccccccacugcuccucccagggcuucacaagucuaguccaaccugagcugcuucaguuuagcuccugcuuaagacaagcaagaagcccaguuagggacccgacuucuuucacagagccugggccaagugcugagaagagcuggugucuuuuuaaaagacagagaggguggacugaaaggggcagccaauggugucccagcugccucccauagggacaccagaucuugcagacaaaauaacacaacacccagccucauucugaauuucagauugugaaugauucaguguguccccaauccugagacacaugguacgacuuuguccuugaugcgaagcccaaaagugacuggguguuacuucacaaccccuagccugggcacugcccuucaaagccugcaaagcacacaugaucucaguggagggccuaguguuuguaugcugggcuggaaagccugcuaucuuacauuugugauggauacacuguaccuaucagguucuaaaagacgauguaggccaucaaaaccaaaguuagcccaaagcaacaauaccaggaaaugcaaaccacuggagcugagucuuuggggguucgaauccugacuguaccacuuauuucuugggagacucggacaauuuccucguaugaucuaagcugaaguuugcaccccgauaaaagaacacggcuucucuaggucagguaugguggugcacaccuuuaauccuagcacucaggaggcaaaagcaagcagaucucuugucaauucaaagacagccugauuucuauagugaguuccaggccagccagagcuagauagcaagucccccaacucuaaacaaaaacgacagaguacagcuucagcuuuuucagcggaggacggagacuaagaaaaacaagcaacacagguuggggauacggcucgguugguggaguguuuccuuauccugcaggaagcccuggguuucaucgccacuacuguguaauccuggcacuggagagguggaggcaggaggaucagaaguuuguggcaauccucagguacacaguaaguucaaggcuacacaguaaguuaguacacgagacccugacucaaaugaauaaaacauaucagcccauaaacaucacauuuuucucaccuguuccugcguuuuauuauuauuuguuagugugugguccugggauggaaccccaggccuggggugggcuacucaaauguucuaccauugagacuugugcuguccucguaauuauuccagcagaauaaggcagagccugaccuccagacugccuccaaguccugccuguaauucugucccuagauaauggaucgcucaagcccauuccuuugcuccaaucucccuccugcugcuagccagcaguuuaggaaugggaaaccggccagagcaagucacagcccagcccauaugaaaucacacaacugcuccaaagcaccucuaucuuccggcccuuuccucucagacaccaaagggugcuaaauggcuuaacaccugggagucuuaggguuucacggagcuggcaccaaaggcccaagauggccgguuuacuuccagguccacacgguucuggccgaagcuaaguggccagcaccucuguugcaaaugaggagggcugagagagaaaaagaacuuaggaaaugaagacauccuacgcagccccgcugcccggagcucaaaguagccucugggguuuuugauuuuaggaaaccucuuaaguuccugcuucuuaauuaugaaauaaggacgcugcauguggaaauuagggagaagcaauuguuuggggacagcggauuucuccuaacuugagccagcacucagacagacccccccccccgaacugcacugaccucucagaaggauagaugucccuguccugcugugggggacaccaggagcgcaggcccgggcgguccggugcccgugccagccugggucuguccgggaggggcggcccuguccgucucuguccccaggugucccucuccguguccgccgccuccuccccggggcucuggaccuucccuucugcuccgacuccguuccccagguuccuggacccccgcccgccccggccgcgcggccaccuucaaguucacggcaggcagcuccaucccgacccggcggagggcaccugagcgacggccgcggggacuccugggcuccgaacucgggaacaaacuuccuggccccgcccgucgcguugcgccaguuccaacggcgggaggccaacucgcgcggccacgugacugcagccgguugcuaggagacggcgucaggcagcugcucuugcugcuaggcucaggcuccugcuacuacuacugccuaggccucuaccagcuccugugcuucaagccaggaggucgggauuucugcagccuaggggcucaacgggcugccuaagugggaucgaggugagguggugggacgaccua

SEQ ID NO: 2265 - RNA, 6431 nt, Mus musculus
acuagauucuaaguagcgcuuccuucgcuggaggaggaagcaggcccgaggugggagcaagcugcugaaccgcuugucgccuggagggggagacggaagccggggaagcccggccaguggagcagcagcuuggugaggggggggggggauccuagagcuccgagcucaccaucuucgcaccgacgcggaaggcccgcuggucggugcgugacgccagugggaagacggggcggggcgaggugacagaggaccgggucgccgagguccaggcccaaggcccuggagagcugaggccccccuuccuccggugcccaggucgcggccgcugggcagcggggaccgcgaguggccggcgggaggguggggccgggcgcaggucacgcgcucguggggagacuugggaggggugcggcaggugcucucgaguccggcgccgggacgcggggacgccgggccugcuguaggcacgcgagggucccggacgguggcgacaccggcuucuccuugggacgccgggcuucaggcgcuaggguaggacguccgcucgugacccagccgcagccugguguggauuuuaccccuaaggcacaccaggggcacuguagucucccuggcaagguggcuuguuuuggggggggagagugacacuggaguggaaugccaucaggaccacggcagggggagaccccccacucgggacacagugacucacccguguaggcagcuuuuaggaguugccgacaucuuuuaaugcgcauaguuuaagauuguuguugguuguccuuuccuuaggauggagcccagggccucccaaguguuagauaagcaugcuaccacccggcagcaccucccccacccccacccccaccccacccccgugagggggagacauuucugcuccuucugccuggaaguucacaguccuucuaaaugagucauugccagccuuauuuacuuuuacuuuguauuuugagacgagcaaaauugauuaggcugggacaaaaaguucaaacuuuccaccgaguaucugggacugugagggcgugccuccacucagguuuguuguuugggcuuuucuuuucuuucuuucuuuuuuuuuuuuuuuuaaaucuuuuuuguuuguuuuaugagacaggguuucucuguguagcccuggcucuccuggaacucacucuguagaccaggcuggccucaaacucagaaauccuccugacucugccucccaagugcuaggauuaaaggcgugugcaccaccacugcggguuuaucauuuuguauuuugacacaggacguuuaaaaaacuguaagcauuugaaagacccugccccucccuagcuaagaauuuaagcuggccccaugugaucccuuuccuucguguaguaaauauuccggagagccagaguguauucacccucuugugugcucagacagaagcccccagaagaccaccagcuuccaggaaaggcucugaaaauucugagaaugcuacaguuuguuucccugaaagcggguggggaggcuuaggcucauuugagugacaacauagggucccaccucacaccugggguaagucggugaagugagccuugaaaggaaguuuuacugcaauggcaaagcaggacucgccuccgagaacuuaagagacagcgcaguggcccugacucuuuccaggucacaggcccaacuggcuccaaaacaaagcaguuugggagugagggguggauauugagaccucguuuccuguguagcccaggcugauuuaggaaacuugauccucuuuucccccaccucccuaugcuggcuuuuacaccccuggcuucuaaacaaauucuuuuucaguggggaaaaggacgucuuuaaaauuuugugguucuggguuuuuuuguuguuguuuuuuuuuuuguuuuuugguuuuuuuuuugagaggcagcagucuugcucugcugcccagaguggccuagaacugcugggcucaagcaaguuucaacccuuagcuuucugaguaacucugacuccaggcaguuacgguggcgccuaccucuacccuaagggcuuuaacuaaaaguccuggaacacaauuuagaagcagagugcuugcucaggauacacgaggccuuaaguuccaucgcuagcacugccaaaaaaauuuuuaagagcuuaguuuuguucuugugguuuuugaaaaccaaccuaggcugaccugaccuaguaguagcccaagagauccuccugcuuuaggcuccuuagugcuuggaacacaagcugccaagucccgcacauuguucacauuacaucucuuccaaacgcaccuagaacaggcccggaggacuuccaagggccacacuccacccccacccuguaagcgcuuccuggcaggguuuccggucagggguggaccugcgauccagaaccugaugggaggggaggagucugcuguuucagguccucagcucacugucuucccccuaccacucccaggucugggaacguaauucucuguugccaccaugguccacaucaacgagcugccagagaacauucuccuggagcuguucauccauaucccggccccacagcugcugcgcaacugccgccuggucugccgccucuggcgagaccucaucgauguggugucccuauggaagcgcaagagucuucgagagggcuucuucaccaaagaccggugcgagcccguggaagacuggaaggucuucuauauccugugcagccugcagaggaaccuccuucggaacccgugugcugaaggugggccggccgggggcgagcccugggagccuucuuuacuucccugaaccgcagggccuuggugcuugccuguccacgcuagcuaacgacaaauguccccgugucccuaacaguccuacacuuugguuccuuguucuuugggucucggaccagcuuagagucuucaucuguuacauuguuuuauaggaauguuugggggauggggacaugcgcaugccgcgggacacucaagaagagagaguagcuuguggaguuggcacucuacuuccaucaugugggucccagggauccaacccagguuguuaggccugacagcaagcaccuuaccugcauagccaucuucacccacuggguugacaucugaugacagcuucuccuuagucaccagcucugcauggcucugugacacuucucagaaccuuuguccuuugugacaauguaaaggucuaauggacccuguguaucacugggcagggcaccuguccccuguggcuccuuccaggcuuccugcugucuguccagggacucucugggccuugacagauguggcagcucagccuccugacagaggaaggauuuugagcauagcagucuuggcuugaggcugguuuccccccccccccccccagccucucuugucuuuguugggcuuuuucucuccauucaccacaguggccaugagagaguccugucugaggcgggcauagcaacuuacaccuuuaaucccagcacuugggaagcagagaucucugaguucaaguccaaccuggucuauagaguggguucuaggacagccauaaugagacccugaguagaaaccaaaacaagggccuugccuucacuucagacagcugcccacuuuucccucuccugauugugguuguggaauacagacaagcaguaaguggccugucucugcaucagaguacuuugggcccugagguuugugacuuggcuuagggcucagaacggucauccacugagggccacccugccaaggcucaggccagucaggggaccuacaggcagcgccucagauacuugaucgccuuaccugcccuagauuccacucagaagcugcccagccaggccaccagcuuaucucgggacguuuuuacagagcuaccuugcagcuuugacuuuggccagccuagccuugcucaaaucucccauggcguuuagcucaugccagcccagcuccuggaauucuugucuuccuuugguucucuacugggaagcuucccagaacgcaugaaaaccgugugggcucuuagagggagggauacagaguggacuggcagaguucuggugaugguucugggccaccaucaauuaacacucguguuuuccugggucugccauacuugaucugaaggggggaaccccuagaucuaacccuguuccuguaggccccauaccacaggacuccugcagccaccagcccaggggacaccaaugugcccucuuggcauuugcccaggaaaagggcaucugaucuugugggaacagugguuuccuuuggcccauagaaucugggucacaguuaaccagggccucuccuccccuaagccuggaaaagcugguggccaggaaaguggccacguugggaagaacucccaucagccauaaggucuacuccaucacaggccuuuaugaucauacucucuaaggauugaaacauggucuuuguaggggccccacggcaauaugaagucaugcccuuggacugguugggugcuaaacuuggcucccuaauauacuacagaagcaaacugauuaauccuuugguaucccaaucugaaaaucugagcccaauuaagcccuagccaaaaccaucucaccacuccugaagucuuccaggaccaguaaaggccucaaaauuucaaguguauacuucagggaugcaguugcuggcagaaugcaaggggaucucacccgugcuuccgcuuucccccagagaaccugagcucauggcggauagacuccaacggaggggaucgcuggaagguggagacgcucccugggagcuguggcacaagcuuuccugacaacaaggucaagaaguauuuugucaccucuuuugaguaagugaugauugcggacggggcagccugugcugagggcucuaccaacugguaggauaagugggagggggccucugggagcucaaggaguguccaggagcagucaacuuggguuucaggugacaggaggucacugaacgucacaucaggagcaagaaucagcaacacuucauaauaucccauggggccaaauacucccuagggaagagcaaaucuaacuccccauuucccucagacagacccaaggagcuccaggcuggguauguccuggaagucaccugggucccuugagccaccuaccuggcaaggaagggcucuguuuagcaugcuggcaauacaagccugaccucugcccccaggaugugccucaaaucccagaugguggaccucaaagcugagggcuacugcgaggagcugauggacaccuuucggccugacauugugguuaaggacugguaaguggucucccccacaguguggcaagggacacccuaagagccacaggucaaccccaccccgcucugccucguuccccuaucagccuuuuuccccccaacagucgacucagauggacagugaggccucccaaugagcuagcugcccugggcgggaacucaugccuuauguagcaccucccaccccuucccucugauuaccccauaccgcuugaauuuaucucuguagugcuaaggaugaagcccaggaccgggacugggcuaagcacacaguuacaagcacaguccucauccaauguaccauauggugacaggcuuggacagugucucuguaagaagccacugugguuuuucaagcucacagccuucucuauccucccuaggguugcccccagagcagacuguggcugcaccuaucaacuccggguacagcuggccucugcggacuacauugucuuggccucuuuugagccuccaccugugacauuccaacaguggaaugaugccaaauggcaagaggugagacccugccugcuuguccugccacucacucuucccagggugggguccuagggaggagggacaagugcucugcaguuccgagcgguccuccccauggcaagucuuaauggucuccucuucucuccucuccagauuucccacaccuucucugauuacccuccagguguccgucacauccuuuuucaacacgggggccaggacacucaguucuggaaaggcugguacggcccccgugucaccaacagcagcaucauuaucagccacaggacagccaagaacccucccccugccagaacucuaccggaagaaacuguaguaaucggaaggagacggcgagcuucggacuccaacacucaugaggguuucuucuggcaagggcuauggcaaaggcuaaggcguuagugggcagucaggcucccagucccaugagcacuugcccuauacaaccuugggcaagcccaucaacucaguagugauaguuggcacccacagcucugacauuuuguuguaauaaauguuuucaguaacccagccugguuugagggcuuacagguggguugcuggcacucugagaaagagccccuucucagggcagcuucgauac

SEQ ID NO: 2266 - RNA, 1636 nt, Mus musculus
agagaaccugagcucauggcggauagacuccaacggaggggaucgcuggaagguggagacgcucccugggagcuguggcacaagcuuuccugacaacaaggucaagaaguauuuugucaccucuuuugaguaagugaugauugcggacggggcagccugugcugagggcucuaccaacugguaggauaagugggagggggccucugggagcucaaggaguguccaggagcagucaacuuggguuucaggugacaggaggucacugaacgucacaucaggagcaagaaucagcaacacuucauaauaucccauggggccaaauacucccuagggaagagcaaaucuaacuccccauuucccucagacagacccaaggagcuccaggcuggguauguccuggaagucaccugggucccuugagccaccuaccuggcaaggaagggcucuguuuagcaugcuggcaauacaagccugaccucugcccccaggaugugccucaaaucccagaugguggaccucaaagcugagggcuacugcgaggagcugauggacaccuuucggccugacauugugguuaaggacugguaaguggucucccccacaguguggcaagggacacccuaagagccacaggucaaccccaccccgcucugccucguuccccuaucagccuuuuuccccccaacagucgacucagauggacagugaggccucccaaugagcuagcugcccugggcgggaacucaugccuuauguagcaccucccaccccuucccucugauuaccccauaccgcuugaauuuaucucuguagugcuaaggaugaagcccaggaccgggacugggcuaagcacacaguuacaagcacaguccucauccaauguaccauauggugacaggcuuggacagugucucuguaagaagccacugugguuuuucaagcucacagccuucucuauccucccuaggguugcccccagagcagacuguggcugcaccuaucaacuccggguacagcuggccucugcggacuacauugucuuggccucuuuugagccuccaccugugacauuccaacaguggaaugaugccaaauggcaagaggugagacccugccugcuuguccugccacucacucuucccagggugggguccuagggaggagggacaagugcucugcaguuccgagcgguccuccccauggcaagucuuaauggucuccucuucucuccucuccagauuucccacaccuucucugauuacccuccagguguccgucacauccuuuuucaacacgggggccaggacacucaguucuggaaaggcugguacggcccccgugucaccaacagcagcaucauuaucagccacaggacagccaagaacccucccccugccagaacucuaccggaagaaacuguaguaaucggaaggagacggcgagcuucggacuccaacacucaugaggguuucuucuggcaagggcuauggcaaaggcuaaggcguuagugggcagucaggcucccagucccaugagcacuugcccuauacaaccuugggcaagcccaucaacucaguagugauaguuggcacccacagcucugacauuuuguuguaauaaauguuuucaguaaccc

SEQ ID NO: 2267 - RNA, 3084 nt, Mus musculus
aguaaccuccagcgucugacguguggaacaagacgugauguacacacguacauuaaaggucaagaccaaacaugaaacaggucaaggguucagugcuucgguugagucacagcaaagaugauggaacucguugccaucuggauguagcuauaagcugugcuaguguucaaauccauucugcaguaaaaggggggucuccuggggucccuguaacacaaugagagggacuguugccaaagacuguuuucucugauauccaccagccaguuugaguuccuccacccuaagcuauucaguguuagucugauggagccuacuccccaccuccugucgcugguccagaauccccaacccuaucaccaucagcuggucuagagagaagcagacugcagaaggagguugcccauugccauggaaaccaaggccagagcccagcacccugcagcuuccgggcacauaccagaugugcuacuucugagucucaaguuccuauacauccuccuacccaguagguguacacacacacacacacacacacacacacacacacacgcugccagcuggcugaccuagaggacuagcagccaacacacugggcagcccucagaauccaagauucuccagcugguggaagacuagcucucugggcagaaaagccaaucccuguagucaaaaacaacaaaagaaaaucuugcucuuaaacgucugagacaagcgagcaagcauaaaccuuggcugucaugcugacaaagcaaaccaccuagaccccuguauagucugcauaucaacccuacgccaguagaagcacuggcccuuuaagagacaaaugagucuuccagcccccaaccaggugagcagucaguggguacuguaggauauucauaggccucuccauaucaccaagauuacgagucuguuacaaaugggaagcgaugauguccccagaggagcaaucuggccuccaucaccuucaccacugauccaauguaggucaccaaaaauagacaaaugggacauuacaugccccgcuggauaaugcugcaacagggacaugacauccccuauuuaguauucacagccgaaagcguuugaacugaaccgaaucaggaggaaacaaucagacccauucaggucgcuggcauuuuacaagacaucagaugcggaaucuucaaaaugccaauuacaagaaggacaagaagccuagaucacagcagaccaaagggacagacggucuaaugcgauguguggucacagaacuacucagaucaaugggaccuugcguuucaggaugcucgcccaggagcagccucucaucucuggagcaugcugggcacuuccuuuccuguaaggcugacgugagaaugacauguagaaaaggcugaagcugcccacgaccucccccggcccagcugggagccaucauacugaugggugauugcugggaacuccagugacagcaauaauggacaagcagagcuauaaggcugagccuugaguagcaagggugucuguugccgcguggggcaugcaggcaaagcugccaaaggacuaauaagacuggggagauggggcucaggcaggagcuggcaaggagaggccagaaaaucauaauggcuuggagccccucaccagcacauggacauuggauaucuacaguaucaggcgccacuaccccaaaucacaaacggccaucaucccccaccacucccaucaucugacuucccaaaguucaucaggacuucccccuaaaguucagucaccuccauauucuccuugccccaugccagccagguuacccaggagaaauaaacuagaagagagauucaaaauuuaaucaaaaguagcaacaacaaaccgugcguggagaucggggagcaauugaguugcaggaacacaaugaagaucggugccagcugaaaccccugagaugcugggagagcaggagagggcagagccagaggggagaaaagggggagaagcagaggagaagacagcuggcuucccccagucaccagaggggaggacaggcuaugacagaaaagccccagacacccucuuaagcaauccagaagauauuugaucuagccuggagucuggcauuucuucugaaauguaaaugaagucucccuuagucuggagagaucagaggagaaagugagaaucagaaaggggugggaccucaugcauauccucuguuccacgaagguaaggggacugagcucgcugggcagugguggugcaggccuuaaugccagcacuccggagguaaagaucucugugaguucgaggccagccugaucuacaaaugagaauuccagggagaaaagaaacagagaggugagagggggaagaagaggggaaagaaggggaagaagagggggaagaagagaggagagggggaggaggggaggagggggcagggaggaaaggagggggagaagggggaagaggagaacaggaagaagacagagcaaagagcuugagucaucugccugaaaucacacgcagucaaaaauuauuaacuccgaacccccaagcugggcugacguggguaccaacuggaauauaccaucacaguggggucccuucaagcucuugguacuaaggcagggacagggacacuggagaaagagacuccugaagcuacuuauugaacccaacagaugggaacgagcaggugagauggagggacacaggcaggcacagagcaggaggcagagaggggcaugggauggagaccucaccuggaagucuccaugacauuucccaucagcccugugagcccucugcagggacagcacauucucugagaacagcauccuaugacuggcugguggagggcuggagagauggcucaguggcucagaacccugcucacucuuccagaggaccuacauuugauucccagaaaccacacaauggcucuaacuccaguacuagaggaucuaacgcccuuaaacacaaggcacacacaggaugaacacccauccacguaaaauagaaaauaaaauauuuuuaaaaggugaccuaccaguaaaaugaaccgagugguuucauccuucaugggagccucagaccaccagg

SEQ ID NO: 2268 - RNA, 46584 nt, Mus musculus
cgaguuuccgggccggccuccugaggccgacgcacaagauggcggcgccguccgcccgauagggguugcgggcugaggcggguuauugaguuguggcacgggggaagcgaccccagacaggcuucgcucaggugacaggugggcgggcagcgccgcuggccccguggcggugcauggccugguugcugucuucaguuuuccccgccucccaaacccugaccgggggcggaaccagagaaaggucaggccaggcugucccgccugucuccguccuggggcgguccccuugaguggcucacuuuuagaauugacuuuagccacguguagcuuccauggcugcgguacaggccccgggggagaagauuaauauccuggcaggagagacagccaaggucggggacccgcagaagaacgaauggcccgagcaggacaggcuucccgaacgauccuggaggcacaagugcgccuccuacguguuggcccugaggcccuggagcuucagugccucacucaccccuguggcccugggcagugccuuggccuacaggucucaggguguccuggaucccaggcuguuguuggguugugcaguggcuguccuggcuguacacggggccggcaauuuggucaacacauacuaugacuuuuccaagggcauugaccacaaaaagagugaugacagaacuuugguggacagaauucuggagccccaggauguuguucgauuuggagucuuccucuacaccuugggcugcgucugugcugcuugccucuacuaccuguccgcucugaaauuggaacacuuggcucucaucuacuucggaggccugucuggcuccuuucucuacacaggagguaagaauuggccuguuuccugcucuaaggucccaguugccuaaacuggaaacugcuaccuuccauaggaaugguagacgugucaaagacgccuuacuaaaguaggccacuugacuggaaauccaaaauguguguaucguggauacuuugaaaccuuaaguugugaaaauacugguuuggcaguggauuaugaacacugcucccccgauggagacauggcuuagccuuuaagaucucuuacugugggcuggagaccccccuacaguuggcuuagugguuaagagcacaggcugcucuuccacagguccugaguucaauucccagcaaccacaugguggcucacagccaucuguaaugggaucugauucccucuucuggcaugcaggcuuacagugcaaacagagcauucauguacauaaaauacagaaauaaauaaauguucauacuuaccuggcaagggagaugccaugaucucaaaggugguuuuccuggccaagacuucucuauuguacuccaauaugcugaccccugugauuuccccaaaggugggaaacucaacugcacuauauauaaaacugcuuuuauagaggacccauguucuguucccagcacccauguugggugccugacaaacauauuuaacuucagcuucaugagauccaacacccccuuggagccccaguuggcaucagcacacaugugcacacacauaucaauaaaauuuuaagcugggcaguaguggcgcacgccuuuaaucccagcacuugggaggcagagacaggcagauuucugaguucgaggccagccuggucuacagagugaguuccaggacagccagggcuauacagagaaacccugucucgaaaaaccaaaccaaaccaaacaaacaaacaaaaagcauagaaugggcuagcaaaauagcucaacagauaauggccgauaccacagagccugaugaccugagcuuaaucuccaggauucauaagguagaaggagagaaccaacuuccaaaaguuguccucaaaagucuuuuacacacaugcuugcacucaaaaaaaacaaaacacaacaaaacaaaaagucaauguguaauaagaauguaagccauuaucuuuuggaaccauugugagucugguucuucauuaacugaagugcgaugcaggucacagugaguguaagaggugguaagugccguggcgcgggacagagaaggggcccugaugacugcuuuaagucguuuggcuggcauucggcucacugaagagguuauaccugaguuagacugaaggcagugagagauggaacuggucauguggaugucugggaauagaacuccaggggacaggaacagcaagggccaaagugccugugugauagaaagaaauucauugugugcacgggggggggggggggggagucauccaggggguaaaggaagagaggaaguaguguccgggcaucagugggaaggcuugcggacucuauaggcccuuugggcucaugagcuucuuuacucugaagugcaggagucauugcaagguuuugaacagcaguaugaagucaugaucugggaauagaugcacugggaauagauaauaagcacgguggacaaggguggaaaagcagagacccaagucagaggcccaugagcaguucaggcaagagguuugguggcuugcuucacgguaguggccagagaggugaauuacguucugaauggacuuuggagguagacaguguuugccaguggacuggaucuuagguagagauaccacagaauuaagcuugacucaaagucuggccgaagccacuggaaggcacaguugacaucaugccacacgggaaaagggcaggggcuuuggagggaagucaggagguggacucuggacaucuuaaugugugcuagagcuccaaguggagaugugagguggguaguuagauaaagcagcucagguuauggaggaggccuggcuauagagacagauauuuggaagucauuggccuauagauaaaguagggcuggugagaugguuagagagaguauugguagaagcacaggaccaguuaugggcucuguagcccuccagccuaagaggagggaagaugagaccacauaaaggagacugaaggagugggaagaaaaucaagagacuguaguuguccaacagcgagguguaagguuagggcaauuaaaaaggucugaggccgcugggcggugguagugcacaccuuuaacccuagcucuugggagacagagacaggcggaucuugaguuugaggcuagccuugucuacacagugaguuccagcagaggcuggguggauauggugguccacaccuguaauaccugcaugguagagggaagcaggaaguuucacauaagucucacacacacacacacacacacacacacacacacacacacacauacacacacgcacuugggaauaaccuuagcuacagagugagguucugccucaaaagaaagaaaguuaagggagcccuguagguggcuguucgaggaaguacaaggcucuggggaaagaagagccccuggguuuguccacuuuccauagcugugucagaccugaguuaaucggcaagggaaagcuugcuuagcauagaggcuuccgguuuacguuaauuggccuguggcaugguacacauggccaggacccauaccugaggaagucugggucugggagccaauagaggaagaggaauaggcuugauccaagucccgugcuucuucaaguacacacccccacgugacuggaagacccccuacuauggcuccacucuuaagcauucuaccacuguggcgcaugccuuuaauccuaguacucaggaggcaggggcaggcagauuucugaguucgaggccagccuggucuacaaagugaguuccaggucagccaggucuauacagagaaacccugccucaaaaaacgaacaaaaagaagaaggagcaggagcaggaggaggaggagcaggagaaagcagaggaagaagaagaggaggaggaagaggaaagaggaggaggaggaggaaagaagaaagaagaaaagaaagaaauaauucuaccacuaucugggugugguggcacaugccuucaauccuaacacuccaguggcagguggaucucuguaaguucaaggccagcuugucuacagagcuaguucuaggauagccaagacuacaaaaagaaacccugccuugaaccacccuccccuccagucuuuuuuuuuuuuuuuaauaaauaaaauuuaaaaauucuaccacuggucuggagagaugguggagagauggcuuggcaguuagaguacucguugcucuucuagaggacucagguuugauucccagcaccaccacaucaggccacuuacagccucuguaaaucuccagcuccaugggccucccucauccucuugugaucuccacaggugccuguguguguguccauccacucacacagaugcaugcacauaaauguuaaaaauacgacauuccaccagcccaggaucgaacucuccaacgcuugagccuucugaaggaauccuugugugaccuaugaccuuucuccuuguugaguuuacauuuuaaccaagacuugaaggaaacagaacucaccauuguucagaauuagccugauuuaaggaccagcacgugcaaaggucugggguccacagggagaaugcggcucagagggaggacagcagagcuuacaaccagagcagucugcucaucccuuuccaucucucagcuucucccugcuccuuagccuccagagcucagccuuuggucuccuuucucucccauggcuccuuuggugauuauagccaguaucacuuguuaaguggguaauucccaagcucuaggcuuauaaacucuauuucuucagcaggauagaugcuggggacuggacaguuuccagugcucgcucucucucucucucucucucucucucucucucucucucucucucucucucucucucucucucucucucucucucuccucagguacagcaugguacagcauggcgagugugugccuuaccugugaacugcacauccagcucuuaggcacuccuagaucaugucugcagucaaauuccuggucaucucuccaaagauacccuuuuuaccuguggauuuucucauuuuacucagugccauuauuuuccuccucuuuauuuguguguguguguguguguguguguguguguguguguguguguguguguacaggucuccucacuugcuaggcagugugugugugaguguguguguauacaguucccgucacaugccuaggcaggcaggcucuccacuguugagcagcaucccuagcccacucauaguuccuuccuuccagcucuucaagcacaaagucaugaguaugcuuacuaacguuuagggguuguuguuuguuuauuuguuuuguuuuugagacagagcugcucuguggagccauggcuauccuggaacuugcuuuucaaaccaggauggucuugaacucacagagaucugauugccucugccuucaauugcuggacuaagagauugcaccacuaugcuggcuggucucuuccuuuuuuuuuuuuuuuuuuuuucccgagacaagguuucucuauguagcccuggcugucccagaacucacuuuguagaccaggcuggccucgaacucagaaaucugccugucucugccuuccaagugcuggguuaaaggugugcaccaccacuucuagccucagugugaguucuugagucugccuucucuugcccugugugauguuuuugaagcucaccguguugucgugcaugucaggagcugauuuuuauuguugaacagcgucuguugaggggcaugccacacuuuuguucugcucaccuguucagggaccuuuggguuguaucuguuuuuucuauugugacugaacauucauguucaagucuuuuuaugaguauuugauuucauuucuccugaguaaaugccuggaaauggaacuguuguggccuccgcugggugacguuuaauucuacaaagagcugccagccccuucagaaguaccuacaccgcuucuaccacagccacgggagauuggugguggcucugcacauucgccagcuuccuccaugaguuagccucuuuguguguggccagaaacucgugauccuccugccucugucuuucaaaugcuaguauuacaggcaugcacuaccacuuggcccuugccaacuuuuugauguaggucuuaacagauucauucuggcugcucuguggaaaauggacccgguuuucacugugcuaucucuuucagaacaugguguugcaaagggugagaaugcuuaaaaagagacucccacgcaggucacaucucugagucaggaggcaccuacagucuuaggccaugucucccacacugagaaagugcucuuuccaaaggcucagucauuguauugcaucagauaaagucaagguuaucagaccuuucucauuccuugaguggguuugugcuugguuuuaguggaggaccuccuuaaggucaagacacaggguuguguuguauugugcuguguuuugaagcucaaguaacacuuacauuagagucagagauaaagacaacaggagaagcaagcuguaaaccuagcugcugggaggagggagaugaagaacagaaggggggaggucaugccuuuugaaauacagguaggacaacagccuugugguaaaaagugaggggcucuaggcaaggacugagagagccugcagugggcuuuggccaguguucaguaaagagaagaaaaugaaagucagaaagcaugcucauggcugaggcucaugucacuuauuggcugcugagcugagagcuggaucucuggagcauccagcuagagguuaauucuucccuaagcagagcccugucaugguguauaggucgaugagugugagaauagaggagcaucgugcuagccuggccugggaggaugcagggaccaugugcucccuaguucagggcgcuuccuggugcuggggagcugaggaggcaugucaguccugccuuguagggaugcugcauucaaauaaaaaaccaggggcucuuauuuggugccagcagacaccaaggugucucaccaaggugagaggugagguuggccauacuuuaguccuugguucuuguguuuuuuagaucuccugaagaccauugucaccugucauuuuagacugguuaaaaugugaucagauauccugaagcuaagcauuauagcauccuuagauucaaagacuucacagguuucuguagcaaccaaaguuugaaagaucaugucuuuggccagcucccaccacugcacauggcuuuaccuguuccagucugagugggaaguacucuugaguuagaaguguuuguuacuguggcucuguguucaggucagccccagggccaaguacuggggagccagcuaugacaagccagaugcugggacuuugaauccaaagacauaggguuguugacaguuugaguguguguugggagaaaagguaaacccggaguuuuaaagaugcugggauagggugagagguucuuacaagaucaaaagccaccaggaggguguggcaguauuccagaguaagaugagccugauuuggaccuggauggaaggcagugagaugugguacaguacuggggcuggagggagggugcuaaaggaagggacuagguaggcuuuggcgcagagggucgcuaggggugauuugguuuugacugaugagacccucggaggguacacugcaugguaacuuccacuguuuuccucuuuacgugggugacagcuucuuuccauggaaguuauaggcugugaaaugccaugguguuucacuggggucuuucaaaccagaaaaaagacacagaaaaaagacccaggggcgguggggaagggggggcgggcaggagaggaggcaagcuguacauuuugccuugcagggcuggagaagggcagaagaaaucaaugcucuggaccauagaaccuuuugcauguucuuggcuccucucaucucuguguacccggagcucugggcacuguguggcugaaacuuuuuuuugggacaaauccuaaaaggcaaacuuggcggguaccuggcaguuggacucagaaaucugagucugcauugggucguuugggggugcuccagugacggcucacccucguagccucucuucagacaugguauucucuuggaccagcccuugauuuacaccgccucucuggcuuuucuggccgcaggaauuggauucaaguauguggcccugggagaccucgucauccucaucacuuucggcccgcuggcugugauguuugccuacgcuguccaggugggaucccuggccaucuucccucuaaucuacgccaucccucuggcccucagcacggaggccauucuccauuccaacaacaccagggacauggaaucugaccgagaggcuggcaucgucacgcuggccauccucauugggcccaccuucuccuauguccucuauaacacacugcucuuugugcccuaccuaaucuuuaccauccuggccacgcacugcagcaucagccuggcacugccccugcucaccauccccauggccuucucccuugagaggcaguuccgcagccaggccuucaacaagcugccccagaggacagccaagcucaaccuccugcuggggcuuuucuaugucuuuggcaucauccuggcaccagcaggcagccugcccagacucugaggagaccagcaacucccaccacagcacagccccuccucaggcagugcagaagccagagacugagaaggggugccacuggccagggugggugcacagcauaggcugcaaacuccugaacuuguguguugggauuaucuuccuaaagauaaccugcucgugauuuguguuccauguuacagggaaacccugaagccacucuagugucguuccuguguuauuuauaaucuccacuagagggugucaucaggccacuuuaggauggaaaguccaucucccccuuguccuagacagaaugcccugacaguuugugaaggagcugugucccaaaagagccauaguaacuaggcaugguacugacccguuaccuuggcacguaggaaauuguacuaauuggugccaggccccauuuauacagagcgcuuguccccugaaugugcugccugcuagagaagggcccucauuagcaaggagugcuccuggcuuuuuguguaguuggugguucagauguuucuguccuuuaugucucccuucgauccucgccacuguggaggaaagugucagaucacccuguagcaagacaguuaagccuggggcggcugagaaaagcacucugcuuucaguaaaacauggcaugguggcugagggagcugcuucccucuguagacuccacuaggaaggcagugauucugggaccugaaguggcagugggaugggcguuuaaagcccaaagggcuuuguccccucccagcugccuccccugguauuccucuugccuacccaggaucucugucccuccgucuguuuccagugccagacugugggcaacagcaacacaugagucaaggacacuuaccccucuccacagagccacaagaugggcaaaucagggaccuucugaauguaugagucaguggacagcaguccuggccacacucagcuggaaugugaggcccugccagagaaagaacuaugagcacggguccuucaucucucugugcucugaugccuuguucagaauguggcuucagugaggucacacccaaaggaccagaggugucucgcugucuucuguacccucucugaguauaacaucuugcauggagaugaucauaccaucuccagugugcuuuacucugaucagcugcccugaagggggcugcaggcucuuagccugcagaaaaccaccuugaguuagcacugggucacuuccuuaggaaaacauauuuaaauauugcccagaguuccucuguagucagggugguuugucuaccagagucccagagcuugaaucaggguccagaauccuaggaacaggauguucuuuccuguucuccccagcgugcuggguuuguacgucuggugcuuuugaguguccugccugugacccuagcuuggggcugauaguugucacccagagccuggaggaccaaugacucucacuguucauaaggcgggccugacacguggcuacccucaucagaacugugucagcugcuacacugagcucuggugcagauuuuaaaugccuauuuuuauauaccauccccagaggccauauuuggugccacauuuuguauacagaccaccauaauuuguauuaugucuccugauucaaugaagguuuccuguagauuugcuaauuaaaauaagagaaaacguaugucaguggcuuuguuucuuugcuuuccacuugcuuuucuuacuggaaaugugcagagacuugugggaguaccaggcaugguaguguacgauuuucauuuccagcacugggagucagguugguggaucucaggagugugaggccagcuagagauacacagugagaccucgucuccaaagcaacauguuauugcacuaaccaggacuuagggagaagugccauaugguagaggucaccucauuaccagugaugaauuugggaacaguuugaccaggguugaugguuuugugacaucuugccauaaguuugacucaccagaagggagccucaauugagaaaaugcucccauaggccugagcuguaggcaagcccauagggaagcuuuuaaaguuggugauugaugcggaagggcccagcccauugugggcggggccagcccugggcugagaaagccacaaggagcaagcaagccaguaagcugcagagcagcccuccacagccucugucugcaucagcucccgccuccagguccugcccuguuucccaaagauaaacaacaaugaggaaguauaagucaaggaacucucuuccucacuaaguugcuuuggacgcgguguuuccucacagcauugguaaccccaccuaggagaggggccauuaggaaaggugucagggaccacugagagccagcuggccagaccacguuaaccucauuucccucuauccuccccugcuuacguuuuucuucugcuaggucaccgugcugauggauuaggagcauguaguagauggagugcacuuacgucuuggcuaggcauuugacgauauauccuuaugaacgaggcagagauacgugcaguggauaucacuguacuuagauaaauuccugaggccgaacgcacccgcgggggagagagcugacggaucagcaugucagcagcacagggaaggcagccuucagcagcacauucgaacaagccccguccuuugcccucugcccuuugcccagcgagacucaacaccuguuauuaacaacuggacuaaggcagcccaaauugaagcucucgggaaccacggaggaagagcuucuaggaggacugauaauuaggacgcucgugaauuagagagcugcuuucacaggucaagggagaaugcgagcgugaguaaaugcagagcgauagauacacucaggccucucucccagaauccggccugugauugagaaggaggugcccugugacggggggggggggggggagcagauguggcucgguuuuagaauggcucuaggcuacauggucacacaccuuuaccacuugagucagauuuauucugcucacagagcggguagcagggaauccaauuccaggccccucgggaucuucgccugccuguaggguugcucacuggggauuccucagucucggggggggggggugaguggggaacagaagucagggauuuuagcuaggucuucaguccuuaccaguuguaagguugccucucugcuaucugaugcugggguucaggccuggaauucacccugaaccuugaaggguucagaaugcucccaccgacaggcaccaugggcccgugggggaugcugguuccugcccccuauuuucuacucagucaacuguucuuuucuguggucucccuguucaccucugcugcucaaaccugcccuccuuccauacguuugcugaacccucacacagggccccaccuagaagaccuuggaagcucggggcuggccugcuguggaggggaacgaaccaugaacccaccauaugccaucuuacuuccuguguuaauaaccaaccacacucacacuggaaccuagcccuaaccucagacuaagacaguaaugaccuuggugaagguugccaugcuacaggagauacacaggaaagagauuacaguucagaacaaggaggcagaagcccuggccauucuucacgggcuggacuugaacuuggacaccuuguuugccuuggagagacucuguguggagacagaggacuuagguuucagaaguaccuuugacagcauaugaaauguagaaugaauggagauauaguuagaagccagcaacauuucuaagugugugcacccacacauaugcguguguguguguguguguuacauggguaacagcuguagcagacauuuuauagguucucaaugugggaaccauauuuugaaggugauauuaacaaaccggaucuugccccagaugcauuuggaagaaagaugaaggcacacaagaccacacuggccuggaaaggagacccaagagaguugucuuggggaagaaggacugggccaggcaugugguauucaaagagcaaaaccaggacgugcagauaggaguugcaugacccgauguaacagcucuuguguuaaagaaaccucuguagcugugaguggaaacagaaguuggaguguucggagcaucaacauggggggugaguuugucguaacuaaagagaaaagcugguuccuuggcaagaacgcugaagcaaagagucacaccacagagagguugacggagacaacugggcagcccuggagucuucucacccugugauuuggcugguucugauaaagaguugcucuauggaccugcccgugaggguuggaaccagaggguacaagaaacaugucgacaguucagcuucuaagugucaucacagcugcgacgacugauacccucuucccauuuuguuugccuuccaaaaauuacauacagaugcacacccagacacaucccgugcaguugacuucacccucaauggcccuggaagggagguggcugacagcuguucuccucugugcccacugcuaauggacugucagccucuuucauuacuggcuacagaccacgaaggcugguguaagagugccucuggcgagaccuggacucuugugguagccagcugacacuugugaucugccaggacagcagaggguggugaagcccagugaggcccugccugggggccuggcaaucacuggacccaggcggagcucaucagcaggggccggcagcuguaacugugagaugcucuccuacuucccaagauguagaagcacuagaggagccagggaacgucuuggucacaugcuccugaccaaacugugugugugguggguaacaggaaauugcucugggcucugugguaauuaaggcaugccccaaaguccgcacuccaugcucccgccauacccuugcuucuguauuucccaccacagcuuagaaucgccaccacaguuagagcuagagucauggauaacaagacagcuccaguguguguucuguguccguuuguuagcguguuuagugucagugucccccaacagguggcugguagacaggcaaguaagacuguauuucagcaccugcccagcacuagcacaacugaccacaguguguuucaacaacuggccauggagcacaggcuugcgaguggcuagacccuaugggacagguuuacugaccacacugacaugcguaccacauagcuggcugacccgcagcaguaaggacaggugaauuccacccaggguuggaaguggaaggggaaaaugacaguaacucugaagaucucuuaaggucuagcucauguuuccggaaaccuguaaauaauuaagguguuggauaaaugacugagggaaugucggggauaacgauggcauuuauugcaagcucccugugugccaagccuuguucuggagcuuacauauauuguuuuaauguuccuaacagcuccaugaauagguuauugagggcuauuuuuucaugagacaaagacuagaguaaagggagaagauuaauuguccaagucacccaucauucaaaccuuagucugugcccaugugaauucucucccacggccucuuguccugucuccgcuuaccucacagugucuugcucacaugaggacuccagccacggguucguccuugcugagugugaggugugaggaagguaucguaggacugauggguggccgaggccauggagggcuggacucccacguguccuucccauggccacaaugcuaugaaguuucccuaaugugggagugacugggccagcaccugcaggccaagaagguagcuccccucagcgugagccagccaccuuccucagggcauuccaagauaggcaagaggcggcccgagaccauguggaagagaugaggagagaggaaacaccagggccccuuaggagcugccucccgucucaagacuggccuauagcguuucugucuucaaagugagguccucugccuugggccuccaguugcucaauggugagaggagagguaagucuacauuacuguggaggugggaaugggaucaagguuucaagucagagccugccaggcuuugaugacugcucaagucagcuggaaaggaagacccauucucaaguuaaaugugggcucacgcccacccgucccucccucccuccaucugccaucuuuucucaccuggccacugaaacagagggucccuagaaacaguccagaugcuuugccugguaagaaugcaaccagccaccagggggcgucggagagaaacuccaguccaccuucacagggaucaggcucugcuugacuugugagaguuccuuggguauaggcagugaggagagaggccccuuugggugagugugcuucuauuagggaaaggggauggacaaagucagccauggaacagcaagaaguguagcucgcugagggcggagaucagcugcagauuggagccaaucaggaggggcuucugggaggagaugacaauggacugagcucaggguucuuaggagaaguuagccaggagaggugcuggugacguggccuaccuguccucacagcuggagggucgucgccaccccccucaccccccgcccugccugcugcugagaccauccagggcacuuuuccuucagucucuucuggucacauagccagacgacuguagcguugaggcagaugugccaaaggugcccuucucagugccaaggucaaagccgacugaggagugacugauaccuugcugagaaacagucagaaggagacgguagcacauuuaaucagcccaggcugccggugcuaaauccagaugaauggccuugaacgaugaggcccaaggagagcauugccagaagcaagcuccugagccugcaucuaccgaggacgagggcuucaucccugcugucccuggcuuucugcuacuuuguuaggccucucgaaugguugcuauacgcuggcaucaacacucaguucucuguagcaaccaaggacaaccuauucagagccuuucuuacagaagagagccaagcuuauucuggggcccgcuaggagcaauggcggguagagaggcugccugaccugcagagggccuucugguggguaccuccuagguucaaggccacaucuuggaguacagucugaguucaacaaggcaaggcuaucuguagaacgcccaaguccguuuuaccaaaguuguuagcauuucuuuaaccaugcaugugcauauguacagauagaucugugagaccauuuggaugugcacgucccccucacucuguacugggacagugucccagguauucagaaagcaucacaaauucuuggcacccggugcaaugagcuccaccuuguagaacaaucucaauuaccagauaagcagucuccacgcugcucuggggaggaugaaaagaaaccacaggggcugugagcaaaugauagcccagagcagcuccaggcagaggcaagggggauacaguuguucuuuagccugucaguucagggcugcgccuggcugaaugcaaggccuggcugcucugcugagaagagucuuuccucccugaagagaaacugcagcaggagaaggaugaaggcaaagauaggcaaaucccucaagcggggcagaacccuaagaaucucugccucaggccgugugguagaugccguggagcuaugaggaaagccccugccuccucaggaggaccugucuccuagaggaagcuaggccccacucugggacccuacugccggcucccggaguugggggcauggaccucucuuguugguaaagcaguaguggccugucacaugacccagucaugagagccacgguagccaggauuugggagaacacuugggucucucaccgaguccccuuguguccugaguugauuauggaauuugagucgagauauucugagggaucaggcgauucugucaaggucauuuagccaccauugggggccccacguaaaagcugguuuucuccuggaccccaaauucagcacuuccgggguuaaagccauccucuaugucacugcuccgcucucuuuugaaggcaggagaggaggcauuguuugguuuuuaaauauaaaucucauuuuucgcuuuacacguugaaagagccacagcugccucuuuugccauuaucccucccaguccccacccccuucaucuccccucuccucccuaacccuguccccaguuccccucagcacaccuuugcucucuggcacccaggcagcuucccaagcuagcugcucuggguguuagaggacaggaggcagagucagggcauaggaacccacgagagaaggggugggggcuucucuuugagagauggaugauuuaguagucacuggcuuuauguggcugcccagcaagucaccucagccaucucugagaucuggagccagcuuuagacugcagcagccauggguggagacacccaugggagugagugcaugcugacacaucucacccucuggcucucaauucuucuacccugucaccuggauuggguccauacaagcugauugucacauuugagcaacgccaugacccaguuuccuaaugaggagagugaggcucuuccagcaggguuaguaccuugcugacugugcccucagauucagaacccaagagcacagcaccagugacagagcugggcuuuggaacugggccuuuaacuccuugcccagugcucuucccacucugcucgguggcaugggccagcaucucuucuguauacugucauagccuccagaaggcuggaggggccccccaggacucgucugaaaccagggaucagcuccaaacacagccaagaggccaacaugcucugccucacaaggcaacaguggcuugagauggcuccccgggcgaagauaggcgccaacaagcgaggagccaccgauugcaccgauugggagauaaucucccugagaaaugauggggaccaguugcuuuggcagcugcagggcugcaucugagccccagugcugguguguguguguguaccacccccagauccacaccgcuauuggcuuguugcagaaacagauguucucaauucucuuugucccuaauaggcacuuaaaugcuggagggggagccagcaauggggacagaaaucaugugacuauuucaggcuuuuuuuuuuuuuuaaagauuauuuauuauuaauccaaguacacuguagcugucuucagauacaccagaagagggcaucagaucccauuacggaugguugugagccaccaugugguugcugggauuugaacuuaggaccuuuggaagaacaguuggugcucuuaaccacugagccaucuguccagccccuauuucaggcuuuuucuggaaggguaggcuucugcaagacuuggggucugggagugggugugucagaggaucagcccccacccugagugcuucugggaaaauccugggaaagcuaccauaguaacagugggcauugggugcugaggacaacuucuuagaggagcugccuucaaccugucaucgggacuggccccaaagcugaagucacagggagggaaugcugggacuucuggccuccugccucccagacucgagaggauuggaaggggucaagggcuggugagacugaugucuuuuguuccauucucacuugauccuuaccugucuguccauccaucuagugugcacacaucacccaugcaucuacugagaacauccaguaucuggcagcagcaugcagguuugcagguaaaacauuucccgaaaaaggcuuugcaccccuuuugccugcugagccauggccaugauuuaaugggagcuuggagccuuuccugccccugaacagcucugcaucaaccugccucagugcccugagcuccacaauccaucagccuugagaauggaagguaccccauuucccagagguccaugcuaagauacuggcaugcaaccgaggagauucucaaagagaaaaaacaaaaaacaaaaaaccacuaccacugugucacgguagagagcagagggucaggccuggacacucagugaacagguuccggugggagaaaaacgagaagcauccaccccauagauguugcuuugggagggaagaucugaggaugucccaggagcaauggggacuuacaggggugggaggagagggguaucucguggggugacccaaagcaugacccacgcauuauuggaugguuugcuuuuugccuggagacccucgagguaagcagagaccugucuaagaacaauccagcacaagggagaguugggggaagauuuuuauuaugcucuacugaccugcaaaagugggaugcucagaaauggaccgaccucugucaccacaagcccugccccugcagaugucaauggggcagaguaacaggggcagaggcugcagcuguuugguuaccuuccagaccccugcagccugcacugucuguugucuuccccaccgggcagaggacugguuacagaugagcucaggccccacuaggggcugccaagggcagaaaguaaccugguccaccaggacaguuuuuauuuuguuuugcuucaagauaggagcucacaguguagcucuagcuggcuagaucuagaaacauagcucagguugauugcucuugaacuuucagcaauccuccugccucuguuuccagagaacugggaugacaggugcaaccauaccuggccaguuugcaaaagaaccuagucacugggccgggggcugggagacucuguuccucugugucccucaucugauggauguuaggaagguaauuaacugacuggggagguguccaacaggcagagacacccuugguaaccccugacuacuuaauauucagagcccauguuacccucucauagcagagaguuucugguggugguggggggagaaaucccauugugaaguacauuaaaauucaccuuaaaugauuuccauaaagacaauuauuauuaucggugauaauucucaguggcugccuggucuacuaagugccagacuuguagugggggcuggggauguuacggcgguaacugcagccugugccuccaaucccuguggccuauacucuuuaucuugcuccgggaagcacugaggaguucuguccagcaucccuggaagccuccuggacccuguccugguguccccuccaguaacacagcguuagacaggaacgcagcgauggauaacauguuccuaacucccaagagacacgggguugaaugaagaacaccgucuaggagaaaauuugagaaaagcagccagaagcucucaaaggcuggaugacuuugucagcucucuccccuuccccccaccaacucuuccgcucacuccccuggcuccuugcuuggguaguguaagcuuuacuuacugcagugcuguggauugaacccaggaccucaaacauagaaggcggaugcucuaccacugaacuauguucccagcccauuuuggucagagaugggcauaugaaaacuuaagauuacagagcucugggaagcuugacaggucagguacaucccuggccccagacaggauucugcuccaacggcccagcacagucaaugucuuaacagcagccugugucuggagucugggucucuggccucugaaggcacauuccuacucagaacuaauccauaguauuagaaguuaggacagcaguugcuccuguuggggaaauaagaaggggacaccugugggcacugacuaaauaggcauauuugcuugucaugaaggggacaauuaaaaugugaguguccuacuggaagaaugggaccccuucaugcaaaaguuuuccccagcacccuuaaagguagcuguucuugcucgaguagcuguggaauuauaccugcucugucagggcaggguggcccagggagcagaaaggcucauaauucccaguggcuucccagugggaugugggacugguuuuccuuuuggggcaggcuguggcucuacagcuguggcaggguuccaggucuccacucuucuuccucugcugggacccagauguguuccuccucccccacugcacgcgcgcgcgcgcacacacauacacacacacacacacacacacacacacacacacacacacacacacauacacacacacacacacacacacauacacacacucacacacacacacacacacacacacacacacacacacacacacacauacacacacaggugcucuaugucacuguguagcccuggcuggccuggaacuuaccauguacaccaggcuggcuuugaacuccuaguuguuccuaaaggccugugucaccacucccagccacagagugcuuuuguuugggaaggauuugauuuugacaguaugugugcucuccuaauguuaaaguucccuggcaacuucugagcccguacuucucagcuuuggaggugacauggcccuggugcauucugcgcagcaaggaagucauacgggaaugaggacagagcacaguugucuccgucacugcccaccaucacugcucagauuccuucagugugcauuucucuccuucugaugccagacuaagguucucuagagaaacagagcugaugggaaaguauaugguauuuauuagaaugucuuacaggcuguggccuagcuagcccaucaaugucuguuuaccaacagaagguccaaggauccaguaacuguccaguccaugaggcugaguaucucaggaggucuucaguguaugcuagaauccugaagacauaggcuccggugccaauugccuuucuucacauccagagcuugaguugucugucuucugccuucugugcccuuuauaucagcugccacagaagguguggaccagaccagaggugcagcuucccaccucagaagaucuggauuaagagugggucuuucuaccaacucggcuaccauccaggcucagaucccgggcuuugagucaacccauccugacaccuacccugucuguggccugcuggugcuugugaagggauuggcuuugcagaaccaaccgaaccugcaggauuuccaagacacagggcaacaacaggauauucgaaacaucuugagaaagacccaguguugaucucguagcagcaggagaggccucagaccagaccaauggcgcacugcaaucagcauuuacaagugaagcuguuuagacaaaagagucuacacugugggacacaccgcaacugacacaccacagcguccacagagagauggguuuuguuuuuguuuuucuuuguguggggagguugcaaggguggaggguggauguggagggaaggggagaugggugggauugauaugcauugagugaaauucacaaagaaucaauuaaaaaguuuaaaaaugcaaaaaggugggucuucccaccucaaauauuuaauuaaggaaaaaauaccuaaaaaaaaaauuaguaauugaacugggugaugguggugcacaccuuuaauuccagcauuugggaggcagaggcaggaggaucucugaguuugaggccagccugaucuacagagugaguuccaggacagccagggcuacacagagaaacccugucuugaaaaacgaaaaggaaagaaaggaagaaagaaagaaagaaaagaaggaagaaagaaagaaagaaagaaagaaagaaagaaagaaagaaagaaagaaagaaagaaagaaaggaagaaagaaaggaaggaagaaaggaaggaagaaaggaagaaaggaagaaaggaagaaaggaagaaaggaagaaaggaaggaagagaaaagaccucacaggaguuuuuaguuaauuccagauguggucaagcuggugcccaggaauagcuaccacaucucagugugaggauccaaaggaaacuugaggugauagggcuccagacucugaccccaggccaguucccaugaugcuacauuagaauagaugccccgagcugagcauggugguacacgccuuuaaucccagcacucuggaggcagaggcaggcagauuucugaguucgaggccagccuggucuacaaaaugaguuccgggacagccagggauauacagagaaacccugucucaaaaaacaaaacaaacaaacaaaaacagaugccccagcuacaccccuguuccagguccuucgccauucuuucaaucuuaaaauuguuuagugugugugugugugugugugugcacaugugugagccaugccaugcauguggacuugggucucuaaugugggcacuggguaucggaccuggguccuuaggcuugguggcaagcaccuucacucauggagccaucuugccagcucuugucaucgucacucuucuuauccagagcuugagucgccuuccgauguggugaaccuggaucgggcuuuuggcucacugacugauaggaaggaugugauguaagaucaugccugggccucagagucccacagcuuccauccugguucucggaacuucuggagccaggcacauaacggacuguucaauccucucuaaggaagaguggcugcgugaagcagaguuucugugccacucagaagaugccagcagcaaacaccacaggagugaaugaggcaggcaugcgagcuuaccaugucccagccgugagcucugucuguagccacacugagagcgcagcucacaggcugugagagagcaaaugaacagugggcauccuaagccgauaaaccuuggauugcuuguuuacacagcaauucauaauccacacagucacacagccucucccccacucucacacacaaacauacacaccacauacacacacacauacaccacacacacauacaccacacacacacacacaccacauacacacacacauacuccacacacacacacaugcacacacacacacaccacauacacaccacacacacacacacauacauguuugagcgcucacuggccagugccacauuccacuguggaacugcgcccucacaggcuccgcccccucucgcugucuaaaagcuucagaaacaacuuucuucccaagauuugcuccuuuccucgcucucacucguuuccagggcuggcauggcagugcccauugcucuuuauuaguuuaauauacguugaagccuccaaauagaugcuggggcccagguggagcagacgggaugugacuaaguucuggggaugauugauaaugaguaaggacuggaaaaucaauuguguuaauuccuggucugucaccgggaccgagaauuaaugagaaaaucuguccaacuuaaugguauuuacacauuauacagagugugauaaaauugucugcaggugcugccuggcauuccaauuauaccaggacugcacagccaaggggcaggccaggacccagccugggcaucgguagccucccuaggauccuuuaacuuccucccugacuuuggaguaagcuucaagcgcccaggcggaugucacugucauggaugguccccaccaagcaugggcuacccagcuggcauagaaccagggaugagcugaaggguacacuucaggucugcuuuggaggaauaugcgcuaucaccgcaacacaucuaaggggcgaguguagcggcacacauccuuaaucccaaacuccugagaggcagagucaggcauagcucugugaguucaaggccagacagggcuacguggugagaaccuguccccgcagacaaacaacacaccugaaagagugauuuuuuuuagcucauuguuuuaagggacucagcuccuagcacuuggcucuauuggugcuggggcuuggugagcuuggagcauaaugguggcaagcaaguauggaggaagccuuucacuuuaugguggacagguggacagaaaggagagagagagggagagagagagagagagagagggagagagagagagagagagagagguggggagggggucaaacuucaaaggcaugcccacaguggccuucacccuccagcucugucccacugagauuucccucggcuguggcaccaagcauuugacacuugaacucucagagacucuaugagucucgagugaagcugacaauggucaaagagaacuugaucuuacaugcuggcagggcacguggucugggaacacaguccaccugcacccccaguccuguucuccaagagggaguccacaccagcucugucccaccacacacccacaggguggucagucuuggaaaacauguuggcugcuguaaggagagagccugccucaggccccgugccugcuucugugcagcucugcuggaggcgggacagcgagccuucagauguccccauggaaggugacuucaguacugccagcucguguuagggauuccccggcaccauccucucccacaccgaagaagacaauuucaggaaccaaugagauaauacggucgcccagccucucucccuuccacucacucuggggagccucacuguugugcggggaggacccuguugggggaauaaggccucaccaagugccagcaccaaaugggaagccuggaccaugcugccuuaccacaguuccugagcuaaauuguuccccagcuucugaccccccagaaacuggcaaagauaguggugcuuacugcugccgugugggggccacuuuuacacagguagggggugaagcgggcaggcagagccagugugagcacacccugcaguguguacucauggaggcguucccagugcuuccaccugauuaaaaaaauauuuaauauguguguguguguauuuguaugucugucuguaugugugugugugugugugugcauucaugcgugugugaaugaagcuggacgaggucgcaggaugcccgggagcuggaguuacaggugguggugagcucccuugcaugggugcugguuaucaaaacuggguccucugcaagaacaguaaugcauuuuuaagugcuacaccaucccucuagcucccugccaucauuuaaaugcuuuugguuuuauuauuuuaauauuuuuaaggucucucuaugcauguccaucuauggguacaugcauguaagcacaggugccuauggggaccggagaugucaggucuccuggcauuggaguuacagguggcugggggccaccugauguguucauaaagguuuuuuuuaauuaauuuacaaauaacuaguggugguggacaagaaccccacccaccccacagugcuccuguggagaugagggcaucucuguggaguuagcauucucuaucugagggacccugagauugaacucaggcucucaggcuuggcagcaagacccguuacccacugagccaucucgccggcccaucuaccccgauuucugccccagugaaaucccuccuguguuuugcagcuuccugagcagaccacccucccgccucugagccugcagaggugcugcccucccugacugaagcagccuuuccacucugcucccuccauguuuccccaggcccuucccccaccuuuaagacuugacuccccugugcccuccccugggaagguucuuaggacauuucgccaccuuuuuagacacccgaggacccucugauccuuuauggcuacccgagggaugugagcuacacagaguaugaguuacaucaucaacuccauccuucuuaguugcucccgggcacccagaggaugcucaacguagguguacagcaaccuuggggagcaagagggcgucugcaugcaguuucacgcuaaggggcaggagugggcagagccuggugaguaggagacuagggcuuccgugguugaucccuguggucaguuuuggggcuguccaccuagcccccauggucauucuucucaccuaccaccccagagcacccuuggucuggggacaggacaucacuuuggagguuccugugucaguugucagugugucccugucacacuuccuuccugaacccucuucuuccuuguuugaugcuucucugcuugcccagucucugcccuuccucccugaagggcaggggagcaacauucagacaaaugugacuucugaagcagguuuaaaggucuuuucccagagaccccaagcucauuucuucuuucugugucuccaaagugccaaagcagcaauucggauuucaaaugccccgagcaggggugcagcugagcuuuuuauugcacacaaugaauuuguuauguggggauucucuggccuggaagauggcuuaaugaccagcaucucccggcuucccagcccggccgcugcucagaggccagagagccucucugucugcuugcuuuuuggacagaaggcugacgggggucugugagcauuuggggacagagaacucccccgcaggcucgccugcuauggcagucagcucugauuugugaagaaucuugcagacucugagaccucaagacaguuggccaaccaucccauagcaggggagagcagagcuaagguuuccugccaggacuaucugauuuuaaggccuugcucugagccaucagccccaaaugccucagucugugaaugucuaguuugggcauuguauggguaauaauuucucuccuucuuccagccccuagucccuccagaggccucgaagaauuuccacaggauuaacuaaaaauaaaagaaaugaagcccacaguagaggugccuggguccucaacacccccaaguuccucagccuccagaagccagucugaggccuggcagcuccuguuuauccgaucuuccaccuggcacaggcagagggaggggcggcuggcugcucagcuuuaucucucagaacuccucagagcagagcaugugaaaccugugagccagccgaggagaaagagauuaaagacgaaaaggauuagaaucuacagggcuccugcgcucugcggagucucucuccuaucucucuauuagacagugggacagagccagcugcagcgguggcaaggacuucaucccccgauugcccccacccugcccgucuugggccucugagacagcugcacgguuaaggcacagagguggggaggcaguguguuuagguuggggcaaaacauagaaggguuuuuggguacagaaaugagaggcacgguguaggguagacacccuggcuccacccaccuuccuccuuccccgcccguauuccuuagcuuuuucugugcaacgugcucucccacauucagagcuuuuaaaauuggcuaucauuacauuauacuuuucucauuuuugauuauguguguaugggugggcgcaugcaugccgggucaccugugucuaggucagaggacagcuugcaggcaucaaggcaucagucaguacucugccucucucauaugggucuccagaucggacucugguuguccgcuugucagcaagggccuuuaccacccccugagccaucucaccagccuaaguguggcuuccuuauggaaagggaguugaggcucaucucacagcugcagugaagaaggaucacuggguguggcaucagcaaacuguuuagccucucuguagaucaguuuucuuaccuguaaaaugggagagcacacuuacuucauaaggaggcuuugaaaggacuuagcaguuucccauugcugggacuaaccaaacacauaguagguucuccauaaaggugggcucuccuuuccagcugccccauguucuaguugcuggugaccucaucuucguuggagaaagaugggucaauagguagguacagcaaagagaggcuggagagugcagggggugaagucgacagugagggucuuccuacaucgaagcugcucaaauuggguccuggggacagcucuagggcuugagggaccaggacagcuuagcugugaggcugauugucaggaauacagggaaagccaagaacagugacaggcuaccgucaggacuucauagugacuucagagacuggaucauagcaugacauggccauucagccuuguucacucugggaggcaccccagccagcgcuacucagugagacccuguuucaaaacaacaacaacaaaagaagccaccuucaucugauagggauuggugugcagaggguagcaagaaaggcagggguuagaccccugcagagcacuccgggucacccaguagcuuuguccugaguggguuccgaaaauggagucuccggggacugcaaugaauacagcuaauggugaaaggccuuuaauggugaagauguaaagaccauuuuaauagauccauaggauaaacucuccugugcccguuguuaaggggacaguucaguggcaucaaggaccucuaugcauugugcagccaacaccacccuuguguccagacucuuugauguggccuuuucuggaagugucugcccgccugcggacucccuccagccugccuccccgaucacaucaggagcaugaugggaggaggagggggcagcucaaacccgcuucuucccuccuccaagggaagguguuaaaaugauccaccuuugagguucccucuccgcuucaaagacucgcggcagcucugcggaugccgcgggaacagcgcggcaugaaagggaguuaucaauaguuaccuggagcccgggaacucauaaaccuuucauuaguuuuacaucagugacggcucaaguccucggaaguagauuuaggcuggaugacagaugucuccauaaaacgucgccuuggaaaauuagggaaauggagggcgcuuuaauauaggauuucccaggagcccccauucugagcuucuguacuuugacagagaggacagugggggcacucagacggguuccuccugagccagucuccagggacggcacaggucacacagcucucggcccacacuggcuggcuucauggggguuuuguucauuuuacuucugagggaagcaagaaucagcauuccagauguuucugagaggaggaaaggaaaucugggucccagaaggagcccaggcagagcagggcuuucucuggcuaaugaggcacacuagcaccagcaccgaauguccugccacagaguguuagcagcauccugcaugccacggacuucacccaggauuuuaucuuuauauaguucucaucauuaccgucccauuuuacagaucagaaaacugaggcccaaaagguuuguuccagaacauuccaggcugccuugagagucaggcugagcuacauagugcuuguuuugguuucauuucauugguugcugugauaaaaacacccuggccacccuggggacacaauguacuucagcucacaauuccagauucuaacucaucacugcagcaggagcauaaggcaguuggucaugucacagcuacaaucaccagcagagaaaaaauaaauaugcaagcucaguaaucagcuuuuucuauucuuuuaaaaauacauuuauuuuauuaugugaauauuuuaccugcauguauaucuguuugcaauaaaugugugcaugcuuagagcucaguuagcuuucucuagucuuucuuuuaaagauauauuuauuuuuauugucugaguauuuuaccuauauguaugccacccgugugcccaggaaauaugaaguuacagguggcugcaagcugccacguggguugcugagaauugaacguggguccucugcaaagaauaaucaccugcaaauagugauauuuugacuucuuccuuuccaauuuauaucccuuugaucuccuuuuguugucuaauugcuuuggcuaggacuucaaguacuauggugaauagauauagagagaguggccagccuugucuagucacugauuucagucauaguguuucaaguuucucuccauuuaguuugauguuggcuauugguuugcuguauauugcuuuuacuguguuuagguaugggccuugaauuccuaaucuuuccaagauguuuaucaugaagggauguugaauuuugucaaaugcuuucucagcaucuaaugagauaaucauguaguuuuuuuuucuuugaguuuguuuauauagugaauuacguugauggauuuucuuauauugaaccaucccugcaucccuugaaugaagccuacuugaucaugagggaugauuguuuugauguguucuuggauucaguuugugaaaauuuuacugaguaguuuuguaucgauauucguaagugaaauuugucugaaguucucuuuguugggucuuuguaugguuuagguauaagcguaauuguggcuucauagaacgaauuggguagaguaucuucuguuucuauuuuguggaauaguuuaaagaguguuaguauuagguuuucaauauccuuaguaaucagggaaaugcaaaucaaaacaacccugagauuccaccucacaccagucagaauggcuaagaucaaaaacucaggugacagcagaugcuggcagggauguggagaaagaggaacacuccuccauugcuagugggauugcaagcuuguacaaccacucugaaaaucagucuggugguuccucagaaaacuggacauagugcuaccugaggacccagcuauaccauuccugggccuauacccaaaagauguuccaacauauaacaaggacacaugcuccacuauguuuauagcaccuuauuuauaauagccagaagcugggaagaacccagaugucuuucaacagaagaauggauauagaaaaugcgggacauuuacacaauggaguacuacucagcuauuaaaacaaugacuucagccagacgugguggcgcacgccuuuaaucccagcacucgggaggcagaggcaggcggauuucugaguucgaggccagccuggucuacaaagugagcuccaggacagccagggcuauacagagaaacccugucucgaaaaaacaaaaacaaaaacaaaaaaaaaacaaaacaaaaacaaaauaacaacaacaacaacaaaacaacgacuucaugaaauucuuaggcaaauggauagaacuagaaaauaucauccugagugagguaacccagucacaaaaagaacacacaugguauacacucacugauaaguggauauuagcccagaagcucagaauacccaagauacaauucacauaccacaugaagcucaagaagaaggaagaccaaaguaugagugcuucaguccuucuuagaaggagaaacaaaauauucaaaggaagaaauauggagacaaagaguagagcagagacuggaggaaaggccauccagagacugcccaaccuggagauccaucccauauacauuaaccaaacccagacacuacaguggaugccaagaggugcuugcugacaggacccugauuuaacugucuccugagaggcucugccagagccuaacaaauacagagguggaugcaugcagccacccauugggcugagcaugggguccccaauggaagaguuagagcaaugacugaaggagcugaagggguuugcaacccaauagggagaacaacauaucaaccaaccagauccccacccccacuccuggggcucccagggauuaaaccaccaaccaagaguacacauugagggaccuauggcuucagucacauauguagcagagaauggccuugucggacaucaaugggaagagaggcccuugguccugugaaggcucaaugccccaguguaggggaaugccagggcagggaggcaggaguggguggguggguugguuggggaacacccucauagacgcagaggcaggaggaugggauaggggguuucuggaggggaagcugggauaggggauaacaugugaaauaaaaauaaauaaaaugucaaaaaagaaagaaagaaagaaagaaagaaagaaagaaagaaagaaagaaagaauagucaaugcucuuaagccaucucuccucccucugcuuucucuauucucauacagcccgaaguccuaaacuagggaauggugccacccacuuucagggcuggguccucccacaucaaucaaaacaauccucccacagacacacccacaacucagcaucaucccuugcugagacucuuccaggaugaugguagcuugcuuuguguagacagagcuaaccaccacagccccuaucuugaacaaauauuugauguauauccauauuaaaauguauccuagcuauuagggguuuuuguuuguuuguuugguugguuaaauuuuacaauuacaaagcaaaacaaaacgaaaagcauuuguuuuggagugggggcugaggaagaagugauugccuacaguaacccaacagaagaugacgaggaugggaccugguuucccaucuuaggagcuguuuuuuauaguacuagagacugaacccagguccucacacacacuaggcaacaagagccugcuaaauugccuaggcuggccuugaacuugugauccccucaccucagccucucuugugcugagcuuacggccauguacgcacaaauccaccauauagcucccuuuugacuuaacuuuguuaggcuaccuuccguuuuaggauccagguuucuuugucucuaaaauagucaaccuuggucaucauugguucucaagaguaauagaaaacagcaggccaggagucuggcuuagaguucuggggcuccucagaauaugagggaugugguucaucaggaagaugcccacacuuuggguuucuuggggccucugucaugucucaggcugaggagacaaaugcuuauucuuauuaugacacaugagacucacuccuuccucccaguccuggccccaagucauaggcacaaagcuguaagcaaugugggcugacuaguuguggguccuggcuugcucugcagggucaagccagcagcuggcuuggcuagguuacacaccaagcaugggacccuagugcuucuuagguccaguuccuaguguucugccuuguuggagagguaagacauggccaggagcuuaugguggagugaagauguucaccuugucguggccagaaagcagaaagagcagagaggaaggcgugggagacaagauuugcccuucgaaggacuccgaugaccuggggcugguucagggguuuccaucuuuguugcuuucccaccucaggacuccugccuaccuucucauccuccugcauggccucccggggucugcccuaaagccucagacagacuaauuacaaagaacagcagagaaaggcuaucaggaagccgcuggugauuuggacuaugccucagaacccagugauguucaccaacgcugcaaccuccccuacaaaucaaagacucuuuaauuuccucuccucucucuucucuugucucugaagaccuggaggguagcuagcgagagacugcacuggcaagcgagucaaaggugaacucugcaguccgggaagcguaaugucccaggagaacuuuuaugugcaugagaauuuaguucuccaucgcuggccucccagcaaggugcuucugugugcuaggcugagguaggagaacagggcucaaagauuccugggaacuaguggaagauuuggguucccggaagacuggcugccuccgguguacaacuuccucucccuccugccaagagccugucuguccauccugccggccuuacucagggcccuuugaagucaagauucuugcuucuguucucuagcugaggaaagagauuugcccgggaguauccuguguaagccaggcuuaguguagugacacgcuccugcaaucccaacacccagagguugaggcaggaagauccaaguuccaggccagucugagcuacacagugagacccuaucugcaaaauaauaauagugaugaugauggugcugcaggcacauuaauuuacuccauuuucuuuucuaaagcugcuuuauuacaucuaucuaucuaucuaucuaucuaucuaucuaucuaucuaucugucugucugucugucugucugucugucugucugucugucuauucacccacccacccauucaucccuccaacccuccacccucccacucccauccauccauccacccacccacccacccauccauccaucuacccacccucucacccucauccauccauacaucuacccacacauccacucaccuauccauccauccauccauccauccauccacccacccucccacccaccauccaucuguccauccauccauccauccauccauccacucaccuaccaccauucauccauccauccacccacccacccaccuacccuccuacucacccauccauccacccacuuacccacccacucacccacuuacccacccacccaccugucuauuuguguguggcugugugcaugugccuuugugcauguguggaggucagagcacaacuuuggggagucaguucucuccuaccaccuuguuggccccagggauugaacucagcucaucagacuuggcagcaaauccccuuucccacugagccaucucuccaguccuacaguaauccauuuucuugccgugagccagguauacaugacuugcucguuagauuuuucucaguaaugcucacaagacagauaccucugucuucuucagcuuggauuccagaugaggaaacugagggccaguuggguuuuauggcugucucagguuacagggcuggugagugccaagccaggauucaagccccagcaaccaggaggcaggccuagcgaccaaguuaaaugcuucaggguaggcaagcccaguccuuuaaaccccagagcugcccuuguccagggaccccuccugcugggggucggucuggagggacuuuauagcagcugcagaggucagacauaacuaccacagacgagagaaggacaauauugguuuacaggggaguccugggcuggaucuaggaugccagugaggucuggcugccucucuuugaggcucauuuccacacacacacacacccaccaccaccagguaucucucuugucuucaugguggguaagguaggggacacaugaacacaauuuaggcucuguucaaaggcuuacaaaugagagguccaggcaaagcugaaauauacccaacacugcuugccaggcuccugccuugggacaaggcugugccaacccagacugacacuuuuccuaauccaucuuccagaaacuacccaguccuaauacauacuauccacucaucuacccacuuauccacucacccauccauccaucaucuacccaccgauccauccaucccucuacucaauaaauaccgcucagccuggacuaugagcccagcacuguucugggucucguggcugacuauugcagugauccagguaagcaaaguccugcuuaguggugcccacaugauuacuugaauaauccaaagagguuuuaaggccagaaggagacauaugaagaagccauggucuuuccccugcccggagugcccaggccccuuccacuaucccucccagcagagccuggcagacauccccuaaccuuccugcucuggccaucugugggaaggucacccaggcuacgggaggaacaugugccaaugcauugauagccaggccacagcccugcugggcagcucugcuaauuacagugacgaauggguuuaauuuacuuugaaagaauaauauggaucacuccguuggcacagauuaacucuagaggcugcuccucccuccccacacaggugcucaccagagcucccgccacucugcuaucgcugucuggcacccuugagcccaggcaccuugcaccagccuuggagaaagggguggugguugaaggaacagguuugacuucguccacucacugccacgcugccccagcaggcugccagccggugacauguacgaaggagcugagugugguggugccagguggggacaggcuugcuugggauggcuguguuuucacuugcucucccugugaggauaaaggacuccaccugucaguucuuuaguccaguuaggacaggacaaagacaaaugaugcagcaagagggauugcagccaggcaagaaggcaaacacaucuuggagagggagugaguuagagaaccugaugucgcacggggacaaugacuucagccuugacacugccugucaacuaugguggcagguccaaucuggcuuggcuuuagucccuccaccuauaauucaggagucuugaccaacugagcugaagaccgaggucuccuuugguccugagccuuagcaccuguaauuccugccccggggcucaaccaggagcagagcaaggcagaccuccugccugaggugcugggacuagagcaggguccuaaggaccagcuccccgagacagacgugggaacuacaggggcucaguggacaagagcccacauugguaauugacucccaccaugggggagcugggcagcuucaucgguaugcggcugggugcugagugcuuaagagaaacuuauuaauuuccccuccacaaagacugagacuucgacaguaaucacaguaucauaucguaauaauaauauaaaaaaauccuuccauagagguugggaauagaaguuggggcucuggagaguucaacaggaaagauugcauuaagauaaaggagauuauaaccaagcagacauuaaagguugucauugucugguaaaucacauuagggaggucccaagacugcugucucccagugagguagcaaagaggcuucugaccugcaaccccaugcaugcuaccugccuccugccagcuccagggcagcucugucucccucuuagccagcaaggccacugagaaagggggucgcauggcagacucaggcaccauguaucauugcuacccccaaauggacgucagauccucaucagaggcagaggcugaggcagggacagugcccagauuuggggggaauagagggcucugugcugggcuggauucuuagaguucuggcugaaagagaucuugaaacaguuaggaagugaggacaggcaguguucugggcucucugugcuuuuauugucuuccuaaugacaggagaacagagccugaagccucaggacacugccaccaucaccucuuagacacagguugauucagaacaguugucccaacaggacaggugggagucugcauccugguaaaaaagcucaaacgauucuggccacacacacccagaugccagguaaccauucccccauggggcucuggccaagugaugauuggcuaggcaggguguagggagagcugagguggggcggggcuuucuuugacaucucuacuggagccagaggaaaggcauaggaucuaaaaguuaccuggacccaggacaaggaauuauaagcugugcauaccuagaagacgacauggaagaguugaguuaaaaaugggccccucugguaucaucagggagaagaaaggguugggaggacagaggaagggaggggggccuggugguauagaucugugauuccagcuccugaggaggcugaggccgaaggaucgaaauucaagaccuagcugggcuacagagugaguuggagggagcuugggcaacuuagugaagcccuuuucuuauaauaauaauaauaauaauaauaauaauaauaauaauaauaauaauaauaauaauaauaaaaagccuggggagauauuuuacagguaaaguucucugcaugaggaccugagcuuguuuagguucaauccccaggguuuuguacacacauccuuagagagagagagagagagagagagagagagagagagagaggacuugggccagugacuaacccucucuguguauuaaccuauaauaucuaacccacaggguuaugaugagagccaaauguuuuauuauaaaugccgggcaugguggcauauggcuuuaaucccagcauucaugaggcauacauagguagguaggucucaaugaguuugagacuaaucuggucgacacagugaguuccaagugugcaggggcuacacagugagacccugccuaaaaaaaaaaaaaagcuauauguaaagugcuauaaaugauaaaauucuacucuugccucuuacugcccucgguggcucaucaugagacagucuccugccccucaccacccucuucagaccacucugggagguagcagugguggcucaggcuuuggguuuuggacuggaaaaccuggguucaaauccugccugagcaugguuauaggagacucguggccacugcacaccuuucagcuagggaaguuccuggcucaagguuaaacuacagacauucaguggacuaacugggaagggacaagcacugucuacccguggcccuccagguggcaccuggcuucugcagcuucaagucccaggacccaggggauucuucugcagcugccgggaguuuaugaggcuaagcggagaggguggcugucauauguguaaugggguuguguggagauaaaugugaggccaggggaaggagguaaggcaagccauuuugccaguuaaugcgcacauuuaagggacaccgaagggagugaagccauuugaaaggaaugcuaauauggguaggagagcuacguucugaaaaaggagaccuugcagagggcaaagcggagugagccuguaugagugucagcagaugacucggccuaggagcuaccucucacacagggugcgagggucucagaggccucuaugccccgucccaugccccgcccccacugucuucgugauuacaugccuuucggaagcuucaaagcagaaacugacaggaagcuuggcauuagauguaggcuuugaccggucuggaggcuucgagaagugaggucuuugucuuauguggagaagagaauagauggggugcagcuucaaggggcuucugggauguggcuugagcugagccuuggaggaggggugagagaguggguggggccugugaccaagcuggggagauucaugaagaucugcgcaucuuuuagccuaucuccguuagagucccaaaaaguaagagaccagggaccagaaccucacuuucuuggggacccuccugcucuggaguaaggagggguuugggcuccuacaugugcccucuggcagcaaggcuugaaguuggagccugggcacgugcucacaaagguccguccccacccuuccuucccuuuuccugggaggcuccucguucagcacgaagggagcgugucccucgaggaccccagccuaaacauccuucccauguccagucuguaggugggaugaacucagccuccagcugugagaauuugccuucuccagagcgcccaccgcagcagcugaggaauccgggcuugggaggccagucaggaggaaaaggcuugcacgcauccugugagguuauuaauaacgucacugggcucugaaugccucuuuaauuccucugcuuaaaccacucaggaauccauaacacuugccccuuagccugugguuauuccacccccuuaauggccuuuuauggagagaccuuauugaaagcuuuuccccagcccaaguaaaucauguccuccgggucauccucaccgcuguuuuauuaacucuguacaagaaguuggaggggccagagggaggccagcgcguccucuguacucuggccuggccagucccagcacagccacuuaccuggcuggaccccaccgcucuccacacacucacuccgucuaaaccauaaauccucaagggugggggugaggguggggcugguggguggggcugguggguggggcuggauacuggguacuuccagcuggacgcaaggagugccggaggggauggcacucaugucggaucccuggcccgucauuccugggugccucagcucuuugguucauugguuccuggguggcugguuggagauuugguguaucgcuuuuguacugagaacaugauuuaccggcaggguaagcagugauaagcaaaaucaguacagaguucuggggcucagaauuauuagguacaggaccgcacuaaugcaagaugaaaguaugaggggcugcuauaucagaagaagagggugcgcgggaacccgcggcuucucaaucugcuacagacccgcaguggcucucaaaacagagccggcccucucuguuuagggcccuucccccacucuccuccaacuccucucuuccuccuccccccuuuucuguuaaaaaaauuagucuacggcuguauuaaucccgcugcuuuuuugagcuccagcugggaugaacauucaaaaaucuuaaauuacauuuauugacuuauuuuguauuugagaaacaggaaggggcagggaugguaucuguccacugcucugacccucgggucgagaaugcugugcacuucguaguagaugcucaauauguguuugcugaaugaauaaaagaaaggagcaaaucuuuugccucggggagaggcucacccgggagcgucccugcugaacaucucaguucccucugauccccucggccucacuauguuuuaggagguggagagaagcagggugagacugaagcucccagcccgagcugcaggcacugcacaaagcccuggggugacagccacucccccggagauggaugcaccugccuagccggcugccccagaagcggcuuccuauuaauaacagcaguagcaccugccaggagguggggagggcaguggcggggaggcggaaggaugcccugucacaagcugaggugggcacgcaccagggaacaguuccuuauuuucuggagggcagccaugucacuuuccauuagacccggcuuguaaaucgggccuuagcugaucccugugccuuccagcacgcggcgcagucugccccuguugagugggcugucaguuagguggagaggguaguaaggauaucugagccauaaaucuuguggaugguaaagggcuggagacgggguacuuccagcuagacucggggagugcccgaggggacugcacccacauccgauaccuggcacauccuuacugagcacaguaaugucaguaaaggggaccugggcuucugccucugggggggggggggacguuagcagcagaaauaaaggugauuacaaaggaaagggaagggaggagggagggggaugcaggugaaccacaggcuauccaugguugggaaggaagggcccaccugguacccagacuggcucccguccuagaggacagagagccuagaacagcgguucucaaccugccuaacgcugcgacccuuuaauacaguuccucauguuguggugacccccaaccauaaaguuauuuucauugcuacuucauaacugucauuuugcuaaaguuaugcauuguaacguaaauaucuguuuugcgguggucuuagccaucgcuacuucauaacugucauuuuugcuaccguuacgaagcauaauguaaauaucuuuguuuuucugauggggucuuaggcucaaccccagagggauugagacucagagguuaagaaaacacugggcuagaggaaccaacagaagcaucaagagggauugagacucagaggucaagaaaacacugggcuagaggaaccaacagaagcaucaagagggauugagacucagaggucaagaaaacacugggcuagaggaaccaacagaagcaucaagagacuugagcugcucucucuugacaagcaaagaacccgucucuguuauuuuuaggggaacacagcaccccgucaccucucagaacaccuucuguuaccagcagagagcagcucugaggaguugccaaaggaggaggaggaagaaggggagagggaggagggagaggagggggagagggagaggagggggaagaggagaggaaggagggagaggaggggagagggaggagggaaguaggaggaggaaggggagagggaggagggagaggagggggaagaggagaggaaggagggagaggagggggagagggaggagggaaaguaggaggaaagggaggagggggagggaugagaaggaggaggaagauagcuuugccaccagccugugcagcaaguucugggcugcacacugggacuugauggccuaauacagaaggucugagggggagaguccagcuugcagcugcuuuucuguucccaccccaaccucuaugucugcccaaggguucccacccugacguuaucccugccuagccccugccucccuuagcucacucugauccugcucagcccuguuucuucacagcccccaucuucggacccaagugccuaguccugggcaguaagucccagucccucggucaccagguacuacacacccacucugugcugugucccucugaccucuuguccucagguucagccucugagggcuuggggccaggcuggaggcuugcagaccacuccaucaguccugagcuaacaggauaucauuagcaggucucuaacuaggccauguuuuccagggcagcuagugcacaauguugaagaaaaaucacacuugcuuguugguugggggcagugugaggacuugugaaaagucacacccucuaacuccuaccagacuccucucugacaucucgcuccacuaggagagugcacuguccccccuacgaagccuucagcauuagugucgcucccgcccuagcugccagcuuagaucucugaaucgcaauucauggugcaggagcuaguaaccccuuccugaauagucauccugccucgagccgagcugaacauuaguuuuuugaccucacccggugugacauggauaccagagaugucaagccacuugccuaaggucacagaacuaagccugacaggacugugcguggguccugguguuuccugucugucuuuccagagcuacaucgccucuccuaucugauuggguuauacugaguaggcccuucuaaguggcagugccugggugggggcagggugguggagcugggucuggggcaggcugugaucucccguggaagcaggaggaaguuuggccacaaacugagggcucguucaagaugagguaagauggggcuggagagauggcucugugggugaccugucuggccugcaaggaugagggccugauuuuggauccucgauaccucaggcagcugggugugguuugggcacccggugcugaggaggcaggggcagugaacaucucugggacuugcuguauagucauuguggcugcacgaguuacuuucuauugcuguaauaaaacaccaugaccaagucaacuucuagaaggaaggguuuauuuggggaauuauggcucuaaagcagcgguccucacuuuccuaauggcugcagcccuuuaauacaguuccucauguuguagugaccccaaccauaaaauuaucucugcuacucuuucauaacuguaauuuugcuacuguuaugaauuguaauguaaacaccuuuuuuuuguagauaaagguuugccaaagguguugcaguccauagguugagaaccgauguucuagagggaugcgggaucaucagugugguugagggaucauggcagcaggcaggcaugggagauggaguagaagcugagggcucacaacucaaaacuauccucaggaagcagagcaugaacugagaacaguguguggauuuuggaaccucaaagcccuccucuagagaugcacuucuucccgaaagaccaaaccucccaagccucgucaaacagcaacgaaccagggacugagucuucaagcaccugagacuguggaggaacaucugucauucaaaccacugcacugacugaaucggugagcucagcuucaguggaagaugcugucucuaagaaccagggaaagaaugauugaugaagauacccagacuugcucucuggccuccacacacacagacgacucaacaacagcaaagagagaggauggccugagugagcagagccaggaaccaggagagagaagaggagggacugggagagcaggaaaaagaucuucaugacuuugcuccuuucccagcagagugcacugggggugucccagacagcaaggaggaaccccccagagaggccuugaggcggcugcagcaggcacagcuguuggggagcugagccaugaugcuaaccccauucaggggugccaaccuuguuugaguguggcuggguacacauugaguauauacgaugugugcguggcauauuuauaguauacuuauauaguguacacgcgguuuacgcacacugcacaggcaguaaacauacaguggguuuguaagcaugaagcccacauguggaguacgugugugguauguaugugugugguguguauauaucuucagugugaauacauguauggccugugugguguagauggaaugcacauauuugugugcuagagaaagacaacccucccugucuguuucacggugggcacugccaucugcacuccagccccuaggggccgcaccacucuccugggccacacaguccauaccgcggccacuuucuagggccuaugcaagcaggugggaacucugcuuuuuauugagacugauuuauuauugaaacaacuugaauggauuucaaaguaaguuaaaugagaagagauguucagacccggucucauaaaucaaggggcauacaaagaaagaaggaaacaaaggauucacaggagccugggaacagaugggcuggcgaacaggaagagagggaacagguuuccaguugacagggugucccaggaauaaaucuuuccuccccuggcuggagagcaggggaaagcugccccuccuccuguuguuaucugggaaggguaaugucuggggacuucuguucucucuggggcacuggacacucccggggucacuuucccuggccucuaguuuccggagccugaaguggguagaucugugagaaaagauuggguuucggggcuagaaugagucucugguuucugggugaccauuagagauaugugaaucuuggagucugacuauaaaaccaucugaacugcucagagcauacaugucuauuguaguguuugucuggugugugugugucuguaugugucuaugucugugucugugugucuuucugucacuguaugucuuugggucuguguguaugugugucugucugccugucuuucaccguguacgugucugccugguugacuguuuauuguguguguccaccugauugucugucugucucucacugugugugucugccugaauuucuauuuguccuguauguuuauauuuguguguuucuguaucuguuugucacugugugugugacugugaguuugucugucacuguguaugucugccugauugucuguuguuugugugugucuuucacucuguauaugugugucugucugucugucugucuccccccccuuucucucgguguguguguuuguaucugagugucccagcauucagcaaggccuagccugaaauaacuguauuccagaagaaagcaagccuugucuucccuaacuuugccucugugccaacuucccacaguugagagcaauguggggcucucacccaccgcaaagccuagaucugcacggcagggggauccucuggccagggaguggggugcacuagagguggaugucagucacuggcuacaagaugggaccuuguagaagggucccauccagcuggaggcucguaaugacagaugucaccgagggccacaaaaagccaaaugcggggagacaaagaggauacgggcagagggccucaugggugccaccugggaaaugagggaggagugagaagccucaagugcuaggacaagaggccagugagcgugggcagacagcggcuucuggagacagagucuggcaggcaggguggucacaggcacuaccugggagaugaugaaccagguccuccuccacccagucuugucugccugccauuuccauuucucuuuugucuucagaauaaagagacucagcaauuccagggcucugcuucugacucaucuaacgcuucaugucuccugcuccugcugguggcugucuuuauuaugcuacaauucaugugucuucaaccuccaucuucccgguccugcuacgggccaguggcccucugacugagugugccucuguugccccgucugucuccugga

SEQ ID NO: 2269 - RNA, 5284 nt, Mus musculus
uucagacuaaggaaggaaagaguuccauuucagaaucucuagcuuuaagaaaggcuaagcaagcacacagaggaaggagaucacggggaaggaagaaaacugccagugugggucagagaaagaagcuuccuacuucuccagggacagacucuaaggggaacaggccugcacaccaugcugagggagaccuggcuauguguuauccuuguagccuuugucagccacccaguguggcugcagaagccucauaaacgcaagacacagcucaaagcagcgggcugcugugaggagaugagggagcucaaagcccagguggccaaccucagcagucugcugggagagcugagcaggaagcaggagagcgacugggucaguguggucaugcaggugauggagcuggagagcagcagcaagcacauggagucucggcucagcacugccgagagcaaguacucugagaugaacaaccagauugacaucaugcagcugcaggcugcgcagaccgucacgcagaccucggcagguaagugcugccuccacacuccucaccgugcgccugcucaaggucuccuggccccagcucugcuucuggauagccugcucaacaacuucgggggcuuuugggaauguacgaucuaugauugcacaagcuuugggcuagugauauccugcgaguuuagccaggacauuugaagaaaaccuuuguauucaacaaaggacagacuccucguguucuucaauucugaucuucuuucucccaugguggcuaauaaaauucuuccaaauaauagagagaacaaguaaauguaaugcugaagugcugaccuuuuaguggcugaaaauaaggaaggcacacgcagugaguuauuugagaaaaaaacauucaguuguugguuaacuuggcacagaugagcuaauaaaugaaucgcugcucagaugaagaucuaauuuucugagguuacuggaaaacauuuggaguaaguauauuuuauagaugaagcauuucuuacuaaugcuuacugcacaauaaaccaagucaagaagacaugauuagcuucuugugaguaagaccuuggcuaucauugguucagacaaagaaaaaguuuugcugaaaguuaagccugaaaagucuguuagcuaauuaaacaaaaacaaaugauuucagagcuugggccuccugacccucaguuugaaaacagaaaguuagggguucucauuuaccaaaaggagggagagagagagaguguguguguucauuuguucugugagauggaacuggucauguuggccaggccagaugcacgcagggcugacuguaccacuucuugcuccuagaagucggcugggaggaagggcagguauccucauuccucccccccccccccccccccagcacgcucugcagaggaaauaggcacuuuggcaucucccacuuucaucuaugcucccuaagucuccagccaaggggcaccaaggaaaaagucucaagacaugcagaagugucuuggggcaacagccacagagucugcuaaaaacagcugcuucuuugaagccccaggacagagccucaaggcggccauggaagcuuucagaucaagcccaaggggaaguggggaaacuucacuuccuggauuuuuuaaaaagaauuauuuauuauuauacauaaguacacuguugcugucuucagaugcaccagaagagggagucagaucuuauuaugggugguugugagcuaccaugugguugcugggauuugaacucaggaccuucggaagagcagucagugcucuuacucgcugagccaucucgccagccccacuuccuugauuuaucaaaguuuuaggaacagucucaagugcugcugguuuucauuugagcaucuagugaugugagacuggggagggagaagauuuccaaucugucucccuuaaucugaguaccuguuggcugguagcugagaaacaacauaaaaccaaacucccugaaauacucuggaguuugccucuagcucaagccugaagcuucucucagggcagcugccacgugcccuucgcagaccauaccauuauuguuucuggaauucacagccuggcacuucagcaggaugucuuacuuagacuuagcccgaagcuuccugcuuaacggucccuuggcacagguuaagaauccccuuacucuacugccccauaaccaaggcggccugagcaggccucucagcccugaugcccacuucucgacaucgguaccccaggggaacuacccacgggcacgcugagguacaaaucaagucuugguuuuuaauccagcucagaugcaccaggcaugucugaccaaccucaaggcccaaaucucuguuuacucugcgucccucacagaugccaucuaugacuguucuucccuguaccagaagaacuaccgaaucucuggaguguacaagcuuccuccugacgaguuccuggggagcccugagcuagaggugaggucacuacugcccugcccuacccuuuguccuccagcccugaaagguacauggauaacaggacuucuucuggucuauggaaagggaaguucaagaaucaaauguaccccaugauggacugugagaaugcucaguuuacgggccccucccuccacuccagcccgcuacugucugcagaaucagcuguccuaguucuucccgacacagaacgagaucagcucucucuaggaggagggaagacacuagaaggagacacguggaaguaccugauuuucccauuuacauuguguucacacugccugcccgccaugccccacugacacucguucccaagcuagccaccaccgugcccccgccuccacguugggggcaguguuucugcuagagaaugcagagagcacaaggaucacugacucacuagauagauacagcacacagcuugggaagucuguccuuaagcuccugccccugcccuugcgccugcccagaggguccucucugcuucagguguucugugacauggaaacuucaggaggaggcuggaccaucauccagagacguaagaguggccuugucuccuucuaccaagacuggagacaguauaagcaaggguuuggcagcauccgaggugacuucuggcuggggaaugaacauauccaccggcucaccaggcagccaagccggcuucguguggagcuggagguaagcucgagcugcaaggccccgucuggcccaggcccacugcacacaugguucauaggcaucaccacagucuacucacucuaggugugcucagucagugcagcaaugcuccugaaagcuuucuguuuuucugucuccaagcgagguccaggaagacccagggcagaacaggguaaaugcauaguuacugggauggaaagaaaacaccaucuccuuugcucugggaucuuguuaaguacaagccacagugaugcugugugguggccccuuuagauggcuucaagcaugauguccucacuuacuccuaccgcaucucaggaugagauuuaacacaaaccacacaucugccccuucagacagacaugaaggguugcagacaagcaauccaggccauacggugagaccagacccaaguuugcucucagaccuucguuugcugacugcuagcuaacauggcaaccugcaauagucuuaccagaguuccaccucugaagaaauguuuagccguggcgcucaugagagaggaagggaccgaggucugcagaaacgaauccuuuaugguuucccuaaugcucugcuccuccuuuucaggacugggagggcaaugcacgcuacgcagaguauagcuacuuugcguugggcaaugaacugaacagcuaccgccucuuccuggggaacuacaguggcaacguggggaaggacgcccuccucuaccauaacaacaccgucuucagcaccaaggacaaggacaacgacaacugcuuggacaagugcgcacagcuccgaaaaggugagaccugggcggcagggagggcugggcccacuaaggacagcagugagcuacagaucuguugcugcugcucuggccgugcuguccccuucgcuuuaaggccacccaucagcccuagucuagggaggacguccccagccuacuagccucaucugucucucaugccagguggcuacugguacaacugcugcacagacuccaaccucaaugggguguacuaccgccuuggcgagcaccgaaagcacauggauggcaucagcugguauggcuggcauggagccaacuauucccucaaacguguggaaaugaagauccgcccagaagccuucaagcccugagagaaggcagacacugaggagggagaacagcaugggaggaggagguggacacaggguaggagggaacaguuuaucauccaggagcacaauauaacuuuaccugugugagcacacacacacaauagaaccacacgugccaacagugcacacuagcagauggagccaggcggacccaguggggccugccacggugccucacgggagaacucauggacaacgguaacccugaggucacuuaacccauuuucccuaacugaggcuuagaugacacgagggaaaagaacaaauaaaaaccuggugugauucucagcggagaggcugugagaaaugaaagaaagcaggugguggagaaggggcuuccaagucuuaccccgcgacacuuccuugugucuauaguauuuguuuuguuuuucuuuuugagacagggucucucuacacagcucuuucuguccuggaacucacuauguagaccaggcugaccuugaacucacagagaucuaccugcuucugccucccaaguacagggauuaaaggcauguaccaccauacccaguauauauaauuuuuaagacacaaaaaacauggagauagagagcagcugcccaggugucuccgggggggccuuguugucagaguccugggggagagaggagcacuggacaacaugcugcgggucugacguggcgagaacaccagccggaggugagcacagacucugggugaucacaauacugccuucaaacauccucagucaaaaaccaaaagauccccuuuaauaaaaaugcuuggaaaaugaagguagauggcgcugugguuuaaaacuugugauguauauagaagcaucuuccuuguaaaaauaaaauauuguaauuccuauuuuucuuuuuuuacuuuuuauuagguauuuuccucauuuacaauuccuauuuuucaaaauaucuuuuucuauuacaauaaauacuaucaaaauuugau

SEQ ID NO: 2270 - RNA, 1279 nt, Mus musculus
ccugacagcgcgacccggcagcugggcuguggcuuacugagcagagugcucugcccgcucagcagccuugauuuccaugcucagcacaacaugcguccuagugcaggucuaaaccccagcacucgagaaacagaagcaggagggucagaaguucugcuacacagugaguugcaggccagccuggucauggagugaagagcucuccccacagccuccugccccucccaagcgaaggccauagaaggaguaacagauugcauaaaugagcccaggccugacaccuggacaugggaucuuuccugcacuaacucucgagcccguuccucugguugucuuauaaauucugagagcuggagauaagccucaaggaaagaugauuuccaauuucuuaauccuguuuaugcuccaauuaauacaacaaaaugcuuguaagucacgagacuucagaaagacaccaauggcagaugaugccagugcagcauccgacccaggggcugcugaggaggcuguggcuguggucaaggucaaggaugugggcucauggagguaaagccaaagacaaggcguggaucccgucaccgagcugagccuccugguuaaggacaugaagauccaguccuuggggaucuaccuguccuccuggcccaucacagaagcugagacgacuggcuucccccugggugcaucccuaaaggaugagguucugaagauucugccagugcagaagcagacucaggcggccaguggacagguucaaggcuuuugucacuauuggggacuacaauggucacggaauggucuugguguuaagugcuccaaggagguugccacugccauggaggggccaacaucauggccaagcuuuccacugucccugugcagagggagaggcuacugggggaacaagacuggaaagccccauacugcuccaugcaaggugacagacaggccgcuguggcucugugcuguugcaucucauccuuguccaccuaaagauacuggcauugucucugcuccugugcccuagaagcuccugaugauggccaauauagaugauugcuacacuccagccagagguugcacugccauccugggcaacuuugccaaggccaccuuugaugccaucuccaagagcuacagcugccugacccccccggccucuggaaagagucuguguucacuaagucuccuuaucaggaguucacugaucaucuugugaaaacacauaccagagucucuguuaagaggaccuaggcuccagcuguggcuaccacauaag

SEQ ID NO: 2271 - RNA, 3494 nt, Mus musculus
ccgagcggguuagguugcggcgcgggcagcgggcagagcuggucacguugugcugggggggguccgcgcgcccugcagucccgaacccgcuacgcgcuccgucggcccgcccgcccgccauggagccuggccccgacggcccagccgcgcccggccccgccgccauccgugagggcugguuccgagagaccugcagccuguggcccggccaggcccugucgcugcaaguggagcagcugcuucaccaccggcgaucgcgguaccaagacauccucgucuuccgcagguauggcccgccgcgcgccggugcagcugucagaaguucugcgcugggcccggcccugcguccacgugucacuaucgggacacgucagccgaggggaccccgggacccacccagcccccacacguggcucgccugccacgugucaccccgaaugcccaccccuggaccccauggcggccacgugcacgcccagggaggacagggaccuaaccucccagugucccaggacccacguccccgacugucucugcccgcaguaaaaccuacggcaacgugcugguucuggauggcgucauccaguguacugagagggaugaguucuccuaccaggagaugaucgccaaccugccgcucugcagccaccccaacccgcggaagguaccgcauugccccuggguucagcccugagcucgggguccuagaaaagcaugucgggcugacacuaggugaggauguuugggggcagaugcuacccagaugacugucagaaaaugcgggucggucaggaugaauagagcuccugggagagcuggucuccuuagaagccccgagaggggaacccaggcugccaggaaggaccccguggcacagaagcguucuggagaguagagaaugacucagaguccuguagcugggaagaucagguucugugggagugggccugcucaguccugacuuguccuucccuggcccaggugcugaucaucggggguggagaugggggcguccuacgggaaguggugaagcaccccucuguggagucggugguccagugcgagauugaugaggugggugcaguccaggaggccuggauuugagucaccagagucagcucugucccauccugacucugcaccccgaggcgcaauguucuuaccaucccugcccuguuuccucagucugaaaagaggguucaguaggaaaaccagauuguuaaggccuggcacacaccacaccauggauguuaacucuuagugcuuucagagcccaggcagagccagagagcucaacaacuuauggcaucuccccuugagacccagcaugguuuuagugagcacuuacuguaugcugaguguuacccaaggugcuggguugauacggccauggacaggugagccccugaguguagagcugguguuuggguuggagaagacaccauaacacagcaugacaugaugaggccagacagggauaaaagauauggagaacacaggcugauaggaagugugcagccacgcaugcuuacagccccagcacuuggguagaagcaggacgaucaagaguuugaggccagcgugaguuaucugagaccaucucucaaaaaugcagaagcucagaugggacuuggucugcagggaguugaggccugaaaaccaugaagagcugaggugguguagaucugggggaaaggguuuucaaaagagaagacuuguccaaagaaaccccaccaggaguccccagccucuaguccagcccagcccuuccucuccccccucuucaggaugucauugaagucucuaagaaguuccugccuggcauggccguuggcuucuccagcucaaagcugacucuccacgugggcgauggcuuugaguucaugaaacagaaccaagaugccuuugacgucaucaucaccgacuccucagaccccaugggugagccagggcacgcgcguccugcagcacacagcagccccagacuagagccaugugaugauggaggccugaggacggugggggucuagccuugguccauagugaccucugcuuccucuuuggcuucuucccugugcuuguuggccagcauccgggugugcuauggugcagugggggaggguuugaaugcagggccucccaggugcuaaggcaguagggggccacaucccacaaacauggguccagcaccugcuuugccacugagcugcugugggugacuguggccuggaggucucaggcaggauggccaugcucuaccccucuaggcccugcugagagccucuucaaggaguccuauuaccagcucaugaagacagcacucaaagaagauggcauccugugcugccagggugagugccaguggcugcaccuggaccucaucaaggagaugaggcacuucugcaaaucucucuuccccgugguggacuacgccuacuguagcauuccuaccuaucccagcggccagaucggcuucaugcuguguagcaaaaacccggugagcugggggugacugccugcaggguggggcgagggcaggcacuaagagccccaucuugaugcucuuugucccugguucccagagcaccaacuuccgggagccagugcagcaguugacacaggcccagguggagcagaugcagcugaaauacuauaacucggacaugcaccgugccgccuucguacugcccgaguucacccggaaggugaguggccugccaggcucccugcugggccucauccugcacagcuugcacauccuccugacugccuucaugucccaccaggcccucaaugacauaagcugaauccaggugccacugugacaccacccgagaccucaaucggauuggaccaaggaucuuccaaguugucuggggaccaccaguccuggaccagacucccagaugacucuugcccaccaaccaaguguuacaggccccacgaugcugccuggccuggccuggccuggccugcccugcuggguggacucagucucugucugucuaucucuguggcguucagccccacgccuauaccagcucuguacagcaccgccuaugcccugugacccaacaaaauacauguguauuuauaacaagcucagucaugaccucugaccuuuucauuuuuguuccuaccagugguacugccggauguuggguguucugugagcucuagggagccugcucuagggcccaguguaaggguccagguagggcagccugaagcuauagcuuuucaacugcccacgggcaagaguguuccuagcuuauggauugaagcagggugcaucauacuuucucagugaggcauugcuucugcuguggauauaaaccugaguucaaauccuucccagguuuccaaaguuaccugcaugggccuggccucucuccgaggugcugaaccugacccuccacugcaucgcagccucuugcuggaaccaaggcuccgguuucuggagaggagcgaguuacgggucuucgugucugcuc

SEQ ID NO: 2272 - RNA, 3494 nt, Mus musculus
gagcagacacgaagacccguaacucgcuccucuccagaaaccggagccuugguuccagcaagaggcugcgaugcaguggagggucagguucagcaccucggagagaggccaggcccaugcagguaacuuuggaaaccugggaaggauuugaacucagguuuauauccacagcagaagcaaugccucacugagaaaguaugaugcacccugcuucaauccauaagcuaggaacacucuugcccgugggcaguugaaaagcuauagcuucaggcugcccuaccuggacccuuacacugggcccuagagcaggcucccuagagcucacagaacacccaacauccggcaguaccacugguaggaacaaaaaugaaaaggucagaggucaugacugagcuuguuauaaauacacauguauuuuguugggucacagggcauaggcggugcuguacagagcugguauaggcguggggcugaacgccacagagauagacagacagagacugaguccacccagcagggcaggccaggccaggccaggccaggcagcaucguggggccuguaacacuugguuggugggcaagagucaucugggagucugguccaggacuggugguccccagacaacuuggaagauccuugguccaauccgauugaggucucggguggugucacaguggcaccuggauucagcuuaugucauugagggccuggugggacaugaaggcagucaggaggaugugcaagcugugcaggaugaggcccagcagggagccuggcaggccacucaccuuccgggugaacucgggcaguacgaaggcggcacggugcauguccgaguuauaguauuucagcugcaucugcuccaccugggccugugucaacugcugcacuggcucccggaaguuggugcucugggaaccagggacaaagagcaucaagauggggcucuuagugccugcccucgccccacccugcaggcagucacccccagcucaccggguuuuugcuacacagcaugaagccgaucuggccgcugggauagguaggaaugcuacaguaggcguaguccaccacggggaagagagauuugcagaagugccucaucuccuugaugagguccaggugcagccacuggcacucacccuggcagcacaggaugccaucuucuuugagugcugucuucaugagcugguaauaggacuccuugaagaggcucucagcagggccuagagggguagagcauggccauccugccugagaccuccaggccacagucacccacagcagcucaguggcaaagcaggugcuggacccauguuugugggauguggcccccuacugccuuagcaccugggaggcccugcauucaaacccucccccacugcaccauagcacacccggaugcuggccaacaagcacagggaagaagccaaagaggaagcagaggucacuauggaccaaggcuagacccccaccguccucaggccuccaucaucacauggcucuagucuggggcugcugugugcugcaggacgcgcgugcccuggcucacccauggggucugaggagucggugaugaugacgucaaaggcaucuugguucuguuucaugaacucaaagccaucgcccacguggagagucagcuuugagcuggagaagccaacggccaugccaggcaggaacuucuuagagacuucaaugacauccugaagaggggggagaggaagggcugggcuggacuagaggcuggggacuccuggugggguuucuuuggacaagucuucucuuuugaaaacccuuucccccagaucuacaccaccucagcucuucaugguuuucaggccucaacucccugcagaccaagucccaucugagcuucugcauuuuugagagauggucucagauaacucacgcuggccucaaacucuugaucguccugcuucuacccaagugcuggggcuguaagcaugcguggcugcacacuuccuaucagccuguguucuccauaucuuuuaucccugucuggccucaucaugucaugcuguguuauggugucuucuccaacccaaacaccagcucuacacucaggggcucaccuguccauggccguaucaacccagcaccuuggguaacacucagcauacaguaagugcucacuaaaaccaugcugggucucaaggggagaugccauaaguuguugagcucucuggcucugccugggcucugaaagcacuaagaguuaacauccaugguguggugugugccaggccuuaacaaucugguuuuccuacugaacccucuuuucagacugaggaaacagggcagggaugguaagaacauugcgccucggggugcagagucaggaugggacagagcugacucuggugacucaaauccaggccuccuggacugcacccaccucaucaaucucgcacuggaccaccgacuccacagaggggugcuucaccacuucccguaggacgcccccaucuccacccccgaugaucagcaccugggccagggaaggacaagucaggacugagcaggcccacucccacagaaccugaucuucccagcuacaggacucugagucauucucuacucuccagaacgcuucugugccacgggguccuuccuggcagccuggguuccccucucggggcuucuaaggagaccagcucucccaggagcucuauucauccugaccgacccgcauuuucugacagucaucuggguagcaucugcccccaaacauccucaccuagugucagcccgacaugcuuuucuaggaccccgagcucagggcugaacccaggggcaaugcgguaccuuccgcggguugggguggcugcagagcggcagguuggcgaucaucuccugguaggagaacucaucccucucaguacacuggaugacgccauccagaaccagcacguugccguagguuuuacugcgggcagagacagucggggacguggguccugggacacugggagguuaggucccuguccucccugggcgugcacguggccgccaugggguccaggggugggcauucggggugacacguggcaggcgagccacgugugggggcugggugggucccgggguccccucggcugacgugucccgauagugacacguggacgcagggccgggcccagcgcagaacuucugacagcugcaccggcgcgcggcgggccauaccugcggaagacgaggaugucuugguaccgcgaucgccgguggugaagcagcugcuccacuugcagcgacagggccuggccgggccacaggcugcaggucucucggaaccagcccucacggauggcggcggggccgggcgcggcugggccgucggggccaggcuccauggcgggcgggcgggccgacggagcgcguagcggguucgggacugcagggcgcgcggaccccccccagcacaacgugaccagcucugcccgcugcccgcgccgcaaccuaacccgcucgg

SEQ ID NO: 2273 - RNA, 549 nt, Mus musculus
ugggcgcgcggcaggcaguggggcggcgacccugacgccuugaagcggaggacccccgauuuaguguuuucucugggccccgccccucuccgguccucccggcccggcuccucccccggugaccccgcucucaccacagucccgggucggggucucgaccgggucucaggcccuggcuucccgcucggcgaccccucggagcccucugggcuuggucaggaaggguggcgggcuccgguuagguccucagcacacagcugcagggcccugcuggaggagagagagguggggaaggcucguugguacccggcuguccccugucgggaggggccuggcgacucccgcucccacggccucagcccccaaagugccagcaucuggggcuucauucaccauggggcuuucuuuccuuuucaaguuggggcgccgcucugaggacuccuucccucccagugcguuaguagaaaggggacguacuuuaaauaacagacgccacugagcuuuagcugaggauccaacccucgcuuggcuggguuugguugucuuagc

SEQ ID NO: 2274 - RNA, 1060 nt, Mus musculus
cuuuuuuuuucuuucagcuuuuagcaacuuuauuuuccuuccaucuuuuuucccuuugcucaggcaccugcacagccgcucaggaccacucagugguggcuccaacccacucaguggccugcgcugugggagcugcugaccaauccucaguggcuggcugugcacuccagucuuccguggggaacuguuggaugggcacagagggaaccugcacacccucagaccagucggccaccucaggcugagcagcagugaacucaggagcuagugcuguccacucacccuggaauuccuccuuggucacagccuucucagcagcagccugcuccuccuucucaaucuccucugggucucuguggaaguaaagaucaggcaugaucucccaggggugcucacgggagauaguaccucgcaugcggaguacuucccuggccagcauccaccacaucagaaccacugagugagcucccuuguuguugcauggaauggcaauguccacguagugcaggggagaaucuguguuacacagagcaauggugggcagguugacauaagaggccucugugaguggcugguggucagcccugggaucggucaccacuaaaagccguggcucccugaaggcugcuuggaucugguuagugaaggucccaggugugaaucggccagcaaucggaguggcuccuguggcagcagcaaacuucagcacagcucgcuggccuguguuccuggaggagaugacgcugacgucagcaggguucuugauggcaacaauagcuagcucgagcugcgagcaacagcuucucccagguccucuucagguuuaugauguagauauugucacuuuuccuuugguagauguacugcuccaucugaaagucaagguuggugccaccuaaguggguucccgcagcaaggaauuugaggacauccuccuccuucaucugcaggacgucaagggcuccggacauuguguaaguuucccuuuaaguuacgaugggaaucaagaacaacgccguauagacccguccccggguagcgcagaaagccuauaauaacu

SEQ ID NO: 2275 - RNA, 16789 nt, Mus musculus
uauaacaggcgccgcagagacccaauagcguggggcaucggcccaccccugucuucugauuggccagcgucucuguaagccucucgaggcgccgggagccggacuucacuguacuugccucggagcgcucgguccuucgcguuucuuccuccucgacucugcuucgucugccuccgccauggcccagugagugaccgacacgcgcagucgggcccgggagacuuccggggcugagcguggugauggcggggcucugcucaguugucucccuguucuccucagccccgguggucgccugggucuccucgcgcagcccugaccccugcaccucaggguccccgccauggccagcgcaagcuccgccaccccuucgugggagcuugcggcugcgacgggcucgcggggaaggaaggccgcgcugggucggggacggcccacgccccuugugcuggccaggccauaaggaacgacgggcagggccaggggcagggcauggguggcuucgugugcccggacgcccuuuagaaggaacuuccauggaacuguggggugcagggugcggucgauccuaggugcauggugugagccgagaagggugcaggcugccaguccuaauaaaagccacuaaguaacacuaauauccuuucuuuguguuugcuuuauuguuuuuuuuuuuuuuugucauuucagagcugacauugcacugaucggacuggcugucaugggccagaacuuaauuuugaacaugaaugaucauggauuugugguaaguagugaggacacguugccuucccgcugagagcugugauuuguuuuucagagaucccaaggcaucacucaguaagcacuguuuggugucuuuguagaagaauuucugcuuuagucgugcucccucuguaguuaagggaagagccuccuuggauagaaauaaauauaaaagcagugguucucaacauuaugauuuauaacacuagcaaauuacaguuauugcguaguuaugaaaauaguuuuaugauugggggucaucacaacacgaggggcuauauuaaagggucgcagcguuaggaagguugaaaaccauagauguaaagggacccagaucuuggaagcuguagcuaggaaaacuugggguacauggagauuguuuuucuuuguagacagcagcuugucucacaguguugucacacuggagucucagggcccucucaucucagcuuucugaguccagggucagaggauccuccugccugugggcucugaauguucuuucuaaauaguagcauggcuuagacaccaggauuaccagggacaaaggacccagguaguagugacaggcucaaccugauaagcaacaaguggcaaccgccuuucccugggcucucugcugugacuggacuuugcagagauugccuagcacuuaaaaagaaaaggcaggucagcucucgcuagaccuuggacagaguagacguuucucuguugcugcaucuaccacccgagggucaugugugugccagauccucugacaggccuuuuguccuuccaggucugugcuuucaauaggacagucuccaaagucgaugacuucuuggccaacgaggcgaagggcaccaaggugguuggugcacaguccuuaaaggacauggucuccaaacuaaagaagccccgccgggucauccugcuugugaaggccgggcaagccguggaugauuucaucgagaaauuaguaaggccagcucgguucucggaugccgcccgcaaaucccucuaacugucucacuucugagaugguggucuucagugucugaguacagacugauggguucugauaaagugcuugaguguuucaggcuugguugccuugacaggcacuuauggaauaguauuuuuguuuuguuuguucuuaguuuuucaagacaggguuucucuguauagccuaggccuuccuggaacucacuuuguagaccaggcggcucagacucauagagaucccccugccucugcuuccugagugcugggauugaaggugcgugccaucaccgccaaguuguguucucuguagagagggguuuuuuguuguuuuuuuguuuguuuguuuguuuuuucauuuuauuuuauauaaaugaauguuugccugaguguguaacugcaccacauaccugaagugccugaugaggccagaagaagagagucagacuccuuggaauuggaguuagugggcaauugugagcugcuauguggaugcuaggaauugaacucagguccucugcaagaccagccagugcucuuaacccuugagcuaucucuccagcccuuauuuaaaauauauauauauauauuuaguauuuguguggggguaagcaugacacauuggauguggaagucacggggacuuuuuuugucggaguuggcccucuaccuccaccgugugguuuguggaaagaacucagguugucuggcuuaauggcaggugccuuugccugccgagccuucccacugggccaggguuuuauuuuauuauuauaguguggggucaugggagcaugcaagugggggucagagcacgacucuguggagucaguucucuucagucuuugcuuuggcucucaagcaccucaggcuugggccaugggcuuguccaacagugcuuuccccacugagccaguaguggcccacagggagcuauuccuggguggucguaauucuaggaccguaaggacauuucagucagauuugugaagaggaauagcacuugaacaauagucgucuauuaaugucugccuaucuuugacagucuugugggucccgguggggugggugugugugcccuguguuccuguuguguuccuguuguguucccaggcucaggugcuagagaccuguuguagagccucgugcauguccaugccagggaaacacaagcacccuaagccacaucccagcugcuuuucccuuuugcuuguuuuuuuccuucuucuuuauuuuugagacaguguaucacuguguuguuuggggcagguugaaaacaguguuucccuuugcagcucuuacuguccuggaacucacucuguauacagaccagggugaccucaggcccacagauuuagaaguguugcaguguuucucuuaaccuggcuagcccaaauaauugaaacuagacuguuagguuuauuuuacagcuuuaaggggaagcaguugaucaguaucacucuauuuuaaugcucuaagauaaucuaucuaccucccagccuuauggcugcaguacuuggauuuuaguacugaccuggguguaucuccuggacacacuccuccucuaggugccuucucccucccaugaaugggaggaaguccaacccuauucucugcccugcucagucauuggcugaucaacuucuuuauuggccaaucagggaauaauuggggccaaugccuacacaucauugagacaggagguucucagaguaaggauugaaaccagauauggggucccagaaaucggcauuuaaauaauaaaaggauaaucuuuacacagugcauaauaacaugccuacaccccugccucccaagugcugggguuaaaggcuugcacgugcaccaccgcccgguuuacuauguauuucucuuucuauuucuauuucucuggcuugguaugaacuggcuuugaucaugacaauuuuuccuccucaguggacuuaguguuaccaugccugccuguguuuucuguuuuaguuuuggucuugaggaaaagaacccagguccuuccaccuucugagcacacacucucacugagauguauucucagcucugguguccugcaauauugacugugauauuuaucuauguuuagugcuaguccauaguaaccuuuguguccacacuggguuuuauuuagacaugaauuuucuuccuucaguacuccuauaaaauaacaguucucauuaauaguugcuuuauuuagcacccuuguaucaauuuguuggcuuuaauaagacuaucuucugaagugcuggagagauggcucagccguuaagagcacuggcugcucuuccaaaggccuugaguucaauucucaguauccacgugguggcucacaaccguguguaauggcagcuuuagggccucccaacgaaugcacacaaguagcaaacauucacacacaccccuacauacauaaguaaaaauauuuuuaaaaaagaauaucuuuggaagaaaaaauauacuucugaaugaaggggaacaggucggaagaguuuauuucggcacucagaaauaacaguagagcaagcaguggagugacacaagggacugcuguggaagugauguaaacagaacugugaucccgagggggggaggguugaaguauguuaggcagaguggugguguggagaucuguacugaagacagaggaaacugaccaguacacuacuguuuaagaggcuuagaaaggaaggacgcugagguaacuccugugcugcaggcugccaggccgcccaccguuggcucccacacagugggcugcaggcugguugguugguuuuauuuuuuguuuuguuuuuguuuuuuguuuuguuuuguuuuuucaagacaggguuucucuguauagcccuggcuguccuggaacucacucuguagaccaggcuggccucaaacucagaaauccgccugccucugccuccccagugcugggauuaaaggcgugugcuaccacugcccagcgguuggcuuuucuacagccuaggaaaguacugaagugaucucaggugcagccuuggaagggggacacugagcaauaaagaggaaagucaagcaucgauuuggggagggggaggaggaggagggagagggagaggcagaggcaggcugggucugugaucgaggccacccagggcggcacagugagaugcugccucaggugagagggauggaggagaagggaagaaggugcuguggaagcugccacuaaaggaaagaugugguuccauccaaagcggauucuagagucuacauagugacugcuuucccacuguuuaucugggauuuauuuuuguuuugguccacccuaagguagcguuuguucacagguacccuuguuggacacgggugacaucaucaucgauggaggaaauucugaauaccgggacacgacaguaaguguuccucaggccaaacucuuucaggucuugagaacauucuagaaagaaauacuagcauuguucauguggccaaagaguggacugucuugugauccuuggggauugguccuggcacccuggaucucagccuuuuucugcuaagacacuugaugggugagaugauggcuuagacaccgcaggcugagggcuucuugcguaaucuccaccuucugcacugcacggccugcuaaaucccugcccuuacugugucagaugccaaagcaagucacgugggcuagcgugugagacagcauuaagucaccuccgcaccucuucagugcacuucauccuauaaggucuucuccaucaaaaugggacuguguguucaggaauuucuccuagggauggugcagcuaucucagaaauucaguuauucuuuuaaacuuuuuacaggaauuuuuaccucagaguuuuaauccuccuguucuagccuccuucauuuaaauuauaggacucuauaacauccuuugaacuguaacucugaauguauaaacugucuggagugguuggcugcuccuggguccuugggucauuuacuugcaaaugugagcucuugauuccuggccuugcaccuccucagaaagaauuuauuuugugagaaaacccugaaacuguuuuucucucuuuuagagaagaugccgggaccucaaggccaagggcaucuuguuuguggggagcggagucagugguggugaggaaggggcucgguacgggccgucacucaugccaggagggaacaaagaggcuuggugaguucagcacaggcccagcuaggcgggagguguaaggguucgaugggaggccucagccccugucucucuugcgucagguguggucuuccuuagugcgguccuaagcguugguuuugcaggugucaagguuuggggucuguaccaaacguucuugagaagaugagccuuuguuugguagggggaagggccuagcguuuccucugagccguagugaggugggaugagaugaagaguugcuccagaugagagcaucucuuagaguacugcacagcgcuggcuucucucugauccagaugugcagagccauguuguaccuggugacagacagccggauggugagagugucccugagauguucuuguacugcuugguuugggucauaaaguggugggaccuucuucuccuguucugagggggucagugaggagcuggggauggagcccgaggccucgugcaugacaggugugcacuuuaccgccgagccacaccccucggucuuuggugcgucugcccugccuuuuccuuugugaauuggcugucuccacucugaggccacaccggguggguggugcacgcuugucagcaaugacaccagagugucucugcaaaguuucgcacagccauuacucugagaguggcgucccugcauggcacugaaagcucggcccucuccuguugauugaacucacuuccccuuccgcaggccccacaucaaggcgaucuuccaagccaucgcugcaaaagugggaaccggagaacccugcugugacugggcaaguucugggcuacccuuugacgacgugcaccgcugaagacagaccaccuuggucccagugguuagcucugugcugugagccucucagucuuaagucacugucccagcuugucccugaaguacauccccgucugucuucauguccuuguagcugaaccagcccuugagagcccgagguuacugugcuaaaagcagcuuccucaacccuacuaacaaggaucauaaauaggaucaggaauggugaagggaagucagaggucucuguagcuguuuacuucauggccagaggaugcaggagcuaguguguggguuagccaccuugucccaacagaugccucgggccgugcggguggaagaaucuuugcguagcccagguuuccgguuuucuguagauguuccccagagcucaggcaccuggccaucggcacuuucuucccccguuugcuguugcugugagaaucaguaccguggacugacuggaaagcccaucagcugcccuuaggcuucucuguuaacugacggcuggccuaggacagaucucuguaggaaggcuucucugagcaacagcuaagcuagguuaucucuguucuuaacagcuuuucuuccucuuucuuccuuucuucaaauuuauuuucuuuucuuguuucccuuuucuuccucucagccuuccauuuucucugucugucugucugauuuguacuucucucucugguguauaugcuggaaggugauaaagcagcugccugucuguggaggucagagcacaguuuguagaguugguuguguccuucugucauguggcugccuucaggucuggcagcaagcaccuucaccugcugaaccauuuucuguccccaacaccgagugucuccucaagacugggucuccugaauuacaggccuguguaccaccacaccuagcccccuuucuauaccugcuauuuuuaugugcucaccuuauuauuuuaguaauguguaugauuaaaaguagggaugcauaaggcuccaggcaugugggcauucgggaagcucucccacugaccugccagcuuugguggcugccuuuccccaggggccaguguccuuccuugguggcagacagcuacuuccuucuaacucccucuaggacagagucaaaaggaaaagccaagcuugcacucuugggccuugacucugccauaguccacgccuguggccuaaggcuuggguucaggucguaaggauaaguaguguagacugcaagugggugagccuggagcaacaggaagggggaaguaagaugucuucauacgcacaguuaggaaggggcaggccagugaugaagguagacaggcagccucugaugagcagugacugccagggaagacuguccagcugcccugcuguggagguagcuacuugugacuguaagccuggaggcaccguggacugacucugcugccuucuuccaucucccuguccauuagacaguguucacagaguaacucagcugaaagacccucccuaaacucccgcugacaaacugauaagcuggauacauccuaccagauuaccuugcuuucauaggaccauccgagaaugcacuucugcauuuaaaaggucaaggccagaccuugauagaagucguuuuacccucaguaucuguuagaaacaauuguauuacauuugagucuagggaguaaucuaaucuauuuuacaaguaaucuaaucuauuuagccagcaguugccagaagacugguaacaucaagaccauggagacuuuaguguggggcugggguccgggaguggggaguaguuuuuaauaacgagggacagugggaaguugggcuaaagguuuuggaugcugggagguucccauggaaccauacuguuuccucauguuauuuuucugaagucuuucgucugcggagacuucuccccuguaguuugcugcucugacggcucuuguuugucgccaacaggugggagaugagggggcggggcacuuugugaagauggugcacaacgggauagaguauggagacaugcagcucaucugugaggcuuaccauuugaugaaggauguucugggcaugcggcaugaggagauggcucagguaaguccugggcacugccgccaccuggguaaucaccucccaaaggagagagagcuugcuacugacaauuaacccuuccuccuuccuguucaccugccugucugguggccccacauggacucugccuaauguaagggaagccacgguaauaacaucauaaagugugauagccggccaugaagcaguaaucggccaugaagcaguaaucguagucugcaguuagugagccaugcuuugucaggcaccgugugugaccucauauccaucccuccccauagaacacagagccuggccuuaggugugguagaugaggacuccccacagagcccaucccaguccuucuuuuguuccuaccuuuguuccauacaggaaguaaguagcuggcuuuguugaccaaguagggggcucagcaguugagagcacuuguagaagacuggggcgaguuuccagagcccauccagucauguccuucugaccuuuguaggccuuguaugcagugguacaugugaauacuugcaggcaaaauacccgaacacauaagaaauaaauauaguaauaaaucuuuuaaaagaauuaaguucaucccaguggggaagcacagacauccucagcauuuuauuaugaaaauauuaaaauacauaagaaccacaguaugagccagccauggugcugcacaccuugaugccuccuagggaggcagaucucugaguuccaggcuagccuggucuacagaaugaguuccaggguagccagggcuacacagaggaacccuguuuucaaauccaauaggaagaaaagaagaaaaaaaaagaaccucacuguccaccacugagcuauguauguccagucccaggaggugggguguagguacgacaagaaggugauauugugccuaggcccagaugacaugaggggcuugacuccaaggagaggggacagucucagugcugagaaauuagccaggcagauacucaacagaacuuccugaccugggaaacucaacucacugggcaggaauaggagucuucaggccacuaggaggaggguuugcugucccuaugugcucugcagugagggcaccagcuacagacagaagcaagaauauggcagaugagccagggugcccacagaacccucucacugggcuuucuccucuguguguaggcauuugaagaauggaacaagacagagcuggacucauuccugauugaaaucacugcuaacauucucaaguaccgggacacugacggcaaagagcuguugccaaagauccgggacagugcugggcagaagggcacugggaaguggaccgccaucucggcgcuggaguacggcaugcccgucacccucauugguaauauggcagcuuuccccuucuuuguguaguugguucuugagacagucuugaugaguagcucagguuagcauugaacguacaucagucucagccuccugaguaccggaauguaggccugccugccuuguuggcuguugguuguuuuuauaagauuucuuugauaauggguucaguaagccgggcauggugacgcacaccuuuaauccaaguacucgggaggcagaggcaguuggauuucugaggccagccuggucuacaaagugaguuccaggacagccugggcuauacagagaaacccugucucgaaaaacaaacaaacaaaaacaaaaucaaaaacaaaaauggguucaguaagaaaaguucacaaacacauuuugcuuauguaguagucaacaugaauucucuggguuuggaugucugucuguccguccuccuccuuuauuuuaugauuauccuggcucacccugaggaagaccaguggguggugaguccugcacagauaggaggaaguuggcugcacuagggccaaucccagcagugcagagagcaucuguccaccacccacuuagcuaugcguaucaggguuccugccuucaaaagcacccuccuccaucuuagagacuggguucccucccacugcuaggguggacgugguccuuuccuaccuacugaacugaagaaggaagaggucucagcuggcuccgguaugccugggaggauuugccacacuugcuguugcacaauugucuugcaguauuuccuuccacaagugugaaguaaugcagagaggaaggacagcggucgggucagggcaagccggccucaaguuaugucuagaguccuuuccccaaaacuaaaaugcugucuuaguucccagagaucaacccacuuuguuuagaggagaagaaaagucauuuaucuuaaauaaauugagcaguagucagucugccacaagggaugguuuguuaaaguauuaaauguccuaauguacuguauugaaggauauugugaaaccuaggauuauggguauuaaaaccagccuaagggcuggagagauguuucggccguuaagagcauguauuuuuuaauuaauuaauuaguuaguuaauuaauuaauuaaauauuauuuuauuuaugaguacacugucacugucuucagacacaccagcagagggcgucagauccaauugcagaugguugugagccacuaugugguugcugggaauugaacucaggaccucuggaagaggagucagugaucuuaaccccugagccaucucuccagccagagcuuggcuucccagcacccacaucaggugaucacaacccccugaacugcaccaggcggaucugacuccuggucucugagggcucucgcguucaaguguacgaaccuacacucagacacacacacauauaaauaauuaaaaauaagucuuacaaaaagaagaacacuaaaccugggagcuagugagagagauggccuaguaaucaagagcgcuuguugcucuuguugaucuggguuugauucccagcacccacgugguuggaucuugcgcccucuucuagccucugaaggcacugcaggcaagugaugcauauacacaugaaggcagacacccauaaacauagaaauaauaaauuaaaaaucagcuuucaaagcugagcauggagguguacacauuuaacaccagaacuugagaggcaggggcagggggugcucugaauucaaggcaagccuggucuacauaguaaguuccaaggcagccaggacuaccuggaaaaacccugcugucucaaacaaaaaauuaauaaacgucuuuuuuuuaagacaauaaauugcaucuuuggugagcacuuaauucucaccagucagguguggagcauagcuguaauccaagcccuugggaggaagaggcaggaggaccugugggucaaggccguccucugccguauugugagugugaggucagcuuguacuuaugcagucuugucucacaacaguuaauuucuucuucauagaaacugagguuuuacucuuggguuaauauugaguuguucugugcaauccuugccuuaccucucucaccucgagacgucccuuugaauuccgaguugaucuuuguaguugaaugccugcgucuguguggagaggcuaacuuggucuuucaguucuggaaugaacagagcuauguggcccuuccccauaacccaggucaaagcacucagcccuuggugcaggcuggaucucuugccccuguccuggccucugguuggaucccugaucggcccugucuuccccaccaggagaagcugucuuugcucggugcuuguccucucugaaggaggagcggguucaggccagccaaaagcugaaggguccuaaggugguccagcuggaaggcaguaagaagucauuccuggaggacauccguaaggugacugccccucaccucgucgccugugguggggucuguagagguccuccaauuccagccuuucccguucugucacccucucucacgucucugaggugcgaaugaaacugggacauggguguggcuacuccaccaaccacagcucugaaguccugugucacuuuccaggcccucuaugcuuccaagaucaucuccuacgcccaaggcuuuaugcugcucagacaggcagccacugaguuuggcuggacccucaauuauggcggcauugcccugauguggagagggggcugcaucauccgaagguagguaagaggcgaacccgggacugcaguacacugcccagcagugcgugccuugcccuguagccgggacagccacccugccacucaacacugcagcguguggaucccauugucaccgcuuaugcaguacuuuugccuuaugcaguacuuccuucugcauagguguccacuuuaaaacaauugugguucaaaagguuagaaaagaaugagucggaguggcacacaccuucaauuccagcacagaggcaggaggaucucugaguuggaggccaaucugguccacagacuuaaguuccaggacagccagggcuacacagagaaacccugccuggggggcaggcacagguggaggacacaaguaaacaguguguaccgcacuugcuaggcccuuuagaaaaggcagugaacauuuggagaccacuuuucucagcauggcuccccaggccgugccgggaaccugcuucacgucccauccacaucacugugagcauuguaggcccgccggacggugcacugcacggcgucugugugggugguuugauugacuacucugggggaggagcuauaggugccaggcccguguggagguaagcaagacuuguaggaauucugcuacagcucaguguaucuaucccaguuguacauucugggacugagggaauaaccagaggcugaguuuaggaagccgcugaccugcugugaguuuagcuucacuaaaacuccauuaaaccugaccuccacaggaccugccuuagccggaggaccacagagcuucuugggcucuccuagaacuagguugccucaggaagucugauucuccuccaccccagccccucagugaaguuucccuuguaaagggcugcagguccuccuuuauucacaggguucuaggucuagaaauugguccaggagcugggaguccaucuuguugggaucccuguaaccuuccuuucacaggggcuuuucuucugcugugucuguuucaucccuggaaaccccacaacagaguagccagcacccgaggucuccacaaaccagaacaccauaaaucacuauggugugcccauuacaguacccacacaucacagugcucacaccucacagugcccacacgucacagugcccacacgucacagugcuuacaugucacagugcccacacaucacagugcucacaccucacagugcccacacaauauaguaccauacauuacagugcccacaccucacagugcucacaccucacagugcucacaccucacagugcccacacaucacagugcccacacgucacagugcccacaccucacagugcccacacaucacagugcucacacgucacagugcccacaccucacagugcccacacaucacagugcucacaccucacagugcccacacaucacagugccauacauuacagugcccacacaucagugcccacacaucacugugcccacacaucacaguacccacacaacacguugcccacacuccccuccauuucuuucugugugccuucuggggcuucagguuuugcagcaagccccuuugccacugagccaugucacugucccauuaaguacuaggauuaaguaugaggcuaguucaugaggggcuugagcucucaggaguuuugacugaaccccuucucugggcuugacuccugggggccacugccuuuuuguuugauaggaggaagggccucgcacagcccaggcugaccuucagcugacgggauccuuccgucuccaccucauucucuguacuuaaaaaaaacuuuuuaaaaauaacuuuuaugugacuagagagaugacugagcaguuaagaacacaggcugcucuuucaucagagaacccagguucaauucccagcacccccauggcagcucucaaccaucuguaacuccaaucccaagggguacaaugcccuccucuggccuccuucggcacuguaugcaccugguguacagacaugcaugcaagcaacacacacacacacacacacacacacacacacacacacacacacacacacacacacacacucugucugucugucugucugcauuugcagggugguacacaugggccacaguuguguguaggucucaggagcccauuuguggggaugccagcauuuggggccaggaauggauucagauugucagccuuggccaauagcuucaccugcugagccacuucacuggcuccucaggacuuguaacggucguccugcuggcucuggggcacgggaacugugacucugcacccaggacuuguaacagucguccugcugccucuggggacggcacgggaacugugacucugcacccaggacuuguaacggucguccugcuggcucuggggcacgggacgggaacugugacucugcaccucuguagaguaugcagggcuuauucccagauguuuagccugcuacuguuuuuuguuuuguuuuguuuuuuguuuuucgagacaggguuucucuguguagcccuggcuguccuggaacucacucuguagaccaggcuggccucaaacucagaaauccaccugccucugccucucaagugcugggauuuaaggcgugcgccaccacugcccgacuccugcuacuguuuuaagauugauuucuugcaaacuauuucaguguguuccugggaaaaauuaaagaugcauuugagcgaaacccagaacuucagaaccuacugcuagaugacuucuuuaagucagcaguugacaacugccagguacgugguuggcaauggguggugcugugcucucugggucucaguagcauugacgucccugaaguguguccuguagaccggaaccucagugucucuagggcaaacccagcuccugaccuucugcucucugcgcucaggacuccuggcggcgggugaucagcacuggggugcaagcaggcauucccaugcccugcuucacuacugcccucuccuucuaugauggguacagacacgagaugcugccagcaaaccucauccaggugagcguggggcgggugguaccuucaccuggcugguuccgugggccugaguaucacccugacccugaccaacugcauuccucccucaggcucaacgggauuacuuuggggcucacaccuaugaacucuuaaccaaaccgggagaauuuauccacaccaacuggacgggccacgggggcagugugucauccucuucauacaaugccuaguaggccuguggcuugcccucccucccagcaauaggacagccccguggcgcucagcacccccccuuugcccuaguuccugcucuuagccaaguguuggcugugauugcugaagaagucaccgaggucuauaguuucugaaccaccacaugcuccaccuccgucucugugcugcccaggaccugacccugugcugccacugcgugaccugacccugugcgccacugcgugaccacucccugacugagccgugccauguggaccagacaagcugcagcucuuagcucacagagggggugggugugugggaucguacaaccuggacguggaccaugcgugugggcucugcuguccuccagucagugaaguguauaugguuacacucucugggugugccuggcagaacgaucugcacugaguucacuauugcaaauugauuuguuuuccuuuagccuuguucacuuuuaacuccggcuuuuuuuaaagacuccaaauaaaacaggacagguagugaguaaaucuggagggaggugcagagccgaggagucggugggcagaggcucuccugucggguauuucuuacuggcacaguagguaccuggauguucacagagcauccgccccgucccacuuguaauaaacuuuuagacugguuuggcuucu

SEQ ID NO: 2276 - RNA, 2431 nt, Mus musculus
cagggcugaaaugaagccccuuaacguauacucuaaaauguucacuucaagauugcucucuucugauuacacagcacauuuggaucaggauuugugacacaauuucauuguuacugaauuaccuguuuauauaucagaaaaguauaagguaacacauuaugauuuggaggacauuaaguagaguaauagguaaaagaugcuugcugcuuauaaaagagcuuugaggcaacauugagggagcugggggcuccugagaacugugacugaggcuuacugugaccugauggcugaaacuccuggcccaguccuguuccgagguugagaaugggcaguguaauggagaccccaccccaguaaagagcugagguaccugugggguggcagugcgcagggagcugagguccaucugcagcugucugcacaugugcagcuuuacuguguauuccucuccuucucugugcuuccucacugcucugugacaggaaucacuguguugccuccagcagggccacugucacacgggggccugucuacagacugagaucugggucuuuuccuguuucuugauaagcagaugucagcauagcagcagaugcgagcgagcgggaagcagcucaccgugguccacauuccugcucccuuagggauguguaaaggggauuugcuagcaucuccuaccaaggcugagagagcagccgguuaaagguguuggagaugugucucaggcaccugcucagcugugcuccugugauagccuggacauagacaagccugacuguuuuccaaaagagugaccacauucaaauacaacuuuauguguggguguguuagggacgguauaugcuaugugcuugccagcgccuuuggcggucagaagagagcuuuagacucccuggagcuggauuugccuacucuuaggagcgcacugauauuggugcugggaaccaaaguguguguccucuggaagagaagcacguuuucuuaaaagccaagccaucucuucagcccgccugcauuucugcccuccuuccuugcucgcuuaagcacuuuuucagcccccagcuuuccaacacugggcuaaaaccaugauuucuacaacaggaagcucaggagauuuuuuuguaugaacccagucacugcaugaggaccucauuaguuaaggaaucuuuuugcuggucaguauuuaaugucuggucuacagcagcugucucugagcucagaagccauguuugucccagcugcagcagguacuguuggccugccgacucuugagggcuauuuguccuuaauauucugucaguuuaauucaucacaguggcaagacguacgccguugacaaaugucaccgucuucucucucuucaguaaguagauuagaacaacacgugccugacuguuggggacuugagaaguuuauggggaaauguggacaugaggcuucccagccacagugacaggacagcgagggccucuguccucucccugcuucucagugacuuuggagugaugcucuaagagaaagugucucuuuccagaagacuucugugggcguucaucucuaugcaaucagaccacuccauuauagggguuuucagaucaauggcgggggagauguuugauuccaaugcuuucucuagcuuugugcugcagcucagcacaauucaggggugcuuugcagauugagcagcccauucccacugggguaggagcuucugggccuggacuuugcagcagcuuggaccguccuguuguccuucauuuccuaggagcuugguccccgauuagcagccaugcugaacuuuaaccugcagcagcucugcggacccaagugccgggaccugaaaguugaaaacccagagaaguaugguuuugagccaaagaagcuguuggaccaacugacagauauuuauuuacaauuggacugugcucgcuuugcuaaagccaucgccgaugaccaggugagcacugaggaggcccaucucaucaggaggccuggcacugagccgugugguuggcaucuguggucugcaccuucacagcagaccuugugcguguguguguugucgucccccuccacccugugcguguguguguguguguguguguacuccacaccucaaaagagguuaaagcaggaauuuuaaagucucguuuucagaaguuguuaaugcagugaacaugaagucgaggaccacagcugguccaggagaagaacugaugcuuccuugggagaauagagcagagcuggcccccuaaucccucagacccccaaacagauucuguuuccaaacucuguuugcugugucaggaaauugcaggucuucccaagcgcccugcuuaccagcugccaugaauacauggccuucaagccaacgccugccuccucuccuuuauccaagagccuugggggucaggucagcucauguaccaca

SEQ ID NO: 2277 - RNA, 447 nt, Mus musculus
aguuuuucucacccgccuggaaaaugucaaguagacaccgcuaacuggccagcaagccugaagggucucacugucaccacuaccucagcagugggauuacaacugggugccacccugccuggcuucagccccaccccccaggggaagggcaaacagcuggaauggcagcuacagcccagcaaguucccucugggcugcugcugcacuccgugccugguggagacucugcagugggcuggugagcugcccacuucuccugggcuaagaaugagccuauugagaggaagcugcaccaggaagggcccaggaacagccaggccucaauggccucagugugagucugaguaucccaucuuucccuugcagauauuaugcaggcuuggucugaggcaagacagauggacaggcugaaacuuuaacacaaccgauuaaacacaauuuucuaua

SEQ ID NO: 2278 - RNA, 2975 nt, Mus musculus
caucgcuuuccucuuaauggugaaaggcguuagagagauccuucaguucuugagaccagggcgggagcaaaggaagaguggaagguaucuaucgggcugucuggucccccaaugggggagguuucagaauugcauagucagagguuaaaaacuaagaacacgaggcacugaaucgccuuggcuucggccgcucgcaccgccgcagccuccuccagcagcaagcgcccagagcugccgccucuggccacggccaccgcuaugggguccucuccaggcgccacugacuccccucagcuucccagguuacccagggcgggcggcgcggucuccagcucggcucgugcccgcugcgcgccgugucuucguggcggugacgcggcagcugcguuuuuuucucccgcagacccugcuccgggucccaccccugggcccaggcgggaacagcuccacugcacacuggaugcccccgaggcgcggcgacccuacagcagcccaggcagagcccagcaccggaccgggaagccccuccccucuaaaagcaggccaggcucgccccgccuccacgcgagaaccccgguggggggcaggggagggacgggacuggcgaagcccucgcuggaagcguaaauccuccuaccccuccaacccuacucuuacccccucgccccaccaagaauuauucaucaaaacaacagggcggccaucuuugaaaggggucacgugacccucgccggggaggcggggcuucucgcucugggauucgccagccaauaagcagcgggcgucgcgccgccgauuuccucuucgcuugcauccuguccccgcccccugccccacccccucuucccugagcggcgccaggcggggggaggggcgagaggggcugcuaagaggagacgaggaggaggcggggcggacagucaccauggagacugagcggaggcgaggggcgcggugggcggggcccagguagaauugcugagggcaggaugugccaauccgaauauggcccuuccacgggcucuccccugcgccuuggguuucugcggugcuaguuuguucccauguggauccugcuguggagugacuuggaaauccuccaggaugcugcaagccggcuacagacauuagaagaacugaggaaucggaaacacauuugcuuucugcagggagcauuuagcaccauccugcaaauaccuugucccacucuuuuccucccccaggaaaacccauggaagaaaacuaacaggaucuuaauuuuauuuuaccuuguucuuuuagagaggugcucugcuuuaaggguguagagacucaaauuauugagaaauguauugaacaaugacuuaguaacuaacccuuuguaaugccagcucggccggacaacaaaaacuuacuuuacaaucaauguauaaauacaaauugaaaaaucuaacagaaccgugaaaauccagauuuugccacaaaguauauaucguauggcuuacaaaagccauaaucaucucguucuuaauuguucuugagacagaaucuugcuauguauuucagauagccccaaauuugaaauccugccugaacgcugggguaugcaccaccaucacagauuacccaacuauaacauuaauguauguauauguguauacauguauguauuugaaacagggucucgcuggccuggaacucacagagaucugccugccucugccucccaagugcuaggguucauuaccggcuacucuuagcugaacuauaaucuuaaacauuccacuccuguuuaaaagaguuacaguugaucuuauccaaggggacaagaagugacuaaaauaguuacaauuuguuugcuacaugcuaaaaaugggaacaugacuauuagauaugcaaagagucugugaguaaaauuaaaucgcugcaggcuuuucaggacugcauucuacuuuccaggaaaugaauucuguguaagccauuuugcaccccuaguuacacugaugucaauuacauuguuuuucugaaaacaugauaauugccauguagccucagauuaaaucacacaaguaaaguauacaauggcuuuaggguagugagaguucuuuaacaucauugcucuuuaauuucagaacauuuuaaucacccacccagccauccaacacacuauaaccauuccuccucauccugccauuacuuccgauagccgaucuguccucuggcuccccggacuuaccuacucugcacauuucacaucaaauaaauugaacauuugguaacuacucuugcggggccucaacugcacugcuuuuuugggcuucagaaagauaguuuuuccuccuugaggccuugacguuugcugucuccuuugucccaaagacucuucuccuggacuuugcauggcuuauuccuucuuaguguuuagguuuuagauuugaugucauuuccucacugcugcauuaauuugcuuaucaaguauauguauggauauguuccuguuuguggagguguacaucuauguauauauguguguguguggaggacagaggacagccuuggugucaucucaggaacaccauccaccucuauugaaacacggccucucauuggccuggagcucaccaguuagguuggacugcuagccaguaagcccuggagauccuccugucuccgccuccccagccuggggcuugcaagccuccaagccuggcauuuuuacauaggguuuggugauagaauucaggcccucauucuugcaaagucagacaucaacuuguagaaauugguucuuccuuccacugugugggcuuugaggaucaaacucagaucaauuggcuuaauggcaagugccuuuaccuaccaugcugucuaccagaagaacacagcuuuuuccuuugcccaggauuggggcuauaaaucagugguagaaugcuugccuaaguauuuaugaagcccuguaggacagaaaauaauaauaauaauaaauagucuuccuc

SEQ ID NO: 2279 - RNA, 2975 nt, Mus musculus
gaggaagacuauuuauuauuauuauuauuuucuguccuacagggcuucauaaauacuuaggcaagcauucuaccacugauuuauagccccaauccugggcaaaggaaaaagcuguguucuucugguagacagcaugguagguaaaggcacuugccauuaagccaauugaucugaguuugauccucaaagcccacacaguggaaggaagaaccaauuucuacaaguugaugucugacuuugcaagaaugagggccugaauucuaucaccaaacccuauguaaaaaugccaggcuuggaggcuugcaagccccaggcuggggaggcggagacaggaggaucuccagggcuuacuggcuagcaguccaaccuaacuggugagcuccaggccaaugagaggccguguuucaauagagguggaugguguuccugagaugacaccaaggcuguccucuguccuccacacacacacauauauacauagauguacaccuccacaaacaggaacauauccauacauauacuugauaagcaaauuaaugcagcagugaggaaaugacaucaaaucuaaaaccuaaacacuaagaaggaauaagccaugcaaaguccaggagaagagucuuugggacaaaggagacagcaaacgucaaggccucaaggaggaaaaacuaucuuucugaagcccaaaaaagcagugcaguugaggccccgcaagaguaguuaccaaauguucaauuuauuugaugugaaaugugcagaguagguaaguccggggagccagaggacagaucggcuaucggaaguaauggcaggaugaggaggaaugguuauaguguguuggauggcugggugggugauuaaaauguucugaaauuaaagagcaaugauguuaaagaacucucacuacccuaaagccauuguauacuuuacuugugugauuuaaucugaggcuacauggcaauuaucauguuuucagaaaaacaauguaauugacaucaguguaacuaggggugcaaaauggcuuacacagaauucauuuccuggaaaguagaaugcaguccugaaaagccugcagcgauuuaauuuuacucacagacucuuugcauaucuaauagucauguucccauuuuuagcauguagcaaacaaauuguaacuauuuuagucacuucuuguccccuuggauaagaucaacuguaacucuuuuaaacaggaguggaauguuuaagauuauaguucagcuaagaguagccgguaaugaacccuagcacuugggaggcagaggcaggcagaucucugugaguuccaggccagcgagacccuguuucaaauacauacauguauacacauauacauacauuaauguuauaguuggguaaucugugaugguggugcauaccccagcguucaggcaggauuucaaauuuggggcuaucugaaauacauagcaagauucugucucaagaacaauuaagaacgagaugauuauggcuuuuguaagccauacgauauauacuuuguggcaaaaucuggauuuucacgguucuguuagauuuuucaauuuguauuuauacauugauuguaaaguaaguuuuuguuguccggccgagcuggcauuacaaaggguuaguuacuaagucauuguucaauacauuucucaauaauuugagucucuacacccuuaaagcagagcaccucucuaaaagaacaagguaaaauaaaauuaagauccuguuaguuuucuuccauggguuuuccugggggaggaaaagagugggacaagguauuugcaggauggugcuaaaugcucccugcagaaagcaaauguguuuccgauuccucaguucuucuaaugucuguagccggcuugcagcauccuggaggauuuccaagucacuccacagcaggauccacaugggaacaaacuagcaccgcagaaacccaaggcgcaggggagagcccguggaagggccauauucggauuggcacauccugcccucagcaauucuaccugggccccgcccaccgcgccccucgccuccgcucagucuccauggugacuguccgccccgccuccuccucgucuccucuuagcagccccucucgccccuccccccgccuggcgccgcucagggaagaggggguggggcagggggcggggacaggaugcaagcgaagaggaaaucggcggcgcgacgcccgcugcuuauuggcuggcgaaucccagagcgagaagccccgccuccccggcgagggucacgugaccccuuucaaagauggccgcccuguuguuuugaugaauaauucuugguggggcgaggggguaagaguaggguuggagggguaggaggauuuacgcuuccagcgagggcuucgccagucccgucccuccccugccccccaccgggguucucgcguggaggcggggcgagccuggccugcuuuuagaggggaggggcuucccgguccggugcugggcucugccugggcugcuguagggucgccgcgccucgggggcauccagugugcaguggagcuguucccgccugggcccaggggugggacccggagcagggucugcgggagaaaaaaacgcagcugccgcgucaccgccacgaagacacggcgcgcagcgggcacgagccgagcuggagaccgcgccgcccgcccuggguaaccugggaagcugaggggagucaguggcgccuggagaggaccccauagcgguggccguggccagaggcggcagcucugggcgcuugcugcuggaggaggcugcggcggugcgagcggccgaagccaaggcgauucagugccucguguucuuaguuuuuaaccucugacuaugcaauucugaaaccucccccauugggggaccagacagcccgauagauaccuuccacucuuccuuugcucccgcccuggucucaagaacugaaggaucucucuaacgccuuucaccauuaagaggaaagcgaug

SEQ ID NO: 2280 - RNA, 623 nt, Mus musculus
gcuacgccuuccgguuccggccucacgcgcuccgcugugacaacaugaaacugcucacccacaaucuccuaagcucccaugugcggggcgugggcacgcguggcuucccgcugcgccugcaggccacugagguccgcaucaaccccguggaguucaacccggaguucguggcgcggaugauccccaaaguggagugggcggcgcuugugcaggcagcggacaccuuaaacuuggccgagguacccaaagagccgacugaaggcuaugagcacgacgagacauuuuugaggaagaugcaccacguguugcuugagguugauguacuggagggcacccugcaaugcccagaaucuggucgucuuuuccccaucagccgcgggauccccaauaugcuguugaaugaugaggagacugagacguaaccuugcuagccgccacuuugguauuuuguugacuguguguuucuguuguacggucuguuaaauagacgugucaugugugacccccaaacuccccccagugacucaccgaccaccguguacuugagcuccauaguauauuuuuuuuucucauuaaagguucaaaaccaaaaaaaaaaaaaaaaaaaaaaagaacaguagcua

SEQ ID NO: 2281 - RNA, 18492 nt, Mus musculus
uggugaauuuugcgggaucauuuauuuauuuguuuaauuuagacacaggguccucagcgucccuugaugaccucagacuugcggauugucaaggauaccuugagccuuugauccuucugcuuccaccuuccaagggccagcauuaaaggugugcauugccaugcccagguguggugaucuaauccagggccucaggccugcuaggccagugcucuaccaacugagucacaugcccagccaaggucacaucuuaaagaauuccuuccuuugucuauucuggauaaagaugguugucacuaagcacuaaggacgugucaguucucuucauaacuagugcuaggauucuguuuuguuuucuugccuagggucaucuuugacuccuggguucaaagugauucucugaccucagcuccuagugcagcuggggcugcaggugggcaucggugagccuggcuagagugaggcugcucuuucucuuuguguggcaaaugugugugugugugugugugugugugugugucuuuugccugaagcauauauggcccagacuccacagaggacagagagggcaucagaucuccugaaacuguaguuacagacagcugagagcugccaugcaggugcugggagcugagucugggugcucuggaagggcagucugugcucuuaaccucagagccaucucuccagccccuaaagaguagcuugugggggcuggcaagauggcucaguggguaagagcacccgacugcucuuccgaagguccagaguucaaaucccagcaaccacaugguggcucacaaccauccccaacaagaucugacucccucuucuagagugucugaagacagcuacaguguacuuacauauaaucaauaaauaaaucuuuaaaaaaaaaaaaagaguggcuugugaauggacuugcucaucacguuugcuucucuugugcggcagagcaugagguccuuucuagaaaaauugauuuaaaguuagcgucauuaacauuucauuuuagugacugagcuguuauuugaaaggugaauuacauccuuuuuuuuaauggucuuauuuaaaacauucaucucagucacggaucuuaauucccuggugguuuguuuuuuuuuuuaaaucgaaccuuuaucuuucaguugaugaaacaggaugauggcaaguccuucccugaguuucgagucuccagacgagccucuggcggacgccgugcccugugucacagaguggaaugguugugcuuggccucugcggcguuccucugcagaggagccagggugaccccagcauuccugccuucgcucuccguguuguacagcucaugcuucucaauguacucuuggaccagguccgguaccaaguagcggaugcucuggccccuccugagcgcccuccggaucuugguggacgagaugucauuggugauccacucguucaccagguggauguugcucugaugucuccacagcacaucggacucguagaugaauuucugagcgucacugccagcccgagugauacagaugagcccaaaguuggccacgauuugcgugauguccuccaucuuccacaaguugggcacgcugaaggacuccaguaaaucugccccacacagcaauuucaccuugggcacaccucgaagggagaaucaagcacaaggucaggguuuguuuucuuaauaaucacccauacuaaagugaccgcgcacguaugcaagagaaguagaucuggugucugguaccccagagcccuuccuuccuuuuaauaucauggacccagcaagucuggaauaagaaauaaaaagacugggcuggagagauggcucagugguuaagagcacugacugcucuucuagagguccuggguucaauucccagcaacuacaugguggcucacaaccaucuguaauuagaucugaugcccucuucuggggugucugaagacagcuacaguguacuugcauauaauaaauaauucuuuuuuuaaaaaacaacaacaaacaccaguggggugucuuccguggaaucugagcaauuuuuggaguccugguagacaucacagaccuguugguuugggcucuuggggcuucugugggcuagaaucuugcuuuugaucagcccacuuccucuuccgcccaggcuuuuccagugcaggugagcuuuguggguaacugcagcugccaguugccagcuucuccugaugguaucuacaaaaaugacaacccaaaagcacacuccuuaaugucagaguacucucugaaguauugugugugugugcacauguaugcaacaguaagaguuaacauaacuacuuacucccuuacccagcuguguuucacacuuuucuuggcuucucaugggaaaagcgcugcccucaccauggggaagacgggacuugaggccucagguccacugcuagcagagucccgacauuggaagcaucucacacccaaugugccacugucagugucugucagagugcuuguuagcccacugagagaggagcugauuaagcuauccacaguacaacagaaccucgauguuuguuuguuuguuuguuuuuuguuuuucgagacaggauuucucuguguagcccuggcugucuuggaacucacucuguagaccaggcuggccucgaacucagaaaccugccugccucugccucccaagugcugggauuaaagcugugugccacuauugcccagcccagaacugggauuuuuuaucugacagucaggucuagagccuacacccuugaccacuaaagacugugaucuaaucuuacaaugaagaagcacauggcaaggagaggcacuggaagggcaagugucugaggccuucaagaaaagcagcccugcaggaacggggcugguggcaaaggcucacugccuuaccucagugccaugcuaccagagcaauguggaccaaaaccccagggguuggcccuucacacccucacuccccccucuuccccaucaacagccaacugacugugaggucgccaugaggccagggggaagaguggggcugaaacaagaugauggccucccaugggagaauauuuuaccaucaguagggauacugcuuuuccuguuaaccccaaaaagggagccuugguaugucauagguagcugccaucuuuuggcucaaugcccuguccuacccuaaacacuagccagagguccuuaugucaacguccaguauggcugagagucuguagauaagacucucugggaguccagugagacagaagccagccacugcagcauuccccauagcccacagcucaagcgcuuuuggugucugcggacuccaacggccgcagagggcagcgggaacagaucagauccucuccggcugugcaagggccacccgaugcuucuggucccuaacacacugcacucaaaaugcccagagcgcauccuacucuuaccccugaggguccuaagaacagacauuagacaaagguuuuucacaaaguccccuaguucacccugcagacuguaaagagaugguuagauaguacuuccuucacuggaguggucuccaaggucugagcacagaggucuggauagccuccuaugcucuucugugaggaccacacaaggucgggcuggauccuacacaagcucugccugacacuccuccuuaugaaguauaugauaagauagucauuaaaaacaaaaacaacugggcagcuggagagauggcucagcgguuaagaguuccgacuguauuuccgaagguccuaaguucaaaucccagcaaccacauggugguucacaaccaucugaaugagaucugacacccucuucuggugugucugaagacagcuacaguguacuuacauauaauaauaaauaaaucuuuaaaacaaaaaagaaaaaaaaaacaaaaacacccuccccccccaaaaaaaagcagcagcgguagguccagaauaaaagacacgugagccccucagaagauauggugcauaagcgggaggggaagagcauuagacagaaacaguaaauauacggagaacuaaccaugacaugagagggccuuaagggaaggagcugcuucccuuacaaccuggagcagagccucauuaacagugagaacuucacaaccauguguaaugggauccgaugcccucuucuggcgugugucugaggacagcuacaguguacucacauacauaaaauaauuuuuuuuuuuuuuuuuuugguuuuucaagacaggguuucucuggcagucauggcuguccuagaacucacucuguagaccaggcuggaucugaacucagaaauccaccugccucugccuccugagugcugggauuaaaggcgugcaccaccacugcccagcuaaaauaaaucuuuaaagaaagauuuaaaggggcuggcgagauggcucagugguuaagaucccgaguucaaaucccagcaaccacaugguggcucacaaccaucuguaacaaaaucugaugcuuucuucuggaguaucugaggacagcuacaguguacuuacacauaauaaauaaauaaaucuuuaaaaaaagaaaagcagagagagagagagagagagagagagagagagagagcaagcacacuucucugaggggaacgggggcagagcagccucuuuagaacgcucaguguaccucccuucgcaaaucccaagaacaaagaaauguucagacauuuauaaguuucggggguaggcuggcaggaauuuuuacauugugugauuuaauuuaacauaguguaaugacaaagaacacagaagagccaggugucacaaauugacaacugucaccguuguucagcaacuguuuagacugcuucugaacccugccccagagaaggcugcggagcaucucucugggccgugggaccuuuuaaacaaucacugucuguuagggguaccacccccuuuaagcaucuccuccccucuuccacaccuaggaagacugcacuauccucuuucccuccaggcagaaaggccaggccagcuucccuaaucucugaggaacaaucaugucggucucucaccucccugaaagaggcaagggcuuaggggcccugcucuguugcuugcucuauggccugcuguggcguguaaauaagaaugacccuccuaggcaaauauauuugaaugucuuagugacugggaguggcaucauuugaaaggauuagaaggguuuggaagaugcggccuuauuggagcaaguaugucacuggagguuggcuuugagguuucagaagcccacgccaaggccuggucuccuuggccugcugauccaucaggauguagcucuccgcuacugcuccagcgcaaugugcugccaugcccccugccgugcucccugccaggaugaugaaaccucugaaacuguaagcaagcccugguuaaaugcuuucuuuucuuuuuucuuuuuuuugguuuuucgagacaggguuucucuguauagcccuggcuguccuggaacucacuuuguagaccaggcuggccucuaacucagaaauccgccugccucugccucucgagugcugggauuaaaggcgugugccaccacgcccggcaaaugcuuucuuuucuaaguguugcuuuggucauggugaacagugacuaagacccuuggugacaaccucacaguccugcacagucagaugcagaacugaaaccauggcaacaagaacauguggacugcaccguguuuaccugagcaccuucacagucuccacccacuccuucugaagacuuucccacguauccacuuccacccagugugaguucuugguggcaaguucugccaugaugauucgguggugggcugggaugagcccuuucuucuuguacgcaucaccgaccggugagauaaugccuuugauaacacuguauuuuccuggguaaagagugauguucgauauuaggcauaacaaaucagacuuuauggacaggaaauaucaauauuauuuuauaguuacaauguccccccccuuuuaauaggcaaucggaacugugaugaagggcuagcaagagggcaugauggguaaaggagugugcugucaggccugaucaccugacuucgagccccaggacacacacggugaaagaagaauggauaucuccaaacuguccucugaucucuucaagaaucccaugucucgcaaguaaauacauuuuuuuaaaaauuagaaaagaaacucuaauaacuucuaauauuaugaaguuaucgccugaacucuuucagguguauaguucuguaguguggagcucaugcaggcugcuauacaaccuuuacccuuuccagccucagaacuccaucuucaccaacuaaagcccuccaccccuuacacaccagcucugaguucccuacaugacuuacaacucugguggauguugcuguuccuugcaaacgccugagucagucugcaguguucaccuagggcagcugaaggacucccgcucgcugccucuaggugcuugacaacaucaagugagcuuuacugaccgagccucugcccagccuugcuccuucuuauauagaccaggcuggucugaaacucaaagagaucaccugccucagacuuccaugugccgggaccaggcuggucugaaacucaaagagaucaccugccucagacuuccaugugccgggaaugcaccaucacacccggccuuauucacgccuuccuguuaacauacuuugcaacaagcaccccuaccugcagagccaccucgcuggccccauuaaccuuuucuggcuaagucucugugccuggaagcagggcaagcuccuuguguccaggaucgggcauucacauggacucggucuuuaauuagcugggucgccgcuccuaccuguagcaugcauauaguccuuggccagcucgaacagccugaggugcauguuggugaugggguuaaaagagccacaggccaggagaaccaccucugucuucuuggaugaguccauggggagaaguuggugguguugaccuacaugcaacccucugacagcgauguugucuacaaaggagaagggacacaugcucauuuacagaucucuugaagucaacaugcucucccugcagacaggugggcaaauacguggcuucacagacugagaggaacugcaacacaggcugcacccucugcucuucgcuuccaccaggaugcaguuccucccagagaggaacgggacacaccucucucucccuaugauucgauuugcccaacagaauacggcguaaaagauaaugcguuaguuuugagccuaguacuuagaggcuaucucagagaugguuuccguuguucuauuaacauauaguaacauacuaaagagcgaggccguggugacccacgccuuuaauuccagcacuugggaggguucgaggccagccuggucuacagagugaguuccaagacagccuggaacagcuacacagagaaacccugccucaaaaaaaacaaaaccaaaaaccaaaaaaaacugcucuccugaaaacuaauucacucucaugaccuucuugcuucccacgaggcaccucuccucuaaggacccggcaccucagcacagccaugcuggacaccaagcuuucagcacauggacuccaaggauacacuccgacagcacuuaaacugaagcagagaugucccuaucuucugcugcugccucuacgcuagacugcucugugaugacagcugguaccccagcugagaagacaacuagccucuugauaugugacaggccaucagaggccagccaagcacagccaagauccucagugccacagccagcccaggagagggcagacgcaccugauggaucucagcaaaucgaugugagguuauuaaucucaagcugaaacgaguauuuacugauggcugucaccugggccuugugauggaauguuaauaaaguaauucacagagcuggggagauagccaaguggcaggacacuugccuaauacagaugaggcguuuaauccucugcacagcaaaacaaacauaaauaaacagacaguaacucauaucgcucuugaagaaacaagaagcuacggcaggcagcgggaauggaucugagcaugccugaggcccucaaaccaaacaguuuuggaguucuagcugccugugaggcagggaccugagaggagccuggacaagcgacuaagcucucaucucaaaaaaaaucuucccaaaccucccaaaacaacagggguuggguucaagcaauaaagggcuuguuaggcacucaaucacgagguccugaauuucaucuccagcaccuacauaaaaaaaaaaaaagccaggcacagugggcacaaguccauaauccaagcacugggcagggcaggcagagacaggagacuaucaacggaucucuggccagccagucucuccaaauccauaaucuccagguucacugagagacccugccuuagaacaagguggggagggguuaagagagcugacucuaaucucaggcuucacuugcacgcacauacaaccucccccuccccacucugcgcaugcacacacauugaguugggaacgcacaccuuuaaccccggcccuggggaagcagagcuagccagucuagcucaaucagcaagcucuaaauucuguauguggccccaguucaaaagguaaggugggcugggcagugguggugcacgccuuuaaucccagcacuugggaggcagaggcagguggauuucugaguucagggccagccaggucuacagagugaguuccaggacagccaggaaaaaaggaaagguggaaagcuauuggggaugacacuagauauugagcacaggcuuccacauguucacauacacacaugugcaccuucacaggccaaccaauaaaaacaaacaacaaaagacagggaaacugcuaaauguggacagauauugagacuggucguugauguucgguguacuguuaguugggguagggguuggggcuagcgauuagucugagcgcuugccucacgugcagccguuggauaccaaacauuugauccccaguggugcuccccucaaccccaaaagaagaaaaggaguuguuaaacaguaaggcuuucaaggucucacuucuuucuccuuacgaaaccaggguuugcuaaugccagcccugucccuuccagcauuaccucuauccacuucccauacaaagugccuguugcagagcugggagaaacagaagggccauaaguucaaggccagccugggcuauaggugacccugucucuaaaaaaggcagcaucuccacagaacucuagucuacagaggaacuggggugccugccgaccucugagcaagcucuccaggucuuguuggaaggucccucaugccaguccugagcacacccaagucagguucuagacgcugugucccaagggagggcagaguggaaggagguaagguguggagggaguccagagacugccuggggucuggaaacagagagaacaaagugcauugggacccacccugugcucuggggagcucggguucccuuccauccccagaggaggaggaggcugcuggaagcugaucucucaguguacaaggggcagucuuuguccuuugucacacuagugaccugucucagauauccagccaucucagcuaggcucucaacccuccaagcaacagaguuaaguuacagugagcuccuacaucguguccugucccaacauggaggugacggauggguguggaaucucagacagaacuguucugaacgccgcggcuaccagaccagugucgccaugauacacuuguguuugguccacacagccugucaccggcacugcuggcugcaucggcucaggcuguaagugccgccaugauucacuuuuguuugguccacacagccuaucgccugcacugcuggcugccgaggucgcaccgccucaggcuguaagugucccuccccagcgcuuuaugucaaaaagcucguagcuuucuggggcagucuuugaguuuaacugaaauuuacuucuacagcacccaucuuuugaguguaaaagacacugugaugcaaacauuaacucaugacuacaacuucagaagagcacugugacucugcaguucuuucccgucuccagucgcccagucuaaagccacauuggccuacugucaaaugacggguucggccagaccaccucucacaaccgcugcuauuucuuuugaacugguggcuuccuauaucuuguucugaugaugcuucaaguguuuuaaauaguguagauuuugaaggggucuguuuuuuaguaccucaucugaaagugcaguaauuauucucuaugagccuccuacagucuucagccccaagcccuacuaaugaaaccacugaggugaauagggcccgggggugggguggacuaguauuuuaugaugaagguuuacuuacaggucaccaagacaacacaaagaauucagaaaacgcgugcagcaguuagcggugauucucauuggucugcaggcugacucgguucacacucaguguggcucacccugccuggggcaaggguggcuugugggcucugagccuagguaucucacugacugcugcugucuguuccuugaacaacucaaauuuuucugagccuuggcuucugcguuauuaacauggggaccccaggccuggugacaagugucucugguaccagcacuuagcaggcugaggcagaaagacugccaaaacaaaacaaaacaaaaaaagguauucauacacuuaccuaauugcaaauauuaaguucugugguuugguucuuuucuuuucuuuuuuuuuuuucuuuuuguuuuuccgagacaggguuucucuguguggcccuggcuguccuggaacucacuuuguagaccaggcuggccucaaacucagaaaucugccugccucugccucccaagugcugggauuaaaggugugcaccaccacacccggcuagguuauuuucuauucuuacuuugaguuaauacuucuuacuguaauuuguguguuguuucauaccuuugacugaaucaugguggagguucugcaggcugccuugcgacugcucucggcggcaccugguacaaggucggggcugagguacugacagcugcguguuauguuucacuggcgagcuagccauccaccuuuugcuuaguuuaagaccgaauuugaaucugguuccuggaaguccuaaaggugccccucccuguguccgugcagccaggugacagugcuccuguuggggaucagcacccugacccuccaguucuacgugcuguuacgguaagucagcccaggcagccuuaccugugggagucaugcgggugcucccugggacuccuguuacacgccuaacugccgccugccccauuguuuccguuccuguuacugguggcagacguguccgccccuucgcauaccuggaaaccucagugcaacaaacguugcagagaaucgggcagauucaguuuaaguuuuaacaaacauuuacuuccauguaagaggucauuagaugggagacagugagggcgucaccaauaacucaauugauggauucccuagaguccagucccaagggccuagugugagcuaaugucugcagggccgagggcaaggcaugcacgcucagucaacuggauucugaacugaugugcgacuucagauucagggugggagcuuagucugcaagcuagagacaaccggcacugcggaagcaaagcaaacacaaccugcuugcccaaaauaaagagucucugucuuaaaaauguggagauucuacauaaaucugaaaacugagaagccacugacgugaggauaaaaagaggaggcccgagcuggugcuaaacgcauagcgcaggucuagcacaggucugugugugguacauuguaauucuuuacucccaauggucagaauuucuauaacauacuuuuaccaaaaccauuaaauuaggauuacauaacacgcaugcucauuaucaggcugccaggagccagacagagcaugagggagcuccuggugugcccaggccuuggagaauucgcugcugaguaacuguggauugcuuuucaggcccagguccucccgguucugcagccagccccuccuggccaaccuggucgguagcauggucuucacccugcucacacuugguaaguagguguagaguuaccugaaagcacccgguagguguuauuauuugauacacucuguagggaucaaagaggcgaagagaagguuuucugcucuguauguguucacacaagagaaaaaccacacugaaaagucugacggcaggccuggguugcagcuccauggcacagagcuuaccuaguauguaugacgucuggguuugaccaucagcaucauuaaaaaagaaaaaaaaaaacuuaaaugaagagaaucuuuaaauuuuccugggcauuccuuauaguuauccuauaauuagaaugugaaaccugagaccaacucuaguaaaauaaauuguauuuuuuuuccuuccuuccccuaacucgauuuugggggugggguugggguguuugguuuuuuguuuuguuuuguuuuguuuuguuuuuggagacaggguuucucuauguagcucuggcuguccuguaccauacaccaggcuagaucuagcacucgggagagggaggcaagaagacagugagacugaagguagccugggcuacgggaccagagccuguuucaagacaggaaagcaaaacagcaaaaaggaaugugcgugcgugcgugcgugcgugcgugcgugcgugcgugcgugcgugcgugcgugugugcgugugugugugugaggcgaucgagccugauggccgugggcacuuccuugcagggcucuuugugcugcucacucagacggagcuggccccguuggcucuaaggacagcacuagcgguauuuggcguggcguccuuuggugaaggagucugcgcugggcuguuaacacuccuggcuucagacugcguaugcuuuuuacuauuugugcauuaauuuacccaugugugucauugcaugcaugccacaauauccgagugggggccagaggacaacuugugggugcugggucuccucugaggaucaaauucagguuauccggcucagcagcagacuuccuggcgagccaucucaccggucccuguuuugguaucuuacucugaacaauugguuacauuauuuuucuuuucuuucccuuuuuuuuuuggggggggaagggaguguguguugagacaggguuuuucuguauagcccuggcuguccuggaacucauucuuuagaccaagcuguucuugaacucagaguuccaccugccucugcuucccacucgcagggauucaaugucgagugccaccaacacccagcuaccauuacuuuuuaauauuuauuaucuacuuauguugaaaauagagauacauaggcauggaauuuaaauaaucagauacaccacaguuauucuagaaaagucaaagcuuucugggggccagagggagagcuccaugggaaagugugagaggaccugaauuugacccucaaagcaugggaaagccggguaugggguacaugugguacuuguagucccacuguuggaggaggggaaagacaggcauauucuggggcuuaaaguccagccaagucuaacagguugagaucccaucuuaaggaggcaaauaacauuccugaggaugccugcuucuacauguaaguguacacuugcacacacauguacacacauguacacacauguacaccauuuuguuuguuguugguagugacggugacuuugcuuuuguugcuuguguuuuugagacagggucucucuauguagccuuggcuggcuuagaacucagagaucuaccucuaccuccagaguguugggcugaaaggcaugagccaucacacucgucaugagauuuucuuauugugggugaaucccauguuaauagaaaaaaauauguauauguacauauuuuaaaaagaauucuuuauuuauuuuaguauauggguacacugucacugucuucagacaccccagaaggcagcaucagaucccauuacagaugguugugagcuaccaugugguuuuugggaauugaacucaggaccucuagaaaagcagucaguggagccaucucuccaacccgaauuuuaacuuuuaaaaaauuuaaaaaguguaucacauuugugugugugugugugauguguauauggaaacauaugccguggcaagcauguggcggacaagucuauggaguagacaaggcuaugcucuccuucuaaccaggcaguauugaacucagaucaucaucagguuugguggcaagcaccuuugcucacuaagccaucucacuggcccuaagaacauuuuaauaauauuaaagacaguaaaugucacaagacacauguagcacacgugccugugacuguggggcuugagaagcagaggcagcaggauugcaagaacuagggaagccugggcuacacagaaacacuaugucacaacccaaacaaagcuaaauguaguguaccccuuuaagcccagcacuugguaggcagaggcagguggaucucuaugaguuuugaguccagccuggucuuagugaguuccaggacagccagggcagcacagcgagacccuuguugaaacaacacaaccaaaccaaaccuaaaccaaaccccacuggcuaaagaacagagauauuucugaugguguuuuguuucucauacaggagaaaaccaccccugaacuuuacuaccuaucuguggugcugucagugggcagccugguauccacgggugagucaaaacaccucccaagccccuauccagacccccuugcagaccccucaagggaagacacugugugagcucagaggccccagcuccucuuacugcagaacucacagagacagaguguuaaagacaggaaagggaggcuuuggaugggauguaaagaaacuuccugggacgcagcucaguugggaagagugccagccagcacagcugagguccggggcucagccaccagcaccacccuaugcccagguggugacacacagguuggcagucccagacacuccagaggagguagaggcagagauggagacaggugguuuucugugagucggaggcuagccuggucuaccuaaugaguucuaggaacuauguaauagagaaacccugucucaaaguuagaucuuccacagcagcuuuaguuagcugcauuggaucugcacaggacugggccucuuaacaucccgucaucauggccagaggagggggcucauaaggccucaccccuucccuccccagggugcacacuauuggcaguuaaugguagcuggagagggagucagauuuuucuuugguuguaggcacugguaaggcgccuugcucacacaccuccucaccccccauuuaugcaggcaacauuaauuaaagccucuaggccacaaagaaaacaaaacaaaaaaaagucauggaaguugggugggauguguuggggaagaaagguuuugaggugggagaggggguaaggcaguacugcgggaacacgaucaacaaacauuuauauaugccauccccuuguguaugaacuuuugaaggaauacguuuuuaaaagcauccuucucaccugaguccugcuccaccuuauuagacacugugcucuguccugcagugcuuuuuucuggcauggggcucaucuggcuguccaaagugaccugcccaagaccagaugcuaagccaacagucugaagcuagcccauagguccugcugguuuccugccucauuuacacaccugggcugacugaguccgccccagcauuaccacuguguaccgucaagcaucucacaagaugaccuagcugccauuucuacauaaaaugucugcugcacaucauaaccacgcaaaaagcaugccaagacuagccaucauagaaguugcuuaaugagugcugaagaagcgggaaacgauuggucaacugauaccacaggaucgccauuaaaaacaccuucauacgaaggaggagugagugucuacacaauacucucaagauugcuacaaugacuuccuauaaaccucggaucuuauaaaauagggacauuagaaucugagccgaugacaccggcagaaguggacauugucaaaagaaaucgcucaucucagcaaagugaagcuucacaggaaaacagucgugcagaccuaagaucucaccaagaucaaucuauacauucuuuacguugugggaacuuuuggauaaagagaaucucuuuauggguuacaacaaucuuucauauuacuacagccaauuauuuuguagaacauauagccagugucugagccucacucugcugcugugacaaaacacucugaccaaaagcaacuuggggaggaaggguucuuuugccuuauacuuccaggucaguccaucacugaaagaauuggggcacgggcucuaggaggaaccugaagcagacacuacugaggaaugaaugcugcugccuccuggcuuaaacucagucuguagaccagacuggcccugaacucagagauaucauuccaucucugccucuuuagugccaaugcccagcaccuaggaagcuggcuuucuuauacagcccaguacaucaggguggccucgaacucagaaauccaccugccucugccucccgagugcugggaucaaaggccugcgccaccacgcccggcuuaacuaugaacuucuaacaccccccccccuucaacuucacaaaggcaucacuguaagcuauaaccuuucgauuucuugucuccaaagucccuguuaacauuauaaaacaaaagcauagaccaacuuucaaaauucucagucuuucaaaauuucaaaacuuuuaaaguuccgagucucuuuaaaaguccaagucuuuuaaucaugagcuccuguaaaaucaaaauaaguuucauacuuucuaaucccaaaagggcagaaccagagaauaggaauaaucacaauuaagcaaacccagaauccaacaguguagcucaauauccgacauuugggacucaggaucugggucccaaagggcuggcauagcccuuucuccacucagcucccugguaacaguuuacaguccacucagcagcaauuuaacugguucucaaaggcugugugggcuugcucuuucccagauuuggaaacgacuaaaagggaauguccuucucagcacuggcuuucccccauugccucucacccacaucccucuaaguucaugggcgucugcucucaagaaaucucuagagaggaagaauccaggccaccccaagugggggaacugaccugcaccaaggucacaggaaaguuaccaacuuuuugguuccaagaacuaaagggcaagaguugacuaugaagagcuggccccagggaccguuacaaaagucucuaaaggcccagccauugugcauugucccuugcuuggcaaaguacgggucaccgggcuaacgcucgcacaggcucgucuccuaggaccucgguggguugcuuaccaggccuugaaggccaaacggcccuaguccuccaggagacaaccucggcccggacgccagcgcagggaacaccgccgccuugcucucauuggccccacacagccggaagugcgcgaauccagcggaagugcucgcuccaugcgguccgccaggccggggagucagguaggcggggccccugguuccaaacccugggauccgcuagcgggcggcaggcggggaucgggagggcgaaggagguuguccuguuuuccgaucagggaggacggagaagcguuucgcaggcguaggacuccccgccuccucaggugaccaccgggccugcuggagcccggccuuggcgggaccugcacaccucggcgggagcuuggaguucgucuguccgcggggaggaggccggcauccgagcgugcgguccggcucugccuuauuuuugcuccgguggucccgggcccgggcuuugcucaccuccgucccugagaaggugugcuuucugcccuugccuucucgugcgucugaguuggacaguuuuccucaagccgagucccgagugcuguggccucacccagaggagacucggcaaaagcuacgggaggcacagcccagggauucaguggccucucccgcgucuuccuaggaauggagaacguauuucaguuacagucugcuuagcgggaagugaucuggacagcuguaggccaaguucagacacagcaaauaaaacucuuaacaguuuuaccuuguucuagccagcuccaccccaggagguuugaaguuugagccuccgguaaacuuuaugacaacuucgcuuuccucaaauugaugacacucagagcuccgacaguuggcgaguuuugagcaccgugcacgggacaggauacuggaaccccggugagcgugaaugaauauauuccacuccagaugacaguguuggccauuucggcagucuca

SEQ ID NO: 2282 - RNA, 1286 nt, Mus musculus
agauccaaacauuuuauaaagccaaaggugucaguauuuguagaaagaaagaaaaaaaaaggggugauuggugaauccuaaugugagggagacagucucauguaacccaggcuaaccucaaacuuaccagguagccaaggaugacccugaacuuuucuuuuuccuucuagacaagguuucuccagguaguccugguuguccuggaacucucucuguagaucaagguggccuugaacucacaaagguccaugugccucuugccuccugaguacugggauuaaagucguaugcuacuuaggaaccaacuuugaauuucugauccuucugcuucuaguucccaagugcugggguuguggaaggcaccacuaacaggagaucaagcccagggcuuccugccugucucacgaggacucuaccaaccgagcuccguccccaguucuaacaagagaggauugagguucaguuagcuauguggggagagcauuaacaacaacaacaacaacaacaacaacaagcccuaaaaugagagcaagcucagaguguuuggaagagagaggucaggaugccagagacuggagggagcgagcagggguaaugggaagaggaucagagguucaaaggagcugacuaccaagggcagcacugggccagaagggaauguucaauucuaaugggcucccagggcaccggauggaggucugcauggccuuacuuguguaacuacaggcaccagaagaagcaaauggcuguccagccuuggagagccauuggaacuggagaccagcucacucuuuguuagaucaggcauaggccugccuccuagacuucaaccgcuuaaaagacgccaaaggcaacucaagcagaggguuguucugcagaaacaaacaaggccgagccacccagagccugaagcaccgugguuccuuccucauacauggagaaggagggaacucugccaggacacaggcugaccgggcagccgccucuggaaugcuacagaguggcuugcaaagcugccacccagaguggcucuucagcguauugcguauauuucauuaucuagauaaggcaaguuagggccagacuuaaagggagcagagaaauacaaucuauauggcuagaaguuacuuaaauaggaauguuaaagaggaauuggcaauaaugugucuuacgggcucccugaggcucagacgaaaggaaagguaugggaaggagggggagguacaaacccagcccugacucccggugagucugaugcucuccuuggugccccagucuuccccgug

SEQ ID NO: 2283 - RNA, 62474 nt, Mus musculus
ccgcccccggccggguacccucgccggacccgagagagagcgccgccgccaucuuagccgccgccgccuccagcgcagcgcugccgacgaggggagggcgcgcgcggcccagcagcacggcggcugccguucccaucccggugcucgccgcgccgcccagccgccggcccccggcugcccgcgccccucucggcgucccgcgcgacucccugcugcuuccgcgucgggccggccguggcgccccgagcccgagcgaugcugcgccgcccugcgcccgcgcuggccccggccguccggcugcugcuggcggggcugcugugcggcggcggggucugggccgcgcgagguaagcgacggggcgcggugagccgggugcgggagucagaaccgagugcaagguugggccgaaugcagaagucaugcggggccgcgggguucgggucggggccgggugcgggaaccgugcucgggugcaagguggggggcugagugcgagggucaugcggggcggcgggguuaugggcaagugcugcaguccuguagggccucuggguucugggccgagugcgggacucgugccagagcccaggguucggguccuagugcgcgcauuguaucaggcaagguucggguccgaguguggggaucgugccgaggcccaggguucggauacgagugcgcgagucauauugggcaagguuggguccgaguucgggcauaguaaccgggugcaaggaggugggcagagugcaggagucgugcagggccgcggaauuuggguccgagugugggaauugugccagggcugaggguucagguccgagugcgcgcgucguauugggcgaggcucggaucccggugcgcagaucgucuccagcaagguucggggcccagaucguaucaggugcacagguacaggacccagugcaggaauagugucagcgcacagggaucggugccgagugagguaguguugcuggggcgcgggguuccgacccgacugugugacugauugccugggagcggggcucugggcugagugcggaacaucgagcccgcucgcuacgugagauucagguucaggcgcucagagaagagcuccggagaaccuaggcgcgcgcugcagaugccuggggaagccaauuuuguacccgggcggggcaccugggccaugacugcccuaguuguagccccagggugcuugaggugcuggucuggggagaucuggggacacgcggugggaguuagcccacuuuccaguagcgcaugcagccuggggggugcgccccugggugggaugcaguguacguguguuggaugaucagcccagggaugcacgcaaggauuuuggugugugcuuacauaagauuccacuccuccgcaucacuuucccaagaucccgguucucugcugcggcuagguggacaccacgacuucgccccuuuucgccuccucuccgcguccuuuaaacgcgguuucggaaguaacagaggcgaaaacuccucuuccuucccacccuuuugcccaaagacgaaauugagaagguguuugugaucacuuuucauccaccagugugaacaaagcgcucguccgcugcaccuuuacucagaguaguguaccggacuuguaugaccaccacagagaccagccagccccgcuaauuccuuaggagugugggaggcaaauaggauuuugcuguuuuaaaucuucauccacuucaucuaaacauuguaccugccuucugauauugaccgagcuugccaccaaaacugcuuacgcauugcagauaaagccuucugaauggaacuugaaaccguaaacauuuuuccuggucuuaaaguagucuagguagauagucuguagagagugcucgaaucuauuuucuucaaguguauauuuuggaaaucaaaagagcuuugugggaggaggauugauagaagucugggugagauggucacguaauaacuuugcaagcuuuaaaaaaagauugccuuuucugcuuggccugacuuaggaaaguuguguucacaaaaaagggcagaagagggcaaagcauccuuuguuccagcgugccacacagagggugauaaacugaaaacuucuuuuauuccaucuagaacauucuguccauucuugucaaauucagcuccuugccacuaaguaucuaauuaccgugcauuugauuuuuuuuuuugaaaaguuucagcaaaccaaguaugaaaugagguuugaagccuggucuauuuaagaggaagaaaacuugguuuugcuucuuuuggaaaaaaaaaccagcccauacaugaaaggaggggagggcuggguuggguauuuuggaaacaguucaaguaauguuuaguugaguugguaauagcaucgccugcuugaauuacugcuuuuaaggugucuuccugcaucuaccuacaguacugcucaucuuuuaguuacuuggguaaaccauggucaggcucaccugauuacccucauuauggcugagaggaaugugaaauuuccaacgucuuacaaaguaaaaauguuugaacaucaguuuuucuuuugcauuuaccguuuuuuuuccagcuugcauggucaugaauauuccaugacaugcuaauaaaacaauuucaguuugaaauguuacaaaugaguuuuauauguaaauaugcgguuucuggaggcacuuucccugggcucauuauuccagugaacaucugaguccucccugcaacguuggugcuggggacggagcccagggcccgaaggcuggacaggcaucugcuccugagccacacugccccuucagcauucccguuuguuucuuguugcaagauggaauggcauaaacuguuuguuggucagccuccauaugccuucagugaugaugagugagauaaaggucauaugcggacuuauagugagaaugacagcuauccuaauauaaaauugcacuggacuauuaauuagcuguuguuuguuuuguuuuguuuuccccccuaucuuugagauagucucacucuguagccaggaacuugcuaugugggccaggcuggcccugaacuugugauugccugggcucuuuccccauugcugagcuuacauauaucgcaccuccuguuuggcuaauuccguuguuuguuuguuuuguuguuguuuuuaaguguacuauagaauuucacuuuaauuuaaaaaaucaaaauacguacaucaaaauauuagaagucuccucugcauguccuggauggucaugucugcagcagcuuaucuucuguccaaggagauuggaaaauacggucaggaaacaaauugagugcagaaguugaaagcuacaugaaugugagaucugcugguuuuaugcuugcuugcuauuuuauuuuauuuuauuuuauuuuauuuuauuuuauuuuuuugagacaggguuucucuguguagcagcccuggcuguccuggaaccagcuuuguagaccaggcugccucuaauucagagauccuucuauuuaugccuccugaguguugagcucaaaggugugcaucaccccugccuggcaaaauuuucacacagacuucucacagccuaaaauugaaauacuaaggguuuuguuguuguuguuguuguuuguuuguuuguuuguuuguuucuguucuuuguuuuugucuucaaagucaaaaugccacaguaaaccauauauuagaagcaccuaagcccuccuccuuguccuguuugacagcuaaaguuucucuagagacaggugcugacuuggggauuuagcccagggucuugcauguggcugaagaaacacacccugagcuacaucuccugccccucaccccucuauuugacauauucuccccucucucugugaacccccuauucucccuuucucuaucucacuugcucauuuuugcauaguguuuacuccauuaaauuuuuauuuuaaauauuuauucacuguuacacauucagccacuccagaagagggcgccagaucucauuacagaugguugugagccaccauguaguugcagggaucugaauucaggaccuucagaagagcaaucagugcuuuuaaccacugagccaucucuccagccccuauuaauuuuuuuuuuacuuuuuuuuuuuaauuuggggagaggggagcaugccaucuggccaucuugcuagccccuguuaaauagguucuuagaaauaacuuugagguggggggauuauuuaaauacagaauuuaauauuaucuuuagucaaacauuuuauuuauuuggaccuguaaaugcagaagaauuaauaaaauguuauuaauucuuagcugucaugacagugcugggaauugaacucagguccccuggaagagcagccaguguuccuaacugcugagccaucucuccagcucauaauuuuuuguggggacaggguuucucuguguagcucuggcuguuuuggaacuugcuucgggcucauagagguccaccugccucugccuccuaagugcugagauuaaaggcgugcgccaccaucaccaggccuguaauuuuauuuuuuaagucaacaagaacaacucguuuaugagaauauggccugauauaauauauuuuuggggaaauaaauauagcuuuuuaaaaauugaaaucagaaaaugcuauauuuuuaacaaguuucaguagcuggguaaguuucaagucuaaagguuuaaaaugauaaaccugaaauaaggguuuguuuguuuguuuuucaacaaaacugaaaaaauauuacaacucagguaauuaugaauucccugagagauggaggcagaagaaccagguuugggaucauucuugacuacacagaaaguuacaggcuagcuugggccauaggagaccgaguuucgaucaaauaaacagguugcauuauuuucucaauggcuuuguaucacaggaaaaugugauuuuuuuuuucuugauagaauuuucauuuaaaagaacugaaaccgggcuggugggauggcuuaauggguaaggcacuuuucauuacgacuugucauaaggugcgucuuggggacccacaugauagaacagacucccacaaguuguguacucugaucuccauacaugugccaugacaaaugcaagcuuccccaccaaaauacauacauauaaugcaaaauacacacacauaauauguguauguauuaaacacuuaaaaauagaaccaacucucacaauugccuaggucugguucccagaggcuuauaaccaccaggaauuccacuuccaguggaucuggugcccucuucuggucuccagggauacugcacacauguaaugcacagacauacaugcaggagaaacacacauaaaaauuaaagcugaaaaaaaaaucuucuuuaagauugaaacgaaccaggcaugaugauggcauauauaccuguaauuagagcacugaggagguugaagcaggaggacugccacaaguucgaagccagccuccgcccugcagugaguuccaggccagugcuagaaaccuguguaccucacauacucugguugaggcugcagaacauucuagcuugcuuuuccuguggucuugauuuggugggagcagaguuucucaagaggaauuccaucuuugccaacagaaauuuaagaugucgauucuuuaaaaugcagcuuauacagaaaggggggagugugugcuguggacuggagaugguuuauacagucaugugcaguagucauguucucuucauuguuuaaaaacccaaacgccacagugcccuuuagacacaagcagaggcuauggagagucacuggugggagcuggugugcuguggcagccccucccugaacacaaucucuccaagagccaucaccgacgagacacugcacugagauggcuggcucagaauuguccuggccuuugucuccagcauuuuagcugugauuuugcucaucuuaucauuuaugaugguauuauuagagcagacauuuucaaaggauccagagcugagugcuuuaaaaaaaaaaaaaaagguucucggcaaagauucaaugacuucaaaguaacugaauauauagauauauaaguaaaaaccuguaagugcaucugaaggucagcuuccuuccacucggaaccccagcgggaagagcguggcaggcaguguaccaaaagaaggucuguguuuuccuuuguaccuuuuccgucagucagagguggauauugucucagucaucugccucaggucagcucccaagggccccuguugagucuccucccagcuucucuguuuaacccauucuccaucucaugcguguuagguaaacagucagcuuccgaacucgcuguugaggucaaaagaaagccagugcuucccauauccauguuaaaaaauaauuaccucguaaugacguuguagcuggagcccagggcccuguguauaguaagcaagugcccugccaccaagcuacauccugacacucccuuugaaacaacacuaaggagguagaauucacaaaccauaaaauuauguauucauucaucagcugggagaccuugggcuacguccacuuagugccuuuucuauauuaugaacauuuaugcacaagauuuugagggugaguuguaagaucucaugaguguguauguaggggugggaguuguaggucuuaugguaacucuuccuccuccuccuccuccucuucuugauuuguaggucuuaugguaacucccuccuucuuccuccuccuccuccuccucuucuucuuccuccucuucuuucucuucuuaauuuguaagucuuaugguaacuucuuccuccuccucuuccuuuucuucccuuuuucuuucuuccuccuccuccucuucuuuuuccuccuccuuucucuucuuccuccucuuuuucuccuucucuuccuucuucucccuccuccuccuccucuucuucuccuccuccuccuccuucuccuccuucuuccuccuccuccucucuuucuccuuucuccuccuccucuucccccuccuccucccuucuuccuuccuuccuucuuccuucuuccuccuuccuccuucuucuucaaaucccacauagcccagccugaacuguuugaguagcugagucucucauugguucucugauccugcugccaagaagagagacccuaggcuugugccaccaauccuggcuacuuuggguuuaaccagaaggccuucaccauccugcagccuucacaggcgcccaggguaggauuuuucugcucaaacaccacauucacagcagucuguccuuaagucauagguugcucauuuuuuccuacuggggcaaagaaguauuucaccuaaccgguucccuccugugucauccguccauucccccccccccccccccccccgccugccccacgggccucuggacacaaagccgccuuuucucuugcuccgauuuccuuugcaaugaauccuauugaguccuaucacucuuuccuaucuuggcgucaucacagccuucggcucuuugucaccuuucacucugagaggccugcaacgcuuuguggcccagaaucucccaaguucugaugcuuggugaucugagguggagccagcucaugugaggggugagggacacaugcagauuguaggucuaggcuucugagcagggcgagcuucacgagggcgccggaagugacacgugaaguccugggcuccagcuagcuugagaagacgucgguggcucauucauuauauuucuguuaugcuaaucaaagagcaggguuuaaaaauuagaugauuaucuugucuggccuuuugauuucauucuuuaaucagugauccuuauuuacccagccuuuaauccuaguacagagcacuuagagauacguuuuuagauucaaaugcauucuaaaacuugguaaaaacugccuuuuuuuuucuuuuuuuucuuuuuuuugguuuuuagagacaggguuucucuguguagcucuggccucgaacucagaaauccgccugccucugccucccaagugcugggauuaaaggcgugcuccaccaucgcccggccaaaaaaaaaaaaaaaaaaaaacugccauuuuuaauaccuccuuaaaauaaaagaaacaaagguauuuauucugagauccuccaauacuuaaaaauaaaaauuccaauuccauacgaagcugagaaugcccuuucggacuucugauccuucugccuccacauccgugugcugggaccacuggcguguguugucauacccaguuaugggguuugggcaucagauacacacacacacacacacacacacacacacacacacacacacacacacacucauuaacacauucacacucaaauguggcaucuugcauucuaggacuguaggauaguacucuaaggccaagccacacuggugugaggaacaggguguuacccuauguccaagaccggauuagaacucacucugucacuggauccagcccuuaacuuuccgcaggccuucuucugcagccuuccaaaugaacuagccagugcuuguccacccucccagcugaugcucgccucuggccuccugggagacuccagucuucucuuuucuaacagccucaggaugaaggccgccccuucuuugugugcacaacaccuugccagagacuugucauucuaaguccaucagagacagugagagcaaguggguggcugcgugauuagggggauuaaaacccugugucaaacagauuguguuuacuuuuagaauauguugacuaauuccugccaguuuuguguuggauauggaaugaguaccuaggacagcagucauuaaaauucacggcuaaucccucaucucuuuuuccugccaugcauuucaaacauuaucacaaguaaaagaaaaacaguguacacagacuugacuaugauuuuucuuuccugguguccucuggguaaaaacuguggaagaacaguagggugggggcuggcaggagggccgcagccagcuuugugccugagcccuguuacagugcugcauuaauggcugagcuucucggaaauccugagggaagguuauaagccggaguugcggagggcugacguugcuucugaguguuuguaaauaucuucauaccuggacuggcugguuuugugucaacuugauacaagcuggaguuaucucagagaaaggagccucccuugaggaaaugccuccaugagauccagcuguaaggcaguuucucaauuagcgaucaaggggguagggccccuuguggguguugccaucccugggcugguggucuccaguucuauaagaaagcaagcugagcaagcuagagggagcaagccaguuaaguaacaucccuccauggccucugcaucagcuccugcuuccugaccugcuugaguuccuguccugacuuccucuggugaugaacagcacuguggaaguguaagcugaauaaacccuugccuccccaacuugcuucuuggucugauguuugugcaggaauagaaacccugacuaaggcaacaccccuacgugugauuacuaaguaaagcugguuguuuguuuguuuguguguguguguguuuuugguuuggcaaagguuuacaaaggcccugcccaggaguaugugggcucucuuagcaaaggggugauuaggacacaucgucaguacuucaaauauaaaauaaauauccuguggcuacagagcuggcccagcaguuaagacauguugcugcucuugcagaggaccugaguugguuccuagcauucuuaccaggcagcucacaaccaccuguaauucucgcuucaagggguccgaggcucuccccugaccuccucagggccagcacuccuguggcgugcacauacacuuaaauaaauugaccugugguuaggagcguggcuuaaugcuagagcccgugcucugucaaucugugugcuuaaugcuagagcccgugcucuuucugugugcuugcucuuucugugugcuugcucucuccuauugcaaaagccaaaggcacccagggggcuggggagguggcucgggcuaagaacacaugcucagguuggguucccagcacccacauggcagcucaccuccauccauaacuccaguuccaagguauccaaugcccucagcccucggcaggcagugcacgcaugcaaaacacucauacacgcaaaaugaaguaacauuaaaacagaguacagccguagagaccuugacugcugggcaggcagguacagcucaguggguaaaggugcuugucgcacaagccugagaccccugagccccugguggaaggagagaacagagcccugaauguugcucugcagacuucacugugugcuccggugcaugaacuuguaauccuguccacuacacauaauaaauacaaauaagcggggugugguggugcacgccuuuaaucccagcacucgggaggcagaggcaggcggauuucugaguuggaggccagccuggucuacagagugaguuccaggacagccaaggcuacacagagaaacccugucucaaaaaaaaaaaaaaaaaaaaaaagaaaaagaagaagaagaaaaaaaauuacaaauaaaaucauaggugccuuuucuuuaugaaucaggugugcaucgcaggcaugcauacugccaucaggcuauccccagcccuggacagugucaugucgcuccacuucuggggccuuuaguaacaagagcuacaguaucaauauuuguuucagugagauguuuuagaggccacucaaggccagugauacauaguugcuuaucuaacugauugaguuuacugacuguguuaaaaaaaaaaaaaagguauccugacucuucuuaaaaguauuuuuugcuacuuuaaacaaacaaacaaacaaaaaauacaaguggggcuagacagguggcucuguaggcagauggcucagugguuaagagcauuuguuguucuuguauauaacucugguucgauucccaacacccacagaugcucacaacucacuguaacucuaggggucugaugucuucuuccauuuccaucaggcacacaaguaguccagggauguaaaggcagguaaaacaugcauacacaaaauaaaauaaaaguguacugccaauggugaguggagcugaguggccagucuucgcugcuuuucucuucuuauaggagguaucccugugucuucaggugaugucagggccuuagguaucagagcagugaccagagacagaggggaagauggcaggaacuguguggagugagccauccagcggaugucgccagcacccuguuuuggggggagcagugagccacugagaacaggaaggaccaggcuggcgauggcagagguggcagcagccagacugcagagguggaaguggccuguccagagcugguuaggacugggaaugcagaacaugggugagcucaguugcucucucugauauuggcucagugugaccagaccucuggcaguucaaguccccuacggacauugucucauccugugucuucucaaggaggagacugggcacuaugcagagggaaaacgucacaguacaggguccuggcucugagccugacaugaagcaauggcagagagauccugaagacuccgccccucagcguggaugagugacugccuccugcuugagggauucucaacccugguagguggagcagagccagggacagugugaaggcaagcuucacucuugggcugggcacguguggcgcaggcuuaauagguggcuucgagagacagucugaguuugcguuucaaguugaaccucaaggcaguaagcacguaaggacauggagcaaaagucuuuauuuuguuuuuugagacaagguuucucuguguagcuuuggcugucguagaaugcacagagaucugccugccugucucccaagugcuggguuaaagacgugcgccacuaugcagccccaacagucuugacuuuucauuuuaagagggagucacacuauguuaucugggguuggucuugaacuuuuagccucacgcaacccuccuaccucagccucuugaauaacuggaacuacaagcugagugaauuuucuuuuagaaaaucaagggcuaaagagauggcucagugguuaagagcacugacuguucuuccagagguccugaguucaauccccagcaaccacauaguaccucacaaccaucuguaaugggaucugaugcccuccuguggugugucugaagagagcaauggcauacucauauacauaaaauaaauaaauaaauaaaaauucaaauauacacugguaaacugaggcggcuggugcaggagguauuuucucucuccccacucagauccuguugucguaaacuggcccucagcacacucugaccucugguaucuucugagcugugcagcagcuaagagccagcuugguucugacaguguuuucucggaccacagucaugugugauuccaagaugaucuagaggucacacgucgggucacaguuuaaaggacagcaacuugaaacucaaguaauauuuucugcuuggaaauguuagaaacucugugaccacaggaaguuuacucagcccgcaguaagcgugaguggguuaggaagacaguguagucacacacagacaccaccgcauggggaaucauggccuguaacucccugagucacguguaugcugaggagaugggaugaagaguugagaagguggagagagauuuccaguuucuugaguucugcaccaggguggguaagaagguagacaccggccugucuguuguggucucaagggagaagaauggagccagaagggaagagaauggaagagccuccuggugccccugggucaggucagguggugugucuaccauggggacugucugacccuuucugaaacuuacucuugcugucuccagcucccagugcuggguuucucagccugggccauuucaccugccuuucaggaacuauuuauuaaugugcauuacauaaagccaugacugaucaaauguaccuaagaguuuguauuaaagaauuuaacuuaagaauugcuguuugaaacugcccccuugggcuuuccaaauuauuuaaucuauaagaaucagguuuuacucucuugucgaaguauuucaacaaaguagagagaaaagagugaaaagacaaugaggacaccacgcacacgcacacgcguacacagcaggaauggcuuuaccacagcacagagauuuacuuguuuccucuugcuaugagccucauuaaccgugaggggcucccuggagugggguucuggcccucuggccuggcauugcuugugguacaauacaagccacccuagcccagggaggcauugucacaguuggagcccucagcgugguauuggguuagcuaugugcuuuugagcuacaauacuuugcuugguuuggucuggucuggucuggucuggucuggucugguuugauuugguuuuuuaagacaggguuucucaguguagcccuggcugcccuggaacucacucuguagaccaggcugauguccagcucacagagaaccuccugccucugcauccugagugcugggauuuaaaggaugugcuacugugcuggacccuacuuugcuuucuuuaaaaauaauuuuuugggggugggcaggaucucauguaggggaugcugaccucaaacuaaauuguauaguugaguguaguuguuggggcugagugucuuuuucgucacuggggucucugagcuccuccagcaagccgcucaggggaggcagaacacagucugugauaggggucccaggugagaaacagugggggcugggauggaugcuaagguuccuggccuccuguguacccagauguugcuggugacaucggggaguuaggaacugggucccuacaggccaggcaggaaggggauggcugagcccaggaagugggcgggauccaguauggaguguggaggggcuggaagagagagggacugcuccaggagacuuaggcaugcucuucacgaugaaggccucacucagccaugguccuugauagaggagccuguccuugcugguccaaacugcuuuauuugauggcagaugugaaugcauucaucuuacucagggugaaccaggaauuaaauacuuuuguggaaggaaugcccgggaagguaagcucauuggcuaaacacucgggaccuaucuagauaccucauuaacaaggagaacuccaggguuuaugcuacaugaccaguugucaugguccucgcacugggcugucuugguuacauguuccagagcaggucuuuggcagggagcuggccucacgccuacuguucucaauucugagaguucccgggguuuaggcuugcucggccuuaccaguccuucuguccacuugccuuacagagcaugaccuugaacucacgaccuuccuaccuucaucucucaaguauugagauuacagaagugcacuaucaugcuuccauuucuuuucuucuaaagaucuauuaauuuuuauuuuuaauguaugaguguuuuccauguauguguguguauguauauguaugugcagcacacacauguagugccuauguaugccagaaggggauguuggagggcccucuggaacuggaguuacaggaauuuguaaccauccuguggcuccugggaaccaagccugguccucugcaagagcagccagugcucuuaaucacugagccaccucuccagcacacuucugaguuuucuugggaggugguugauacugggguucaaaccucacauaugcucugcaaauaccaccaaguuggccuucucuuuugaacuucaguuguuaacaauaacaacaaauuaucaccuuuguguacccucccaagacagcccuugcaagcccgugauguagugcugaccuuguaaagugccugccuuuuauuaagcuguggugaaugaagccuguguuugcugucugcuucauguuccugaggaaacuguugggauuucuccggcaucaggcuuuacccggggacaguuccacccucgggaccugcccagugcccgugggaaaggcugugaacugcugaccccagggcuugugcuuugguguuauccuugauaaggccagugacuugguuuugcuuagacaacauuccuuacaucuggcuccccugacggugcucugccccaucugccccaguccccucugcccucgugugugugugugugugugugugugugugugugugugugagagagagagagagagagagagagcgccuuuacuuguaaaguuggcagccugccuguccacuuaaacaggcucuagagucuagagccuggaauuguauugcauuaggauguuagguacuuaaaacccuuaagcuauaaaagaaaaaaaaaucuacuaauuuauccuaaaaacaacagcaauaaaaacaaaaaaacaaaaaagccccucagcuucugaauuucgaagcugggauucuagaaguaaagggacuucagaagucacauugcuuacacauuuuaccaaagggaaaguaaccggggcuguaccucugucacuggcuuuuauagcucaggacuagcagguaagauugaauaguggggagaugacucagagguuaggagcaccaacugcccuggcuguagaccuggguuccguucccagcaccuacgugguggcucacaaccacccgccuguaacuccaguuucaggagauccgacucccucuggucuccuggcucuugcauguauguggugcagguaaauucauguauguaaaauuuuaaaaagucuuaagcaaaaaguucgagugcaguguagagcaagggccuggguuccauccucagcacaccccccaaguauuuuguauaauuagcccauuguauuuguuaaccucugcagcauuuacauguguaaacagcucaaaaacuuggacugugcucccucacccguggcugcagcgugggcgagugccuagaggaucugcuguggcuuugcuaagugugugguaucuucagugugagcccagcucgcucaccugccuccaggggagcccucccccuuagcgucagcugcauucugccugagcaucccauggggugaguuuggguguggccauucccuacugugagcucuugcacggguuauuuaacuucucugugaccuagauuuuuuuuuuuuaaaucucugaaaugagcguagugacaguagcuaccuaggguugugggagagugaaugaaccuuguggaguguuuugggcauuagaauaaguguauauauuguuuuauuaauuccauguaaauugccugcaccuccuuuuuaaaauugagacaaaauuuauacaauguaauguggacaauugacuuuuucuuuuuuuacuacauucacuugugugugugugugugugugugugugugugugcgcgugcgcaugugugcucaugugugccaugccacaaaugcagaggucagaggacaacuugaagagguugggucucacucugcauuguguggaucucuagggauugaacuuggguuuccaguuuugguggcaaguguguuucccugccagcccagguguuuaugaggacauaaaucuuuaauuuacaaggguaaggaccaaggacaguggguaaggaccaaggacagugaguaagggugucucucaucugaagcugccggugucuucgggguagcauuuugccuccacagcagugugauugagagucccuguuuguacccuccccagcauuugccuuucuaugacugcuggccugguuaguggacucucacuguucaggccgacagcguguauggggaacaucuagucacacauugacucaucuuaucgucuguagaggauucugucugucuuuugccuauguuaagauuguuuaucuuaggggcuggacagauggcccagugguuaagagcacuggcugcucuuccagaggaccuggguucaauucccggcaaccacauggcagcuuaaaacuguaacucacacccucgcacggacauacaugcaugcaagacaccaaugcacaugaaauaaaaguaauaauaauaacaaaaauaaagagaucauucaugugcucacagaguuaucuucuugcccuugggcuccugcccuuacccucuuuugaggugagaacuuguaguuuguugcccaggcugaccucagugauccucaugccuaagucuuuugaggagcucuggcuacaggugugucuggcuuuuucucucccucucccucucccucucccucucccucucccucucccucucccucucccucucccucucccucucccucucccucucccucucccucuccccauccacccaucugucaacagguucucacuguguaccccuggcugucuuagaacuuaccauguagaccaggcuggccucgcacucacagauauccuccugccucugccuccuaaacucugggauuaaauaugugcaccacuaugccuggcuucaccuggcucuuuauugaggcauaugaguccuuuauguauugugggugacaugacaauccuuuaugcaagacaccuucuguaauguaaugugccuuacuggccuguggcuugucuuccugucuuuuuuuuuuaaguauuuacuuuauguaugugaucugcauauacaccugcaugccagaagagggcgucagauuccauuacagaugguugugagccaccauguggaugcugggaguugaacucagaaccucuggaagagcagccagugcucuuaucugcugaggcaucucuccacacaguguuuuuauacagcagaauuguggguuuuaacagcuuauugauauggaaaaaaaaauccacuggaauuuucuucuuuauaucuguuugguuuguguauuccuucuuuaaguuuuggcagacuuugccuuccaaggaguugauccguuucuuuuaguuaaucaaauuguuuguauuauuccuuuauucuaaugucuauaaauucuucauccuuuuaaaaauguuucuaguuuuauuuauucuuaaagaguuauuuauuaauuauaugugcauacacuguagcugucuuuagacaccccagaagacggcaguagaucucauuacagaugguugugagccaccaugugauugcugggauuugaacucagaaccuucggaagagcagucagugcucuuaucugcugagccaucucuccagcccucuaguuuuauuuuuauuauuaguuuuucauauauuuauuuuguguuuugccugcauguaugucugugcaccacauguaugcagugcccuuggaggccagaagagggcgcuggauccucuggaacuggaaugacugaagacugugagcagccauguaggugcugggaauggaaccuggguccucuguaugagcagccagugcucuuaacugcugagccaucucuccagucccauuuccaggaaucuccuuuuucuuagccgucuagaaguuugucuuuuuuuuguuuguuucaucuuuuucagagaaccaacuuugauuuuugucgauuauucuauugauguugcugauguagcuccaauuuuuguuuugauuccuaacuacuuuuauaucuuuguuuuagggcagugguucuaagccuuccugacucuuacccuuuauuacaguuccucauggugugccucccaagggcagaauuauuuugcuaccucauaacuguaauuuugcuacuauuaugaaucacaauguaaauacuuaugugcagaauaucugauauguaaccccuguggggguuacgacccacagguugggagccucugcuuuaggggaucuuucucuuuugggguaccuacuaaguuggucuuauuugcuguguaaucuuggcuguccuggagcuugcucuguagacagggcugaaagauuuaguuaaucuuuauuaguguguguccguguccgugugugugugugugugugugugugugugcgcgcgcgcgcguguguguguguguguguguguauguaugcaucccauguacauagcgggugcuaaaggaggccaaaagauagaugacauuggaucccacagagcugaaguuagaggcaguugugagguaccugaagucagcgcuggauacugaacucaggucuucugcaaagcagugugucccuugacccugagaaacaucccgccccagcagaaagauguccauagccaagggaaccgugugcuuugucuuugagggcaggucagcuuugccugucuccaagccaagcagccucgauucucucagcuguucuucaggugacauugugucucaaauuuccagagccagccugguuucuuucugggcaccuccaacgguguggaugcugccuuucaggcugaggguuugaugaagguccccauaccugucaguaucuguguagccagcuacccuuuucugucggcaccaugcucucucuguucuggugcgagccuuuguucuuccuccauuucauccaucuugcugccugagccucgcucuaauuugcugauuaaucaccacacaucccaucuuuucguucuggccucgugucaucuccaguuugacaaacagguggauuggagagagccuagugaggacagaggcuuugaaagguggcuggaggguggucuggguucccguggguuccugaucaugguaaguccuccuguucucaguccuggcauacgggggugggguggggggggcucgucacguguugggggaggggagggagccuugucacguguuuggggggagccuugucacguguucucgggaagccucgucauguguucaggaucucagcugagcgaggcagugaggcccagacccgugcuuggcacugagcgagcuggagcugaaguuuuccucccagccguugccugaagcauccagagagcuuguccaugugaauccuggcugucagcuccugcaguuccucggucucuagaggcacaggacucagccggggaugugguugcuccgcagcagcaaccaucagaugguccaucuccgucucguugugcaaauccgucuuugugggcaccguacauaggucccuuaaagagcagcuaugguggagcuuagagucccgggacuuagaacacucagaauaacucaggcauuguuauuauaugagaaucccuuucuuuuucauguucucuuaccuuggggucuaguucaccauuacauugguucuguucuuuccaggaaaauaaaugcgcuuuuugagagacccccccccauggcagaauacgacagagaaauuuaauuuucuguuuaucauaagaguauuacauuuauaaauaauacaagggcuugucagaccacuagucucauugucaguaugauaggaacacagauaacaaaggagagagagggaagaaaagcaggcuccugauuuggugaccaggcuaucuggcuucauagaugcucagagccagccuuuggucgcacucagggaagcagcugguaaggguuuugcaucgauaaugaaugucagcagguuuucaguaccucguggccuuuuuggaaccgcgugugauaaaaguuuucuauugugcgugaaggucagagaccaaaaacacaacaggacuuggaaaugccgcuggacuauuaguuaccgggcucgagacagugcccugcccuauuuaaauucaagacaaauguggcggugauaaaggaggagggaaaggucaaauccuggccuguauuuucugauagcacugaaauaggaaaugaaggaagucaugacuuguguccugugggauaacuagguuuauagucagcacuguaagcccuucccacccgccagaugauaagcacuugcgcagaccuguucccaggugguuacucugggggggggggggaucugccccucgccuguuacgcauuuaauucuauaggaaacugcauguaggugcuauagcgaggguucagcuguuaagagcacuggcugcuuuugcaggggaccuggguuugguuucugguacccacaugguggcucagccauuuucuauaacuccaauuccaggggauccgaugcccuccucuggucuccaagggcacccggaaugcacaugaugcagaugggaagcugggacagauaagcugauucugaggaagcaauugggagauuuggaaacccuggccugcccuaaagcacccaggagugguaugcauagaaagagacgcuuggcagcccugcauggagauucugugcuaccccucggagacuuagcguucauccacaagaugaucgugagcagggggacugugccaaagcaaagcaaggagcggguggucacagcugcugcgguuugggucccucccaaggugggaguguucagagggcacuucagagaaggaccacccacucuggcugaggaaccuugcgguuuucccuggguggccucugccccugagcguccugugacaccagugauugggaaguaugugacagccaccuagagaaggcccagccagugcugcagcaggaucagccuccagggugaggucgcgagcugugccgcccaguggaagugcaccggggcaauggacagccuuucuuuccugcugcucugugguggucagagcacgguggcucuuugccuucuaagguuugaucucccaugcccuccucuucaggaaugagugaguuuuccagucccgucccguccccccgucccccagucccccauuugccaguuccagaaacagacaccugagagagacacauuccugucucaacuccagucgcccugucuccgagucacaccucacaccuuaguucccagaaaccccugcucucagacuagucuacagucgccgccugaggcaggaguucagaggaaacuggaccccacccaccugacucagagacccugccacccacccccacccccaccccacaccuaccccacccccaccccacccccaucugagucagacgcugucuuaugugcccucucuagguauuccggacucaggagcgaaccuguuuugaucccagggauacuguagcucagggugugacuccuucauuccugugacaugaggaccaccuugaccuggccccucccagccucccauggaacucagagauuucugaguuccucagcccuccugcgcuccuccucgucugggauuaaaguuguugagcagcugaugcuucacuacaguguucugagugagguugguccaagucaucucucgaggaaacagggcuagaauuugucuuagagaguuuaugacuauggcugccuggacacaaacaacuugacuugaccagggaagaugcuagggccauccaguauuuggagggcuaauauuguacuuacaucuagcuaguuaacuuguuccuuuuaaacauuugccuauuuucauuuuuucuuuuccaaaaagaccugugaguauacuguggcuguuuucagacacaccagaagagggcaccagaucccauuacagauggauguaagcugccaugugguugcugggaauugaacucaggaccucugggggaacagucagugcucuuaguuuuugagccaucucuccagcuuauuuucauuuuaugaguguauggccugcacgggugugagugcaccaggcgugugcugugugugugugugcccacagaggcccacagagcgcguagcccagagcugcuugcccaguccuggcuuuuagggggaaaucacucggaauaaauugaaaacacuuuacagugagggaacggguguccugaccaagcucguggcuggggauaagcugagcagcggugccgaguugcauuuugcuucaguuaguugaaguuucucucuccuuaaaggcccagguucuguccuccaaagguuugagagugggauccuuuuuagcgggaguuguacugguuggggugugaggaauugcugaugcagggguggugguggucaugggcuugugccuaagaagucuggcccaccgcccgccuucacagcuacuugagauaguuggcuugcucccagcccucaggucuguggugguuaccuugguaaccaccucaucaccuacacccagcacugccuagugugcaugaggccccggguaccaaaucacgucugcagaaagaaagaggaggaaaaaagcuggcacccuucccuccacaccccacuccaugaaguuccaccaggcugagcagaaugcugucacaaacccauccauuccuaccccagggcuccugcuucuucugaccuccuccucuuucuaauguuuuaguucuggugugguaguauuugccuuuagucccagcauucacugugccauucuggcuggccuggagcucacgcucagaucaggcuagccacaaacccacagccagugcuucucuagagagggagaucuugcuuugcucugcuugaccuuggcauuggagcaggcacguuuguguuggcagcugccuguguguguugguccucacugugaaguaacccucacugggugcaggcucacuaccacacugguggcagaggcacugaugagcagagcucacgugguuuggagcacauuuggaguugauguuuggguucuacccagguguucugagagcccaacaccuaguagcuuuccuucugcacaggagguggaagauugccugcagcacacagcuaugagaaguuaaggaccuuugacacucagcuugcuagaagaccacaaggucugaacuggacagaauuuauacauggagacaguacucagucugagggugugucuuuuaauuuuuccuuacuuuuuauuuuuuaaaaaauaauuauuuauuuuuauguauaugaguacacugucacugucuuuagacacuccagaagagggcaucagaucccauuacagaugauggauuugaacucaggaccucuggaagagcagucagugcucuuaacugcugagcuaucucuccagcccaguguuuuuuuuauuuuuacauuuuauacuuaagguuauuauuggugugcgugugugcaagugcauaugaguacacaccccagugugcauguagaguucaaaggauagcuugcugggguugguccccuccuccacuguggguuccugggcugagacucaggcugucaggcuuggcagcaagugcuucuaucugcuaaacuauguugguggccugagaauguguuuuccuuuuaaagguuugguuuuauuauuauaaauuaugucucuguguguguuuguauguggguaugugcugggacagaaaaugcuucgaaccaaacucagguccucugcaaaagcaauaccugauccuuauggcugagccaucuccagccccaagagugugccuuuugcauuuccaguuuggaucucuccagccccccuucugucagcuuucuguugcuguggaaagugugugagaaaaucacccuaaauaaggaaaggugcgcuggcauauaaguucagaguugcgguccucaguccauuggcucuuguuucugggcuuugcagaguguaucacugccuggggcguguccuggaggccacugaccuucuagggcugugguuuucaaccuuccuaaugcugucacccuuuaauacaguuccucaugguguggugacuuacagccauaaaacuuuaguugcuaccucauaacuguaauuuugcuguuaugaaccauacuguaaauaacugauacaucagcaggauaucugaagugaccccucacacacaaggguugggaagcggagaggaaacagugagaaggacacagagugagugggccacuauucuguucgagaccacacccccaaauuaccaccuggucccaauuccugaagguuuugccaccucccaaugguaccacaggcuggugagcaaguuagagcauccaggccuuagaaggggacacacgcucuccaaacuguaccaaccuguuuuaguguucagcuuugguuuuggauauauauauauauauauauauauaucuguguguguguguguguguguacacaugcgcgagcucucauguguguugccugaaugcauucugcauaccaugugugugccuggugcccacgcagaggaugagccaccaugugggugcugagaacuaaaccuggguccucuucaagaacagcaaaugcuccuaaccgcugagcugacucuccagccccugcccuguuccaguguauuuggggaaagauagagucagcuagagacuuuacauguacucacuuauuuuugacuagacucgcuucaaagcccuugcugcccuggaacuugugauccucuuaccucugccuccugaguuugcagaagauugugggcaugugacacuaugcuaaguaggaauuuagaacauagucgcagguacuuugccacucagagcaucucaaugcgggcugccgauacuccuuuaguagccagggggugggcuagagguuauuuuucaaucaaagcauaauuucaagcaugcacacccgagcaccugcugccaccugguggcaguaucccaggauugcagagucuuuugauggaccaagauucaguuugucuuggauuuuauagguucacuuauauuuuauagguucacuuauagucgaaaugcaucaaagaugguugaaacuuacaguauggccagcauagguguucugauauaggaagcauaugucaaauucuuucuaucagccaauggauuucuacacauaaaagguauaaagcagaagaggaagaugugaccaguguguuugguguugggcucuguggcacagaguggaucugaaaauaaccuggcagaaucucuugcucgugagacuugggcaggagagcagccuucuuuagcccacaaaacuaggaugugcugggauaaacuuuccuauuugaaguuaacccugagcuucacuguucuuacugauuguuuuuguuuuucugagacaagguuuucuugagugacccuggcuauauuagaacuugcucggaagaccaggcuggccucaaacuaagaaauccaccugccucugccucacaaguauugggauuaaggcaugcaccaccaccuccuggcauucauagauucuaaaaucaaguuuuuaaucauuaagaucggaggucacaaagaucauuuuugccugagaguaaccccagaaaacccacacucuaacaggugugaucgcuagguuugcuguuaggaauguagcuggcuuugauguucuggcaugcaguggagugaggcccuagggcuucgagauggccaaugggguccuugacuuucagcccauaaucuggugguuggagagaagaugauuacagaaacaucagucacuuguuucuauaaauguuucauaaugcaaauugaaugugaugaaauauuaaaaauaucauucauuaauuauugaaaaguucagccucugaaaauggccauauuucuccuuauacugccaucuuaaaggagcaauugagaaauugugaauuacaaaauuagaauccuggaaugguagugaagugaagcaccauaaaguuauuuucugcucugagauuuguuaaccauuuucagcuguagccuuucuguuauggugagccugcccauucuguguuaggacagugcaggugccccacacuucacuaugcuuacuauuuuuauaucccugugguucuggaaaaaacaaggugacaccauguugaacuaagagucuuauggacucaaauguuggaauaaaauucaauuuuauuuuauuauacuuguaauuuuauuagcaaaacaaagcaucaauacaaguuuguaucaaauguugcuauuaguuacaagccaaauuaauaguuugccuuguaaaaugaaugauugugguuggauucaguggugugcagcugugaucccagcaguuugggaggcagaagcaggaagguuaaauuugaagccagccuaggguauuuauguuagagagagagagagagagagagagagaaagacagagacagagacacacacagagaaagagacagaaagacagagacacacacagagaaagggauagagacaaacagacagagagacagaacccuaaaacuagagcauggugagaugugucugagucuucauuguuugugagcaguuugcaucgggcugaucccccgaguugucccagcuuccuucuuagugugguucauauaaaauauacuggggucucagcaguggaugaguugcccaucuccaauugcauaguagaggugucuuauguuccaugaaccuuugaugaagguuggcccuugcugcugugagcuuuacuggauuccgucaaugcccucaggcaucccugcuauuaugccaucccauucugccuccuuggggacagaggguaggaaugaugacccuccugaugucgcucugucagagcucaugucgcaggagucucuuguggagggaaggagucaauuucugucuucaugaucuggguuagauuuuacauggggcacucccauaaucaaaccacaguucgcccuuuucagaugaucagucucuuugcucucuuugauuuaugugccucuggcuuugcuuuccugugugcaugugcacuuguguggaagccagacgacacauguucaucuucaaaggcagcaggacgcugaagcagugaucugcaucuuacuguugcuucccuuuuucucccaccaguuaacaagcacaagccauggcucgagcccaccuaccaugggauagucaccgagaacgauaacacggugcugcucgacccuccccucaucgcccuggauaaagauucaccgcuccgcuuugcagguaugcaggccagcuguucacuaucugcaaaucuggccuggaaagaaagcaacuuaagucuggcugggugacuggaccucucaggaaguguucugguagccgagagcuuuuauggcuccaggcacauguucuucuuguaauacucgagguagcugacagugagcuguguugcuggucaaagggagaauugcuuagccuaauugcaucauuaugugcugugccuugugcagauaggcagauacugucuagacacacacagcagagauggagcacacauggacuaagugaccacuguucaggacacaguuagugugaugggcuugggaaccaguguucugccuguucugucuggguguucaaaugccuguuucacgucacuccagcaacucuuaguuccuuacauucaccugcacagacuucagaaacauugagcagucuuugugggggaauaaguuuuggccuagauuuccuuuuuuuuuuuucaaucuuuaacuuuuauuuagcuaaaucuuuuucuauaguuuuauuuugcauaugugcaccgugugaaugucugauguccacagaggucagaagagagcaucauaucccuuggagccagagcuguguggauacugggagucgaacccagguccuuugcaaaggcagccagugcucuuaaacauugagcugucucuccagucucucauuuugugguuuaaaaucauguaugguguugcguuauuuaagaaguauacauugcaugcugagcacauugucaacuuguauuuauuuuuauaggcauguacuaccaugcccaauuuaaugaauuuaauuuuuauuuuccuuuuuguguguauggguguuuugccugcaugugcuugugcaccaugugcaugcaguacccacagagaccagaagagggcacaagauucccuggaacugaguuaauaguuaugcaugaccuugugggugcugggaaccaaagcccgguccucugggaaaucagccggggcucuaaccacugagucauauccucagaucuuucuuuguuagagaaaguuuugcuauguuaaugcuagcuggcaucaaaauucucauucucuugccucagccuucuuaauaaaguuauuaaauguuugauaugaguuauuuuauaagauugcacccugugccuuugcagagaaaaacccuuuaggacagugucauagauuuugaucauauggugauuuuccuacaucgcugacauuuagugguguuugccaggcagaucugcccugacugcuggagggcucugcuuucucagucccagagugagagcaaacacugggauaacacacacacaugcauguggcuguguccagguuuuaaauuuuucuuucuuuuuucuuuuuuucuaguuuuuuaaaguuuaugaauguguuuuaccuguacgugugcagguuuguuaggaggucagaaaaggccaucauaucuccuguugugaagucaugugagugcagagaguugacccagguucucugcaggagaaacagaugcucuuaacccguggaucaucccuccagccuggguccagccuuuaauguagguucugagaauccaaaccucgggcagucaggcuuugucagguucuuuaccaauggaaccauuccccagcccaaaacaacuuuuuauuuuugagauaggauuuaguuugacucaguuuuuuuuuucuuuuuucuuuuuuuuuucuuuagcuguccucagauacuccagaagagagcaucagauuuuguuacagaugguugugagccaccaugugguugcugggauuugaacucgggaccuucggaagagcagacggcgcucuuaaacacugagccaucucgccagccccuugacucaguuuuuuaaagauuuauuuauuuuauguauguguguacacugucgcucucuucagacacacgauaagaggaugucagaucccauuacagaugguugugagccaccauguagaugcugagaauugaacucagaaccucugaaagaacagucagugcucccacacucugagccaucucuccagcucaacucaguuuuuauaaagauuuauuucagccgggugugguggcgcacgccuuuaaucccagcacucgggaggcagaggcuggcggauuucugaguuugaggccagccuggucuacaaagugaguuccaggacagccagggcuauacagagaaaccccgucucgaaaaaacaacaacaacaacaacaaagauuuauuucuauuaccuuuguuacacaugcacagacacauacacguguguaugcauacacacacacaugcugcacauacuauacauauacacagaaacauacaugcacaccacaccacuaauacacaugcaaacauacacuguacacacugcacauacacauguaaaugcauacacacauaucacacacauacgaacaugccacacauggacacauggacacacacaagcauacgcacaugcacaagugcagguagcugcagaggccaggagagggccuuguucuuugaagcuagcucuaaguguccagucuuuuuuauuuuguaaguauuuaucauugcuccuccugugugacauuuagagcuacaucacaguuuuagugagguugccgaggauauguugccaguggguuuauauacauuccugcauuuuaagaagugauuuagaggcuuggggaggcagcucaguaauuaaaaacacucugcugcccuuguggaggaccaggguucaacucccaggacucacaugguggaucagaacugaaacuccaauuccaggaaguacaaugcccucuucugaccucugugggcaccaggcaugcauacggugggacacagacauacauguaggcgaaacacccuuauaccuaaaaauaaaauguuuugaauaaaauaagaauaaauauuuaaaaggagaguaguaacucaggcugggaauguacuagccuggcaccacaaaccuugcauucggagcucagacccaugucacauguugaggaaguacaaacuuuuaguccccucagcauuugugagguggaagcagagggauuaaacagucaggcucauccucugugacagagucaguuugaggaagaucagacugagcuacuugagacccuuucuuaaaacacaaggaggcaaagaaugacugugguccaggauucuggggucacugcccccagcuuugauuuacaaagcaccagcuguguacaguaugcggcgcucagaacccaccucacagcgaauaaugcauuugcuccugagcaucaagaagaaaggccaggcacuuuuccaaaugcuuuauaaauaaaaauuuguauuuaauucuccaucacuugaagcaaggaugcauuuugccagccacauuuuaaagagaggaacuaggaucugaagagauggcuuggugguuaagaacacuggcugcucuucaggggacaaaaguuuguucucagguacccacauaguggcucaugaccaccaacuauuacugcaguuccuagggaacugaugcucucuuucagccucuaugagucccaggcacucauaugguacacugacuuauaugcaaagaaacaucacacauaaauaaaaaugaaguauuuuuguuuuguuuuugagacaggguuucucuguguagcucugccuguccuggaacucacucuguagaccaggcuggccuugaacucagagauucaccugccaccugagcacugggauuaaaggcuugaaccaccaaggucagcuuuaccccucaguuucaucaucuguaaacagaagaauuccaaugcccuuccuaaggcuugggcauauuuguuugucuauaugaguugaagagcuuaaauucacucuugaagacuggggauguugcucagugguagagcaccugucugccgugcauaaggcuguggguugcaagcuacaccccaagccccacccucagcaauaauaauuaaaauaaacacaaaauaaaaacaucaucugaaggaguaaaacagugauugguucagagucuuguauggaaugucugcuguuuccauauaaacagugaaaucauauguagcauguuuaaaaauauguuuucaugacccagcaagauggugugguggguaaaggcaccuacuccccagcaugaucccugaucccaggaggaaggaaaaaauggccuccuguaagcuguguuuccccuccccaaauagauuuuuuaaaauucaguuuaguuuaguuuuguuuugcuuuuguuuuuucaagacagagucuuacuacuuagcccuggcuguccuagaacucuagagaccaggcuggccuggaacucagaaauccaccugccucugcauccugugcuggcauuaaagacaugagccacuacacccaacaauaaauguaauguuuaaaaauguuaauguauggccuuaaauuuaauauucugugggaaauaugugucuauuuacguaaguuguuauucaauucccucacacuucagauuauuuuuguguugagcaaggcuuauucuggaaacuuauucugagguuguuuuugcaaugguacugagucugcuguggugacaagauuggagaugucuugugagguggcaguagcucacucucagugaacugucagugucccaacuuguccugggcucuuuauggccaccuguccuuggcuucuagucucaccauaguaucccagguggggaaacuaguucagagcaugucagcugcaugcugucgggaaugguggucucguccauuucucucccuagugcccugguuaguucagugcuugggacacaccaggacuccauacuuguauguggaaggacagaugaguuuggcuaagaccacaagcuuuacuaaguauguugccuuugaaccaggcucucuggcugcagcucucugagacaugacauuucaaaguugagaacagucugcuuuguguucccaucccucaugggguguguguguguagguaagugcugaccgagcucacuugacagagcucugaagcagacacauuugugguauugagcuuucugucccugacacccaaugucugacucuuaggggacacauggccaagucuaguuguuuucuuggugugcugcaagaaaaugugccagggaguuuguugagggaaucugcugcagguaucccccuucauagaugagccugaagcgaugacuccccucucaaccuuuauucuuauauuuuuucaagauuuauuauuguuaguguuauuauuauguuuccuggcuguuuucaagucucuuucucggguccauagucaagugugaacauuuugccuaccugcauauaugaacaccaccugcugucuggugcccucagagguuaggagagggaaucaggucucugauaauaaaaaauaauaaaaagcuguaggugcgggcuggugagauggcucaguggguaagagcacccgacugcucuuccgaaggucaggaguucaaaucccagcaaccacaugguggcucacaaccaucugaucacgagaucugacucccucuucuggagugucugaagacagcuacaguguacuuacauauaauaaauaaauaaauaaaucuuuaaaaaaaaaaaaagcuguaggugcuugggagccaccacauugaugcuuggaauuaauuuugagucuuuugcaagagcaggccagugcucuuaacuuuuuuuuuuuuuuuaauuuuguauuaauguauaugagaacauuguagcugucuucagucacaccagaagaggacaucagaucccauuacagaugguugugagccaccaugugguugcugggaauugaacucaggaucucuggaagagcaggcagugcucuuaaccagugagauaucuccccaccccccaccccccaccccccugccagcccgaauucuucuguucaauugaacauuuuuuacuucacaaguagcuuagggucaaauuucagaagcucagccaucaagacuggugaggcagaagagugaacgaggaaagccuuucuuugugacgccuaccagauccgggugcuggugaaugagcacagccaggaaggcacugcacgggugcagcacacaugggcauggggcagcacagguccccauaggucacugucagcuuccuaagacagccguugggacguagcucagugauaaagcacuugccuagugagucccaggcccggguucaaucccagacauaaaggcuguccugucccggaagaguaguucaguugcuguuuauaagucccugugcaaaaggauucucuagucugugcugauggaagaaaauuguaggacaggaaaccaagaaugagccauagccccucggagcugugauggcagccacuugacccuaggacugcuucagccagaucucgggcaguucuaaucuccugcaaauggucagggugcuucaaggaugaguggguugugcaacugacuuugggcucagacuggcaaugcagggcucagagaacaggcuuuuuuuucuuaaugucucuucccccacgcuccccuugcugagcacugguccaccuaaacugagugaggcugaccguugaacaugguggccaacaaaggugaugggaucuguggucccaccugaggaggugguucugcuguggacggugguccuuuuuccugugugagcugcgguguuuucuggcuguucucaggucuccuucucugguucacaguccaaccaguccucuuacauuagguagaauggauucccuugcuugcagauuuggaagcccaaagcugggaucccugccuuccaugaagaguggagggucaguuggagccugaaagcaggagcccccagggcuuggaggcugcuggaagagggguaguauacccuccagauagggagggguccuggaagggggggucagucugaaacuauacuuauauauaacuuuggaucaugggaagucaaaucuagauucuguuggguuucucuuuuuauauuuugucuuuaaugauuucuuuaggggggaaauacccuuggccauuuuagauccagucuuagguuggagaggaagagguuggcggacagaaguaacuguagcuguccagcagccauagagaacuggguacaccugaaagggaggcugggaaugaaaaaggaugggcgggcgagaaaaaaaugaagccaggacagagguuucugaucaaggcucaaaguuuaauuuucagcccugcacuuauauaggcaaaacccacagacccauccuuuguuucagcuggauugaauugcaaagcaggcucaguaggcagucaacuccucaaagcucaaagcagggacuccaacuagagguuuguuuagccuaugggggaagggcacaaguaacucuggggaagugacagggugggacaguucugacuccgucccaggcagggguacugggauucugguuuucaugaggacaguauuuuaggagcuuuccugcuacagggcaguuguguggagucagcauggagcaggaaggacggacaaggaggaaaugguauagaaggugauucugagagguucuucucuucucagugugugggacucagggaacaagacagaaaucauaauggcugagggguagagaugccagugugaauccaugcaaugcugauaacuuggugugaauuguacauuaacucgggguagggagaagccaaugucagcggggacaguaaauaaaugagccaguuguucccuaucagauauccugaagagcagguguuuacacuaggguugaaaaaaaguaucaaaauuacaauuaugaaguaccaacaaaaacaauguuaugguggguggagucaccacaccaugaggaacuguauuaaagggucgcagcauuaggaagggugagagccacugaaauaaaucagugcauaugcauguaaguauguauuauguauguauacauguguguguaucuauguauuagcuccugggagaguggauaugagugacauaaaucuguguaggggaggaagauucuaaaagauuauuguucauuuggcugugauggacuguugugguuguguuaaacagagauagacgcuggaguguugugaacaaaaccaugucaugccugggguuugcuaugaaagucuccacgcggggcuggagagauggcuuagcaguuaagagcacugacugcucuuccaaagguccugaguucaauucccagcaaccacaugguggcucacaacuaucuguaaugagaucuaacucccucuucuggagugucagaagacagcuacaguguauuuaacauauaauaaauaaauaaaucuuaaaaaaaaaagucuccaugcaagcccaaagauggugaggggcagugacuacaacaugcacacacacgcacacacacacacacacacacacacauaugcaugcaugugcacacacacagauacaccacauggacacccaccccauacacacacacaccacacacacagguucacaccauauacacagagacucacaaagacacacaccccacacacagacacauacaugcagacacauagacacacauacacacacagauacacacugcauacacagagagauguacacaggcaccccccccaacacacacacagguuucauaccacauauacagaaagauacacacagaugauacacacacagacacacagacacagagaaacacaggcacacagacacauacacagagagacacacaggcacacagacacauacacagagagacacacaggcacacagacacauacacagagagacacacagacacacagacacauacacagagagacacacaggcacacagacacauacacagagagacacacaggcacacagacauacacagagagacacacaggcacacagacacauacacagagagacacacaggcacacagacacauacacagaaagacacacaggcacacagacacauacacaaagagacacacaggcacacagacacauacacagagacacacaggcacacagacgcauacacaaagagacacacaggcacacagacacauacacagagagacacacagacacacagacgcauacacagagagacacacagacacacagacacauacacagagagacacacaggcuuaguuucucacuuacacucgaccacagcucccuugccuuuaaaguuccucccaagucuagagcugaucuccccuaaaauagcuccugaggggcuggggagauggcucagguuaagagcaccugcuauucuugcagaggaccugaguucaguuccccagcaccuccaugguggcucacaaccugauggaaccccaguucugcgcgugcagcacuuugcuggccuccacaggcagugcacaugaggcacacaugagcuuuccaggcaaaucuacauaugcauaaauaaaauuauucuaaaaaccaaagugaccugcugggucuggccccuggccucucaugcugggguagccuggugaccauguuuacccagacagacuuguuuuaacagagcaaaggguccuuuagaacugaagucccauucauccaaccaaccaucugcugacuccucucugaguggguggcacaguauugccacuguggaggcugagucaagaggaccaguagagcccaggcauuccagagcagcucaggcccugacuugucugucguugcuuggcaucaagcaucuucacccucucauuugaauguguggcacuaguggagguacccaaauucuccugccacgguccuggucugugcucaucagcaggaacacacagcucuugucaggaacaccagcucacucgauacagagcugccucucuugccagaagagugaacuucagucagaaauugggacgugggcuggagagauauggcucagcgguuaagagugcugacugcucuuccaaagguccugaguucaaaucccagcgaccacauaguggcucacaaccaccuauaaugagaucugaugcccucuucuggugugucugaagacaacuacaguguacuuacauauaauaauaaauaaaucuuuaaaaaaaaaaggaauugggacguuuggcaacuaggauucaauguauuuuauagugcuagagagauggcuuauugguuaagaguguacacaguucccagaaacugugccgggcaaacacagccaccuauaacuccagcucccaugggaucugaugucuguggcuucccugguacuguuacucauaugugcauaucuauacacaaauuaaaaguuguaaaaccaaugcugguagaguauauuuauaacacgguuuauuagcauguccuaggauacuauuuggaaucacaugucaccuggcucuucuaucucagauaauuuuuuuccuuaaagaucucgacagggaaugcuuuagguucuguaguccauaaggucucuugcagagguauaaacugacagggaaccuagccaucaucgugagaauacggcuggggacugagccagugagcauguuugugguccagccaaacauuacuuaugaagacugauguuuguacuuuaguagcauauucucauguuaugaaaaaccauuuacggggcuggagagauggcucagugguuaagagcacugacugcucuuccagagguccugaguucaauucccagcaaccacauauuggcucacaaccaucuguagcgagaugauguccucgucuggugugucugaagacagcaacaguguacuccuauacauaaaaucaauaauuuuuuuuuuaaaaaaagaaaagaaaagauggaaacaaaugcuuccugccaacuguucacaggcagcaaagggccugagacugcgcuguaggcagacuggaaagugguuuuaguaaccgugaauguuaagggcuugcuaggcagaugaguuaagccgcugacucaggcaucagugggacaauugagcuuuagaucgugagguugggugaaaggcacaaaaccuucguuccauguuaauacuaugcuuaaagccuuaaagacaagcaaaaugaagcaguguuucuucuuuauggagauguaugguaaagccacuuaaaaggaggggaauuugugcaaugcugcaguccuagaguggcaucuucuccauggugggcaugggguggccugcuggguuggcacugacgaggugauaucuagucaacagaguggucaccaccagagagcugucuugggaugguuguugugaccuggcuucuguuuccuuagcaggcacuucugucugcugcucugaucggguacuuuagacacaguguguucgugggaacaaaggcucaaguccauuagcuccagauuuuuguuucaguaaaucuaaugaugaauugaaugcuucuagaguuguaauuagagaacuuagcuuaaaaauaggaacauaguucaggcgugguggcucacacuuuuaaucccuauacucagaaggcagaggcaaggggauuucugugaguuccaggcuagccugggccauucugggcuacauagugcgacccuaucucuaaaacaagcaaauaagaacacuuagguuuccuuauuaauagucauaaaagggaaaguccuaaugacagggguggggggauggagggguaggaggugggguuggggcuguauuggguuauugggaagggaaaccuuaacagcuuugaaugucucaucccugagagaguucaguugugaaguuacauaguuuaugguaaguaggauucaaaguagcaauuggugcgaaggauucucucguaagaguguagcagcugucugauuagccuguguuaagugaccuguccagcuuuugugucgcagcucugacuguuuccuuguaauucccuagucguuucuuuccugaauuacugacauggguuugucuuuuuucccuuuagagaguuuugaggugacagucaccaaagaaggugauaaaggguucuuugucucccuuuuaugaauauuaacccacuaacuuguuuauaaaauugggaaucagccauuaaacagaagcaacugccaugccguuucucccuauuuauccuccuaguuuguucuuuuuuuuuuaaguguauuuauggaaauuguauguaaccagacccuugguuagaaauaucuagaacucagacauccauuugaacuacauguucaggaccacaugguuuuguuuacuugggcuuucuuguuuagcacuguuuuucuccuauucauuggacuugugaaagagcacagucuuauuuuuauaugaaauacauuuuguagauucacauaugcaucagacauuaaaucuguucucccacgggcaggcguggaaccuuggaccuuucuaacuaggacaguuucgcaguagcgaaguucccaggcuggcgccccucuuagguuccauagugugaugcccagagcuaaggaacccuaacaccccuccuguaacagacagugaugccagccguugaaauggaugccugaaaacuugguauuucuacuacucugauuuagcgguuuguuuugauucccuaauuuuagccaggcucauugcacaggaagacuuuuucuucuucuucuucuuuuuuuuuuuuucuugacagaauuucuguaauuaugaugcugauuccacaucuucucucgaugcuuaacucuguauuuuauccuuucccaaacccgaagagcugccgagcgagcucguucgggucgccuggccagccuggccuuggcugucacucaggagacuccuuuuaccuuucagccaucuaagugcuccuguggaaugccugccuuuguccucucucuuguaucccugcaugaauggaugcaaaguaaaccaguugcuuggaaagccagaccgcuucuaucuaauaaagccccagaacucacccgugcugaagcacaacguccccgcuuuguccacggacccucuaaacccccuggcugcuaaguuguugucgccuauuuucuuugggggcggagggcaaugugcagacgguucgaggggcagauguacuaacccggucugguuuauuccccaggugagauuuguggcuuuaaaauucacgggcagaauguccccuuugaugccgugguaguggauaaguccacgggugagggaauaauccggucaaaagagaaacuggacugugaacuacagaaagacuacacauucaccauccaggccuacgacugcgggaagggccccgauggcaccggugugaaaaagucucacaaguaagugggccggacaguguccaaaaagagccacccaggagaugaguguacaugggggaggagcagucaggagcuggccccuggguucuucucuguguucugaaaaggagcaggaagaguucuguggggaaucaguugggucggucgcaaagggcggccuccagccugcauguucccuuuuguguccagcuucuggaaagaaccuguuggaaacagguuuugaaaagagaaugaaugguuuaucccacugaguguucuugguaaagaaacuaaagucccacugggaauaguggcucgugccuguucuuggaggaggguggaggcaggaauggacagaugacugacagacagauagacagacagacagacagacagacacacacacacgagguccuguauugacguuuucccugaggaaaugguucuguuauuuuuauuauuuccuguaaacccucagcgcguaagcuagcuagcuugugaaagaagcagacaggccuccuccauccugcguugaguucacaugucucccgcgagcagaggguguacuccaacagagagggcucuagaagagacagguuuaauacccuagacuuuucucaccagcccuucaacaccagauuuaauguugcugagcgcugaguccccucagugucuacacugugugggccacauucugucugucacaggacaugguaagggcacucgacauagaugagcgugggucgggacgcuuacaggugaacagcaugguguguugcaguggugagaguaauguguggccggcucacacagugacguuuuauucauugagaagaguuugagugugugcuaaggaugggccugugcauuacaugggcucucagcuacagauuugcccucccaaaagacgauagauaccugguaagcgagaaguccuugaagcccguagugucaucguuuggagacugauuuggcgguacccaguuauagggcggggagggaaggggugccucugcuauaggccuguacuugcauaaucuggaugacaucccaguagugacagccuccuucagaggagggcagaguuucuuuguuuuuacauguguguguaauguguguucacaaacugcguggauaucccggggugcgugcguuucucagcugcucucagcuuucuguguggagaugcucagucucucccugcagguggcgcucaccucacgguuuggccagcccagcuugccagcuuguccugcagucccauucagggcauuacagaugaauggccauaucugugggugcuggggcucaaugcuccugccuucauacuuucgugggaagcgcgucauucacugagccacuucucuaccuuagaauuuauuuuagcucauauacugaaauuuuuucucuauuuucucacccuucuuccuuuggcuguauguuuauaagauucuguaguaaugcaucuuaauuucauggccagagaaagugcgucccuguuugaugaauucaucucccuucacaucuugcccccacacugaaagaaaauccugccucuuuaguuacaccgguuuucugagucagccgccugggcucuuagggcucggaacaaucagcucauguccggguuuuaacuucccgugucucugugccaaacuaaacggaaugcaacuccguuuauauucuggcuucauuguagagagcucacaaaacaauaucagggaaagaauuguugcuuuuuggguaaaaggcaggacagaaccccccacaacagccuucccucuucuuguccagagcguuuauauucuggcuucauuguagagagcucacaaaacaauaucagggaaagaauuguugcuuuuuggguaaaaggcaggacagaaccccccacaacagccuucccucuucuuguccagagcgaccgugcacauccaggugaacgacgugaacgaguacgcccccguguucaaggagaagucguacaaggcggccgugguggagggcaagcagcacagcagcauccucaggguggaggcuguggacgcagacugcuccccgcaguucagccagaucugcagcuacgagauucucaccccagacgugccguucacuguggacaaagacgguaaggacggaggagccucgugaggccuggccccuccggugagaucagaggcugaccugacuucccggugcuggccaagcaugggaggggagcuugcaggcugccugcaguccacuuagcuccagucccucggguuugacuuaacucgcuggucugaagccgcucucaagccugggcucuucgggccucuccgucuccaagccaaguccaguaaaguccucauuuaaugucugucuucucgguuccguccgccugcagcugggcauggugucccuguagcgguuaccuuuuacacacacuugugguaaugcugaguauccagugcagggcuuugugcuugcuaggcaaauguucucguaccggaccacgcuaucgcuccuuuugccucauccuauaggggaggguucguucauccauccauccuuccuuccuuccuuccuuccuuccucucuuucuaaaauuauuuuauuuuuacauaaaauaauguaauguuauuaagcauauuaaauaacauaaacuaauaaaauuuauuuuaauauguguauuauauaaaugaacauuuauuuauuuaguuuuucuuuucuuuguuuuuuuguuuuuuuuuuuuuuguuuuuuuguuuuuuugguuuuuugauacaggguuucucuggguagcccuggcuguccuggaacucacucuguagaccagcuggccucgaacucagaaauucaccugcuucugccuccugagugcugggauuaaaggugucugccaccaccgaccggcucuuauguaguuuuuaaagacaggguuucucuguguauccccagcuauucugaacucacucuguagacuuggcuggccucaaacucucuagagaucggccugucucugccucccucccgaguacuaggacuaacggugugcgccaucacugccaggcucuguuguagguccgugcacgggaguacagguaauuacaugccucuguguagguccgugcacaggaguacagguaauuacaugccucuguguagguccaugcaugggugugcagguacauugggagcccagagguguuggauccccugcaucuggaggugcaggcaguugugagucaugcgcugugggugcugggaugggucugcuggaagagcagugugcucuuaacugagccagagucuuccuguguagccuaagguggucucacaucuguuauccuccugccucagccugcuaacugcugggauuguagcuaggaugggguuuauauccucuuaccccugccagaaccugggcuccugaguaacugaugggagaaacacaaggacucagcuucuuuguagcucgugaaauaacuucucgaugauaacauggugucucccucauaagcugaugcacacugcagucucugguagaaccgugccuuucauaugugagacuuugucgggucgggagagacggcuccacagacccaggacagaggaccugccuucagucuucagcaggcaaaucaggcugcucacagcuaccgauaaauguagcuucaggagaauccaacacucucuucugguaucuaaaggcaccagccaugugugugguguauauacaugcaugcaggcacucacacauaugugaaauaaaaacaaacucauuuaaguuaaaggcccugucuguccuggaacucacucugcagucagguuagccuggagcucaguuacccauacaccaaaugaaaggguucuuaaaaaguuggguggccaggagugguggcacacgccuuuaaucccagcacuugagaggcagaggcaggcaaauuucugaguucgaggccagccuggucuacagagugagcuccaggacagccagggcuauacagagaaacccugccucaaacaaacaaacaaacaaacaaacauugggugaaugguacauguccuuaauccugucacgugggaggccaaggucuagccuggccuguauaauaugagauccaggacagccagagcuacacaguuaagacuaguguagaaagaauacaagaauaagcgggggacgggcuguguggguucaaacaguccuggcauucucaagccuggauucccuguguucuucggcucuggcaggaaggcagagugcugugaucucgggacucgguuuacuucaagcucugucugucccucccucacagcccaaguaaagaugguucucaucguugcuucccuuuucugccagguuauauuaagaacacagagaagcuaaacuauggcaaagagcaucaguauaagcucacagucacagccuacgacugugggaagaaaagagccaccgaggacguccuagugaagauaagcgucaagcccaccugcagccccggguggcaaggugagcugccgucccuuuagcucuuacauccauucugaaacgaacgcgccauagaaaacgugguugcgagcuuccuuucuuucucucacacccauccaugggccaacgcaggcuggagcagcagaauugaguaugagcccggcacgggugcuuuggcugucuucccgagcauccacuuggagaccugugacgagccugucgccucugugcaggccacgguggagcuggagaccagccacauagggaaaggcugcgaccgagauaccuacucugagaagucccuucaccggcucugugguaaggaggucugcugucugaagcccucugucucagggaggcgaguuccuuaggaucccagccccugugacuuggucaguaaacugauggguagaacagacgcaguguucugaaguggcuuuggcuuccuugcugucugguuuucauuccggacgggcauggggaguauacagacccugcagaaucaauucagaauuacguauguguccgcacugaagagccuguguuucaaauaaaguaacguauauucagagucaucagggaugggugacauaagaacaaggaaccaggucuggggaugugcucuguaaucuagcuauucuaaaggcaggggauccuuugagccaugaguucugguuccgccuaggccacauagggcauacuguuggaaaggcacgugcuuuaccuaaugcaugaggcugaguucaaucccagcucgagaagggaggacaaaaaguuuacccugacgguauguccugaugguuguaaaucuucccucugcucuuuuuuaaauuagauuuuuuuuuuuaauuuuacguguguggggggcauguguggcgugguguucaugcagaagucagaggaugucucguguuaguggguuuucuccuuccaacacuccucagguucuggggacugugcugaguuaggucaucugugcugagucaccucauugcugagucaccugugcugagucaccucauugccuucucuucucucccccguucuuuggugcaguaguuccaguucuagaaauuuauccuuaggucagaaucaucagacacauagaugcucagucccugucccagagagaggacuaaguaaguuacaucguaucugugcagugaacugcuaugcagccacuuuaagcugugcuauagaagcauaagaagcagguacguauguauugcagauacagcaggauuccaguuuaauaagcacauugugggcuggaggugugccagggaccagccucggcuuggagagggguacugaggaaggggugugugggaacagagaaagaaacaacucuaaguuaaaucgugggucacaagcugacagccuguguuccgcuugagacagcuuuccagguagauuucugcuugagacagcucucuuaggcacagcuuucuuuacaagacagcucucuggugcuagaaaaaaaaaaugcuaaaagcucucuggauagaucauagguuuuacaaucaaagucagaaaagcugccagaaaaaaaaaaaaucccuggauuuuccagcuaaggcagaaauccuguuaagagaaauucuaaaaguaauucucagguuuucugaccaaaaaauaucagaaagccagagaaaaaaaucuaaaaacaguuguguuagcucucaaagcaguucuuucccuggguuugcucgaucucucccuggccaaagcccauaucaauucaaucauuuacuccagguuuacuccugauuaucucacaagucaguauuccaggaccccagccccuugauucuuagaaagagacagcaagcacuuuuucuuuaaacauugcaagugaauucagaggucugccuacagaugcaagcacagacaguaaaccagcuagauggcauccggcucugaggcugcuaguccuaccacgccuaggaagagcgagguuaggccugggcucuuaggaaauuauauaaauauauuuuuuuuucaacucauguuuucaggguuccuucccacagccuuuuaaaggcuguccauauaugugcauacccauacacaugcaugcccacauacaugcaaacauggacacacaugcacacaccacucuuuuauauauucauaaaaagggauagaaguguuuacacacaaaaguguauauuugggcgggaacaucuaaaguaauuuugugguuguuuguuuugagauagggucucacugcauagcuuuggcuagccugacucucacucuguaauccaggcaaucugaaugcacagagaugucugucuuugucucugccuccauaggccuguguaccaugccuggcuagguuuuaucuucuucauucuucuccuuaaaacagaaaauccacaguuugugugugugugagagugugugugggugugcauaugagagagaguguccaugugugugugagaaugugccugugugagugugugcauuaguguguguaugagagaaagagagagagagagagagagagagagagagagagagagugugacuugguguugauauuuugucucacucacucuguagccaaagacucacuuguagcccaggcaggcuuugaacguggcagcccugccucugccucucaaguacugagguuacuaucuguguacuauuaauuacauuuccauuaagacaagaaaaaugccuuacuuuucaggaaaagcaaaaccaaauccgcaagcauuccaaccccuuagugaggcacugaaccacucccaggcucccuguuuuccguggaacucacaaguccugucccugugguuucaggggcugcugccggcaccucagagcugcucccgucccccaguagcuccuucaacuggacugugggccuccccaccgacaacggccaugacagugaccaggucuuugaguucaacggcacgcaggccgugaggauuccagacggcguugugacccuugacccuaaagaacccuuuacaaucuccguguggaugcggcaugggccguuuggccggaagaaggagacaauucucugcaguucggauaagacagguuuguugggucccuggacuggcuaguguucuucagagucuccucacagggacuggguccucuggcugcucuucguucuaugcuggggacacuuuguccucaagagagacaagaccuagccuggggguuuaucaguuuuacucaguagauuacucaguaaagugcccguguauccguuucuaaccccugucuuggcccgacuggaggguucauuuguacagaucaaaucuuuaaauccauuaaggagccaguccuuacucuccccuugggccugaaguuggcaguuuacccacagacacugucugucuuugcagauaugaaccgacaccauuauucgcucuacguccacgggugcaggcuaguuuuccuccuccgucaggacccgucugaggagaagaaauacaggccugcggaguuccacuggaagcugaaccaagugaguagcugaaccuggccaggucucaucucucuggaugugacagccugagggacacuguggucuguguauccgucggucacaggauggcauaucagacucuuuaagcuccuuucccaugugugcauuuuauacauaaaauacuaacauaaauaguauguucuuuuggggccuaagagauggcuccccaaguaaagggacuuaucaccaggccugacaaucugauuuggguuuuguuguuguuguuguuguuuuguuuguuuguuuguuuguuugagacgguuucucuguauagcccuggcuguccugaaacucacuuuguagaccaggcugaccucaaacucagaaauccgccugucucugccucccaagugcugggauuaaaggcgugcgccaccacgcccagggcugacaaucugagcuuggucccuagaacucaugcccacgauggaaggaaagaacuaccucuuacaaguuguccucugacguguacacguguuguggcccaugugccaugugccacaaaugugcugggcaaugguggcgcacaccuuuaauuccagcgcuugggaggcagaggcagaggcaggcagauuucugaguucgagggcagccuggucuacaaagugaguuccaggacagccagggcuauacagagaaauccugucuugaaaaaccaaaaaaauaaaaaaguagcaaaaccaaaagaaaaaaaaaaaaagaaucuguguuuuaaagugaaagugccguuaugguugacuggauuaucgccuggucaccugagucuaaggcuuggcgucccagacuguaccagggagugcuagacugacucagcccuucagaggcaccaaagcugccuuaaacguucaaguggcagccaucuuggugucuuucagaugccauacaaacugcuagcuggagauguaugucuggugagaccacagagcaccccucuuggugaugucuuugggggucugauuucccaucauuccugugauaagggaggaggaaggcuguugaaauaucuccguuaaggaaaugaagucagcgcaugcugcaaacccagacucacacagcuugugaagggggaagcucuggcuuagcugaguuacuugguucguggagucagugggcaaaggagggccaggucauuagguuaggugggccugggcuugcuaaaauguaacaacuuucugugaaacaguugcgagauccagaaaccaagguauccaugagaggggaacagagccugugguaugccagucuuucuguugugguuuuuauuuauguaaauaauccuuucuccaaagcuuuuacuauauguucccaagaagcuaaggaaagugugccauggaaaaaauuccauguggaugcugcaggcugugccuacugaggugacucauguagggucccgugguuucacauuuguuaaaacuucagauuuauaaggaagacaggugaggguaagggccguuccugggccucugcccggccucuguagugagcagcccuugucagcuuuguuccuugacuauaccugugcucuguuaauaauuuauauuacccauccccaagugacucaguaacucccaagaaauucggaacagagugcugcauucaauauagacauugugucucuaaguuguaacauagcccucacauucauuaaggaggcugggggcguggcuuagugacuacacaugcugggcagagcugagacccuggguccaguaugagcacccucauucccacccccaaaaagggaaacagaggaaaagguaacaguaauucuuaggauaaucaaauauccaguaaguguucaaauuucaagcuguuuuaaagauguaucuuauugaaccagagucucuuuacaguuuguuuaaauaaggauuccauacggagucagacauugcguuaaguuggucuauucauaaugccuguuaacuacuguaaaggaauucaguuuaauuuggcaugcagucugaguuacauguuuuuauuuguuuauuuggucuuuuuuuuuuuuuuuuuuuuuuuuuuuuuuuugaggcagggucucuguagaccuggcugaacuugcuguguagaccaggcuggccuugaacucacagaggugcugcccuuugcuuugccuuucuccuucccucccuucccuccucucccuucccuccucuccuguccucuccccucccauccccuccccuccccuccccuccccucccguccucuccucuccucuccucugacggggauucacauaguucagguuggccucaaacucuacucuccagcugcugagagauugcagccaggcaccauggcaugguuaugcaugguccuggggauuugacccccaggccuuauguguggguauucaccagcuggccucagccuguauguuccuguuuggaugaggauuucagcagagaacauguaugugcucugucauacaacuugacuggugauacugcuauuuugguccgaaaauaaaggacuaguauuugggagguaaaaguugacggacuacugacuccaaguccagucccaagacagccagggcuaccucaguuuuuaggagauaaaugucuaaccugccguuggagaaacuucuggagaacugcacagccccuggcugagucccuggccugugcugcugcugcugcugguuagcuaaugccggagagaugaggaagucggccuucuguccagugggauguguuugugaaauacuuucuccacagacuuuuaaaauccuuuucuuuuuaggaagucauuccuacgcgugacucaucuucuggguccuguccugcugcagcugggguugugucuuuggcuaagcagcugguugacaugucaugcuuccauugccuuggcuaggucugugaugaggacuggcaccacuuuguccucaauguggaaguuccaagugugacucucuacguggacggcaucccucaugagcccuucucugugacagaggacuacccgcuucauccaaccaaaauagagacucagcuuguggucggagcuugcuggcaagguaacgaacggccucggggauuaaauaacagcuccuuaccguguccucacugugucagagccuuuuuauccaugacuccuuuaucugugcguagccuuuuagggaacacuagucaugucaucgauuguuguuuacuaaagguguguuuguacgacagacacaucaccuuuccugaaccugagaacacacacacacacacacacagaaaguaugguuaggaaaccagcauauaaaccuguuuauuaauuauuggugucugcaaagcuggaggaaagagugaaccauagauacagaaauauaaaagauguagaugucuauggcuggcaggucucuucugugguauuuagcccuuuagcaagcugucaagagcuugcuaggaaccugcaagugaggggacauuuggagaggacucuggaaagcucugcuggaggaaugauccccccccccccccccccccgaggccagagcaaacccuugacaccuguguuugccccggggcaggcugucugccuuuuuccucuuauguguuaucucaggugagcuucauaguccucucauagagcgggacaaacugagacccagggaaggagcaacccaagauuauccaggugaucagcacagagcugcgauuugaaccuaaaugcugugacucaucagaggcggcuuugcucauucccugagaggugaagccuuccugguuuggcgaaaccucugaaccccuuaaacgauacauugguuacuugugggaucuuagguagccaacuaagaugagauaguggcuagcauacagaaggaucgacucuguggauuugugguagugauacccaugaugccccauuaagaggggagaaaaagguuuaauggcaggaccagaagacaguguaauuugaaacuagugaaggacuuggggggacaguuugcugaucccugcucuacugugcagugauacaaaaacacccaugauucuccuggugacagggucacagugaccacccacacugcugugguuuauagucuaucuuuauagccaaaggaaauaaguuauuagaaguaagcauuaacuguucuuguucaaauucacagagcccugcucuggccucggagggucacgcgcccacugugacccgugugccugacagccuccuacccaaauccaggcaccaucacugugugugcugggugaagagacuuuagauaggauuuuucuccccauaggaagacagugccuugacuuuaguuagaaaacuaugaaugaaucuaauucccaagacaaaucuguuuauuuuaggagaauuugaauuucacguuuuuuuuuuuuuuuuuuuuuuuuuuuuuuuuuugguuuuucugagacgguuucucuguguagcccuggcuguccuggaacucacuuuguagaccagucuggcccgaacucagaaauccgccugccucugccucccgagugcugggauuaaaggcaugcgccaccacacccugcugaauuucacaguuuuucacgaaauucuuucggauacaaaggaguaagagagcacacugagugaaccgcuucagguucauugucggugugugcaacucccugugaggaaauaagaugucuuuuagguuuauauucaaauguguuguaaggaaaaacaaaaacuaaaaacaaaaccacacacacacacacacacacacacacacacacgcacacacacgcauaaaccugaaggaaacuccacucuggcaguuccaucauguuggugaagugggccaccuugggcuguccugccaccuuuggcuucggggucacugccaucaaacaccagguacuucacauccuuccucgugaccucagcugucucagccugacagcgacuugcacaccaaaccaacacaauuuuuuuuucuaauuuuuaaaaaaauuuuuauguauguauguauguauguauguauguauguauuauauguaaguacacuguagcuguccucagauacuccagaagagggcaucagauuucguuaaggaugguugugagccaccaugugguugcugggauuugaacucaggaccuuuggaagagcagucggcacucuuaaccacugagccaucucgccagcccuuuucuaauuuuuaaaacuccacguguuacaguauuuccgaguguauguauaucugugcaccaugugugugccuugugccuguggaagccagaagagagcaucagauccccuggaaccagaguuacagaugguugugagccaccaugugggugcagggaacugaacccggauccucugaaagaauagcccaugcucuaacccacugacccaucucucuagcccuuaccaacacaugcuguuuaaaauucaguucacacgggaaaagcugcccuuugccuuucagugaauguggaaccccucuccccgauagaucacaguggggaggaugggccauuggcagcugcuucaccccuaacuguagauccugguggguggacauggagguauaacccgcuucacacgucuggccucaucccagggcaucucuacacugguugcauggaguaacgagcacagcauaguggccagugugacaaggggaggcacuuccccgaaacacaguacagaaggaguggguucugugcucagccaugggugucuaaucaccagggaagcuuugaauucucuacccugaucugcagcuguagagacugugcucugugagugcccaggccugccgugagguccguaggcagucagccagugucccucuuaacgucguccuuccucugguacuuaaaacccagacaguacagacucacguguuucaugugccacauucuggaccugguaugagccccucccguuuuguccgugcauucugcuuccugucuggagggaagaagacccuguccaggagcugaaaguuuauuuacgucugcuccagugccacgcucaaccagaccuccaggaaugcacugucaugucagcuaaacagcgaauuuggugugccugcgucuuuaucuuacuuuaaaccgauuuguguuucugcaagaagaagugccuguauaaaagagaaaccccaaaugaagcauugggggauugcacuuggugaccucuggggaaaggucaccaagugcaagcuuguaugcaggugaacugugucccagcagucaagggggacuuuggucucuggggcccauguucggcugcuccuugaaagcacagugugaaggcccuaaccucuugguccuuucugccgucugucuugccuuuccagaguauucaggaguggagaguggcaaugagacugagccugcgacgauggccucugcagguugauggaucaccccacccccacccgcauuccccauucacuauagcguuuccuuuaaagaugagacguugauccauuccacaugucgcaugagaugagcagauugcauuucgaccccagacaccauuucagcugcuugccugcauugagcuuccccauugccuccugggacuuccuucccuuccugccccaucaacccugcagaggcgggcagaucacaccccuguaugcugcguuuguggggauccuagugccuugaguuccccaggcccacugcaugaggcucccacuaaaauuacccaggcuggguuugggaggccccuucauggugaucaguuagcugagccacaggacagaagagcaguuucuacauuuuuuuguccuaguggacagaaauucuaaacagaaauagcaauucccuagggaugacuugacgugacaaggcccuggccuucauuaacauaaaggcgagcuguaguuuguggcugguuauuguggucugucaagucuguccucuaggguuucgcuuucuucauucugucuucccugacuguuauccucagagauagaacucaacagagcuuccgggaagccaagauagcucaaugcaugacuugcuugcucugcaagcauggagcccggaguucagaucccuaccacauaccugaacagcgagugaccccaguggcucacuuguaauucuagugaucagaagucaaagacagggacuuccugaacaagcuggcuaguuagaccagcuauaugggcaaacucuggguucaccaagaggccuaacucagugaguaagauuuccagagucaaccucagguugacucacaugcacacacacacauguacccaaacauauaugaacauacauacuguucauguaugcaucgcacacacgccuacauacaugcacaaaugugugaacacgcauacacuugugaguacuguacacguagacauguagaaggccccagaggguuuuauguggagaaucuaagcauccagaguuccugcugugugaugagccaggcuuucccccacgcccagcuccuaaguccucagagccaggaagagcgucccacaguguacuuggccaauaggugccaguuguugagcagguagagaggagggaggcagugucugugcaccucggugauggcacugccuuggccgcugucgucaaggaauggccagguguauaaggaccuuggaggggccucugagcauucagggugugggugagggaccccucucccgcuccucucuucuucaggccaugugcaugaucauaaacaauuuaauuuuucauugcgcuuccauguaaacuacaaggcuaacaacaggguuuguucugaacuaacuugcauguccauccaucaagccaccaccacugguaacacggccaugagacauaaccaggagccugugggccgcaagcccaacgaaccucucgcuuccuucccucccuaagguggcgaccugcacaugacacaguuuuuccgagguaaccuggcuggccucacaguccguucugggaaacuggcggauaagaaggugauugacugucucuacaccugcaaggaggggcuggaccugcaggucccugaagaugccaacagaggcgugcaggugagagcuccccugaccuuacuccuagccucgcccucugagaguggggccagcaggguagggcggacacgggguccuggacuuuacccuaugugagcaucuuguucuuggggacuaaacagcuucuccgagacucagccccggcugaugacuccacugccucucaguuuuggccgcucucaguugggaccugguuccccucuccucucucugguauguugauuucagauccaagcaagcuccagccaggcggucuugaccuuggagggagacaacguuggagagcuggauaaggcuaugcagcacauuuccuaccuuaacucaaggcaguuccccacaccaggcauccgcaggcucaaaaucaccagcaccgucaaguaggucgcagagcauccaucucugucaccuaccccugggcgggaaaugggugugccuuuaggucuuuagccuguuugcguccccugcucgggaaggugggucaucacuugaucuggggaagcugaaugaggcgugggauauguacugaccacagcauucccggaguagccacccgcuguccccagugagucucgcacaaggcucucacggccucucccuccucuuccugccucucugacagguguuucaacgaggcggcuugcaucgaggugcccccgguggaaggcuacgugaugguuuugcagccggaggagccuaagaucagccugaguggcguccaccacuuugcccgcgcagcuucugaguuugagagcgcggaggguauuucccucuucccugagcugagaaucaucagcaccaucaccagagagguggagcccgaggcagauggguccgaggaccccacagguaacagcugcccccagggccugccucuucugucuugacuggcagccuccucuugggcccuuuuuccuuuaaguuuuuggagggguuuuuguuuuuuuuuuuuuuuuuuuuuuguuugcuuguuuguuuguuuggauugguuuuucaagacaggguuucucuguauagcucuggcuguccuggaacucacucuguagaccaggcuggccucaaacuucgagauccaccugccucugccucccaagugcugggauuaaaggcgugcgccaccacugcucggcugguuuuggagguuuuaauguuuuaacacuugagucugugucuggaacuuggcuguagcugguguuggguuuuaagauuuagcuugagggccagcucaaaggaaguaucccuccauucuuaccgggaacuuacuaagugauauuuauugacugagcugggacugggccugggccuucaacaugcuaaucauauacucuaccacugacuacacucucagcccccaagucuugaagaugacucucccaugcuugguccuuacacuugacugugguuuugaaauguggcagcacggugggugggugggguggggguggggggugggugggugggguauuuaugucaccugcagccucugcuauuucuggucucucucuuuuuuuuuuuugcagugcaagaaucccuggugucagaggaaauugugcaugaccuggacaccugugaggucacaguggaaggggaugagcugaacgcagagcaggagagccuggagguagacgugacccgccuccagcagaagggcaucgaagcaagccacucugaccuggguguggucuucacaggugaggggaaggcuucggccugcccauugccuacaaaugcgcacuggugcauccgccucacacuggcacccuucugcacauggagggggcacgggcagugcuuugugcaggguggggcugggcacauaacaaacagcucaugccccaggauggagaaaugccugcuugcuuugcuuuaguucccugacucugaaagucacagaguuguagcccucagcuuggcugacccaagggcccaccugggcuccagacuuaagcugcucacccucaacacccuacaggcguggagaccauggcaagcuacgaggagguuuugcaccuccuucgcuaucggaauuggcacaccaggucccugcuggaucgcaaguucaagcucauuugcucagaacuaaauggucgcuaccucagcaaugaguucaagguggaggugaguccagggcgcccaccgcaaagggcgaacauuaaguaaucagauguccugacucgggcucccaagguuucagauguucauggcggcgacuuauuuaggcucagagcagggcuggcuggcuguguccacaggguagacauacaggccuugaggagcagaguuggagugugacgacagagugucugugaacgagcccccaggaaaccaaguggucuugguggcugugucagaccaccggccccguugacagggacauuugggucccggguuguugagugccaacacugccacagucacucugaggccacagcagcuaaaggacaguacacucugcccugacaccuucaguggccucugccgcagcugacuucaugggccagcgccuccgaggucugaagaaauaaauucugagcaacccgcccgccaucuccaccuugauccaaguggugggcggaggagacuaaauguacucgagccaaaggguggcuggugagaagaaugggaagaggugaucugagcugucgccuaaggccaggguggcuuccuacucugaugugaaugccuucuuuuguaagcuacacuacaaaugagccaucggacacacuguuucugggauaugugacacugucacacuguuguaaacaggugauguuuuucuggucacuguuugcccccagccuggagcugggagacugggaagcagcacugccgaccgucuauucaccugucagguacacuuggggugccuagugacacucucucugcuguaggugaaugugauccacacagccaaccccguggaacaugccaaccacauggcugcccagccacaguucguccacccugaacaucgauccuuuguggaccugucuggucacaaccuggccaauccucacccguuugcagguaggacgggggaaagcacgugggucaggaugcugugguauguaggguccagauggauagacagacagacagacacacacacacacacacacacacacacauacacacaaaccugguagcaagcguagcucacaacuacugcccaucaacuaccccaaugcugucacuuacacaaggaagcucgcucaccacugccacagagcagccagugagcgaaggcaggcuuagggcuuccuccuaggguuuaggagucaggaagcacucugacacauuccauuugaccuaccuagaguaguugaggaggccaaggagggaugggauggggggagcucuuuggguguaagcagcgucacaaaagcugugugucuggucuucaaaccccauggcaguuguccccagcacggcgacaguggugauuguggugugugucagcuuccugguuuucaugaucauccuggggguguuucggauccgggcugcacaucagcgaacgaugcgggaccaggacacggggaaggagaaugagauggacugggaugacucugccuugaccaucaccgucaaccccauggagguaggcacagaagggccaaccacaaagcgccacggagacccagacccuggucaugugcuugcagguugggucagugagauuagauuaggggggucaccuucagaugaggaagcccuugcugaaggccuccgugaguagcauaggcaggcaacugacgcucuuggcuucuuuaccccaagauguccgugguaugacaggacuaagcuccgccccucugcauugagcaccccaucccaugugagugguauccauguugcuaaugagagcgucaccugccgggucacuuuggcgaggcgacucccaguaccacucaggcccuucugucacugugggguuggcuguguuuuccuuuguggcuuuuaguagauagacacugggcgauggggcuacaggcuagauuuacgccgucgucucuuugccagacauaugaggaccagcacagcagugaggaggaggaagaggaggaggaggaggaggagagcgaagauggggaggaagaggaagacaucaccagugccgagucugagagcagugaggaggaggaaggaggccccggagacggccagaaugccacccgacagcuggaaugggaugacuccacacucagcuacuaaacccgcacucagcgccugcucuccagacucucucccagccccacggguccacgauguacaaaaucauuuugaccagcaggucugcagacccuucccccacugcucaaaguccucccgugcuuggugugugggaccaccggcuccacccuccccgcccaucaccauugcaguuuugcuagaagcuggcgcuuccuccccagggcaggggccccacagcaccucagaccccaagugugucuggaguucccugucggccagggagaggacaccagcaccugggaccuccagagaagccgcacugagcggacuugucgacagagggugaaaaauuacucccacgcagucaguaaccauuucucuuauuuuuaaaaguuuuuuuauuuuuuuuucccaaacuagugcauguauaaagugggagagcagaggggguuaauauguagauggccaaccgacuuuuuaauauuuuguaaauaaauugggauucuguguguccucugugcuaguaguccaggacaggaauguaaagucagaaugcggggccaggagggccucuuccucccucuucccucccaagaaaccagguuggagaggcccaagucacuggggcccacccuugcuaggguuuccguacagccacguggccggggccauggcuuucaagugcugucugggggggccagccccacgagccuccaaccacauuagaggcugggaacagccaggauguugccaaagccccuggccuuuccuguacacgccugugacuggcagccacaugguuucugcuuauuaacgugagccucccuguuggugaaaugguguagcugggaacggacagcaaaggugcaggcggucaggcuccucgcuuggaagaccacgguucugagcaagucugcacaacagcaccaaaaggagaccccgaggcccaaagauaaacugcuacaaugcuccagaacaaucuuuucucuccuccccagaggccccaugggaugccgcgugcuguuggguuugggcuaagaucuaagacccagcagauaggagacagcagguaccacccacacagcacagcucuucauucacagucaagaguuuagacugcuccagcugggacauccaguccucgcugcuguugcugcuaguucgaaggaugccgccgugcugucuguggccgcccucccauguccuguccccuguagcugcuuucuuagauggaaacaggcuaacgaagagagggacacugucgugucaguagccgcaggguccccuuuaagauguguauaucgacacuaggucagaaaguguaugcguuauaauaaaguucugguucuaacuccag

SEQ ID NO: 2284 - RNA, 1529 nt, Mus musculus
gacauaugaggaccagcacagcagugaggaggaggaagaggaggaggaggaggaggagagcgaagauggggaggaagaggaagacaucaccagugccgagucugagagcagugaggaggaggaaggaggccccggagacggccagaaugccacccgacagcuggaaugggaugacuccacacucagcuacuaaacccgcacucagcgccugcucuccagacucucucccagccccacggguccacgauguacaaaaucauuuugaccagcaggucugcagacccuucccccacugcucaaaguccucccgugcuuggugugugggaccaccggcuccacccuccccgcccaucaccauugcaguuuugcuagaagcuggcgcuuccuccccagggcaggggccccacagcaccucagaccccaagugugucuggaguucccugucggccagggagaggacaccagcaccugggaccuccagagaagccgcacugagcggacuugucgacagagggugaaaaauuacucccacgcagucaguaaccauuucucuuauuuuuaaaaguuuuuuuauuuuuuuuucccaaacuagugcauguauaaagugggagagcagaggggguuaauauguagauggccaaccgacuuuuuaauauuuuguaaauaaauugggauucuguguguccucugugcuaguaguccaggacaggaauguaaagucagaaugcggggccaggagggccucuuccucccucuucccucccaagaaaccagguuggagaggcccaagucacuggggcccacccuugcuaggguuuccguacagccacguggccggggccauggcuuucaagugcugucugggggggccagccccacgagccuccaaccacauuagaggcugggaacagccaggauguugccaaagccccuggccuuuccuguacacgccugugacuggcagccacaugguuucugcuuauuaacgugagccucccuguuggugaaaugguguagcugggaacggacagcaaaggugcaggcggucaggcuccucgcuuggaagaccacgguucugagcaagucugcacaacagcaccaaaaggagaccccgaggcccaaagauaaacugcuacaaugcuccagaacaaucuuuucucuccuccccagaggccccaugggaugccgcgugcuguuggguuugggcuaagaucuaagacccagcagauaggagacagcagguaccacccacacagcacagcucuucauucacagucaagaguuuagacugcuccagcugggacauccaguccucgcugcuguugcugcuaguucgaaggaugccgccgugcugucuguggccgcccucccauguccuguccccuguagcugcuuucuuagauggaaacaggcuaacgaagagagggacacugucgugucaguagccgcaggguccccuuuaagauguguauaucgacacuaggucagaaaguguaugcguuauaauaaaguucugguucuaacuccag

SEQ ID NO: 2285 - RNA, 1122 nt, Mus musculus
ugaagacguagaacucucagcucugccugcaccaugccugccuggaugcugccaugcucccaccuugaugauaauggacugaaccucugaaccuguaagccagccccaauuaaauguuguuuuuauaagacuugccuuguucaugguaucuguucacagcaguaaaacccugacuaagacaggcuucuuugaaaacaaagguucagugacccccauuuuggcccagcgaaccuuugugacacugagauggagccaagcaagguagaguaggccaccauucacaugacuugugucgcucugcccugcagggacagaaugagcaucuccaaucugaaaguccagaacgucaccuuggccagaucagacaugcucaccaugcuuaccaugccccacgcuggaaaucucugcauuuccugucccagguguuucagguaagggacacccaaucuauguuuguauuucagucuacacagugacaaaugacaaagccaacaacuguucuacugcuccaggagaaaagagaacuacauaccguguggguaagcgaugcaggaggcacaucccuuagaaacagcagcagcugccaugaguccaaagaagccagaggaacuuuucucagcuccaucuguggaggagacgaucggagcgucuuucaaacacuucuuuaagcucucauaaauagcaaagcagaugauugucuccgagaucccagcguaggaggcggucagcccucuauagaagccgcggacgccuucugucugguagacacgccgagcacacuggaguguguucaucugcuugcagccccucacccugucggaggaucaacaaugcgcacugagagacguaccacaccaagucauaaagggcaucagccaugacacagaaaccacacaggagaagaaaccuguccuuguucugaggcccccugaccucuggcccacugugaggccaguucaauuagcugagaaaccugacaggucauauaacagauggcaucugaaucuacaaucccugaagcaggcuuauagccucugacccaauucuagaaacugcuaauggaagacaacacuacaacacuugucagaggaacauuuggaaucauccauguaucuaagagca

SEQ ID NO: 2286 - RNA, 12033 nt, Mus musculus
caccuugcaccuggcagcccugccgagcaagcccugucuugcuuugccuucagcguucccugccucuucucaggcagggcuggaaacagcuuguggggcuaauucuacagcagaacaccagcacucugaggucccuccgagacccucuggucuaaccaggcugggugccugccugccugccugccaugggaaguucugugguggggcagaaguggugggaggcauguugggccuugauggguaagggcacuguccugaggaagggcaguucucuuggugugaagcccccaggaugccaaaacaagggcaagcaugaggggagaccagguggguggggaggagaugaaguaguccguggggugggguaacaugugcacguguguuuaggcaacagucauaggagccaugacacacagagucaagccuugccucugugccuucacauacaaggacaaugacuauacuugccuuguggguguguugggacuaaggugaggcacauacacugucugccacaucaaauggacucuagauggccaugcccugucucugccuucuaacagccagccauucucccuaaauccuccugggaccuuccagguagcucuagcagguaucugauggccaauguggugucucuccacaggaccauuccuuggcuguggcuggguagaacucugugccucaucauagaagugacaaacacagcccaccacgaaggugguuccuauccgagucccacagauuuccugggacugcauggagccugagguaggugaccugcagcuuuaagcuggcaacaggccuaggaggugaaaagaucucccggagucccacacugcaaagggcacuugguggaccaguggccuccagcugcugguggccccacagacaccagcuccggugccuaccugcgaagguuggugucaggcucuggaagccgucuggcuucugcagcucucggcgcaccuguccgcuguaggccugguacuggcccaggauggcacugcucuucugcagcccccgcagggccuggaaggcccagagcuuaugcuggagcacggcggcugagcugcugauguugagaggcaguuccauggccaccagcgugaggaucucagucaggugguucugcagcgugucacggaugacgccauacuccucauagaaacuggcccgaccugagugacacgagggccgucagaggguccccgggaugcuaccccaucacugcccuggcauccucauucuuccaucuaacgaaccuaugacaaggugugccacagcaagccucacaugacacaggaaaggggacgguuggaccgaccgcccuucaucuacaaguauucuaggagaagggauugaucaucccgucaggccuuacaggaaugugcuuggggagguccuagucucaggccuaggaagaaacauaucuggaccuuggccagcuuccuugcccugccuucucccucccugggcacaggccagcagggaaagcuaccugaucaaggugagaaucggguaggacagcccggagaggcugggugcuggcucugacagccaccuccuaaugagggcuacuuuguugacuggcuuggauguccuaccgcuaaacagagcuaaaaacaccaccccauggcccagugcaagaguauaccuagccaagguacaacaaaauggaaaggaaagaggaaaggggacaggaaaaccugugagaugugucagagggucaugcaaggcuccuucgagaccaacggcauugcagaugaagagaccugggguaggagaaacagggucugcuggggcuggacagggaagcaagaggagaugguggaggggagcuggcaaccuguggggugagguuaagguacagugccagggcuccaagggaagccccuggauguccacaggggagcaggauccuggccugcuguguugugaggcuguagaggcaggaagagguggcagggauggccaggcucccgcuagagccaguggcuggggagucagagucuuuucagcugacuggauuugccaaccaaagaggagagggugacaacagcaaaaggaaaggagggagcagcggcagacucugaaacugguccagagcaguuucaucccuaacacucagagauggaggacaggcagggaacaaacgcuugaagggaaaccaugcauguguuacaauguugcagacauccagguggagacggcuggcuggcaggugggccagugugacggugaggguugugucuaggaacaccaagcccaaagcuugccaccugggaccugggacaccaucaagcaccugacauaugucacucucgaaccaugaaggucugacauggacaguaucugcuugccccuguucuagcugggaaggagucgugugaccagggccaggaccaaagcauaggagcucugauuaucccugacucccacacagacacaagcaucaaagcacaggacucagauauaccucuacccucgucaugggcuuggaggucccaacuugcaaacaccaagcccagucgccaccucagucacacaucaaaccugacagcacggcacaaagaccauucacuuaccaaaugcuuugccaugugugcuacaguguagcuaacuaaucccugugcgcccugagaaccuaggagcucuggccuccaauacuacagaccugcccucucugacccacuucaugcugcauucacaucuguaccugagggccaugguggagacuaagcuguuguguacgggguaccuaacacauuaccacuuugauacaauagacagcagaaggaauggaugcccacgcauccuggcacgggucacagggagacagcauugcuuugaucaaggaggaacuuauuuggagaggcuauggggacugaagagaugagucaggaguuaagagcacuugcugcuccuacugaggguaccagcgcuuacauguacauacacucacgugagugcacacacacgcacacacacagagguaaauaauggagaaagaggcucuaaacugguacccaugagcagaaucaaaguaaguagccaucacugaaguuagcaaugcagcagagaguaguuagagaugaggaggaacugggagaggcaaaauagaaaagagaccugaaguuugcaaagggaggcaggaugaagaggugaaggaaggcugaggagggacuuggcagcagagccuugccuggcaccacauggcccuggucuccaaccucagcagcacaaaaaaaaacaaaaaaacaaaaaaacaaaaaaaacaaaaaaacaaaaaaacccaagcaaacaaaaagcugauguacaacguguggcuccucacugggaucugacagcauaucguuucaggagauggacacacauaacaacaguaaagaccagggagaugacucagucagcaacuugcuggucaugcguucauauccccaacacccaugucagacgcuggcuguggcggugcacgccuggaacgccagcacuaaggacagcacuccagccccaggaauagcuggcuggccauacugagacccuaacucaagacuaacaauguggacuauguuucaggaagaaaccuggcuccccacaagaacacauauguaaacacgugugugcgacacgcacgugcacacaaaaguguacaaacauacaaacagaaguaagucccucaauauugagagcaacagaggacaggaaauggaauagaggccaaggcgacccaacacgggagaugcuaaagccccuuuaaaccucugcugggaggcugcagggauaagccaguagggaaacgugcuugcucgaaagccugacaacugggguucagucugcaggucccauaaccaggaaagaggaaccgguuaccacagguuaucaucugaccuccacacggguaucauggcgugcacaccccauacaugcacauaauaaauaagaaaguaauuaauuaauuguacuagauagaagucuugaagaacagaacuugcaagagcucagguggggugugcugguagaauucuuauuuaucaugcuuaaggcucugggcucauucccaggagggaaaaauaaaaaacugaaauaaaaacuguugguauuucuuauugcauagcucauucaccuugcaccuguuuccuaagcauuauuuuaucaggaauccuguuacuauuuaaucccaagcagauaaaugagggaugauccuagcuuagacuugugagcugagcaugcguguucugagcaggcauccugagucuucagcaccugccucgcuggacagaugugauggcuaucaggaaauaagggaaauuuaacaggcagugugggaggggcacuggagagaugggucagcgguugagagcacuugccacucuuccagaagaucugaguucaguucccacacccucaacuaccuguaacuccagcuccagggcaucugaagcccucaucuggccacacugauacugcacucauacauacaaacacacacaugcaguacaacuaaaaaugaaauagagccaggcauguggugcacgccuuuaaucccagcacuugggaggcagaggcagguagaucuugguauguacaaggccagucuggucuacagagaaaguuccagaucagcaagagcuacauagugagacucugucucaggaaaaaaaaaauauauauauaugguauaugugaugauuuauauaugcuuggcccaaguggaacuauuaggaggcauagccuuguuggaguagcugugucacugugggugugggcuuuaaggccuucuucuuaacuacccagaagucaguauucugcuagcagcccucagaauaagauguagaacucucagcuccucuugcaccaugccuuccuggacacugccauguucuuuccuugaugauaauggacuaagucucugagccuguaagucagccccaauugaauguuauccuuauaagaguugccuuggucauggugucuuuucacagcaguaaaacccuaacuaagacagcauacacacacacacacacauauuugguauauauauauauauauauauauauauauauauauauauauauaccacauauauagauaugguauauauauguauacauguguauauaugggacauauauauauauguguguguguauguguacauauauauauauuucuaucucagcauuuguugcccuuacagagaggaccaggguucuguucccaacaccacaugguggcucacaaccaucuguaacuccagguccagggggugagauacugucuucugacuacuaugggcaccaggcacucaugugguacacagacauacauucaagcaagauacccauacacauaaaauaaaaauaaauguuucuuuuuacgagcaguuggcauuucaugaggaaagugugaguacaccuugaugguguccauuugaaaucggauucagaggagaccucaugggacacaugguggaguccccaaaaggucacuggaggcaagaggugaagcgacguggcuaauuauaacuucaggaagaagcgggcugcuggcucagccugguacucuggacagcaaacucagcuucagggaugcucaaaugugaaaacccauacuugauaaaaaucaauggguuagagcagauuuaagcaaagagaggacaauuacggcuuuaagaacagaugaauuuuugauggagagagggcaccagaguccuuaaaagcccgcuaucugcuuacuauucauuaauuuccuaaauccccgaguggcucucuuccuauuuuuauccacccacuccuucauucuggggagauugcaugccuggggguuacuaccugcugacuagagagugcuuccuuuacuucuucauuucaagcucugggagugugccuguauuuagcacagcccguggauuuauggguuuugcucccaaccugaucuauaaagaaccagggcuguagccugggccacgcgugaaggagaaagaggcugugcacagggcucagcggcugagcggcagggugggcggggucagcgguugaucggcagagugggugggaccagaggcugagccgcugagugggcgggaccagaggcugaguggcagcgcggacugccaggugcuggcgcuggcucgcucucaccauacucagugugcugacuuaguccaagaccugucagcugucggaacugauuuguuuuuccuaaagggagucucuacuggcuuugcacauucuuuucuagguuaaagguugcaagcuaaaauucagaguguagaaaagaggaagugcaagcaguuuggccaacuagaagaccccguguacucaucucguagcugugcgaguccaggguggaccguggcuuugcccucugcuaucuuguuuaucuaaaagacagaagacugcucggaacugcuuguuaucuuuggcccagugacuccacuguagaaauaugcaagagggguaaaaguuaaugauccaugaauguucuagaaguagauauugcaaaagcgcuaaaacacacugagucacgaacuuuaaaugauaaauuuuacagaauguggacuugaucucaaaaaaaaaauuucagaaaguacuaccuaaaauagcaaaaacuggaaacagccaaaaugccuaguuauagaauuuauacugcauauucugugauauaaauagaacugaacaaaaauauagaucuguuaaaaauauauuaugcagauugucaauacauggagauauggaugggagguuuaagaaagcaggaagaguauuguagaccaguuacagaccacacgcuaagccagcauugguuggaacaggcauuuuaagaucauccuuugugaacuuggagggaaucucuauuuguugaguacaaccacggucauuaucuaauuuaacacagaaaaucacccagagagugccuagggcggcuuucacucuuuacaaguugaaccaagagucacuucucuccaacugagccaguaaccgucucccauguuucugugcugugggagaccuggguucccagacccaaaaauuaauuaauuaauuaauuaauuaacaaaacaaagaggagaaaacaaccaaaaguuagcugcaguuccuaccaaugucuucugggaucacuaaaaauaaggaaggugagaaccgaggggagacacugacugcuggcuggcuggcgcucucucucucucucucucucucucucucucucucucucucucccucccuccucucucucccuggcucuggguauggagcuagcugcagcuaccccagcucacccugcagacagcacagcagauggcuuggaagggacgcugcucugcugagcaagugcccagcaccuuaugucacaugggcagaaggaagccaggacagcuggugucaccugggaggagccugguuguuugggucccuuggugagaggcagugggcagccauccuaacccccaggggugaacaugccuuuccccaaugccuggauagcacacuccucaccaggggcagucucggggagugccccucccccgcuucccuacucccauuuuccaaucaacucuuugugcagagggaacugaauugguagggaguguccagaguacaggguagugagggaggccaacucuggagagccugggcacggagaggcugaggaacacauggauaaaagcuuggguucaaaccccagaacauagacugcugaaccucugucauuacagacccgauuucucugucugcacagucuucuggacucauugcuucaaugcagcaagugaccaaggucacuuccuuagcccaugcugcugcgucugaagaccccaccgagggaccucgggucuccuguggggagaacccaggucagacacugccaggggggguugcugcuggccugaaggauggcuucuuccuuccuccuccagugugcccccagccucugcagcagccucugcagcaagcuccacugagccaaaggcugcggcagaagcagaagccguggaggggagggagcuggagagacugcggccacccagguggaugggggugggagagaaagagccaaacgaccuugcaguucaaaagucccuuucccagggcugccacagagcaggggcgggggcaggaaaugacaggcucagagagcaccccugccucuccagaaugcaggguacaguuuagagccccagcaucuaccccuagguagaagcagaacacgagcagguaggggugggggaagagggaggggaaauggcuugugaccuuggucuucucccuugcaauucagacugcagggcucagaauucagccuuggaaacacucagcccaggcugaggcccacaggaguggcccucauccauugucacccaggugcuggcacgggcagagcuacagcuccugucagguagaugggagaggacugggccugcagccucugcagcgcacuccucaggaugccaaccagacucgccugcccagcagucauguuugcucaaucuagugccaacauggccugcaacagaggcccuccuacugggacugagggucugguagcacaguuucccauuauuggcugcucuggaccagugccuagacuagagagacccaaaccacagcagagcaguuguccugcugggcagcugggucaaaaacaaacauuagaaaaggggaaucauaagugguaguuuguguuugugaccccagcacuugggagucugggaucagggcgggaguauuucugugaguucaaggccaaccugagcuauauuggaagauggaggccagccuaggcuacacuuugggacagacacacacacacacacacacacacacauggccuggcugccuguccucccacuacaugggacagcaccauccuggagguauaggaauagucaaacuacuugcuacaggagccuuguagccagccccuggucugucucugggcacagccacccugguagcagcugcuguucagacccaugcucucacugcuacaggcuggccucacuaaguccaccugucugucuaucugucugccagcuuccacucuguaacuuccaaaggcaccuuuguagugcuauagucugccuggucacagucuccacagaauccucaaaaagaauccauagagggugugcaauacgugaaggaccacagacaacugcacacuggauucuuccaugccccauggcgagcacagggaagaaccccagggagagggagcaagacccucucucccugccuuggugggaacagacggaguccggacagcagaaagaaguggacaccccccgcugguuggcucaggaguggccgcuguaccacccgucagauccaagcccucauucagugccagcucucugcagaugaagcaaggacaaggucccgcacucacucuccguggacaucaggcaccugaaaggguucccaacacugccugagacccauguaaaaucaugagaaggggcuguacccguucucugccguggauccuggagggcauagaucacuaccuccugacagagagaggccugccaagcccugccgagccuccugccccucacuccacaccugcuucccaguuugccuguggccucuacauuggaguuuuucaccccgacccuggccugggucucauacucucagagacccuaccacccugcccagagcuucagugcuaaguacacacaucaagagaaaggagagaaguugccagggggaagagaaagacaaagcauaaaguacagguggaggagaggaaggacagacagccaucauugggccagaagccuggggggcucugcucuagccaggucacacuuugggguggaaagggggguggccucuggggauuccugcagcugcagaaggcaggcguacaucugcgugggacggugacacugugcaguggugccacgcgugagaggugaagccgcacagcuggccuaagagcggucuccuucacuccagccgaggauuuuggacacaguaccauacugauucuuuuagagagggucaguaauuguccccaccuaauauggcuacuggggacauaguaacaguuagcuucuuaaauuauuacuauuuaaugggggugggauggggguaaaagagccaauguuguaagcgcaaucaaaaccgcaauaacagaggccugagagauggcucggggguuaaagcacuuauagagcaacugcauccaaugcccggcacccacagggugacucacaacugucugcaacuccagucccaggagauccaguguucucuucugaccucccgggcacuaggugaguaccugguacacaaguacuuucaggaaaaacacuaauacacauaagacaugaaauaaaucuaaaaaaauaguuuuaauuguaauaacaggacaagaaacauggccuguugaguaaauguguugccaucaagccgaugaucugaguucaauaaccaggagccacuuguuaggaaagagcuaacuccaaagauuguccucuaaccuccacaagaucacaugacacaugugcaugugcacgcacacacacacaucuaaacauuuuuaaccuacauugcagaaugccauaacucaaaggaaccuuaccugucaucacccaaaaaaccuacuccugccagagauggaaaagugacacacugaagauacuaagcuagaggcagagacgagcccaguacucugccucccgacccuggacugauaccguuuguacagcacuucguaagacaggcgcccucuuggcaccuauaaucacaugugagagauaggaaagccagcccaggccaggaagggcuccacagagagcaagggaagccuguggcuuugggagggaguggcccgugaaggccucccagagaacgagcaagggugcuagcgaucacuugagagagacaggagggcauaggagagcugccaucccccagguagcagcaucacccacauaagaaucaagccucacaacugcaauggccgccauuacacuagagugcaguccccgggacagagaggccagaggaucauaagcucaaggucauuacuggccauguagcgauuuugaguccagccugggcuauaagagaaccuaucucaaaacuacauacacacacauauacauacacauacacacucacacacacacacucacacacacuaaaacauuccugggguaaccuccagcacuacuugucggccguuucaaacgucuccaccaggugcaugucacuggaccaaaugcccccuuuggcaucaaugacaaguugggcuuuaccacuagacacccugcggauuggccgaguaaaaagugcagcacgcaguagggagacauacuggaaggaggucacauacuaacagaaacccucccuccaagcugagcuugccguggugcaaagaccuggcugauacuccagacugcagggccuggaaugccaccaaacaccaggcaggcaaggagugccaggacucucacgcaccuuccgcaucuauggucuccuucaagaugaucuccacccgcuccacauggugccuguuccagaggccauccaaggccuugcgguucugaucucggaagggcaggaucugagccaccgccugucagggagggagacuggucaucccagguucuuuuagguaaaggaagagcccucgagccccagcccucuccacuuaaaaacacucuguggacaauggcuccuagaccucaggucucacagcucagugagauacucuagacaaaaugaccuaaacaguuucuggcuaagaaagaacauguuuuaaauugacuauuuuccuguggcuacggcucaguguagggugauugccucacgugcaggagacccuagguuuaauaugcaguacaacgaaaaugaaaaaaaaaaaaaaggacagaaaaaaaucccuaucuuuuaagacuaucaacuuuuaauaaaauaguuuagugacaaaauuguaauaugaaaaacuccaaacuguauacauuuaauauuguuuccuuuuauuuccaggccaauaaacccuuagcaaagcugg

SEQ ID NO: 2287 - RNA, 425 nt, Mus musculus
cauauauauauauacauauauauauauauauauaaauccaagaugcuauucucucauuuccccaucuuccucuucuucuucaacgccucugauguagaggacauuauuacaccuuauuagaacuucgcccagauguccagacagcgccccaucuauguacucuucuguauuugcaagcugcauguucauguagccauccacggagaccagguagcccuuguacuccaugccccacuuaaguuucaccaucacuggcuucccugucaguccacugagaaaaggcuugggguugagggguagacugaucacgaccaccggcgagcgcugcaccccgcuagccgccgacuccgccgcugcccgccccuugugaccggagcggcugccgcuacacccaagcgacccgcgcuaagagaaauggccgacca

SEQ ID NO: 2288 - RNA, 4107 nt, Mus musculus
uccugauaacaaaucaacaagagcauauuugcaaacuaguaaugugggcgugcuuguugacauaaaaggaguccagggugaguauuuaauaaugcaggauguuaaacauuuuggggguuguuuagaguuauucaauaacaugauuguauaaugauuguauaacaucaauguugagaucacagcuucacauaauauguaguuauguuauguacaaaauggcuggaguaugauuagggccuuuucggaaauggcugaaauucuguucuaaucccaagccagaauuugacaauucuuuuuaugaaacucaaacaucugucuuuauuaaaauuuuuuuucuuaaauauuguuuauuucugugugucacaauguuuguguugggacuuugcaugccauaagucucauuuagagguccgaggacaauuugcagguccuagggauggaaguccgguugucagguuuagaugcaagccccuuuccaugcuaagccacauugccaguccucaaaaaugcccuuuuauguuauuggguuuuuguuuguuuuguuuuucaagacaggguuucucuguguaaccuugaguguccuagcaaaacgucaauuuuaaggaguuuuacauuaaguccugacuguaggaugcccagaagcauuuuacugauggccagaguuuucccauucagugaguuuuuaacuucaugacuaaauauauucucugggugagggcaacaggggaagaguuuggggaagaauacgguacuggauauuggcaauaauucguuuauuucaugugaaugcggggguuuggauauagauaugguguguguguauauauauauuccaccauguggugccugaugcccuuggaggucagaagaggaggucaguucuccuugaccugcaguuacaccuggcugugagccaccaccaugugagugcugggaaucaaacccagauccccauccaccccacccccaccccccagcaacaacuguucuuaacugcugaguccucucuccagccccuggucauuuuuuuuuuuuuuuuuucccaagacaggguuucucuguauagcccuggcuguccuggagcucacuuuguagaccaggcuggccucgaacucagaaauccgccugccucugccgccugcugggauuaaaggcgugugccaccacgcccgguguccuggucauauuucuaaagccagaaguaaaguuuuccccacuaggaacaagccuguaacucacucacucauaaaccgaguuaccauggcuaaguacagauuuguguuugggucucaccuggcugugaggaugcaugcauagaaaacaaugaggccuugcuuccaaggugcagaguacuaaagaaacaagugucagucucagcagccaugugugcaggugauggcuggcccuggagcauuaagcagggcuacuuagcccuggcaguaugacccagccaguuaccacaguuuaaauauacaccuauucuuucucugucacccuuggcagccuggcauucugacauuacaccuucaggaccagagaaauaauauacaaggccuuggaaguguugaguucauguucaguugcuggaagacauaagaaacagaccaugaucuuaguggcuuagcauuccucucuguaaacaagucagcauguuaacuauuaaauuacuaucgaaaacaugaagguuuucauguggagacagggguucacagagggauggaguugccugccuuagaagcuaggcucacauacugaugucauccagcuccugugugcugagggcuuggcuuuguuucgauuauuucagaggccgcucugcguuucugguaaaccacaagguaaagccgcccugcgaggcagaugucugguugguuuugaggccuguggcuuuccauagagaaguaacaacacaggccacaugaagcuuucacuuccucuuuuucuuagaauagggccaagagugcuuugcacuuguuugucaugcaugggcagcaguaauaggucugcacuccccaucagaugcuaguucauauuucuggaaguguaguuaguuugagaugccugugagacagccacgugaguguucucagugggauugcuucauagaugcagccuuagagacacuagugaguauuuuucaagaaacuuacagccagaacacaggagguuggagguuguccugggaauuuugaggaguagaaagaccaaagcagacccuggaagcacauugagaggauaaguaaauaauugggcugggugucacagggagucauuucagcuuccagaguucagaguggacauuuuuguggugguccuuguuuguuugguauggguuugcuugcuuugguuucuuugcucuguuuuuuuuuuuuaauuaauguagggcagccucagacucacaguguauagaagaaugaccuugaauuccuuagccuccugccuucauauuccaagugcuggaauuuuaagcaagcaccauguugcuuggccauggguccuucuccauuucuuaguccacgacgagccagugcuagcagaguugacuucacuuguuucagaaacuugagaacaucaacugucuaguaccauaggaaggaacguggcgugugauaggauuccugccuuugcagcuuuuauagaugaguacaugaagucuccuacaaaucaaugagugggcuggucacaggacuuuaauuuuggagcaaggauuccagucuguauuuuaaaugaacccuggaaguagaacugauaucaucaggcaucuggauggaaagguagggugggccuugacaucaggacucaaagaagcaugggcaccguccugcaggguuaagcguuacuuuuuuuuuuuuuuuuuuugguuugguuaguuuucuuuuuguuuuuuucagagaugggggucucucuguguagcccuggcugcccuggaacucacucuguagaccaggcuggccucaaacucagaaauccgccugccucugccucccgagugcugggaucaaaagugugcgccagcaacgcccugcaaguguuacucucagaagagcugggaaagauaaugggagcugauggggaaagccauagguuuguguuguuucgugcuguucucaaaucugcuuuuagcugaggcugcccuugagcuucagcucccacugcuucugccuuccuaggcuagggcugcagugugcuuaaaaucuggaggcuugaaagcuucccuuggcaaaggcuugucacaggcuguguggagagcugcguuccgggaaggagggcuggaggggggaccugggccuucaauaggugggcuggaaggaagaguugagcugcugaucucagaugugaagaacuggcacacugguguuaaaugaacuggaaaguguacagucacaggacagcuaccaacagacugaauuucauagagaauguugggaaacuaggacuugugaggcuggcugacucugaucuguuucaugauagaccuuccuuagguuggggaugauagagcacaugcuuaauaauuacuuuugauuugaaugguguuucucauaaucugugaacgcauagauucugaauucauuggccugcucuaucacauuauccagauguuccagaguccgccuucuucucucuuuucuggugaauacauuguauguugcugggcacuaacccuacauuugaugccacagucuggcacuccacccuccaaacuaucuccuaccaaccaucuccccuucucaaagcucccucuaacccuacaaacacugcuccucccauugguaaccugccuuggugagaagauguucuggccucccuuggugcacaguugcgaugccccuugcugcuuucagguaguacccuggagugcucugugaugacuguaugcacuuacuuuaccugcaaaaagcuagucacaguuuaagcauauccugucaagguuuuucaaagucccucccagugcuagauguacaguaacucaccagagugaauucagggccuccucuccuacagugcugugccaccagccucggcugcucucuucguacuccacaacuugggccuccccagggaacgcuccaccuucaaccccuggucgaccauuggaucuuaacu

SEQ ID NO: 2289 - RNA, 3422 nt, Mus musculus
guuacuggcuuagacugucucuuccacuccauucuuuaauuggucuccacgucuugcacuguuuaacucugaccagcuuagacauucaccaucccacaguucccucacacaggagaugcagcaucuuauuuucuguguccucuauaacagucaauaaacuugaccuguacguaacaggcauuccauggcugacacagaggacacagaggacucagaaccacuguccccagcagcucuaagagcuacccauguagcaaccgauccuaucauguacaguaggaaaucaauacggacagcucugagagugcuaugcggcuccacagugacucgcuaggcuucuuccuaaaagugacaucgcugagacuugccucucuuaccugaugacacugucgauacaguucaucugcugauaggacgagcugggcugcucuugcugcagauugccaccggagccaguauccguggugcuuuuauuuuucagugucugagaggaagaaaaguccuucugcucaucugaaaggagauggaaggagauacaauucaaauguucggcagcuagugagaaaauauucagcaaaucguagcaggcucauaaccuauguuuauacaguaucauguaguauauuuaauaucauuaaacaugagcauagaucuaaaugacugacacagaaauaucaguaaggugaauaaggcacaaaagcaagccacacacaaggacuacacugguauuucuaaaacugagugaagcauguaucucaggcgaggauuacuaagucaacucugggacgagaagcuggugggggacgcccagugucaggguauuaucacaacuggcuaacacaccuaagugccaccugucccuccccuugugcacugccuggcuacugaacaccuguagaguuggucagugggcauggagaccggaauaacugguaucgcacauaucucaugugcugcagggugcaccacacagcacuuccugggcugagccuccguggugacugaugcuguguuccugcugucccacgugcuggccaccaccaagggaugauaaaaugauacugcgccgaucugaguuugagcuuaucaagugugccuuguggaacaggcguggaaagaagggaaaagccuccaggccugagcacgagagaaccugaaucugcugucaagaugacagagcccaggaaaggagacagaaaaccuggcaaaggcggaaugcccugcaaaacagugcuauacccagcaagaauggcaggguuccggaaggcgugcgugauuacgucacaugacugacagaccuguggccucagcuguguguguucuuaucgacagacacgucuagcuggccuggagagccuaucuuaacaggacuucuugaauagccucauuucaacucuuccccauaccccuccuaagagcgucuacuaacuacacaaugaugcgcuaaaccacaaaauucacaguggaggcaugcuuuucauugaaaugaaaauugacuuuucuugcauuuuuacugcguuaucacuaaccguagcuuuuauuucaggauccagcccaggaucucaguggaucuggugguccuaucuuaacgcugcuguaaccugaucccugucuugacuuaagucuuccagucauuugucaguacagacacaggucaugaaauuuguuggguuauaaaccaacacuauccugccgaguucuguuacucagauuguccuagccugagcuauuuguagcuuuuccaagcuaccuacucccugagcccuuaugcugucugucugucugucucuugaauauauuuacccucuggcccugguuccuuguguuaaaaaacauauauccagcaaccaagaucuuggaguuaugaguguguugucucuacuuguaaguuuucccaguggucagagcugauuauucaggucugcauguuagcccuugcucaucugucauccaccuauccagcugaaugccucaguucuuccacaugcuucuaccucaaugcaggacaaucuauuccagacaucccccuuugauuacuuaaaacuucuauaguagugggaaaccuuguuagcuuacucucuaucuauagugucugcauccguuugcucgacugcaguauacacacaaagugucuucagaguucugcugcugauaaacccaccagccuggguucggguucugugcacguuaguguucuguaccugacaucuagcugaaauacuuuuuccuucucuaaagcuacuuaagcucacccccuugagcauguuuucgccauuccugcuuagcagacucaucugcauguggccuuggguucucucuaccuucugggacggggguugauguuuauggcucuuggcgaaugcacggauucucccagcuaccccuucguaggcagcuccucuucccuuucagucucaguauguaucccaucacugguggcuggguuugcuuccugugcuuuuagugugugaaguuuuuaguuuacuggagaacagaauugagccccgagcuuuguacauccuaggcaaggcuauacaguuacccauagucgcuugucaacuggaaacaguuaagcagauguuaaccauuccugucaaacugcacuacuguaaacuaugugaugcgaccucgcuguucugcuccagcccacaugggauguacggcaucuuuguccaggguauccacagucucuccccucccagcaccauccugagcugagugauucagcgucaccaaaagagccaauucuuccugagcucuuuaaggucaacaguagauuaacugugucacagugccuuuucaucuaccguccuucauccacuuuacaagguacucaggggucaccuccaauuaguccauucuuucagagucuaaggcuguauguuccucaaagcucacccagcauagggcaauucagcugccauguuuuacuuguauggcaccaaugaagagugcuaucuguaaucaguuaucuuucauaucaauuaaaaauaaaacuuuuuuuuuauacauugcccaguaauuuucacuccuuaguguagauagguuuuguauaucauauuucucccugcuaagaaauuccuggggcuggagagauagauagcucagugguuaagagcgaguacugcccuuuuggaggaacaaaguuaaauucccagcacccaugauggguggcuacaacuaccaccuguaauuccugcuccaggggauucaacaccuccaugggcauucacacuugugugugauaaguguguauacacacucauguaugcacacacacaugcgugcauuaaaaauaaaucguuaaacagacaaaagaaauuccuuggcauuucugguagaaagugugcugucaaauucucaguugauugggagaucugauugggaaagauuucccauggguacggaacucuguguugaca

SEQ ID NO: 2290 - RNA, 3422 nt, Mus musculus
ugucaacacagaguuccguacccaugggaaaucuuucccaaucagaucucccaaucaacugagaauuugacagcacacuuucuaccagaaaugccaaggaauuucuuuugucuguuuaacgauuuauuuuuaaugcacgcaugugugugugcauacaugaguguguauacacacuuaucacacacaagugugaaugcccauggagguguugaauccccuggagcaggaauuacaggugguaguuguagccacccaucaugggugcugggaauuuaacuuuguuccuccaaaagggcaguacucgcucuuaaccacugagcuaucuaucucuccagccccaggaauuucuuagcagggagaaauaugauauacaaaaccuaucuacacuaaggagugaaaauuacugggcaauguauaaaaaaaaaguuuuauuuuuaauugauaugaaagauaacugauuacagauagcacucuucauuggugccauacaaguaaaacauggcagcugaauugcccuaugcugggugagcuuugaggaacauacagccuuagacucugaaagaauggacuaauuggaggugaccccugaguaccuuguaaaguggaugaaggacgguagaugaaaaggcacugugacacaguuaaucuacuguugaccuuaaagagcucaggaagaauuggcucuuuuggugacgcugaaucacucagcucaggauggugcugggaggggagagacuguggauacccuggacaaagaugccguacaucccaugugggcuggagcagaacagcgaggucgcaucacauaguuuacaguagugcaguuugacaggaaugguuaacaucugcuuaacuguuuccaguugacaagcgacuauggguaacuguauagccuugccuaggauguacaaagcucggggcucaauucuguucuccaguaaacuaaaaacuucacacacuaaaagcacaggaagcaaacccagccaccagugaugggauacauacugagacugaaagggaagaggagcugccuacgaagggguagcugggagaauccgugcauucgccaagagccauaaacaucaacccccgucccagaagguagagagaacccaaggccacaugcagaugagucugcuaagcaggaauggcgaaaacaugcucaagggggugagcuuaaguagcuuuagagaaggaaaaaguauuucagcuagaugucagguacagaacacuaacgugcacagaacccgaacccaggcugguggguuuaucagcagcagaacucugaagacacuuuguguguauacugcagucgagcaaacggaugcagacacuauagauagagaguaagcuaacaagguuucccacuacuauagaaguuuuaaguaaucaaagggggaugucuggaauagauuguccugcauugagguagaagcauguggaagaacugaggcauucagcuggauagguggaugacagaugagcaagggcuaacaugcagaccugaauaaucagcucugaccacugggaaaacuuacaaguagagacaacacacucauaacuccaagaucuugguugcuggauauauguuuuuuaacacaaggaaccagggccagaggguaaauauauucaagagacagacagacagacagcauaagggcucagggaguagguagcuuggaaaagcuacaaauagcucaggcuaggacaaucugaguaacagaacucggcaggauaguguugguuuauaacccaacaaauuucaugaccugugucuguacugacaaaugacuggaagacuuaagucaagacagggaucagguuacagcagcguuaagauaggaccaccagauccacugagauccugggcuggauccugaaauaaaagcuacgguuagugauaacgcaguaaaaaugcaagaaaagucaauuuucauuucaaugaaaagcaugccuccacugugaauuuugugguuuagcgcaucauuguguaguuaguagacgcucuuaggagggguauggggaagaguugaaaugaggcuauucaagaaguccuguuaagauaggcucuccaggccagcuagacgugucugucgauaagaacacacacagcugaggccacaggucugucagucaugugacguaaucacgcacgccuuccggaacccugccauucuugcuggguauagcacuguuuugcagggcauuccgccuuugccagguuuucugucuccuuuccugggcucugucaucuugacagcagauucagguucucucgugcucaggccuggaggcuuuucccuucuuuccacgccuguuccacaaggcacacuugauaagcucaaacucagaucggcgcaguaucauuuuaucaucccuuggugguggccagcacgugggacagcaggaacacagcaucagucaccacggaggcucagcccaggaagugcuguguggugcacccugcagcacaugagauaugugcgauaccaguuauuccggucuccaugcccacugaccaacucuacagguguucaguagccaggcagugcacaaggggagggacagguggcacuuagguguguuagccaguugugauaauacccugacacugggcgucccccaccagcuucucgucccagaguugacuuaguaauccucgccugagauacaugcuucacucaguuuuagaaauaccaguguaguccuuguguguggcuugcuuuugugccuuauucaccuuacugauauuucugugucagucauuuagaucuaugcucauguuuaaugauauuaaauauacuacaugauacuguauaaacauagguuaugagccugcuacgauuugcugaauauuuucucacuagcugccgaacauuugaauuguaucuccuuccaucuccuuucagaugagcagaaggacuuuucuuccucucagacacugaaaaauaaaagcaccacggauacuggcuccgguggcaaucugcagcaagagcagcccagcucguccuaucagcagaugaacuguaucgacagugucaucagguaagagaggcaagucucagcgaugucacuuuuaggaagaagccuagcgagucacuguggagccgcauagcacucucagagcuguccguauugauuuccuacuguacaugauaggaucgguugcuacauggguagcucuuagagcugcuggggacagugguucugaguccucuguguccucugugucagccauggaaugccuguuacguacaggucaaguuuauugacuguuauagaggacacagaaaauaagaugcugcaucuccugugugagggaacugugggauggugaaugucuaagcuggucagaguuaaacagugcaagacguggagaccaauuaaagaauggaguggaagagacagucuaagccaguaac

SEQ ID NO: 2291 - RNA, 10665 nt, Mus musculus
aucauguuaauaaacaacuuuauucuggucaccauaccgggaacauucccagcuaaaugcacagagaagcgagguaucacuguguuaauacaggagccacugaguuacaugggacagaauaugaggagacagcaccaaaguugugaggucagaccaggacagaagcccuaggcugaugcggcaaggcauaucuucaacaucuguauuguuucaguaauguuaggggaacagauaaaaaacuagaaccaguugggcguugguggcacacgccuuuaaucccugcacuugggaggcagaggcaggcggauuuuugaguucgagccagccuggucuacaaagugaguuccaggacagcaagggcuauacagagaaacccugucucaaaaaacaaaacaaaaacaaaaaacuagaaccagauucuaugacaucuugaguaaugcugcuuuacacacaaacacagauuucaggacauucuaguggcacugccauaggcaagcagcuuucccuucaccacuuccucaauuccacccaugccugaacuccugucuuugaaccaagccuugaugaaagucucauauaaacaaugaaacugucccagacagcaauggcuacauucuaagagcaccaggcaucucugguuagcuauccucuacgagugaccgguggcuuaccucaagcauaagacagagaugaguacaagcaguacacagucuucuggaacucugugcagacugaugccuuggugaggcugcacggcuacugcucacaucgcacuagagaccacagccuagcucagucuacaaacugcuggcuaaguaucuugucuacaggugugaucugagcccaccuccauagcucuaaagaagaaaccaaaucagaaugacuagccuucucuauagcauuucacaggauggacugccgacauguugaaggcucgcucucacaguauuaacauuuuucuuaaaggacaccuugaguuacauuuggcacuuauuugaauguaucuauuggggcaauuuauuuguacuuaacuuuuggcaaaauagaaacuuuggucauaguucuauaaaaacuucuuaaaggguuauuucugguuaaaauacuauuuuaggagugauauacaacaagaacaagaaaguaaacauagucauaucuaacauaagagcaugagcucuucaccagcaucuuaaauacagcgggagucaguagugcuuacaaacggagaauaaucuuaaagaacaguuuccuagcuaucaaaauaaggcacacccugcuauugucacccauugcuguuaggcaguaguguucuucuuggaagguccaaguuaggaaucuaauuacccaaaaguuuaaaaugugguuuugaagaugaugucagauguggggacagcugccuugaacaaaacccccuuccuggaauccacaacaagucaucuugagugacaacauccaccuccauucagcacucagaacuacacaaguccucuuucccaguccagaaaucuguaaaggcacugugcaaaauguggggaggguaggucacaccuccaguuuggaguguauaugaaaaacaaaggcacauuuucuaggcacuaaacuguauguaaacuaacaaaaauaaucauuuggaaaaaaaacaauagguaagcucgauaacacggcagguucuaaguagaaagucuugaagaagauccugaauaucgggcuucaguuucaucgguucuucauuaagagacacaccacacuaagaggcagggaagauuuagaaacaaugaaaagggcauguuagucuuugugugugcaaauacucaguagggauggacuucuacugucuaaagagggacagagagaaacugacuuggccaguuuuccacuggcagcuucuuuacaugcuacagggcucuggggaagacuaaacucaaaaguggaaaaggaaauacuaacaagaacuagcaaaggaaggcaugcuuugcuaggauguucgcauagacuggaaugaaaauaaagugaguucuucuaauaugcagucacaagaguggugggaguagcuaugugcuagcuauauacauuauuuacauaauuacuauuucuguucuccuaugccagguacuuucuuauguaauaaccagguuuguccuaacaacacaagguggacaccauuaccaucuucauuuuauucaugaggacacuugagguccagacagacccaacugcuugcccaaagucacagagccuuacuacagguggcauagcugggauggaucaacucagcuaaucacuacauuccacaaaaggacacagacuaaaacugcacaggagagaaaaauugaccagacauuaggagugagauuugcuauucuuaaaggauaagugcacccaucuauccaucauccaucuaacaaaacaccagacuuuaauuacaaaaacucaaauauuuaggaucauuuugguggcacaggccuauaauccuagcgcuugaaauguuaaggcggaaagaucacaaguucaaggccagccuggguugaacaucgagacccugccucgagacccugccucaaacuucccgcaauaccaucaucucaaaacacccucaaguauuuaaaauacuugauaaagaacgauauuuaaaccuuggacugaauccacucuuugcugcugcacagacgaacgucuaugaccauggguaacucaccgaugaugaugaugacaaugaucaccaggacacugaucccuaucgcccacaucugcaacaagacagauccauuuaacauugcaaaacagacagugcucgccgcaaccgcuacagugugaaauaauuuauauaauuucuaaagccuaaauuuuauauuuucaguuaaguccugaaauuuaguuaugggcuuucagaaguagauuccaauccucugugaccucugaaaacacacacauuuccacacaggcuccugaucuugucccauuaucucagaguguccuuucuaaacaaagcauaacaggaagugugugagcucuaaucacagacauucccauuugcuaagucugcuuuggacaauauucauauguugcuuucuccucuuuuugaacaaggugggauuucuuagcauuuaacuuuuuuuuuuuuuuaaagauuuauuuauuuauuauauguaauacacuguagcugucuucagacacuccagaagagggagucagaucucguuacggaugguugugagccaccaugugguugcugggauuugaacuccugaccuucggaagagcagucgggugcucuuacccacugagccaucucacgagcccagcauuuaacuuuugaaauuggagccauucccagaaugggcaguuaacugagcaucaaagccaauagccccgucaguguguucucaguuaccuaggucuagugcccacgacugcuugggccgucugauucugcaugucuucuaacuuuagccacaaaacauggcauuagauucccagcugugggccaggaaaagggauauagacucauaguuggccaagauucuacccacuacccagagucacccaaugcaacagagugccugugcaacacuugggguauggaggcccgcugugaaggucugucaagagagcauuaccuugcaguucuuccaccaauacuuucucuucaacuuggcagcacuuguuucaaacugcgaggcaccugccugcagugcaucugcgcggucaucuagcuccgagagcuucuggucucuuucuaacaccuuauccacauugacucucaugaugucaaccaccuaaauggacauggucacaguuacacggaaaggagaggaagaacaaaacuccacaugacaccuaugggcacuuuguauuuuuuuccagaucaguacuuuauuauguugagcuaaacuuccacuuaagaaggaagcccaggccuuugggauacauccacacagcaaaccaggaauagaagagacuucaauuacagagaagcccacauuaguaucacauacuauggugagagacucaacuuccuucuaagaucugaagcagaacaacaggauguuucacuuucauggcuguucaacacuacacuggcagucuuggucagggcaauuauccaggggaagaaaggcauccgguuggaacagaggaguacaacuaucugugccacauguaagaaacucuuaagacuccuucauaggaggcugcagagaugacucaucagguaagcugagugcaaucucugggacccacaucaugaaaagagaaaacugacuccugcaaguuggccucugaugucugcgugugguggguguacuguguguucccaccaccaauuauuuuuagagccagaucugugcccaucaguaaucccuacacucuuaagaugagagguggagacaggagaaucacuuguaugcucauggaccaguuagccugcauuucauagcacaguauggcagaaacaaaagagacaucaccuugacaaaguggaagagaaccaacuucaagaaaguuguccucugaccuccaacacauaugccauagcauacccgugccucaaugaaguaccuuaccucuucaguacauacaaaaacacucacacacauacacaaacauacacacuaaauaaaaauauuuuaauauaauuuuucaaaaucuacaaugaauaaauucaguuaaguuucagcaucuaagauaaacacuuaucaguuguuuuucuucaugccagcaaugaacaauccaaaaagaacauuaagagaacagcaucuuaauguuccaaaaaccucauaauaaaauuauaagcaauauauuuaaggagcuggaagacuugcagaauaagaaacuacacaucggacugaguagguagcucaguggauaaagggcuugcugcacaaacacgaggaccugaguuuggaugugcgaugcucacagaaaacaacagguguggcagucuguuccugucacugcagcacugggguaggcagggagaggaggaucccagagacucacugccaacagaugagcuauggggucaguguaggacccugucucaaaaauuaagguauaaagaaaacaagaaaaauaccugauuuugacuucuggcuacuauauguguacacacauguauaugcuacacccauucacaaaagagcucuaagcugggcacaauagcacauaccugcuauuugugaggcuaaggcaacccacauacacacacacauacauacacacacacacaaacacacacacgagagggggagaggggagaggagaaugaaaguauuaauaaggggaaagacauucaugguagcagauuggaagaguuaauacuguggagauacaggacuccuagagugaccuauagucaauauaauccuaacagcucuguuucucucagaaagacugucaugcaauccccacuccuguggcuuuuuuucauauguaagcucaaagaagaacugagaauaguaaaccaauacuaaaagaguuauaauggucauuucaaaacucaccacaaagcuggaauagucaaaauugugguacuggcccaggaagaugaagaucaaugagaaagaacugagaaccuggaaaucugcuuacauauuuacagcuaauugaacugguuuauuuaucgacugaucuacuuuggugacggggaugcuuguauagguuagcuaagugcucuaccacugagcacuuacuucagcaacacucucagucugccaacuaacuucaaaaugaugcuaagaccaacaaauggagaaagaauguccuuuuccacgaacagugcuggcaaucuaaauaaccuuaaggaaagagcaggcagagcagugagcuaaguuuaaguuggacucuaagagucuuagagaaaagguaaagcuugccagcuuguuccagguuucuagugcugugcuagaacuccauggccaaaagcaacgcugggccaacaaggcuuauuucaucuuacaguuuguaguccaacauccaggaaagucaaggcagaaacugauaauguggacggcauggaaugaugcugcuuaugggcuugauuggccugcuuucuucaucaucuaggacaauuuucccaggguggcaccacacaugaauaaauuggguauuguaucccacaucaauccucaauaaaggaacugugugcccacagguaaauuagggagggguauuuucccaauugaaguugccucuucuaaaaugacccuagcugguguugagcugauauaaaccuagccagcacacagcuucaggauuggcucugggcucuuaagauuugauaucaaaagcaagagcaacaaaagaaaaaaaaacucaaguaacuaaagagauaaauugggcuuuauaaaaaguaaaaucuuuuggcaucaaaguauacuaugaagaaugugaaacucaaccaaccaagagaauggaaauacuuaugaacuacaucucugauaaauguuaucugugaagaaugcaaaaaagagccuuacaacuuaaugacagaaaaacaacacaauaaaaucauuugcaaaaagaacuauguaugagaaauauaacuguaauccuagaacuugagaggcugaggcaaguucaaccauagccugggcuacauagugaguuccagguuagccugggcuauauaauaaaacugucgcagaaaacaaaacaaacaaacaaacaaaaaaccaacaguaauacaaaaggggguaaaggacuugaauagucacuccuucagagacacacagauggccaauauacaccagaaauguguucacugucacuaaucauuaaucaaaucauuaauucaaaaccauaaggaaauaccaccuccugcuugcuaggaugacugcagccccaaacucaagagcaccaggagauuggacacugcugccagaaaauaagcuacuguagaaaccacaggcuaagcugccaaacaauuacuguaugaaccagaaaggcccacacccaaaugaaacagaaaugaaagcacauuuaagaucuggcuucuggguauuuacagcaacauuauaucagcagagaggucagaagagcucaguuaccaauaaaucaugguuuacuaagaucauaaacaaucacucagccaaaagaggaaacaaggugccagcauggagguuucuacaaccuccaugaacaugggccacacugaagagagagaagccuaacauugacccuggaacaugcuacaccuggaauaggcaaacccaacgaaacagcugacuacagguuaccaggcaaccagcagaaugagaggugagugacgaguucagggugcuucuuaguagagacaaaacaguucugaaagcagaaagaggagaugacugugcaaaccacugaauauacuaaacauauuaaacacuaaaugacagacuuucaaaaacacuuaauuguauguuacaggaauaucuccucaaagaacaaaaacuagauuaucuuuaaaauuucuuuaauuucuaaaaaggguagaauuugaguuuuuuuaagugacagaauuaguguaaaaguauaaaguguucagaauuaaguucauaaagaaaucaucauagaaaaaucuuacuguaugauuuaauaauaguaucuaagauaacaaguuuuagaacagccuaaggcagaaagauugugccaggugaugguggcacacacgccuuuaagcccagcacucaggagguagaggcaaguggaucuaagcuugaggccagccuggguuacaaggacagccaggacuacacagagaaacccugucugggagaugugugugugugugugaguguguguguguguguguguguguguguaugaguggggagaugguucaaccuggguuuaguucccagcaccaauaaagcagcugaaaaccuucuauaacucuaguuccaaggguuuugaugucuucuggacucugcagaaacugcauacacacacagcacacacacauaguacauacacacacacacacauauacacacaguacacguacauguaggcaaaacccucauacuuguaaaucuuaauaaaaaaauauggaaguaguggucugagcuucucgcaggaucugcacugugguucuacaugagcacaccaaaacaaaagaugccuuaagacuccacuagcucaagaauucuagggagagcuggggcuacagcaguuccaccugcuauggguccuucaacaaauaucagagaaagcaaagaccugccucuauuagggaacuaguaaaccuggcuauaagacacacaacaauuuggaaacaaaacaaaacccaaaucagaaagacuuguuccuggcuugaauaauccaauuacccuaucuuacaaguggcucuggggacaagcuuucagauauguuuuagguuuguaauugguaguagaaaaauuaguaugaaaccaggaagagucuccuuugugcuuagaagauggcuucuagaacauucaggcaaagcaucauauacauaaaauaaaaauaaaccuaaacaaaaagaauauggaaauacuugucugaguuucucgcagaaucuguacuauugcccuuuaaauacacguuuaaaaagaugacuucugauauagucaaaauuuaugcccacacacugcugaugccuuuuuucucuaauguuuuaaaaaaauaauuacaugcuugugucuguguguacaggugcaugcaugugcccuuggaggcaguuacaagcaguuucgugauacaaaugagagugcuuggaacccagguggauccucugcuagaacaaguaaguguucuuuuaacucccgagacaucuuucuagcuccaacgacucuuuuucuaaauaaaauucuagagaauucccauguuuguuuaaaagucacauuuaaaauuuuagagugguaccucaucuacuugauuuugugucugcuggagucuucgauuacugccaguggcagcacuugaccccgaaggcacaccuguagaccugaaagguauaaagucacaaguaugaguacacuguaauucccagugcacuugauaagcuaauauauaaucccaaugcuccaaccaugacaugggagguggacacaugagagucuuggaagccugagggccagcucaccugauacaugcagcacugaacaagagauagugucuccaauaagguggaaagccaggacugacaugugagguuguucucugcucucaaguguccuuugcucucaaguauaccauggccuguuuguguguauaaacuguuauggugggacgcagucuuaacuccuuacacugcaguuauuucuuaaaagucccaagguaaaaaauaaaggcacuaauauguuuuuauaaccccucaauaauucuuaagacuguaucacuugauagugauaaaagucugaaacaaauauuuaacaagaucuguucuaugucaauaaaguguggguuuuuuuuuuuuuuaaacuugcuuuaagacacacagauguuuaaaguagacuccugaucuuuuuguuguggcugauaauuaggaacaaucacagaacagacaauaugaagaaauagguucaaagugcauggagggggucuguaugaacgggaaggaggcugaagcaacugucucuguuggaaagucauucaucucucauagguucagugagucuggauuuucacucauccccacuuuucacaaguacucugguuuuuaaguccuuauugccuccauuaaacucuuguaucuaaaacagcuuccaauuuuugccuuccuacacaacugucacucuaggguugacucacagcacuuuuuaaaguuugcacugugucuaccaccaaggacacaucacugauggcugucucacauaacucaggguccgaaaauuaaacagguaaggaccgugcucuggaagcacuauccauguuauuuauuuuuucucucuuuaaagucuaauaucacuaaagaggauacuacgauccuucccaucuuauuaaaacuuaggcugaacaugcggcuggcugaacugaaccaauuuaauccucuugaguguggaccggacacugccauuugcucagcagucugaccagguacaucuuaaguggugacaacaauucuggcugaagguugcaauuagaaaccaauuuuaaaaccagagugugcuggcuuaaaacggaagagaaacccauugcccagaugcgucgggagcgccaaacgcuggccuacgacgggcucccggccaccucaggucucccgcuccugccgggcgcaccccgcgcacagagugagcguucacgcucgcucccgccccucgcgaggaaggagccgcgggguguggcggccgcuuccucggucaggcgguguccccacccccguccuuccgcgucugcccgccguccgcggggcacucggggacgucgcggcgccacgacucgucccgcagcguccggggacagggugcaccgcggggccgcugcccaccucaggccccgggacuccgcgcguaggccugcgaggccuccacucgaguccgagugucaagcagcggccaccgcgccugaagcgggucgcaggagugggccaccauccccggagcccgccucgccucucagcgcagcgcgucacucacauuuuggcggcgguggcggcggcgaauggccgagggucgacggacucgcgcugcaggcaaccgaggcugaggagaugggcggggccguggugac

SEQ ID NO: 2292 - RNA, 5010 nt, Mus musculus
cauggcuaaggauggccuagacucuucuccaaaagcaggaacgagugaugcuccucuucugaaaaggaagcugaagcacuccgaccuugaggagaggcugcugugcacauguucacaugcagaauccacugagggguaagauggagaaaccacaacaucucccagaaauagguaagucaggucuaaaaggagacuagagaaaggucauuuggccuuucccaaaugcuggggaaucagaaauggaagaggaagugaugucugaacgaaaagauaggggguggggcaaaguaauuaagagaagcgggguaaccugacuaacugcaagagaagaccuccaccgauucccacccuucccggaugcagucacauagucagcgcaagcagauccacuugagauccucacuuuagcacaagcggugcagcucuggugguaccuucaguaccccuccuugcacaguccaugugugggguacucugauggacagggacaacacccaaggaagucaacggccuggagaaaggugcagaagagccaucaccagaaacgagaagacucucaggccuacaggaacauacacagcagguaaucaacucuucauuuuuccaaggcucacuagcacccuagaaacaaucaacuccuuuaggcugacaacagacacaagauuuaaaacagccuaaaaaugggagacacacaggaaaaucagagcaagagcuuuccuuucuggcagcgaguaccaugcugaaaagcaaagccagagccaccugagacaccuccuuacuugggaaagcaagguggagggcucccuuguuaggaaaagaacuucaagagaacagaaacaagaacacacaacacacagcuggaaggugaggcucuacacgaagucugucaaaaaguaagaugacacugcugagcgagagcacgagacagggaggugagcaccugagcagaggcagggcugugggccccagagaaagaaccuggaaacccugccaccuucccgggaagcagcggcaagcacuuuuccgaaggcaccuucuucuaauuucuuagcgucucucacuucacuggcugaaauacaacagggauguacuugaagccgucaguuagcucccaguucuaucagggagaggcagccgcuucuccauuuccuaucauuuccccaaaacacaggaaaucgcuuucuccuacacugcagggggaaaaaaaaaucaagauaagaacuuucacuccccacagaaucaagcugagaauacugucccuagauuccaaauggaaaagucugggcauucaucagcaagcacuccacacaugggagaagugccuuucugcuuauucaguacaauacaaaugacaaaugaaggaguagugugacauugcuuuuaucaacgacaccuuggcuucuucuaauccugaagccaccaauaacauacauggguagguauguacagauacacacauucuggcaaauuaacacuccacccacucugaccauagagcugccaccugacccuucuaacuucuucuggguauguauagaaugcuauugcacauaugcacaaaguggucugugugugucaacaacugugucgagcacccaauuuccgugaugucaaagagaaccagaacagcaaaaaguagagaaauugccccuuugcuugaaaggugcaagauccaaagaaauguuuugaucccacuagagacauaccagggccaaaggaagauucugguacaacaaggagcacacaagcuaccucuucucaaauggcaugugggcgacaagggugucuacacucccuauucuggauagaaaggcauauggcuucuccuuacccagccaacaugaauacaauuugagaaaauuagagaaagucaagguaacaggcucacuaaauauggcugacugggaaacaggagccauaaggagggucugaguucucucagaaaaaaaaaaaaaaaagaagaauugggaaguuuauuuccaagaaagauucaaagacuucuugagagugggaugcauaaagucugguucuuucugcucagaagacaggaaucagaacaccaaauucaagggcacuggacccuuuucccagugggauaguguuaacuggugaagggugcccccuaagauccaagagugaacgggaagcaauagauccuucuuuuccugcaagaaacaaguacugaggucccuuacacucaagugguaggcacaucggaaguccugccugcccuacaucuuacuggggcgcccacccuggcccagacagggaacuccaaggagagaggcagacagcuagggagaggagcauuggagcguccgguuuucccaacaagaaagagggcaacucgaaggguguucaggaaaugagcucacccuaacccaggaaaguguacggaaagaguacagaucuggaagaagugucugccugccuauuuagaaaugacuucagagcugcacagggccccacaagccacugggugagcuaagaaggaagaacauggguagccccgaguccccuuguccuggccaaaaaaaaaaaaaaagauuaacccagcgugcagaggcuccgcggccccacgagaguccccucaaaaaggggacaggcugacacggaacccucagugcucggagaggaucggggucacggaagguaaagggcauggcaguguggagaccccacccucccgguagugagggugcaagggcaaguguggaagagcaugcugugaggggcggggaggccgcgcgaggaccccggcccugcugggggaggggucgcccggggccucggccgaggggcgcucggcacgaggggggcccccuggcggggacccgcgcggggacaccccccacgccggcgcuaggaggcgccgcgcggcccgaggggggcuguggaggggaacguccggcccugacgccgcuacggccgccggcaccggugcccgcgagcccccgcggcccgggaaacuuuccgccccgcggcccccugacaccccgaccgacacggcggggaugccccgggccgggugcgggaggcgucgcggcuucuccuccuccucgcugggcccggcccccgccccgcgcgccccccgccccggccugccgcccccggggcugggugcggggcgccccgcucggccggcccgcgagucaccucaggacucggccgcgcuccgccccccccaccccgccggcgcccuccccgcgcccgccgcgcccccgcgcucgcgccccgcgccgccgaugcccgggauguccggcgcggccccgggcucgccgugucgccgccacccugacagccccgggcccucacgcuccggcucucaccuuccggcuuguuuucggcagccauuuccccuccgcgcgccacauccuccuccuccucgcgaccgggaccccgagcgcgcgccucguaccgccgccgccgccggcccagccaccccgccgccgccgcgcacccgcccuggccccgccccgcggcccacgcacagcgcccacugguuggugcgucugccagucacggcucccgcgaccaaucggaccgcaccaggggucucacuacucuccgggaggagcguccuauccacccuguccauuggcugaucaccaccgcaccgacuaaagugauuggccuggaaucaacgcccccuccccacccacucccgggaaaacccgcccuccagaccuaaacaaagcuuccuaguggacagaggucgaaaggauggcccaaucaggaugaggcugacacggaauauuuccucgaggccgagacgugguguuuugauuggacgucacuacaguguuucccaagccguccagaccaaucaaaggggguucccggaacucgggaacggcugugggaagccccgccccccagcgugaccgucaugaggaaggcgcucgcucauuggugugcuggggcuuuucccgcgugcuccgggagcugaaggacguucccggggaagccgcugcuggcgcgugggggucccggugucuucggaggacacgcugggaucuccgggaucccgcagccugcggcgcuggcggggggcggcccugccggagggauacguaaggcaccgaggcgugccgguucacagcguucccgaaccguuuagccgagagucggggcgucgcugcccgacacgggggaggggcgcaccucccggcagaccacgccccucggccaaaucccgccccuuccuggccucagccccgcccccucggccggcgcagcguccccgcggccacccuacgcucccgccugccuugcgcuccucuguccccuuuucuagcggcuuaaaauacugaaacuuuauuuuggucacguugcccaugugaccggcggagccgaugagucauaggugccugucccaggcugcagccgcggaucuagggcucggaacgcucgaccucggcuagccuagccaaucccucccgggcucccggcgcuucggucggguuccagccgcagcuccgcgcagcucuccugccuguagguccacaccggagagauucgcacgcccugcagacacaagcccgggccagaagagcugcaaaguacugcgccuucucgagagaaaucaggggcucugaacguggccagaaaauagaggaaaggauggaaggagagagggaggggaagggcagagugcaggaauuccgcacauagaaaaauaaaagggaaggagaagagggagggcaaacaccaugcagggauucugcaggugcacugaagggaagcgggagggaaggaaggagaaugcacuuuaaugaaaagcagcugagcuccagauccucucuguaaacuugcacuguuugauuccucaacauuuuuuucucucucucuccguuugcuacuagcagaaacacugaaaagucgaucgaguguuuuggcguuaggauugaucgucaaagccagucugugccaauccuaacaacguguggucuucuuaugauggucaccguugagaauugcuuagguuguuccaaaaauaaagauguccca

SEQ ID NO: 2293 - RNA, 6362 nt, Mus musculus
auggagacuucaaaagauuuauuccacaucuacacgaaccaggcagaaaaagagucacucagaaauacaggcugacggggacccuugcccugccugccaucagaauggcuccuauggggagacaguaaggaccccaccggcuguaagaaugaccagcucucccucugggagcaucucuugaggggguugugacggcucacauuuggucacugcugcuuccccacagcugacagccucagcccaagaaaccugggacggugccuccgcaguacuugggcccccacccgacaacugccugucgcagcaucccaucccacucucaaggcaccugcagcaucagcagcggguagaaacgcccauagcaggccagaacaccacuuccugcuaagguguugccaccacccccacaucccagagcuugcucaggcucagcuucccugugccggccgucuggcccgaggucccggcugucccucucuguaggcucucaggcggccacauguccuccgcaacagcagccucugggcuuucagccgcuuccgaagccucuuguuuuccuucagugugagaaagaguuuuuuuuugaggguauccaaguccgaaagggcauagcugugaucagacggcugucccggaaggggccucuucaaccccagagggcuggcaggcaggccagcggccuccguggccuccauugcuucucgaucugguaagaccuaaggacagaggaaagugagugcugggaagagccuuguguccuaagcaggacggcaugagcuggggccacagcugcccguuacccuccggguuuagccccaguccauuuccccuucugcaacccugaugagcugucauggugguugacugagaagcucugaagcccggccaccucuccccgcugcuccuguucugucggguccucuggggcaguggguuucuucauuuuuguugucagcaaaauucgucccucugagaccaccucguacccagggucuuaccugcugcacggggccuuccgggguuggaggcugaaguucuuccagugugguguccauguuccucccugagcuguccccaccagcccccaccucagggcagaccugggaacagcaggcggagucaggcaggcuggcugagcuggcagacaccggacccugcagcugcuacuguccauccggguaaucccuacacgggggcuauggcccugcccugugccucugcagucaggagcagggagucucccucccucccucccucucucccucccucccucccgcccuccaagcccaggucuccagcucucaggaggaggaagccugaggccacagcuucccagagaaaagcucccugaacucagaacccugcugucuucaggcaauagccucaccuuucaccagacucaagcgugugaacacugccugaccaggaagccgccacaacagggcacucugggauguguggcgugcccuggugcacacaccucucugaggcgcgggcaguggcuccucucucccauaaccaauucaagacauggcucucugguugaggcaggacacaguggaaccuaaggacgcccacccaagucuccugacucagccuaacaauacugacugaauccagcccugcucacacuggcuuucacuagauauguccccaaauccuggggcaguggcaccuagacaggucccuacagccaaggaccugagucauuuacaucaccccgaagccugauggauguuugcccugcggcgccaugcgauggaaaggucugaagcagauccagagucccugccaccugcuggcagugaccacuguggccauucaacaugggggcgcugaggacugugcaguuaaacuggggaucugagcaugcucagaccucuuucagccccugucaccacacuaaaagcugucaugcugcacucacucuauacacauggccuaggucgcagaaugugcugccaccuggaaucuguggcaauccuccugccucugccuucuaagagcugagaaugcacaaucacaccuggcuuccuuuuuuuuuuuuggauuuauuuauuuauuauauguaaguacacuguagcugucuucagacacaccagaagagggcauccgauuucauuacagaugguugguugcuggaauuugaacucaggaccuucggaagagcagucagugcucuuaaccgcugagccaucucuccagcccccacaccuggcuuucuuguucugagacaaagucuccuguaccucagacuagccuuagaccccaagguugacugaauauuugaucuuccugccuccaccucuggagagccaggauugcacacagccauggccauggcccacagcccugauuuauguaguguuagggaucaaacccaggccuuugugcaugcuagacaagcaccuuugccaaaaaaaaaaaaaaaaaaucacuacaaccagucuucagcacacaugaucaacuuuuaaaggggcuuuauuuuauuuuuuauuuauuuuacuuuuugucuuucuagcagggucuuuuuuguuuugguuugguuuggcuuuuuguuuuuguguguauguguguguuuuguucuuugagacaggguuucucuguguaacccuggcuguccuggaacucacucuguagaccaggcuggauuugaacucagaaauccaccugccucugccucccaagugcugggauuaaaggggugcgccaccacugcccggcucuaccagggucuuauccugcuuauuuuuuggguuuuuguuuguuuguuuuuuguuuuuguuugauuuugggguuuuuuuguuuuuuggagaugggguuugucuaugugguccugacugcucuggaacucacucuguagaccaggcuggccucaaacucaguaacccacccgccucuguuucccaggggcuucccgcaugcuggucuagcacuguaccaacugagcuagaucagcugcgacuccuuuguaagguccccucccagcacacacacagacccacuggcuggacaucaggcuagcacccuaccucugugggguucugaaaagcgaacaccgugggcacagcauuguguuucagguucuugcgguucccaaaggcgcugaagcacucgggucugaaguguuccgagcagaugacugugugcugcuuaggcuugaagucagcccggccgauguugagcacccacucccucaacagcuccgggcggcugaaggggaaccugugggcacagcauccaauggcacagcuuuggaaacucaguaauccacuguuagucauccagauacucacccuggcuucuauccacauauauaggaaucccaggaccauaaacgugggcaaggagcccgagggaacuaggcuuccaaagcgcaugccaggagccaccucuagcccuucagagcuugccacaugccagucucugcuuuccugccagacgguggcaguggauaggaccaaguuccugcuccucaggagccugcaccucagacaggagcaagccacacugagaggguugggcugugagggcgggcggagcaggugaaaacaacaggaagaagcccugugguagguaaugagggccggccaggaugacguuugaacagacccggcagcaagugagaaauaagacccggccuuuacaaaggaugggugggggcaggggacaaagaugucggucuggcuggggcaccuggaggaagaagggccauaagacacacccagggcuugauuuagguagcaggggcaucauuggagguucuggaggaggagaaggacugaagugaguucaagggcagccuagguuacagaauaauacgccuucaauuccaacacugagaccagccuggucuacagagugagcuccagcacagcagagccuggaguggggaacuugucgagagaagaggaggagggaggggagagggagggcaggaagaaaggaagaaggaaaaagcaaaagccaagugucgagguuugcucgaggaugaugagagaagagaagggaaggagcuccaugguuccaggucccugaggaggaagggagggggaggaggaggaagaggaggaggaggaggagaaggacaggagaguccucggagguccaggccugggugaacacaaguuugaugcguuaggugucaaguucaaggugcucuucagacuggcagagcucagaguggcagaugggcaccuaugcccggggaugucccuacagagccugccagccucggcgaucucagcacuagggagaagcccugaacggcuccaucuugagcaugccagcacucaguguaggaaguagagaggacucugggauggagacugacgggggagaugugggacaaaggucaggaugcgcccagggagugggaagagaacugccuagucaaaagcuauugagaguucuuuuaagacaaagccggauagaugacacagaccuauaagcaagaccuggguggggcacagugguggauaccuggaaggguccaguucauaagccagccugggcuacacaagaccagcccucucgaauuaacagaagcaacacuagccugaagcaaggauagagucagaaggcagacgggagggcacaggagagaugucaaagcacgggguacacacagaucuaaacuguccucaggaagccuaccaggacauguggugauugugccauaaacacuuaagugguggcacacgccuuuaaucucaacacucuggaggcagaggcuggcagaucucugugaguucaaggucagccuggucuacacagagaaauccuaucuugaaaaacaaaacaaaaaaguuuaaaaauucggagguguggccaggcgugguggcucaugccuuuaaucccaguacucagaaggcaaaggcagguggauuucugaguucgaggccagccuggucuacagagugaguuccaggacagccagggcuacacagagaaacccugucucgaaaaaacaaaaccaaaaaaaaagucaagguguguagagcaccugccuacccacuacucuggaaggccugagcuccaucuccaacacaaaguaaaauauaaaagucucccagacaggaugccagcaugcauuaagggaggggguguuuuuuuuuuuuuuuuuuuuuuuugaguguucaaagccaguuuuggguacauagcucuauucacugacuucagucagaacuacagaaaagggccuggucucaauggaggagguggcuauuaaaauagauaagacaccuggcaaaaucccuguggccccacaaaacaggaaagaaacuguccucugaccauccaucccaugggagacauggcaagaggguggaggauucuucuacacacaaaugaauuuaacuuaaaaacaaagaaugagagcgggcagaggugaguguucccccgaguuucuggcaacucagauaccugauaacuacccaugcagccacccggaggcccuuccaugcagagcacacauccuggcucguggucaauggaauacuaugcagaauagugcuuguggggcaaggaugacucucgcagggcccggaaggaagagagagagagauuccauuucuuaagguucaaaccucgccacagccacgcagcccacaugcaagcuaucccugugggcuggugggagaaaagacuguaaguggaugccagcggagacgucugugggcugccaacugauguguguauuuuucuaugguugcuacucuucagcagaaacauucaaaguguacagggugcgggcugccaggaacugagcccugaaggcacagacaucgcucgaagccggagcaguugaagggugcuucccuagaaagggcucagcacgagucuugcuggggaaaaggggucccagggcugcagaaccggggaucucccaccuucccacagccgaaaucccugccaugaggcccggccauccugggagcacucauuccuccaggccucccgcgaggugacgcaggcgcaaggggccagagcagggacacggccaggugccacucacgcccaucuaguuugcacugagcaccuacugcuuccaggcgaggagggggcggcggggucaggcugugaggccgcgcgcaggagcaucgcccgcgcccggcccggccccucuacgcagucccgguccaccucgccugcaaacccuggccugggccucccggagcucccgcccagugcaccgagacccgcgagcguuccguagggucgggucccggcuuccccaucccucaccgguggaaggugagcugcuuccugcggcugcuguagcgguugcagcauugccgggccgcgcaagacuucggcaucucggagaugggcccacugccccuaaaaaagauggcggcucg

SEQ ID NO: 2294 - RNA, 6362 nt, Mus musculus
cgagccgccaucuuuuuuaggggcagugggcccaucuccgagaugccgaagucuugcgcggcccggcaaugcugcaaccgcuacagcagccgcaggaagcagcucaccuuccaccggugagggauggggaagccgggacccgacccuacggaacgcucgcgggucucggugcacugggcgggagcuccgggaggcccaggccaggguuugcaggcgagguggaccgggacugcguagaggggccgggccgggcgcgggcgaugcuccugcgcgcggccucacagccugaccccgccgcccccuccucgccuggaagcaguaggugcucagugcaaacuagaugggcgugaguggcaccuggccgugucccugcucuggccccuugcgccugcgucaccucgcgggaggccuggaggaaugagugcucccaggauggccgggccucauggcagggauuucggcugugggaaggugggagauccccgguucugcagcccugggaccccuuuuccccagcaagacucgugcugagcccuuucuagggaagcacccuucaacugcuccggcuucgagcgaugucugugccuucagggcucaguuccuggcagcccgcacccuguacacuuugaauguuucugcugaagaguagcaaccauagaaaaauacacacaucaguuggcagcccacagacgucuccgcuggcauccacuuacagucuuuucucccaccagcccacagggauagcuugcaugugggcugcguggcuguggcgagguuugaaccuuaagaaauggaaucucucucucucuuccuuccgggcccugcgagagucauccuugccccacaagcacuauucugcauaguauuccauugaccacgagccaggaugugugcucugcauggaagggccuccggguggcugcauggguaguuaucagguaucugaguugccagaaacucgggggaacacucaccucugcccgcucucauucuuuguuuuuaaguuaaauucauuuguguguagaagaauccuccacccucuugccaugucucccaugggauggauggucagaggacaguuucuuuccuguuuuguggggccacagggauuuugccaggugucuuaucuauuuuaauagccaccuccuccauugagaccaggcccuuuucuguaguucugacugaagucagugaauagagcuauguacccaaaacuggcuuugaacacucaaaaaaaaaaaaaaaaaaaaaaaacacccccucccuuaaugcaugcuggcauccugucugggagacuuuuauauuuuacuuuguguuggagauggagcucaggccuuccagaguaguggguaggcaggugcucuacacaccuugacuuuuuuuuugguuuuguuuuuucgagacaggguuucucuguguagcccuggcuguccuggaacucacucuguagaccaggcuggccucgaacucagaaauccaccugccuuugccuucugaguacugggauuaaaggcaugagccaccacgccuggccacaccuccgaauuuuuaaacuuuuuuguuuuguuuuucaagauaggauuucucuguguagaccaggcugaccuugaacucacagagaucugccagccucugccuccagaguguugagauuaaaggcgugugccaccacuuaaguguuuauggcacaaucaccacauguccugguaggcuuccugaggacaguuuagaucuguguguaccccgugcuuugacaucucuccugugcccucccgucugccuucugacucuauccuugcuucaggcuaguguugcuucuguuaauucgagagggcuggucuuguguagcccaggcuggcuuaugaacuggacccuuccagguauccaccacugugccccacccaggucuugcuuauaggucugugucaucuauccggcuuugucuuaaaagaacucucaauagcuuuugacuaggcaguucucuucccacucccugggcgcauccugaccuuugucccacaucucccccgucagucuccaucccagaguccucucuacuuccuacacugagugcuggcaugcucaagauggagccguucagggcuucucccuagugcugagaucgccgaggcuggcaggcucuguagggacauccccgggcauaggugcccaucugccacucugagcucugccagucugaagagcaccuugaacuugacaccuaacgcaucaaacuuguguucacccaggccuggaccuccgaggacucuccuguccuucuccuccuccuccuccucuuccuccuccucccccucccuuccuccucagggaccuggaaccauggagcuccuucccuucucuucucucaucauccucgagcaaaccucgacacuuggcuuuugcuuuuuccuucuuccuuucuuccugcccucccucuccccucccuccuccucuucucucgacaaguuccccacuccaggcucugcugugcuggagcucacucuguagaccaggcuggucucaguguuggaauugaaggcguauuauucuguaaccuaggcugcccuugaacucacuucaguccuucuccuccuccagaaccuccaaugaugccccugcuaccuaaaucaagcccugggugugucuuauggcccuucuuccuccaggugccccagccagaccgacaucuuuguccccugcccccacccauccuuuguaaaggccgggucuuauuucucacuugcugccgggucuguucaaacgucauccuggccggcccucauuaccuaccacagggcuucuuccuguuguuuucaccugcuccgcccgcccucacagcccaacccucucaguguggcuugcuccugucugaggugcaggcuccugaggagcaggaacuugguccuauccacugccaccgucuggcaggaaagcagagacuggcauguggcaagcucugaagggcuagagguggcuccuggcaugcgcuuuggaagccuaguucccucgggcuccuugcccacguuuaugguccugggauuccuauauauguggauagaagccagggugaguaucuggaugacuaacaguggauuacugaguuuccaaagcugugccauuggaugcugugcccacagguuccccuucagccgcccggagcuguugagggagugggugcucaacaucggccgggcugacuucaagccuaagcagcacacagucaucugcucggaacacuucagacccgagugcuucagcgccuuugggaaccgcaagaaccugaaacacaaugcugugcccacgguguucgcuuuucagaaccccacagagguagggugcuagccugauguccagccagugggucugugugugugcugggaggggaccuuacaaaggagucgcagcugaucuagcucaguugguacagugcuagaccagcaugcgggaagccccugggaaacagaggcggguggguuacugaguuugaggccagccuggucuacagagugaguuccagagcagucaggaccacauagacaaaccccaucuccaaaaaacaaaaaaaccccaaaaucaaacaaaaacaaaaaacaaacaaacaaaaacccaaaaaauaagcaggauaagacccugguagagccgggcagugguggcgcaccccuuuaaucccagcacuugggaggcagaggcagguggauuucugaguucaaauccagccuggucuacagagugaguuccaggacagccaggguuacacagagaaacccugucucaaagaacaaaacacacacauacacacaaaaacaaaaagccaaaccaaaccaaaacaaaaaagacccugcuagaaagacaaaaaguaaaauaaauaaaaaauaaaauaaagccccuuuaaaaguugaucaugugugcugaagacugguuguagugauuuuuuuuuuuuuuuuuuggcaaaggugcuugucuagcaugcacaaaggccuggguuugaucccuaacacuacauaaaucagggcugugggccauggccauggcugugugcaauccuggcucuccagagguggaggcaggaagaucaaauauucagucaaccuuggggucuaaggcuagucugagguacaggagacuuugucucagaacaagaaagccaggugugggggcuggagagauggcucagcgguuaagagcacugacugcucuuccgaagguccugaguucaaauuccagcaaccaaccaucuguaaugaaaucggaugcccucuucuggugugucugaagacagcuacaguguacuuacauauaauaaauaaauaaauccaaaaaaaaaaaaggaagccaggugugauugugcauucucagcucuuagaaggcagaggcaggaggauugccacagauuccagguggcagcacauucugcgaccuaggccauguguauagagugagugcagcaugacagcuuuuaguguggugacaggggcugaaagaggucugagcaugcucagauccccaguuuaacugcacaguccucagcgcccccauguugaauggccacaguggucacugccagcagguggcagggacucuggaucugcuucagaccuuuccaucgcauggcgccgcagggcaaacauccaucaggcuucggggugauguaaaugacucagguccuuggcuguagggaccugucuaggugccacugccccaggauuuggggacauaucuagugaaagccagugugagcagggcuggauucagucaguauuguuaggcugagucaggagacuugggugggcguccuuagguuccacuguguccugccucaaccagagagccaugucuugaauugguuaugggagagaggagccacugcccgcgccucagagaggugugugcaccagggcacgccacacaucccagagugcccuguuguggcggcuuccuggucaggcaguguucacacgcuugagucuggugaaaggugaggcuauugccugaagacagcaggguucugaguucagggagcuuuucucugggaagcuguggccucaggcuuccuccuccugagagcuggagaccugggcuuggagggcgggagggagggagggagagagggagggagggagggagacucccugcuccugacugcagaggcacagggcagggccauagcccccguguagggauuacccggauggacaguagcagcugcaggguccggugucugccagcucagccagccugccugacuccgccugcuguucccaggucugcccugaggugggggcugguggggacagcucagggaggaacauggacaccacacuggaagaacuucagccuccaaccccggaaggccccgugcagcagguaagacccuggguacgagguggucucagagggacgaauuuugcugacaacaaaaaugaagaaacccacugccccagaggacccgacagaacaggagcagcggggagagguggccgggcuucagagcuucucagucaaccaccaugacagcucaucaggguugcagaaggggaaauggacuggggcuaaacccggaggguaacgggcagcuguggccccagcucaugccguccugcuuaggacacaaggcucuucccagcacucacuuuccucuguccuuaggucuuaccagaucgagaagcaauggaggccacggaggccgcuggccugccugccagcccucugggguugaagaggccccuuccgggacagccgucugaucacagcuaugcccuuucggacuuggauacccucaaaaaaaaacucuuucucacacugaaggaaaacaagaggcuucggaagcggcugaaagcccagaggcugcuguugcggaggacauguggccgccugagagccuacagagagggacagccgggaccucgggccagacggccggcacagggaagcugagccugagcaagcucugggaugugggggugguggcaacaccuuagcaggaagugguguucuggccugcuaugggcguuucuacccgcugcugaugcugcaggugccuugagagugggaugggaugcugcgacaggcaguugucgggugggggcccaaguacugcggaggcaccgucccagguuucuugggcugaggcugucagcuguggggaagcagcagugaccaaaugugagccgucacaacccccucaagagaugcucccagagggagagcuggucauucuuacagccggugggguccuuacugucuccccauaggagccauucugauggcaggcagggcaaggguccccgucagccuguauuucugagugacucuuuuucugccugguucguguagauguggaauaaaucuuuugaagucuccau

SEQ ID NO: 2295 - RNA, 7901 nt, Mus musculus
uguaugucacauccggcgcggcggcgguggcgucuccgcgcugugggccgggcaguaguuagucuugugggcgguggaaguggucuaggccggagcagugaagccggugugagccgggaggaccggcggggugaggagggugcgggagggagguggagagccgccucgggcucucaggagcguguggccgccgccuuccgcuugccgcccgcccgcgaugugcaggcgcggcgugggcuugggucaccugugcgcagccgccgcccugcccuacuggcuguccguugggugcucuacagaucagcugucguccacgcuggucuagccccaaacucucauuuucauuuuuuccccaccagcacccuaucccgacugccccuguccugucucccgccaugcacuuccucucccgcucucuccccuccggccaacccaugccgcuccccgcccccaagacuccacucuggcuguguacucugugugcacuuucuaaccuugacccaagccugcaucccgacauggguggaugugcaaguguccaucucacucucgguccaaaagggcuuuuccgauuggggcugagcagaggggucauguuugccuucccuuucagauuauggacgguuccuucgugcagcacagcgugaggguucugcaggaacucaacaagcagcgcgagaagggccaguauugcgacgccacacuggacguggggggccugguguucaaggcgcacuggaguguccuggcguguugcagccauuucuuccagagaaucuacggggauggcacagggggcagcguuguccucccagcgggcuuugcugagauuuuuggccuccugcuggacuuuuucuacacuggccaccucgcccucaccucagggaacagggaucagguacucuuggcagccaaagaguugagggugccugaggcuguggagcuaugucagagcuuccagccccaaaccucagugggacaggcacagaguggacugggucaaccugccucccaggacgugaaaagccaccugaaggagccgacagacuuggaugaggaggaaguuuucaggacucugagccuggccuccguggaucaggagcccagagacacugagcagccccagcuggguacaccugcucagagcaccacggccuuccucugugggaaacucacgcaggcuuugaagccuucucccucagaggacaaagagucugaggacugcaaagagcccccaaggcccuucgaggcuggaggugccccgcugcagggcgagagcaaugagguacuguuuucagggaacuggggaggcaagcauaaggguaaagaccgacacuucgggagcaaacaugggaagccaguggucucagcugaccuucugcgagcuacacuuguccaugguugccagcuuccuugggguggagugagcgucaggguuacagguauuuccuuagguuagugauccuggccagcucccugcuaacauagccacuaugcuccaaguccaagauugcagucuccucugggcccugcagggaacuguugucucuggugaacggaccaucuggggguggggcuuauguuggaacugaaggcuggguccugcugauaccugggugacccuacccccuccugcugccuccucugcucuagugggaaguggugguccaaguggaggacgacagggacggugauuacguaucugagccugagacugugcuaaccagaaggaagucaaaagugauuagaaaacccugugcagccgagccagcccugggugcggguucucucacagccgagcccacugacagcagaaaaggugcagccguuccggucgaaugucccacaugucacaaaaaguuccucagcaaauauuaccugaaaguccacaacagguaaaugcucugcuuguuuuaauuuccuuuuccuaucugcccuuccguguugcagcagaggguccuguacuccccuccuccgggcucugcggggcuggggauccuaggucaggcccagacaguggcuggucagcaugccaccucuuccugucuuucugugauuguggguuuguggauaccuggucaguagauucuacccacuguggaguuugacugugggcaggccucuggccccuuccugagcugaagcugaggucugauagacagugugggcugugacaagaggcugauggagaggacggaggcugccuguguuucuggggauguuagcuuuguaggucagugauguauaaggagccauuuguccaacagggaccuuuuaugacuuggagguuuguccucuuguuaguuuugucaggcuuuuuguuuguuuguuuuuugagacaggguuucucuauguagcacuggcugcccuauaauucucacuguguagaccaggcuggccuccaauucagagauccaccuucaucugccacccaagugcugggauaaaagccaugugccaccauaccuggcuuguuuugaguucaaauuacuugagaucccauaccacaugccaggcauggugguguacaccuuugaucucagcacuuaggaggcagagguaggcagaucucuggguauugaggucagccuggucuacagccugaguuccaggacagccagggauacacagagaagucuugucucgaaaaaaccaaugcccucccaacacaccgaaaauaauaauaaaagugagugcuguagacacagccccaucucagcugcuaaguagacauacuagucuccugcaguaccgagccaggcuguguugucagugcgucacucuggcaagccacuggugcucaccugguguaggagugagaccuguuugucaugccugggcuuuggccuugggguagaugaggcuauccaucucugcccaugcucccuucauuccuuccguggucugugguucgcugauggcccugagaacugggaaggaauggcuucaagagaugcuuauaucuaggcguggcggcacuuggaaaauagaggcacgaggcuugcuggaagcuugaguguguguggugaguuucaggucagugaggacuacgcagggauaccgugucucaaaagaauaauagaaaaugagguccuugcaguggcagggacuacgggggcgaggauucuuagagagaagaagaugagaguagguuuggcuucuggacggacauacaggagacucagugcuacccauggcgcugaggucaggguugguuugguuuauucagcugcugcugcacuugggaugagaugauguagcccuugaagaugaaggucuucauggcgcucggaugcagcacagguacagcaagccuugugucuugcaggaaaggaagcaguacuuuagcaugaagcagacagccugagccugcacuuuuugggaguuccaggccaguuggggcuucaguguguggcacccuguuuagggagguaggagaguaggggcagaggaacugggaauuggagucuacuguauagauaagguuagugguauuuauuuauuuauuaagaagguggggugcuuccuccucccuugugaccuucagugcuagggacugaagcccagggucuuugccacugagcuauaccccagcccauuuguagugagacacgccuuacuaaauugccuaggcugaugauccuucugccucagcuuggagcagcugggaaugggcuguagcucagucuuuuguuuuuuuuuucuucccgagacaggguuucucuguagcccuggcuguccuggaacucauucuauagaccaagcuggccuggaacucagaaauccgucugccucugccuccugagugcugggauuaaaggcgugugccaccacgcccggcuguagaucagucuuaaucuguuugccugccaggugaggcccccauguucaguccccaggaugcuaggggggaaagauccagaccaaguggcugagguuacacugccggccucugccacccgucuaggcuaggagacuuggaggauguguggaagccagucacuggugagagucuucuggcugggagaggagcuagcuggcuguugugagugguagggccugaccuggaguuggcauggcaugggguaaggucagugaggggcaggcugguucacuggcuacccauguccucugcccccugggcucucaauacaaaauaagcacuggcagguugugagcccaaggggccaccuuuucugcaaagagucuggacuuaauggagccuccuggagagauagguagggagccaggaaccaguggugacucaaggacuccaugaacugcuccagccacgcccuugcuggcaccugugaaauggacgcacagaaucugguuguggagucccacauuuacuucuuuacugagugugggagggucacgugcagacgucaguguacagcuugugggaguuguuuucuucaccucaugugucucagggauugaaccuggguccucuggcuucucagcagcaagugcuucugagcauugagccauaucaccuguccugccaugguguugaacgugggguccgcagaggggaagaugucaaccaggucuugucagugaaguuuugaggcagccauuuagggaggcuggcagaugaagggcuggcucuuccuggcucccuccuggcugucuuuccauggcuacuauuucuuccugaggcucucuaagcuggaggggguuucuagccuucccuuacaugagcaagcugggugucgcuaagucuacaugguuaacuccagcuagacuuaggacacuucuuccuccuaaugagcacagcaugucuguggcaagagcuggaggaucagagagcugggaaacccucuuagcccccacgccucuguggccucucuuccuggcaggaaacacacuggggagaaacccuucgagugucccaaaugugggaaguguuacuuccgcaaggagaaucucuuggaacaugaagccaggaauugcaugaaccgcucagaacagguacuugggaauugguccaaguauuugugggcagcagcacagugccugugucuucaugccaucugggaaggauccucaggaaacccuacgggauuauaaaauaagaacugcggggccuggcagguccgcauccuaguacuugccggacacaugaguucagagggcacaagggauauuuuggguuugccugccugggcuccuggucuagcuccaucuuaugcuuuggagcaaguaaaguauuugugggagauggcugccaggaagggccacuuugucggcaccccgccccuccaaguggguaguguuuggcuaaacccugucauccucuucccagagacuggccaguagcagcuggcucugucucuagccugucugaagccaagaagggucuggcgugugguagugugcagugcucugauggucaaggcaggcagguuacauguugcccucuccuaccccagcauccccuaccccaggcagacacuuaccagcagcguuuggaagccccugcagaggcugccgucgcaggcagaggcccucccugaugcuggcccugcuugccccucacacugccaggucuucacaugcuccguaugccaggagaccuuccgacggaggauggagcugcgcuugcacauggugucucacacaggggagaugcccuacaaggucaggcccgcuugucccagggccaugggcugggguggggguacgggguauguagcucucugccugggaugguaccuggcacuuguuccagagccaugggcuggggcagggggugcgcagcucuuugccugaggugguaccugucaccucucccuugaagccugccuuccuugcccauucggugacaccacuuguguagguagggcgacucucugcagccuugcuugcucagcauucuuccgggguaguauggcuggcugaauaucgcccccucuugggagccgaccuuuagccaucaaggacugucccuguguauggacuaggcccuuccccgugugcugagagcaggccacugauggugcuggcugcacuggaccugacugggccuguuuuuucaguguuccuccugcucccagcaguucaugcagaagaaagacuugcagagccacaugaucaagcugcacggagccccuaaaccccacgcaguaagugccagucagggcugggguuccgguggcucugggacagcucaauccuguccucaccuggaugugcucccucugccugucucacccaccugcagugccccacuugugccaagugcuuccugucuaggacggagcuacagcugcacgaggcuuuuaagcaucguggagaaaagcucuuugugugugaggaaugcgggcaccgggccucgagccgcaacggacugcagaugcacaucaaggccaagcacagguaugaaggaggaguggagugcucccucugugcaguguggcccugcuaccacaggaagcggccaccaccuccucccugagucucgcacuuguagcccuuccaggguggaggugagagacaggcaguuugcuaggcuaucggggaggacucaggcuggggcaggucucugccuccccucccggagcuaauccuucuccuuuagcuuccugacucccuacaauagagauuugucuuuugcuucugggaauggugguaucccuugcuggcuacccaagcccugcugcuuguuaccauguccagcuccagcagaguagguggagagggauggcguccccacagugauggccucugcuuuguguucccaucugaccaggaaugaaaggccuuaugucugugaguucugcagccaugccuucacccagaaggccaaccucaacaugcaccugcgcacacacaccggcgagaagccuuuccagugccaccucugugggaagaccuuccgcacccaaggugaggcaggcccagccccuccuugccccagggcugagacagccacugaguuccaccuugucccccauagccaguuuggacaagcacaaccgcacccacacgggcgagaggccuuucagcugugaauucugugagcagcgcuucacugagaagggcccccuucugaggcauguggccagccgccaucaagagggcaggccccacuucugccagaucuguggcaagaccuucaaagguaauuaguaggcaagcuguaggagaauagugggccuggcuuguuuccugcccgccuggguuggagggucuacacagagaucaagggcaccgguagcuucugcaugcuccucagaaccuucagcagcuccaucuuccgugugcugagaugagaguggagcuucugugacagcguggggacagggcacccugcaccugggcaguggugaccucagugcgcugcuguagggccugcuccuaacgcccguggucccuuuccucugcagcuguggaacaguuacgagugcacgucaggcgacacaaaggugugagaaaguucgagugcaccgaguguggcuacaaguucacgcggcagguaggccgggccggguccccugcuccccugcucccuuccguccccgcucugagcuuggcuucuccccaggcucaccugcggaggcacauggagauccacgacagaguggagaacuacaauccccggcagcgcaagcuccggaaccucaucauugaggaugagaagaugguggucguggcucuccagcccccugcagaccuggaggugggcucugcugaggucauuguggagucccugacccaggguggccuugccucccaacucccuagccagagacuguguucagaggagagcuuugcuagcccuggcguccuggagcccucucucaucaucaccgcugcuguucccgaggacugugacacguagaccccugcccggauggccccacugaccaauaaacaugugacuuagcacuugu

SEQ ID NO: 2296 - RNA, 22176 nt, Mus musculus
cgagaucgucccgccggagggguuccgggacaagcauggcggagucggagguguuacaccggcgggcuccgagccgcucuuccuggcugcggguacgcaaagcccggccccaccuccuccucagccgccggggccgccgucgguuugggguccugacccgagucgagcugcgacgccugcgacggcggcugcugcgggcacacgcguuaggcggggacuggaagcaggucgcccccgcgggcgcgcacguggcgguaaagugcaaacuccgggcccgcagccggccggcgccccgcagcccgcccacaccgagcgucccgcccgcgccaugcaccgcguccgcgaccugcagccugcucaacccccgcaaccacuccacgccccagagccgggccgggcgccccgugcggaagguguccccgaacgucacccagcccgugcgggaccugggcucgggccgcguguugaugaugcugccgccgggagaggugaguggucagcggggcgcugccggugagccuccggaugcaggucggaugcaagcccguccucguccuccugcuccggagccucuacuccuagcaagcuaauggggucggacuuaguggcacuuaaaccgccagcgauccagguguucgaaaccauuuaaagcccccuccucucacgggagugaccgcugccaugucuuucccgugucgaugggccgaaagacaaaauaaguaacuugcacgagguuagacacuagccaaggcagagccaggaggcaaagggaggcagucugacguggacuccggucggggacauugccccugucaugucaagaagcgaagccucaggaauuggagacucaagcucgcugugagccuucccaagcaucgggugugagagcguguugggagcugcaguggagguacuuuguuuaggguuagguuaaaaaccugacagaugcgugguggcgcacaccuuuaaucccagcacuugggaggcagaggcaggcggguuucugaguuugaggccagccuggucuacagagugaguuccaggacagucagggcuauacagagaaaaaacaaaaaacaaaccugacagauguuggcuacuuaguacgguguaguuuguuuguugguuuuuugaguauguucugccugcguuucuguacacagcgcaugugcagugcuuucuauuacagagcauuggaaacucugaaaccauagucguagaaggaugugaaucgccauaugggugugcagaaccaggccugggaucuccaguagagcagccacugcccuuacccaaugagcagccguugcgggcuccaugcuguguaguuuggguuuccuugucagguguggcuggugacaugcacucugaaugcagggaugguuggauuuuaaugauaggaagaacagccuguccuguguucuacauaguucugggacagccagagucuuaaggcccucaaucaagaaagaaaaauccuuuugagcagggcaugguggcgcacgccuuuaaucccagcacuugggaggcagaggcaggugaauuucugaguucaaggccagccuggucuacagagugaguuccagggcagcaagggcuauauagagaaacccugucucgaaaaaccaaaaaaaaaaaagaaaaagaaaaagaaaaaaaaggaaaaguccuuuugauagguaaaucacuaguuaggguguuuaaugguuuuuuucuuuucacacuaggguuucacuuucagugggaucugccgugugacuugcgucuacggccaguuggaaguauacggccauaucaucaaccaagggcagccuccccaagaugucuuuucugucuacacccacucuuaccugaccaucaaugggguuccguacgcagaacccgagaaaagugagaaggcgaucaggagggagauccgggcccugcucaagccuuacacgaaacuagguaauuggcucccgcuuccgaugucaaggcugaugacgaaggcuuauuaugggcuggacguugcgcugauuccucauggggggugucuuacguuaugagaguugaagcugguagguggcacacuucgauggccugucuccacccagguguaccggugaccagugacaaccuagagcuuagcaguugggacaagacccugcaggcucuagaauugucacuguugcugaggugucuugcucuucuuuggcagaugacagaaacuggguggugcgguacuucccuccucugggcuccauuaugauucuggaacggaugcagucucguuuuguggacuuccugaagaccuauaagugcuccucauacgugcuccugcaggagguaaagccaguguuccuugaugcuuugugccagagcagucaccccucaccuacaauggcuguguagggacccccugucacagugaucauccccucugucgugugagugagguguguguucagagaaucccauguguuagcaggagauaaucuauagagagauguaguauggguaaaggcacuugcugaacagccugacugaugugggugccauccucacuugugaggcgagggacacacuggcauagacgcuuacacaacggugaucccuguucccucugcuugcuugguuucauugcccaguagaacucaacucuuccgugaagaauaagagacauccggucucacgggucgauaggcaucgugggagugcgguuagaaggguaggacugugcauuugggagcugcaacagagagggugucugagaacacaaaugagcagagagagagcacgcgcgcauaagcacgcugguguaacuugagaggagaggaugugaggucugggcagugucacuucagaggaaguuaagguacagaagacacauaagaaccugaggaauggccaggguugggggcauuguggucuaagguggucugagaaagucccaugcagaggaugaggguggccucacgauguggucaagagagaaacugaacggcucaaaaggaacgaaggcagugaagcggaggcucagggcuaagcgcaaaggagccagagcucagcaguacuguugugaaggggaaccugaaacaaugcaccugcacaccgggcgugggaugaaaggagagaagaggagggagaggugaaggugcugaggggaugccccugggccugucccagacccugacgccuugggaggaacaaagaguugugugugugugugugugugcguguguucauucaugugugacaccuuacuucugguccuccgcagcuaucuguugagacagucucuggcuggccugaagcugccagcuggucgggcugaauggacggcugaaucacagcuugucugugcaccucccagguccuggguuaccaggcguuugauuuguuuaaguaguguuuuuauuuuuauuuuagcugucauuuaucuaguuaguuaguuagagacaggguuucuauguguagcccuggcaguccuagaacuaguucuguagauccagcuggccuugaacucaaagagauccuccugccucugucucccaaggccugggauuaaagaugugguuuaccaccaacaggcucuaauuaaauuuuuuuuaauguauuauucugagugugugugugugugugugugugugugugcgugugugugugcgugugugcgcgugcgugcgcgugcgugcgugcgcgcucguauugccuggaucugugcagcugucucccgcgugcccccaggaggcgcugagagucaaaccccaguccuuccuuuguaaggacagacagagccucuucucucucucuuuucuuucuuuuuuuuaguucauuaauuuuuuagcuguuuguuuuguuuuuguuugagauuugguuucucuauguagcuuugacuguccuggaacuccacucuguagacuaggcuagccuuuaacucuagggucucuaccacccuaguguugggauuaaugcuacccaggguggccuuguaugaaguuucucuucccuuuguuguuugguugguuuuggguuguguuguuauuguugucguuuggcucuucuccccgaaccuuugaaaugcuaaugcucagcuuggugugguggcacacaccuuuaaucccagugcucaggaggaucucuugugaauucaaggccagucuggucagcuuugggcaggcuagacuacagagagaccuugucucaaaaaacauucaaucuuuucgugcaaagaguacaagugugcaacaacacccacccccugccacacacacgcacacgcacacacccaggacgaacgaggagagagacaagagcacacacuggaauccucucauggucccugaguacccugaguacugugaaaaggaaccaaggcgcugcuggugugggagccgagagcgucaggcuuagaguugcugugggaagggagugaaaugaagcgguuggguuggucaaggaugugcuucugggacuguuguuucagugugugauuauguggguguaugcggauguguguggagccucuggaggacaggugugggauccaucccccuggagcugaaguuacagaaggucacaagccacucggcauggaugcuugggacagagcuaaaagucuccuaaccucugggccaccucucuauacacauacacacuuuucauuguuauuguuguuuuggagacaauguuacuauguaccuuguccaucaggccucaaauuguauuccucuugccuccugaaguucuaggauuacagauagagauccuacuaagguggcucuugugguuaaauuguuauuuaccucuuuauauuugugugugggguuggaugagccuguguggugugaacuugguguggaggugacccucaggccgucccacuuaguccuuuuacagugucucuuguugaagcugggcccuucacuuacagcucuucuagcuaaccagcuuuucuccaggguuccugucucugcaucccacaucuccuuagcucuucauggacacuggggauuugaacucugguccuaauaacuagaguuuuaaccacugcuccaucucccuagcccuuugugugauuguauucugaagaguuuuuuguuuauucuuuucauuucuuugucugugaaugccacauauuuucagaaggccagaagauaacaucagauucccugaagcggagcacaguugauuguuagcugucugacaugggugcuagggaccuucugcagaaucaguaaucacucuuaggcacuaggccaucuuguccacucuugguuacauuuucauccuccccagagugagggaacccuagccaugggaggcacccaggaagguggcaggaaagccuccaugauggcacugaacugcugauugcaugagauguguuugugggaggucccuucuucccuucucuuugaccgugccuccccgucagcaagcaccugcccuuuguaguuucugucuaccuuccuuccguccagcaggcuucaguggaaugcugcacaaugcccuuuacucuugagccucauuagugucugcccuggggucuguuuugcgauuuguggccuccgcugagcuuucccuacauuuccuugccugccuuggcaggggcagccugaguaauguaagccguggagagaggcaggcaggggcagccugagcagugugagaccuggagagaggcaggcaggggcagccugagcagugugagcccuggagagaggcaggcaggggcagccugagcagugugagccguggagaggcaggcagggguagccugagccauggagaggggcuugcacaugagaaggagcaggauguugguggagggauguguggugaggguugaauuuugggguauuaagagaaauuuuggggcuguagagauggcucagaguuuaagacugcucuguauggagguguuagacaccaugaaaaauguuuuaaaugaggcuggagagggcucagcgguuaggagcacugagagcucuuccagagguccagaguucaaaucuaagcaacauguggcucacgaccaucuguaaugagaucugacgcccucuccuggugugucugaugacagcuacaguauacuuagauauaauaaauaaaucuuaaaaaaaaaaaaaagcuggaccugguggcgcacgccuuuaaucccaacacuugggaggcagaggcaggcggauuucugaguucgaggccagccuggucuacaaagugaguuccaggacagccagggcuauacagagaaacccugcccccccaaaaagagagagagagagagagagagaaaguuuguaacucaugacuauaugaugcuuauuaauguagaagcaaauaaauguauauucauuagaaacuuuccuuacaguuucaguuguuauauuucagaacgcuccuguucgggucaauucugaguuuacaacuuugaagaaaauuggcaucagaagacagaagaggaagaaagccauuugcuugagugagaguggccuuugugcccuggaagaguuagucagcguguccuguggugaguuuugccuguuguagaugccuguguccccgaagccucagucacugcucaggacuagaguccugaggacuggcucacaccagggcucacuguuuguuuuaccugcaaaaguagauggcugcccugucauccuguuguguggcgcuugugacauuggaaagucaacguucaauagaauacugauuaaccaguuauuaaauagguaagcucgcuuguguuuucauuggucaucugggcaugaagugagauucaaauggagaaacuugcuuuuguuugaucuucuaagguguggccucacucucuagaccaauuuggccuuggugauucuccugccucagccuccccagugcuaugauuauaggcauaagccaccaugcccagcuugauggacagacugaaguuggggauuuguuuaacucacugcugucagcugggccauggcauucugcagggcaguccccugccucacucccaugcugaugcugaucugcagcagaggcaccugcucuccgucccugagccagcccuguguuaguuuauagaauaccguguguguugcaauuggcacagggucuugccugcaccguggcccucaccuuguggaguaggacagcuacaaggccacacggggugaugauccuugugugucacgaauuuuccacaaagaaggcugccucagaucucuuucucucucucucucucacaauuuucagcauuccugggguugacuaucuggaaugugaucuggggcagacggaguucacuccuccuggcugugucgcuuuacuuaccaucacagaaccacuucuggguacguaauacacgcuccucagugucucgggcucucacaauguucucuauaaaaggaaaaaugugcaaagugaaucacucugccucuagcuuccacagcaaacuugagcaauacuuuauaucagauuuuuuugacuauauuuaugugcaugguguuuuacgugucugcgacucuggggugcuggguccuuugaaacugaaguugcagggagacguaaguuggguccugcaacaugucacccugacagcaucccagguagccugugugucugacccaguacuacugaacaggcuacagacgcuucuucugccuccaccaguuauccuauaacauccuuuuccugguucagacugcaaguagaauuucugcuuuguuuuguuuugucuucagcugccccuggguguggaguugucucgcuucugcauccagauagccauaugccuggcuggcuggcuuuuuugagacgggguuucuccauguaggccuggcuguccuggauuucacuguguagaccaggcuggccuugaucucacagagcucccgcugccucugccucccaggugaaggccugcauagccuggccccagaauuuuuuauuaucucccagugaagcaguucucuuugcagucaucuccuccuccccacccugucugucuguuucugucucucucucugucucuguuucucucucuaauuuauuacuuuuuuaaaauuuucugugcauugguguuuugccugcauguaugucuuuaggaaaguguuggauccccuguaacaggaguuacagacacuugugagcugccaugugggugcuaggaauugaacccagagccucuggaagaccaaccagugcucucagcugcugagccagcuccccaucucuuucacucucuuaguugcuguucaguucuguccccacucagucuggcuguucacuguggacuagguuagagacugugucagacgucaucuccgagaaggcagcuugacggauaaaaaccaccucagguuccuccguguggccgaguguccuguuacauguuuacagaauguguuugccuguccagcuauugaauguuugggguugcaccaaccuguguacauguuccauggcgcauguguggaaaugagagccuuugaagaguuucugcuuccggcugcagaggcaggaucucuugguuuucugcuacuggaccgcauaucccagacgagcuggccugcaagcuuuuaggcugugcucaccuccccaucccauucuccugcaguacugggugcgagugcaugggcagcaccuuccccacugagucagaaguccgcccgccguggaacaucacugccauaagcacagagggcaagcacacaguugagacccagcuuucagggcaguagugugugccuagagaugugugguugcuagguaacaugaaagucugcugccagcaacagugcacaguaacauuaacuaauucucuugguucuugccaaugguauuaucuugauuauagacccucgggcaggugugaagcaggguuugggguuuugguuuguguucucaugacugcugacacuugaauaucaucuccugaggauucacauugucagugccuguuggccacuccuuugaccaggcugaccuugaauuuagagaucugccugagugccuccggaguguugggauuaaaggccugugccaacacagccuggcuaagucccuggauuuuauuuuauuuuuuugucccuggauucuuuuauucuuuuauuuuuuaauuguuuuggggcaagguuucucuauguguguacccugacuguccuggaccucacagagacccaccugccucugucuccugagugcuaggauuaaaguguuuaccaccauggccagcacaccauuuuguuuuuuaaauuuuauauuugcuuugcuuuuuuuuuuaagauuuauuuuuauauauguguguguauacacauauauauacauacacacacauauauauaauuuauauauaaaauuuuguguguguauauauauauguauauguguauauguauauauauauauauaugaguacacuguaacuauauucagacaaaccaaaagagggcaucagaucccauuacagauggucaugagccaccaugggguuccugggaauugaacucgggaccucugggagaacaaccagugcucuuaaccucugagccgucucuccagcccauacuugcuuauuuugaaugggaguuaggugcaagcgucuuggcauacauggaaaucuaaugacagauuguuagagucagaucuucucaccauguagguucugggaucugagcacuggccguuagcuuuauucaacagucugugccaucagaucucugugucuguagaucucuuucccugccucugccucccaagugcugggauuaaaggcaugugacaccacugauuuuuuauuauuauuauaucuaaguacacuguagcugucuucagacacaccagaagagggcaucagauaucauuacggaugguuaugagccaccaugugguugcugggauuugaacucgggaccuucgugagaacagucaauggucuuaacugcugagccgucucuccagccugauuauuaaccuccuggauauugggaaccaaacucagcuccuuagugagaguaguggaucuguuccuuccacugaggccaaacucuggcuuuuuucuuuuggucuuuuccuuuggguuugggguugucacuauaucucuggccugccuggaacuugcugucuuggaagucacagaguugcuuugccucccaaacgcugggauuaaaaguagguaccaaggggcuagagagauggcucagcugcuaagagugcugacugcucuuccagagguccuaaguucaauucccagcaacuacauggugggucacaaagaucuguaauggaaucugaugcucucuacuggugugucugaagacagcgacaguguacacauauaaauaaguaaaucuuucaaaauaaaaguacauaccaccacucagcaagggucauaaauuaaauuuuuuuguuuuuguguuuauuuguuuguuuuuugauuuuucgagacaggguuucucuguauagcccuggcuguccuggagcucacucuguagaccaggcuggccucgaacucagaaauccaccugccucugccucccaagugcugggauuaaaggcaugggccaacccggcuauaaauuaaauuuucaacagacuguaagccaugaaagguauagagguucauaguuguaucccaaguacccagaacaaauagagccauaccagaacaugauuggaauuuacucacaugcauggagucauguuugaugguuugagaauuccugaugucuuuggcagguuuggcagggacacagaauccuggccacugccuuguggccaugacacagcuacuuuugcuuggcagugcuguagauggaaccccuaagaguagugguucucaacccguggauagugaucgcccacaaugcugcauauuagauacuuacaucaugauuaaugacaauagcaguauugcaguuauaaagaagcaacaaaaauaguuuuauggccgggcagugguggcgcauaccuuuaaucccagcacuugagaggcagaggcagguggauuucugaguucaaggccagccuggucuacagagugaguuccaggacagccagggcuacacagagaaacccugucuugaaaaaacaaaaacgaaaaaguuuugugguugagggucccuuccaaggugaacuguaauaaagggucguagcacugggcagaugaagaacacggcccucgagcguugcucugucuuaggcgagugcuuggggacucacugcuccuguguucauuuccuaggaccgccguacacucaccagaggaaaccacagaggaugguguacuaugggaagaugaacuguuacaaugacuacgagaauuacauugacauaguaaaauacguguucagagauuacaagagagaguuuccacuuaucaucaacacgaugggcugggugucagguaagaccugcacacaugugcagcugccaugagcacugcacccacacacgaugacauggggugcucgggugagggggagcauggguagcuuguagcugagaacagcccuggauguuccaaugcagagcauaccggcauucaucauggcuguccuucuuaugugcugcugagcaucaaacccaggagcuccggcacucgagccacagcucugagaaucucuuauauaaacaguaccuguuaauaaacaagccagccgggccugguagcacacaccuuuaaucccagcacucaggaggcagaggcaggcggauuuuugaguucgaggccagccuggucuacaaagugaguuccaggacagccaaggcgaaacagagaaacccugucucgaaaaaaaaaaaacaacaauaacaacaaaaaaaccaagccaguggccaaugagcugaggcaggacauagaagguugaacacuggcaagaagagggaauucugggaaguaguaagaaugaaauagauuggagggagaugcugaguaagacacuaaggaagaaggaaagggaacuaagcaggcagaggagauaacaguguggauggauuagguaaguuaggagccagucacugaaugagccaaagccauggccaagacguuuaguaaucaauaaugagcuaucauuccaggaaugggccagaaggaaaacccauuguuauuuuuacauauuucacuuugcuucguugguugguuuuggauuuuggauacaggguuucucuguguagcucuggcuguccuggaacuugcucuguagaccaggauggccucaaacucagaaauccgccugccucugccucccaagugcugggauuaaaggcgcgcgccaccaccgccugccacacugccuggcucuuguugguuguuuuuuuucauugauuuuucuauucugucaaacacuguauguggugcccuugggugccagaagaggguggcagaucuugucagcugugcauaugcugccuguccauggcuucucuagagggcuuuaccugugccuguggccucuccccucacagauaaugggcugcggcugcuuguggaccugauccgggugcugucucccaauuaugucguucaguuauauucugaucgcuguaaauuuacaccgacacugaccuccgaauacguagagcucacagauggccuguauacaaaaagcaagaucaaaagauaucgagguuuugaaauuccagaauuuggagacaauuuagaauuuacuuaugaagagaaagagucuaguccacuuccagucuucacuggacauguacugcugucuguucacuccgaauucuuaaguaguaaaaaugaaaagaacagguaaguacagaaccgcuuguaagcaaagccauccuguacugggcuugcugcuuugcuugggggugagucccgagguggucaugguggcucuuguaggucaucccaacaccaggaaggcagagaugggcaucauggguucagccuacaguacauugucaaacccuauaaacgaaaagagaauacuccuguuaagauugcagguuuaccauggcuauacauuuaaaggagagugggugcuggugagcacacagaggcagggcuucuggugcugcuggucugugcuaggagucuuugggauuccugguggucaaggcaggguuucagauggagaucaacacuaacccuaaccacgugcgcuguacaggccauuuaaccagggggcuugggaacauccugaaagagcaaagucuaucuaguguuaccggagugcucuguugucgcuguuaugcuguugugucaugcugcgcugucaucucugugaugguggcgggcgugacugcugcgauacucuacucacugugcucugcucugcuuuucagggccaaauacaacaggauuuuucgagaucuggcaguguugggcuaccuuagccagcugaugcuucccgugccagagucacuuaguccuuugcacagccugacgcccuaucagguaaucggagcuggugggcagaauuaucugauacugauaagauucuugaggcuuccaaguccuggucugcuccuguuuaacucuuugcuugccuaauucucaaaacagcccugugguucugauacuguccccauuuuucacauggggagacuaaggaacagugaggcuggguugccuggaagaagaugcagaacuggcauuuguccuuggcaggcaagccucagugucugucauguauuguaguuucaugacagcuguaaguuaucugaucugguggcugccccacguuugcacuuaccaacugcaugagaguaguaucugacaucuuagguuguuucugaugcuauaggacucugugagccuuccuggcaguaccuggaaccaagagcaccuccuguggacuuaguuauucuuguuagguuccaacaccaaaugcagaguccaggcugcuaggaauugcuuugggggaaacccgcuauugugugaggaucuaggguguggacauggugucaagugauagaaguaguauguguuuggagauugaacccagagccuuacuauguugugggaugacacucaggcuaaguuucacaugcaugggugcacaggugcacacgugugugugcgcgugcgcgcacgagcaugcacacacacacacacagagucucagguuacuuugccauuccugugucaaaacacugcccaaggcagcuuaaacagguuaauugcucgggcucacuguuugagaggcuuagagucugguggcacagcaaaggcaggguggaaaagcaagagacccugcaucuugauucacauucacugggaauuaugcaagucuuaacaccucaaagcccauccccagcagcacaccuccuaauccuuccaaaacaguuccaccaucuggggaccaagcauucaggcuuaugagccuguaggggccguucuccuucaaacuaucagcagacagacacacacacacugcaucagcauuuuguuucuaaaccaauaaguauuugcuuugaagacaaagcgaacagugucaccauagaucucuacuguugaguuccuugugcauuauacaggggaacuuaauguauuuuguuuuuguuuuuuagauuuauucauuuauuuuauacauaccaguacaccaccauugcuuucuucagacacaccaaaagagggcaccagaucccauuacagaugguugugagucaccaugugguugcuggggauugaacucaggaccucuggaagagcagucagugcucuuaaccucugagccaucucuccagcccccggaacuuaugcuuuguuuuguuuuuugagacaggguuucucuguguagcccuggcuguccuggaacucgcucuguagaccagguuggccucgaacucagaaauccgccugccucugccucccaagugcugggauuaaaggccugugccaccacgcccggcaccaggggacuuaugauuauuaugauuaccuggauauaacaaacaaacaagucacuuuguguuugugccugugggaagggaggugggagguggcugagcccuagagccucuccugcuugcuuucugcucuuguucuucugcggggccgaguggccuggugcuaggcuuugcugcuuuguggguucucccugugccgccgguuuucccuccugucauuagauaggagagaaagaaggauaagggauggggaagacagagauccuugagucuaauuuuuucuuguuucuuugaacaagacuacuaacagaccacauccaaccccaccucucagggcccuagcucugaaaaguucccagaauuccaaaggucacacagucgcacuugcacaaacugucuguggcuggcaaaagcauccuuugccagggcgugagggaaucauagucggcugcuuugggcagguguaagccacaccauaagccugccugggauuaaaacaaaaagcauacucuuaaaauaguucugugguuuguuuguuuguuuuuugguuuuuccagacaggguuucucuguguggcccuggcuguccaggaacucacuuuguagaccaggcuggccuggagcucagaaaucugccugccucugccucccgagugcugggauuaaaggcuugugccaccacugccuggcccacccucucucccucccucccucccucccucccuuccuuccuuccuuccuuccuuucuuuuuuaggacaccaaauuguagaauugacuacacugacuugcagcucguguucuagcuuaugacguagcaugagagugauggguuugcuucuaaaagaaggaaaccgugaaagcaaggucuuaaugcagcaaagcacagcuaguagaugcugcaggcaccgagaaaagcugaccagaggcugucuggacccucagggcccccgugacugaccucauaauccaucuaccaagaacuguccugaaagccuacagcugccaccuaaugcugaucuuaccagugcuuuuguuagguuuuucaaugggcagagaaaggaaugaaaaugauccaggccgggcauaguggcgcauuccuuuaaucccaguacuugggaggcagaggcaggcagauuucugaguucgaggccagccuggucuacagagugaguuccaggacagccagggcuacacagagaaacccucucaaaaaaccaaaaaaaagaaagaaaaugauucagacaggaguacaggaagaagagaaauguagccaggcugccuugaacuucaaguccuccugccuuugccugccaugugccaugacagucaucauauaccaccacacccagggcuuccugcauuguaggccaggacuccgucaucugagccaaucccuacccuagguuucggccgggugggaugauacaugccuacaagcucagcaccugggaagguaaaugaaagagaggcagccgaggcaagcuucagguucaguguuuucuaauccaccuuuuuucccagaagaaaacgggggaccuggugugaugcccuguucugaggcaggcuggucuacauacugagucccaggcaagccugggcuacagaguaagacuaucugcaaaagaacccugcaaguccagaaaguccagacaaccuagaagugggggaaguggcaguacccacacugacuuauaacuacacaagugagcacacacaagcacauauacaagccuaaagagucuuuuaagucagccguugggauccacgccuauuaguucauuguuuaggagccuaaggcaguacauuguccguuugaggucucaggaacacacgucucaaaguagaaguuaaugagaggugcauguuuacgguuuauucuccagguccccuucagugccgucgcuauccgggucuugcaugccgacguugcgccuacccacauacuguaugcugugaaugccagcugggucggccuuugcaggaucguggaugauaugaaaggcuacacucggggccccauccugcuugcccagaaccccauaugugacuguuugggcuuuggugagugaacaguaaacaaugccuccugcccuguccucuucacuggagacagcagucccugacuguauguuguauuaacauuuggugccagacauagauggcaugguuuuauaccaccaucacgcucuguuagccuguuucaguccucauggcugaacauggaacuuucaaauacuuugaaugguacuuuuuuuuuuuuuucuuguuuuuuuuucaagacaggguuucucuauauagcccuggcuauccuggaacucacuuuguagagcaggcuggccucgaacucagaaauucaccugccucugccucccaagugcuggaauuaaaggcaugcaccaccaugcccgguggcacuuucuuaaaacuuauuuuuagcuaggcaucguggcugacuucaggaggcacaggcaagugggucucuuguuugaggacaguauuaucaaguuagcaaguucuuggacaagggcuauguagacccugucucaaaaaaaauaauaauuuuuaauucuguggguguguucccgugaguugagaagccuuuagaauagagguguuggucccagugcuggcauagauagcgcuugguugugagugccugagauuggugcugggagcugagcuugggaggaauaccaagcgcucugccccugucgggcuaccucgucagccccacagcugcacauuauauucuguguaaaacacuggaagggaaaacuccuucauuuauuccuccuguuggggucgcgugccugucugccagcugcucucaaaggccagaugugggcaucagacccaugggaguacaguugugagucagcaucuggguccuagagauggaccguagguccuuuggaguuaagcaaaugugcuuaacugcugagccccaaaauucggaauuaaaacucuuaauguaggacuggagagauggcucagugauuaagagcacugauugcucuuccagagguccugaguucaauucccagcaaccacaugguggcucacagccaucuguaauggaauccaauguccucuauagacagcuacaguguacucaucauguauauaaaauaaauaaaaucuuuuuuuuuguuuuuuguuuguuuguuuguuuguuuguuuuaaaagauuuauuuauuuauuauauguaaguacacuguagcugucuucagacacuccagaagagggcgucagaucuuguuacagaugguugugagccaccaugugguugcugggauuugaacucuggaccuucggaagagcagucgggugcucuuacccacugagccaucucaccagcccccuuguuuuauuuuuugagacaagguuucucuguauaaccuuggcuguccuggaacucacuuuguagaccaggcuggccucaaacucagaaauccgcccgccugcuucugccucccaagugcugggauuaaaggugugugcuacuacacccggcuuaauaaaaucuuuaagaaaaaaauuaauaaaacucuuaaugucaccuucacuucccugcgguugccgugugcagcuuugcagaauggcugacccugcucuguaucuugaagguaucugcagaggcauugacauggacaagcggaccuaccacauccucaccccucuacccccagaagaguuaaaaacugugaacugucugcugguugguuccauuuccaucccacauuguauuuuucagaaccaggugaguccccguggaaggggucugcagggagucugggcaggugaggccaagcugacgccgucagcgcucaaggcaauggguccuuggaagacauacaccuuuuuuuuuuuuuuuuucuuuuucuuuuuuuuuuuuuuuuuuuauuuccauuuuaugugcacugguguuuugccuuuugccugugugugugugugugugucuguguaugugucuaugucuauguaagggugucaugucuuggaguuacagaccgacaauuaguugugaguuccuaugggcauccugggaauugaacccugguccucuggaagagcagucagugcccuggagacagacacuuuguuuauuaugggacuugaaugccacacuccguuuagacagggucucuaugcugcuucuuuguguuuccauuucagccugggcccgaagggucaguuccuuaugucaccacagauuauaauuuaaauaucccuggagcaacagagaaaauuggagagagagaguauggaaaagcauucccuagacacaaauuacggcaaagaagaaaauaagccugggaauggagagacuuugcucccgggaugccucgucccaggccgagucagcagacugcgugggcuguggugaguggggcuguguggcugccgagcuccugcuccugcccgcuguucacggaacuggaaagugugcugugccccuccagugucuucccucugagacaggagggccuuguauccuacagcucuaucuggccucaaacucuggguauuucaggccuguguuaggacaccagcucucagacuuuucagcucuuuggucucaaacuuggccccagcccucuugacgacugguugucccggcuguggcgugcuuccugagagcugugaagcagugaagaaagccgugguguccucagaacaggcagaggaaggacagccuugcaguuuuccaagaaaaucgggaccaugaaaguauggcuagaaacugggcagcaggcugacccgcagguucucauguacagcgcacagacugccgggggccugagcaggcucagugagaggcguguugagccauguggacauuagcaaccaggugccaacuccuuggucugauccuugggugccaucggaucuuccagugcuguaagcaagucuuagaagauuguauuucaucuguuaauuucagggucuuuugaaucaugaggcuuuauguugaagaacuugcucugacauccagaaagcccccugguuaauuaaggaaacccuuggcuccuuaagucuggguuugcucucacugccccuuccuugaggcaguggauacugccauggggcccuccagccuggaguggacacauacaugccuggugucggcaaaucuuggcuaucgaggauuucuccgacagacccagaggccacugcagguggauguugugaccaggagugacugugucaggucauuucugugguugcagagcugaggagcuucucaggcaggcaugauggaucugucaagacuccaccuuccagcaggaucaugaaagaccaaggcuguggaaggcuuacaccauugcuuaccuccaucuugucuguagccaugggagugugccagucuccuuugcuuggugccaucuuuguggcagccucagcaucugaaaaucccauuaggcagagcugcugcuuccccuucccuguagagcacucacuaacugguccccaccgcccccucgcccagucugugucucacuugagcuuguggugagccuuucugggagggaggaggcucuuagccugcugcccaggcaggucucugggcaccguuggcucuccugccucgcagagaguuugaagacagccuucuaagacagccuuugucaccuuuguccaguuccccagaucuucuggucuucacaguacuaaagaucgaguggggcuggagagguggcucagcaguuaagagcacugacugcucucccagagguccugaguucaauucccaacaaccacauggugacucacaaccaucugcaaugggaucggaugcccucuucuggugugucugaagcuacaguguacucauguacauaaaauaaauaaaucuuuuaaagaaaauaauaacaaagauugugaauacagcucuucacuacauuuuccuuaaaagggugaauuuuggcuuuuaaaagcugaccuuguccaucuccaccaguaaagacucacuucaguaguagagggugcugugaggagcagagguaucuaucugucaggcuugggggggaggggggggcgggggaggcuuucuuuggaagccuggcuugggugagaccugggacagcugucuguccgugcaauuauggugucugcauuuggggcaagguuuuggcucugacaucuuuugggaggggccuguguuuggagacaagaucuugcuaugaacagacuggccucagaauccugcacaauccugccucaguuucucaagugcugcuaucacaguguguuccaugugugugguuuccuuuuagauggucuguccuguccacuguaaucaauacacacacuuauuuaagaacacuacagccgggcgugguggcgcacgccuuuaaucccagcacuugggaggcagaggcagguggauuucugaguucgaggccagccuggucuacaaagugaguuacaggacagccagggauacacagagaaacccugucucaaaaaagaacacuacagaacugugagacagcaaaccccaaguugccagugcuccggcuccuuaagaguggcaaccuaggagucguugcugcccugcugugauuauugagaagucaagacccaagaaagugacagugcgggggcugugcgagucuggagugacuccuuccuuucccagagucugggcagaggagagggagggaggugacuacauccuccgccuggaucucuuuaauaagagccucugacuugggguuucugccugguccaugauguggaaaugagaugauguggauaaggagccccaggcuaaccugcagagagagagggagagagagagagaggcacuguuggaugggcccagcccucaucucaaccaaacacugcacugagauggacaaacaagccccauccaggcuguggucuuuauccacugucuauccccuccuuccuuucuguucacccucccuccccauagugucucacucuuggcccagggucuccaguucacugauaacccgcugacaucucgcuaggaugaugcuuugcuucaguuucccgggugcugggacucuaggcguccaccuccucuucugacgacuuuaccuugcuuuguugguuagcuuugaauggcagaguaguggugagacguggugccgugcugucggagcugagagccguauuuuaccacugaggaagaaucuacccggugucuguucccuucuccguguuccaaagugaugagcgagauugucuauaaaaggcccugccaaggcucuuuucuuguauagccugucucugugguuauaaccuuuuugaaggcaggcaucgagguuuuguuuuaauaaagucauucuccacugugu

SEQ ID NO: 2297 - RNA, 22176 nt, Mus musculus
acacaguggagaaugacuuuauuaaaacaaaaccucgaugccugccuucaaaaagguuauaaccacagagacaggcuauacaagaaaagagccuuggcagggccuuuuauagacaaucucgcucaucacuuuggaacacggagaagggaacagacaccggguagauucuuccucagugguaaaauacggcucucagcuccgacagcacggcaccacgucucaccacuacucugccauucaaagcuaaccaacaaagcaagguaaagucgucagaagaggagguggacgccuagagucccagcacccgggaaacugaagcaaagcaucauccuagcgagaugucagcggguuaucagugaacuggagacccugggccaagagugagacacuauggggagggagggugaacagaaaggaaggaggggauagacaguggauaaagaccacagccuggauggggcuuguuuguccaucucagugcaguguuugguugagaugagggcugggcccauccaacagugccucucucucucucucccucucucucugcagguuagccuggggcuccuuauccacaucaucucauuuccacaucauggaccaggcagaaaccccaagucagaggcucuuauuaaagagauccaggcggaggauguagucaccucccucccucuccucugcccagacucugggaaaggaaggagucacuccagacucgcacagcccccgcacugucacuuucuugggucuugacuucucaauaaucacagcagggcagcaacgacuccuagguugccacucuuaaggagccggagcacuggcaacuugggguuugcugucucacaguucuguaguguucuuuuuugagacaggguuucucuguguaucccuggcuguccuguaacucacuuuguagaccaggcuggccucgaacucagaaauccaccugccucugccucccaagugcugggauuaaaggcgugcgccaccacgcccggcuguaguguucuuaaauaaguguguguauugauuacaguggacaggacagaccaucuaaaaggaaaccacacacauggaacacacugugauagcagcacuugagaaacugaggcaggauugugcaggauucugaggccagucuguucauagcaagaucuugucuccaaacacaggccccucccaaaagaugucagagccaaaaccuugccccaaaugcagacaccauaauugcacggacagacagcugucccaggucucacccaagccaggcuuccaaagaaagccucccccgccccccccucccccccaagccugacagauagauaccucugcuccucacagcacccucuacuacugaagugagucuuuacugguggagauggacaaggucagcuuuuaaaagccaaaauucacccuuuuaaggaaaauguagugaagagcuguauucacaaucuuuguuauuauuuucuuuaaaagauuuauuuauuuuauguacaugaguacacuguagcuucagacacaccagaagagggcauccgaucccauugcagaugguugugagucaccaugugguuguugggaauugaacucaggaccucugggagagcagucagugcucuuaacugcugagccaccucuccagccccacucgaucuuuaguacugugaagaccagaagaucuggggaacuggacaaaggugacaaaggcugucuuagaaggcugucuucaaacucucugcgaggcaggagagccaacggugcccagagaccugccugggcagcaggcuaagagccuccucccucccagaaaggcucaccacaagcucaagugagacacagacugggcgagggggcgguggggaccaguuagugagugcucuacagggaaggggaagcagcagcucugccuaaugggauuuucagaugcugaggcugccacaaagauggcaccaagcaaaggagacuggcacacucccauggcuacagacaagauggagguaagcaaugguguaagccuuccacagccuuggucuuucaugauccugcuggaagguggagucuugacagauccaucaugccugccugagaagcuccucagcucugcaaccacagaaaugaccugacacagucacuccuggucacaacauccaccugcaguggccucugggucugucggagaaauccucgauagccaagauuugccgacaccaggcauguauguguccacuccaggcuggagggccccauggcaguauccacugccucaaggaaggggcagugagagcaaacccagacuuaaggagccaaggguuuccuuaauuaaccagggggcuuucuggaugucagagcaaguucuucaacauaaagccucaugauucaaaagacccugaaauuaacagaugaaauacaaucuucuaagacuugcuuacagcacuggaagauccgauggcacccaaggaucagaccaaggaguuggcaccugguugcuaauguccacauggcucaacacgccucucacugagccugcucaggcccccggcagucugugcgcuguacaugagaaccugcgggucagccugcugcccaguuucuagccauacuuucauggucccgauuuucuuggaaaacugcaaggcuguccuuccucugccuguucugaggacaccacggcuuucuucacugcuucacagcucucaggaagcacgccacagccgggacaaccagucgucaagagggcuggggccaaguuugagaccaaagagcugaaaagucugagagcugguguccuaacacaggccugaaauacccagaguuugaggccagauagagcuguaggauacaaggcccuccugucucagagggaagacacuggaggggcacagcacacuuuccaguuccgugaacagcgggcaggagcaggagcucggcagccacacagccccacucaccacagcccacgcagucugcugacucggccugggacgaggcaucccgggagcaaagucucuccauucccaggcuuauuuucuucuuugccguaauuugugucuagggaaugcuuuuccauacucucucucuccaauuuucucuguugcuccagggauauuuaaauuauaaucuguggugacauaaggaacugacccuucgggcccaggcugaaauggaaacacaaagaagcagcauagagacccugucuaaacggaguguggcauucaagucccauaauaaacaaagugucugucuccagggcacugacugcucuuccagaggaccaggguucaauucccaggaugcccauaggaacucacaacuaauugucggucuguaacuccaagacaugacacccuuacauagacauagacacauacacagacacacacacacacacacaggcaaaaggcaaaacaccagugcacauaaaauggaaauaaaaaaaaaaaaaaaaaaagaaaaagaaaaaaaaaaaaaaaaagguguaugucuuccaaggacccauugccuugagcgcugacggcgucagcuuggccucaccugcccagacucccugcagaccccuuccacggggacucaccugguucugaaaaauacaaugugggauggaaauggaaccaaccagcagacaguucacaguuuuuaacucuucuggggguagaggggugaggaugugguagguccgcuuguccaugucaaugccucugcagauaccuucaagauacagagcagggucagccauucugcaaagcugcacacggcaaccgcagggaagugaaggugacauuaagaguuuuauuaauuuuuuucuuaaagauuuuauuaagccggguguaguagcacacaccuuuaaucccagcacuugggaggcagaagcaggcgggcggauuucugaguuugaggccagccuggucuacaaagugaguuccaggacagccaagguuauacagagaaaccuugucucaaaaaauaaaacaagggggcuggugagauggcucaguggguaagagcacccgacugcucuuccgaagguccagaguucaaaucccagcaaccacaugguggcucacaaccaucuguaacaagaucugacgcccucuucuggagugucugaagacagcuacaguguacuuacauauaauaaauaaauaaaucuuuuaaaacaaacaaacaaacaaacaaacaaaaaacaaaaaaaaagauuuuauuuauuuuauauacaugaugaguacacuguagcugucuauagaggacauuggauuccauuacagauggcugugagccaccaugugguugcugggaauugaacucaggaccucuggaagagcaaucagugcucuuaaucacugagccaucucuccaguccuacauuaagaguuuuaauuccgaauuuuggggcucagcaguuaagcacauuugcuuaacuccaaaggaccuacgguccaucucuaggacccagaugcugacucacaacuguacucccaugggucugaugcccacaucuggccuuugagagcagcuggcagacaggcacgcgaccccaacaggaggaauaaaugaaggaguuuucccuuccaguguuuuacacagaauauaaugugcagcuguggggcugacgagguagcccgacaggggcagagcgcuugguauuccucccaagcucagcucccagcaccaaucucaggcacucacaaccaagcgcuaucuaugccagcacugggaccaacaccucuauucuaaaggcuucucaacucacgggaacacacccacagaauuaaaaauuauuauuuuuuuugagacagggucuacauagcccuuguccaagaacuugcuaacuugauaauacuguccucaaacaagagacccacuugccugugccuccugaagucagccacgaugccuagcuaaaaauaaguuuuaagaaagugccaccgggcaugguggugcaugccuuuaauuccagcacuugggaggcagaggcaggugaauuucugaguucgaggccagccugcucuacaaagugaguuccaggauagccagggcuauauagagaaacccugucuugaaaaaaaaacaagaaaaaaaaaaaaaaguaccauucaaaguauuugaaaguuccauguucagccaugaggacugaaacaggcuaacagagcgugauggugguauaaaaccaugccaucuaugucuggcaccaaauguuaauacaacauacagucagggacugcugucuccagugaagaggacagggcaggaggcauuguuuacuguucacucaccaaagcccaaacagucacauaugggguucugggcaagcaggauggggccccgaguguagccuuucauaucauccacgauccugcaaaggccgacccagcuggcauucacagcauacaguauguggguaggcgcaacgucggcaugcaagacccggauagcgacggcacugaaggggaccuggagaauaaaccguaaacaugcaccucucauuaacuucuacuuugagacguguguuccugagaccucaaacggacaauguacugccuuaggcuccuaaacaaugaacuaauaggcguggaucccaacggcugacuuaaaagacucuuuaggcuuguauaugugcuugugugugcucacuuguguaguuauaagucaguguggguacugccacuucccccacuucuagguugucuggacuuucuggacuugcaggguucuuuugcagauagucuuacucuguagcccaggcuugccugggacucaguauguagaccagccugccucagaacagggcaucacaccaggucccccguuuucuucugggaaaaaagguggauuagaaaacacugaaccugaagcuugccucggcugccucucuuucauuuaccuucccaggugcugagcuuguaggcauguaucaucccacccggccgaaaccuaggguagggauuggcucagaugacggaguccuggccuacaaugcaggaagcccuggguguggugguauaugaugacugucauggcacauggcaggcaaaggcaggaggacuugaaguucaaggcagccuggcuacauuucucuucuuccuguacuccugucugaaucauuuucuuucuuuuuuuugguuuuuugagaggguuucucuguguagcccuggcuguccuggaacucacucuguagaccaggcuggccucgaacucagaaaucugccugccucugccucccaaguacugggauuaaaggaaugcgccacuaugcccggccuggaucauuuucauuccuuucucugcccauugaaaaaccuaacaaaagcacugguaagaucagcauuagguggcagcuguaggcuuucaggacaguucuugguagauggauuaugaggucagucacgggggcccugaggguccagacagccucuggucagcuuuucucggugccugcagcaucuacuagcugugcuuugcugcauuaagaccuugcuuucacgguuuccuucuuuuagaagcaaacccaucacucucaugcuacgucauaagcuagaacacgagcugcaagucaguguagucaauucuacaauuugguguccuaaaaaagaaaggaaggaaggaaggaaggaagggagggagggagggagggagggagagagggugggccaggcagugguggcacaagccuuuaaucccagcacucgggaggcagaggcaggcagauuucugagcuccaggccagccuggucuacaaagugaguuccuggacagccagggccacacagagaaacccugucuggaaaaaccaaaaaacaaacaaacaaaccacagaacuauuuuaagaguaugcuuuuuguuuuaaucccaggcaggcuuaugguguggcuuacaccugcccaaagcagccgacuaugauucccucacgcccuggcaaaggaugcuuuugccagccacagacaguuugugcaagugcgacugugugaccuuuggaauucugggaacuuuucagagcuagggcccugagaggugggguuggauguggucuguuaguagucuuguucaaagaaacaagaaaaaauuagacucaaggaucucugucuuccccaucccuuauccuucuuucucuccuaucuaaugacaggagggaaaaccggcggcacagggagaacccacaaagcagcaaagccuagcaccaggccacucggccccgcagaagaacaagagcagaaagcaagcaggagaggcucuagggcucagccaccucccaccucccuucccacaggcacaaacacaaagugacuuguuuguuuguuauauccagguaaucauaauaaucauaaguccccuggugccgggcgugguggcacaggccuuuaaucccagcacuugggaggcagaggcaggcggauuucugaguucgaggccaaccuggucuacagagcgaguuccaggacagccagggcuacacagagaaacccugucucaaaaaacaaaacaaagcauaaguuccgggggcuggagagauggcucagagguuaagagcacugacugcucuuccagagguccugaguucaauccccagcaaccacauggugacucacaaccaucuguaaugggaucuggugcccucuuuuggugugucugaagaaagcaauggugguguacugguauguauaaaauaaaugaauaaaucuaaaaaacaaaaacaaaauacauuaaguuccccuguauaaugcacaaggaacucaacaguagagaucuauggugacacuguucgcuuugucuucaaagcaaauacuuauugguuuagaaacaaaaugcugaugcagugugugugugucugucugcugauaguuugaaggagaacggccccuacaggcucauaagccugaaugcuugguccccagaugguggaacuguuuuggaaggauuaggaggugugcugcuggggaugggcuuugagguguuaagacuugcauaauucccagugaaugugaaucaagaugcagggucucuugcuuuuccacccugccuuugcugugccaccagacucuaagccucucaaacagugagcccgagcaauuaaccuguuuaagcugccuugggcaguguuuugacacaggaauggcaaaguaaccugagacucugugugugugugugugcaugcucgugcgcgcacgcgcacacacacgugugcaccugugcacccaugcaugugaaacuuagccugagugucaucccacaacauaguaaggcucuggguucaaucuccaaacacauacuacuucuaucacuugacaccauguccacacccuagauccucacacaauagcggguuucccccaaagcaauuccuagcagccuggacucugcauuugguguuggaaccuaacaagaauaacuaaguccacaggaggugcucuugguuccagguacugccaggaaggcucacagaguccuauagcaucagaaacaaccuaagaugucagauacuacucucaugcaguugguaagugcaaacguggggcagccaccagaucagauaacuuacagcugucaugaaacuacaauacaugacagacacugaggcuugccugccaaggacaaaugccaguucugcaucuucuuccaggcaacccagccucacuguuccuuagucuccccaugugaaaaauggggacaguaucagaaccacagggcuguuuugagaauuaggcaagcaaagaguuaaacaggagcagaccaggacuuggaagccucaagaaucuuaucaguaucagauaauucugcccaccagcuccgauuaccugauagggcgucaggcugugcaaaggacuaagugacucuggcacgggaagcaucagcuggcuaagguagcccaacacugccagaucucgaaaaauccuguuguauuuggcccugaaaagcagagcagagcacagugaguagaguaucgcagcagucacgcccgccaccaucacagagaugacagcgcagcaugacacaacagcauaacagcgacaacagagcacuccgguaacacuagauagacuuugcucuuucaggauguucccaagcccccugguuaaauggccuguacagcgcacgugguuaggguuaguguugaucuccaucugaaacccugccuugaccaccaggaaucccaaagacuccuagcacagaccagcagcaccagaagcccugccucugugugcucaccagcacccacucuccuuuaaauguauagccaugguaaaccugcaaucuuaacaggaguauucucuuuucguuuauaggguuugacaauguacuguaggcugaacccaugaugcccaucucugccuuccugguguugggaugaccuacaagagccaccaugaccaccucgggacucacccccaagcaaagcagcaagcccaguacaggauggcuuugcuuacaagcgguucuguacuuaccuguucuuuucauuuuuacuacuuaagaauucggagugaacagacagcaguacauguccagugaagacuggaaguggacuagacucuuucucuucauaaguaaauucuaaauugucuccaaauucuggaauuucaaaaccucgauaucuuuugaucuugcuuuuuguauacaggccaucugugagcucuacguauucggaggucagugucgguguaaauuuacagcgaucagaauauaacugaacgacauaauugggagacagcacccggaucagguccacaagcagccgcagcccauuaucugugaggggagaggccacaggcacagguaaagcccucuagagaagccauggacaggcagcauaugcacagcugacaagaucugccacccucuucuggcacccaagggcaccacauacaguguuugacagaauagaaaaaucaaugaaaaaaaacaaccaacaagagccaggcaguguggcaggcggugguggcgcgcgccuuuaaucccagcacuugggaggcagaggcaggcggauuucugaguuugaggccauccuggucuacagagcaaguuccaggacagccagagcuacacagagaaacccuguauccaaaauccaaaaccaaccaacgaagcaaagugaaauauguaaaaauaacaauggguuuuccuucuggcccauuccuggaaugauagcucauuauugauuacuaaacgucuuggccauggcuuuggcucauucagugacuggcuccuaacuuaccuaauccauccacacuguuaucuccucugccugcuuaguucccuuuccuucuuccuuagugucuuacucagcaucucccuccaaucuauuucauucuuacuacuucccagaauucccucuucuugccaguguucaaccuucuauguccugccucagcucauuggccacuggcuugguuuuuuuguuguuauuguuguuuuuuuuuuuucgagacaggguuucucuguuucgccuuggcuguccuggaacucacuuuguagaccaggcuggccucgaacucaaaaauccgccugccucugccuccugagugcugggauuaaaggugugugcuaccaggcccggcuggcuuguuuauuaacagguacuguuuauauaagagauucucagagcuguggcucgagugccggagcuccuggguuugaugcucagcagcacauaagaaggacagccaugaugaaugccgguaugcucugcauuggaacauccagggcuguucucagcuacaagcuacccaugcucccccucacccgagcaccccaugucaucgugugugggugcagugcucauggcagcugcacaugugugcaggucuuaccugacacccagcccaucguguugaugauaaguggaaacucucucuuguaaucucugaacacguauuuuacuaugucaauguaauucucguagucauuguaacaguucaucuucccauaguacaccauccucugugguuuccucuggugaguguacggcgguccuaggaaaugaacacaggagcagugaguccccaagcacucgccuaagacagagcaacgcucgagggccguguucuucaucugcccagugcuacgacccuuuauuacaguucaccuuggaagggacccucaaccacaaaacuuuuucguuuuuguuuuuucaagacaggguuucucuguguagcccuggcuguccuggaacucacucuguagaccaggcuggccuugaacucagaaauccaccugccucugccucucaagugcugggauuaaagguaugcgccaccacugcccggccauaaaacuauuuuuguugcuucuuuauaacugcaauacugcuauugucauuaaucaugauguaaguaucuaauaugcagcauugugggcgaucacuauccacggguugagaaccacuacucuuagggguuccaucuacagcacugccaagcaaaaguagcugugucauggccacaaggcaguggccaggauucugugucccugccaaaccugccaaagacaucaggaauucucaaaccaucaaacaugacuccaugcaugugaguaaauuccaaucauguucugguauggcucuauuuguucuggguacuugggauacaacuaugaaccucuauaccuuucauggcuuacagucuguugaaaauuuaauuuauagccggguuggcccaugccuuuaaucccagcacuugggaggcagaggcagguggauuucugaguucgaggccagccuggucuacagagugagcuccaggacagccagggcuauacagagaaacccugucucgaaaaaucaaaaaacaaacaaauaaacacaaaaacaaaaaaauuuaauuuaugacccuugcugaguggugguauguacuuuuauuuugaaagauuuacuuauuuauauguguacacugucgcugucuucagacacaccaguagagagcaucagauuccauuacagaucuuugugacccaccauguaguugcugggaauugaacuuaggaccucuggaagagcagucagcacucuuagcagcugagccaucucucuagccccuugguaccuacuuuuaaucccagcguuugggaggcaaagcaacucugugacuuccaagacagcaaguuccaggcaggccagagauauagugacaaccccaaacccaaaggaaaagaccaaaagaaaaaagccagaguuuggccucaguggaaggaacagauccacuacucucacuaaggagcugaguuugguucccaauauccaggagguuaauaaucaggcuggagagacggcucagcaguuaagaccauugacuguucucacgaaggucccgaguucaaaucccagcaaccacaugguggcucauaaccauccguaaugauaucugaugcccucuucuggugugucugaagacagcuacaguguacuuagauauaauaauaauaaaaaaucaguggugucacaugccuuuaaucccagcacuugggaggcagaggcagggaaagagaucuacagacacagagaucugauggcacagacuguugaauaaagcuaacggccagugcucagaucccagaaccuacauggugagaagaucugacucuaacaaucugucauuagauuuccauguaugccaagacgcuugcaccuaacucccauucaaaauaagcaaguaugggcuggagagacggcucagagguuaagagcacugguuguucucccagaggucccgaguucaauucccaggaaccccaugguggcucaugaccaucuguaaugggaucugaugcccucuuuugguuugucugaauauaguuacaguguacucauauauauauauauauacauauacacauauacauauauauauacacacacaaaauuuuauauauaaauuauauauauguguguguauguauauauauguguauacacacacauauauaaaaauaaaucuuaaaaaaaaaagcaaagcaaauauaaaauuuaaaaaacaaaauggugugcuggccauggugguaaacacuuuaauccuagcacucaggagacagaggcaggugggucucugugagguccaggacagucaggguacacacauagagaaaccuugccccaaaacaauuaaaaaauaaaagaauaaaagaauccagggacaaaaaaauaaaauaaaauccagggacuuagccaggcuguguuggcacaggccuuuaaucccaacacuccggaggcacucaggcagaucucuaaauucaaggucagccuggucaaaggaguggccaacaggcacugacaaugugaauccucaggagaugauauucaagugucagcagucaugagaacacaaaccaaaaccccaaacccugcuucacaccugcccgagggucuauaaucaagauaauaccauuggcaagaaccaagagaauuaguuaauguuacugugcacuguugcuggcagcagacuuucauguuaccuagcaaccacacaucucuaggcacacacuacugcccugaaagcugggucucaacugugugcuugcccucugugcuuauggcagugauguuccacggcgggcggacuucugacucaguggggaaggugcugcccaugcacucgcacccaguacugcaggagaaugggauggggaggugagcacagccuaaaagcuugcaggccagcucgucugggauaugcgguccaguagcagaaaaccaagagauccugccucugcagccggaagcagaaacucuucaaaggcucucauuuccacacaugcgccauggaacauguacacagguuggugcaaccccaaacauucaauagcuggacaggcaaacacauucuguaaacauguaacaggacacucggccacacggaggaaccugaggugguuuuuauccgucaagcugccuucucggagaugacgucugacacagucucuaaccuaguccacagugaacagccagacugaguggggacagaacugaacagcaacuaagagagugaaagagauggggagcuggcucagcagcugagagcacugguuggucuuccagaggcucuggguucaauuccuagcacccacauggcagcucacaagugucuguaacuccuguuacaggggauccaacacuuuccuaaagacauacaugcaggcaaaacaccaaugcacagaaaauuuuaaaaaaguaauaaauuagagagagaaacagagacagagagagagacagaaacagacagacaggguggggaggaggagaugacugcaaagagaacugcuucacugggagauaauaaaaaauucuggggccaggcuaugcaggccuucaccugggaggcagaggcagcgggagcucugugagaucaaggccagccuggucuacacagugaaauccaggacagccaggccuacauggagaaaccccgucucaaaaaagccagccagccaggcauauggcuaucuggaugcagaagcgagacaacuccacacccaggggcagcugaagacaaaacaaaacaaagcagaaauucuacuugcagucugaaccaggaaaaggauguuauaggauaacugguggaggcagaagaagcgucuguagccuguucaguaguacugggucagacacacaggcuaccugggaugcugucagggugacauguugcaggacccaacuuacgucucccugcaacuucaguuucaaaggacccagcaccccagagucgcagacacguaaaacaccaugcacauaaauauagucaaaaaaaucugauauaaaguauugcucaaguuugcuguggaagcuagaggcagagugauucacuuugcacauuuuuccuuuuauagagaacauugugagagcccgagacacugaggagcguguauuacguacccagaagugguucugugaugguaaguaaagcgacacagccaggaggagugaacuccgucugccccagaucacauuccagauagucaaccccaggaaugcugaaaauugugagagagagagagagaaagagaucugaggcagccuucuuuguggaaaauucgugacacacaaggaucaucaccccguguggccuuguagcuguccuacuccacaaggugagggccacggugcaggcaagacccugugccaauugcaacacacacgguauucuauaaacuaacacagggcuggcucagggacggagagcaggugccucugcugcagaucagcaucagcaugggagugaggcaggggacugcccugcagaaugccauggcccagcugacagcagugaguuaaacaaauccccaacuucagucuguccaucaagcugggcaugguggcuuaugccuauaaucauagcacuggggaggcugaggcaggagaaucaccaaggccaaauuggucuagagagugaggccacaccuuagaagaucaaacaaaagcaaguuucuccauuugaaucucacuucaugcccagaugaccaaugaaaacacaagcgagcuuaccuauuuaauaacugguuaaucaguauucuauugaacguugacuuuccaaugucacaagcgccacacaacaggaugacagggcagccaucuacuuuugcagguaaaacaaacagugagcccuggugugagccaguccucaggacucuaguccugagcagugacugaggcuucggggacacaggcaucuacaacaggcaaaacucaccacaggacacgcugacuaacucuuccagggcacaaaggccacucucacucaagcaaauggcuuucuuccucuucugucuucugaugccaauuuucuucaaaguuguaaacucagaauugacccgaacaggagcguucugaaauauaacaacugaaacuguaaggaaaguuucuaaugaauauacauuuauuugcuucuacauuaauaagcaucauauagucaugaguuacaaacuuucucucucucucucucucucucuuuuugggggggcaggguuucucuguauagcccuggcuguccuggaacucacuuuguagaccaggcuggccucgaacucagaaauccgccugccucugccucccaaguguugggauuaaaggcgugcgccaccagguccagcuuuuuuuuuuuuuuaagauuuauuuauuauaucuaaguauacuguagcugucaucagacacaccaggagagggcgucagaucucauuacagauggucgugagccacauguugcuuagauuugaacucuggaccucuggaagagcucucagugcuccuaaccgcugagcccucuccagccucauuuaaaacauuuuucauggugucuaacaccuccauacagagcagucuuaaacucugagccaucucuacagccccaaaauuucucuuaauaccccaaaauucaacccucaccacacaucccuccaccaacauccugcuccuucucaugugcaagccccucuccauggcucaggcuaccccugccugccucuccacggcucacacugcucaggcugccccugccugccucucuccagggcucacacugcucaggcugccccugccugccucucuccaggucucacacugcucaggcugccccugccugccucucuccacggcuuacauuacucaggcugccccugccaaggcaggcaaggaaauguagggaaagcucagcggaggccacaaaucgcaaaacagaccccagggcagacacuaaugaggcucaagaguaaagggcauugugcagcauuccacugaagccugcuggacggaaggaagguagacagaaacuacaaagggcaggugcuugcugacggggaggcacggucaaagagaagggaagaagggaccucccacaaacacaucucaugcaaucagcaguucagugccaucauggaggcuuuccugccaccuuccugggugccucccauggcuaggguucccucacucuggggaggaugaaaauguaaccaagaguggacaagauggccuagugccuaagagugauuacugauucugcagaaggucccuagcacccaugucagacagcuaacaaucaacugugcuccgcuucagggaaucugauguuaucuucuggccuucugaaaauauguggcauucacagacaaagaaaugaaaagaauaaacaaaaaacucuucagaauacaaucacacaaagggcuagggagauggagcagugguuaaaacucuaguuauuaggaccagaguucaaauccccaguguccaugaagagcuaaggagaugugggaugcagagacaggaacccuggagaaaagcugguuagcuagaagagcuguaagugaagggcccagcuucaacaagagacacuguaaaaggacuaagugggacggccugagggucaccuccacaccaaguucacaccacacaggcucauccaaccccacacacaaauauaaagagguaaauaacaauuuaaccacaagagccaccuuaguaggaucucuaucuguaauccuagaacuucaggaggcaagaggaauacaauuugaggccugauggacaagguacauaguaacauugucuccaaaacaacaauaacaaugaaaaguguguauguguauagagagguggcccagagguuaggagacuuuuagcucugucccaagcauccaugccgaguggcuugugaccuucuguaacuucagcuccagggggauggaucccacaccuguccuccagaggcuccacacacauccgcauacacccacauaaucacacacugaaacaacagucccagaagcacauccuugaccaacccaaccgcuucauuucacucccuucccacagcaacucuaagccugacgcucucggcucccacaccagcagcgccuugguuccuuuucacaguacucaggguacucagggaccaugagaggauuccagugugugcucuugucucucuccucguucguccugggugugugcgugugcguguguguggcaggggguggguguuguugcacacuuguacucuuugcacgaaaagauugaauguuuuuugagacaaggucucucuguagucuagccugcccaaagcugaccagacuggccuugaauucacaagagauccuccugagcacugggauuaaaggugugugccaccacaccaagcugagcauuagcauuucaaagguucggggagaagagccaaacgacaacaauaacaacacaacccaaaaccaaccaaacaacaaagggaagagaaacuucauacaaggccacccuggguagcauuaaucccaacacuagggugguagagacccuagaguuaaaggcuagccuagucuacagaguggaguuccaggacagucaaagcuacauagagaaaccaaaucucaaacaaaaacaaaacaaacagcuaaaaaauuaaugaacuaaaaaaaagaaagaaaagagagagagaagaggcucugucuguccuuacaaaggaaggacugggguuugacucucagcgccuccugggggcacgcgggagacagcugcacagauccaggcaauacgagcgcgcacgcacgcacgcgcacgcacgcgcacacacgcacacacacacgcacacacacacacacacacacacacacacucagaauaauacauuaaaaaaaauuuaauuagagccuguuggugguaaaccacaucuuuaaucccaggccuugggagacagaggcaggaggaucucuuugaguucaaggccagcuggaucuacagaacuaguucuaggacugccagggcuacacauagaaacccugucucuaacuaacuaacuagauaaaugacagcuaaaauaaaaauaaaaacacuacuuaaacaaaucaaacgccugguaacccaggaccugggaggugcacagacaagcugugauucagccguccauucagcccgaccagcuggcagcuucaggccagccagagacugucucaacagauagcugcggaggaccagaaguaaggugucacacaugaaugaacacacgcacacacacacacacacacaacucuuuguuccucccaaggcgucagggucugggacaggcccaggggcauccccucagcaccuucaccucucccuccucuucucuccuuucaucccacgcccggugugcaggugcauuguuucagguuccccuucacaacaguacugcugagcucuggcuccuuugcgcuuagcccugagccuccgcuucacugccuucguuccuuuugagccguucaguuucucucuugaccacaucgugaggccacccucauccucugcaugggacuuucucagaccaccuuagaccacaaugcccccaacccuggccauuccucagguucuuaugugucuucuguaccuuaacuuccucugaagugacacugcccagaccucacauccucuccucucaaguuacaccagcgugcuuaugcgcgcgugcucucucucugcucauuuguguucucagacacccucucuguugcagcucccaaaugcacaguccuacccuucuaaccgcacucccacgaugccuaucgacccgugagaccggaugucucuuauucuucacggaagaguugaguucuacugggcaaugaaaccaagcaagcagagggaacagggaucaccguuguguaagcgucuaugccagugugucccucgccucacaagugaggauggcacccacaucagucaggcuguucagcaagugccuuuacccauacuacaucucucuauagauuaucuccugcuaacacaugggauucucugaacacacaccucacucacacgacagaggggaugaucacugugacagggggucccuacacagccauuguaggugaggggugacugcucuggcacaaagcaucaaggaacacuggcuuuaccuccugcaggagcacguaugaggagcacuuauaggucuucaggaaguccacaaaacgagacugcauccguuccagaaucauaauggagcccagaggagggaaguaccgcaccacccaguuucugucaucugccaaagaagagcaagacaccucagcaacagugacaauucuagagccugcagggucuugucccaacugcuaagcucuagguugucacuggucaccgguacaccuggguggagacaggccaucgaagugugccaccuaccagcuucaacucucauaacguaagacaccccccaugaggaaucagcgcaacguccagcccauaauaagccuucgucaucagccuugacaucggaagcgggagccaauuaccuaguuucguguaaggcuugagcagggcccggaucucccuccugaucgccuucucacuuuucucggguucugcguacggaaccccauugauggucagguaagaguggguguagacagaaaagacaucuuggggaggcugcccuugguugaugauauggccguauacuuccaacuggccguagacgcaagucacacggcagaucccacugaaagugaaacccuagugugaaaagaaaaaaaccauuaaacacccuaacuagugauuuaccuaucaaaaggacuuuuccuuuuuuuucuuuuucuuuuucuuuuuuuuuuuugguuuuucgagacaggguuucucuauauagcccuugcugcccuggaacucacucuguagaccaggcuggccuugaacucagaaauucaccugccucugccucccaagugcugggauuaaaggcgugcgccaccaugcccugcucaaaaggauuuuucuuucuugauugagggccuuaagacucuggcugucccagaacuauguagaacacaggacaggcuguucuuccuaucauuaaaauccaaccaucccugcauucagagugcaugucaccagccacaccugacaaggaaacccaaacuacacagcauggagcccgcaacggcugcucauuggguaagggcaguggcugcucuacuggagaucccaggccugguucugcacacccauauggcgauucacauccuucuacgacuaugguuucagaguuuccaaugcucuguaauagaaagcacugcacaugcgcuguguacagaaacgcaggcagaacauacucaaaaaaccaacaaacaaacuacaccguacuaaguagccaacaucugucagguuuguuuuuuguuuuuucucuguauagcccugacuguccuggaacucacucuguagaccaggcuggccucaaacucagaaacccgccugccucugccucccaagugcugggauuaaaggugugcgccaccacgcaucugucagguuuuuaaccuaacccuaaacaaaguaccuccacugcagcucccaacacgcucucacacccgaugcuugggaaggcucacagcgagcuugagucuccaauuccugaggcuucgcuucuugacaugacaggggcaauguccccgaccggaguccacgucagacugccucccuuugccuccuggcucugccuuggcuagugucuaaccucgugcaaguuacuuauuuugucuuucggcccaucgacacgggaaagacauggcagcggucacucccgugagaggagggggcuuuaaaugguuucgaacaccuggaucgcuggcgguuuaagugccacuaaguccgaccccauuagcuugcuaggaguagaggcuccggagcaggaggacgaggacgggcuugcauccgaccugcauccggaggcucaccggcagcgccccgcugaccacucaccucucccggcggcagcaucaucaacacgcggcccgagcccaggucccgcacgggcugggugacguucggggacaccuuccgcacggggcgcccggcccggcucuggggcguggagugguugcggggguugagcaggcugcaggucgcggacgcggugcauggcgcgggcgggacgcucggugugggcgggcugcggggcgccggccggcugcgggcccggaguuugcacuuuaccgccacgugcgcgcccgcgggggcgaccugcuuccaguccccgccuaacgcgugugcccgcagcagccgccgucgcaggcgucgcagcucgacucgggucaggaccccaaaccgacggcggccccggcggcugaggaggagguggggccgggcuuugcguacccgcagccaggaagagcggcucggagcccgccgguguaacaccuccgacuccgccaugcuugucccggaaccccuccggcgggacgaucucg

SEQ ID NO: 2298 - RNA, 993 nt, Mus musculus
augugaccagaaaggcuccugacagacgcugucccuccucagcaccgccugagugcccggcccaaccccugccauggggugcugcuauagcagcaaaaaugaagacucggaccaggaucgggaggagaggaagcuguugcuggaccccaguagcaccccuaccaaagcccucaauggagccaagcccaacuaccauagccuaccuucagcucccacagaugaguaggcccugcuuuccuccauccuugccaagacagcuagcaacaucauugaugugucugccgcagacucccagggcauggaacagcaugaguacacggaccgagcaaggcaguacaguacccgcuuggcugugcuuagcagcagucugacccauuggaagaagcugccaccgcugccaucucucaccagccagccccaccaagugcuggccagcgagccuauccccuucucugacuugcagcaggucucuaagauagcugcauaugccuauagugcacuuucucagaucugcguggacgagaaagaagagcugguuguacaguuugggaucccaugaagagaggggcccuaggacagcucuucccucgucuucaccccgucuccaccccaccucuucugacccccagccucacuguggcuuucuuuuuuuuuuuaaauuaauuuauuuauuauauguguguacacuguagcuaucuucagacacuccagaagagggcaucagauuuuuguuacggaugguugugagucaccaugugguugcugggauuugaacucaggaccuuuggaauagcagucggugcucuuaaccacugagccaucucaccagccccucacuguggcuuucuacaguaccuaaccugcuacuaaucaaggagaagaaugugaagggaaagaauaaggcuggaggccagagcaagugaggacuaagcaagggaagggaggaccgacugccaucagccuucaugcucugguuagggugagguuggggcc

SEQ ID NO: 2299 - RNA, 573 nt, Mus musculus
cauggggugcugcuauagcagcaaaaaugaagacucggaccaggaucgggaggagaggaagcuguugcuggaccccaguagcaccccuaccaaagcccucaauggagccaagcccaacuaccauagccuaccuucagcucccacagaugaguaggcccugcuuuccuccauccuugccaagacagcuagcaacaucauugaugugucugccgcagacucccagggcauggaacagcaugaguacacggaccgagcaaggcaguacaguacccgcuuggcugugcuuagcagcagucugacccauuggaagaagcugccaccgcugccaucucucaccagccagccccaccaagugcuggccagcgagccuauccccuucucugacuugcagcaggucucuaagauagcugcauaugccuauagugcacuuucucagaucugcguggacgagaaagaagagcugguuguacaguuugggaucccaugaagagaggggcccuaggacagcucuucccucgucuucaccccgucuccaccccaccucuucugacccccagccucacuguggcuuuc

SEQ ID NO: 2300 - RNA, 3605 nt, Mus musculus
cacagguggaaucuggaguccagagcaaguugaaaaugagaugaacuccgaggaccccggggguugccucuucuugggaagcggagcuacgguuucuuuuucacacccuaaggccggggaaccaggucauuuuuaagucaauggggugcucuagauuuuauggagcacuuaaugugagggguccagcgaccccaguauugguuauggccgcuaggucggagaaagauuggaccuugcagagacaggauuuccgugcccagcuuaaaagcaguugguagaacgaaucuccuuucaaacccuuguuguaucucucugagguccccggcuggaagcucugcagccgcuggggaccuuucgguggccuagggaagagcucgcagauccgugggcgugaaugaagccauagggugcaggagaggaggcgaggccuggccccaaccacucuuccuguccaggaggucaguggcccgcacaucgcgcgaccccaccacagaugggacucuaaggccagaguggcaucccugggggacacugccgacucguucucuccagccccacccugugcagugacaaaggcgggaggagggagaggcgcuggcccgacucaaugggggcggggcggagcagggacgcagcccccuuaaagccuaguggcugauagugagcgcacuucuuuggcgggagcuugggucagacuuugaacuugguuaccggcuucgguuuucucucugccuugcagcaggggcaaggauccuccaccccgagguaacagacccugugcacccuucgcuuuccugcagagcaugaggcugcccagaagaguugaggacgcggcggagcugcgcaagguaggagcgggagauacgaacucguggcagguggggugggcgauggcggucuuucuaacuguggucucagcgccuucucgcucucccgcagaaccuaaagccgcugcuggagaagcgccggcgcgcgcggaucaacgagagccuaagccagcugaagggucucguauugccgcugcugggcgcggaggugagugucugggagcucugaaaacugaaguggagggucuuggggugcccagcgaggcggaugggccugcauggucccggggcuccguggggauccaaagaccugcgugugguccgcgugauggagugguagagaccaccgcgcgacuggagagcauuugggagcaagaacgagguacucagcugcccgguuuauuguggggugucucucuugucugaccuggcgcagacuucccgcucuucgaaguuggagaaggcagacauccuggaaaugacugugcgcuuccuacaggagcagccugcgacccuguacuccucugcagcaccuggugagugaccaugcuacaugcucaucccuugcccuccaguuugcaccguacucaggaccugagccucacaucugcucccugugcgcagggccuuugaauagcuaccucgaggguuaccgagccugucuggcgcgacuggcccgcguacugcccgccugcagcguccuggagcccgcagugagcgcgcgccuacuagagcaccugcgacagaggacugucagugaugacucgcccucacugacgcuaccacccgcuccagcuccagcuccuucuccgccggugccuccuccaggcaguucuggccuuuggaggccaugguagguuccuggauauuucacaggcaccugcugccggcugucagggaccuggaugggcuaccggaccaaggaaguucuccauggcaacugcaucuucucacucacuuugagaacagucuagcuccaacugcccugucaagaaucagauacugugaccuggcugggugaugaaaccuucaaggaagggcucggccagagggugaaauggggccaaaggaaaaagagcaaauaugugcagggugaggagaagcccagacuggaagaaguggugccucggcagggacacaccugcccuacagugggcagcagaccaaagucuggucuugaagcucaccugggccuggugccacaccugcuaggaugggucacuguguuuccagccacgccuggauauacugccagcucagcugggcuugugacgucuuuaugaacagagcaguggcuuggggacuuugaccgugccuccucagagcacugagcagggcaaaggaacagcagggcagucaauccuguucaacuccuccaauccuaggcuucccuucccacugaucuguagaaggggguguggacucucccuuuuaauucucuaaguguuauuucucccccaccgcaggucugguggucuugggaugugaggggagggugagacaagagggaggcuucccuguggcuuuggaggagcagagcacaggcucuggaauggcagggacucuggagaagcagaggcaggaccaccaucagccuugccugcuuucucugguaaaccccucucugaauccaggcagcuggccuaucagaaacuugcucagagguuauuucuaccccacggaagccuggaagcccaucaagacucagggaagggccuucagaucccaggagugggugcuucacagaaagugggaggauuugugagccagggucacuccaaguccauggggauuugcagcgccuagccacaaagcugcuuccaagucugcacugggaaccaggucacuaaagccaggaagacagacugaccagggaagggacagucacuaucugcuuugcuaugcaugucuaugauggaucugggcacugauuuagguaguaggaggugaggaaauuggaggcauucauaagaagaaagacaauaaagaugaagagggaagggggcucccggcagugcugggcugggcccgguugccuagacuguaaacucuugggaggcggggcuggguauagugcuccuguguguaccucugcgguacuggaugcacaguggcugugcaacaaacaggauggauuaaaggagucaugugacuggcucacacuguaucggaccuuggacagccuggccuuugcuuagaucaccacuccaaauuccuagagcagagguucucaaccuuccuaacggggcaacucuuuaauacaguaacucauguuguagugaccuuccccccacccccagccauaaaauuauuuuguugcuacuucacaacuaaaaauugcuguguuaugaauaaugauguaaacaucuguguuuucugauggccucggaugacccuguggaagaaucauacccccacuccaaggggucgcgacccacagguugagaaccacuacccuaggcucacccacauauuuguccaaccaggguacauaugcagucuguuuuguuguucuugguggagcaagaagaggcugagaaaucguuggcccuggcccaaacucacccaagaggcucugggcuucuccuugaauauaaagggacauccuccugucuccacacauaagaacucucaauacuuguuuacacaaugaguuuucagccaucuuugccugaggauugagacccugccucaaagagggaaaaaaaaaaucuggucugccugcuucugcguccugagugcugggauuaaaggcgugugccaccacccgcagcuuga

SEQ ID NO: 2301 - RNA, 1816 nt, Mus musculus
uguuguuuuuuuuuuuuuucaaggcucuuaagauggcucagaggguagauaccuguuguggagccugacaaccugaguuaggaucccuaggacucucucucacaguaggaggggagaauacuaaaaaaaaaaguucucuaccucuacacaugagcaggguaugucaccccaccccaccaaaaaagauaaacaaaauaguuuuuuaaaaaguuuuuucagggcuagucagauggcucagcacauaagggcacuuaccacccaaccugacuucuugugaaggaagugaccugacucccacaagucuacuguagcgaguauaagcaugguccugugcucucagguguucugggcugcauuuauaaccauucuggaauaucugccaucuuccagccacgggcuugacagacgccauagccuaucuaaagaguggaggcucagacgaaugaggaggguuauccggggaguaugagggagaaggagagcgguuucugcaaguaucggaauaacugaauaucagcgcugcuucuggaauguuccagcucccacugacagaauaaagcaagaguggggaaugccaacacucaacaccaaggaggaagaagcaaagccacuucuuagagaacuuaacuguccguggugccggagcagaaagguucguagcaucacaaagccaaggcuguucaugccuguaaucucagaauuuggacgaaugaaugaggcaggagaaugcugagucuaagaccagcuugggguagacagugcucuccaggccagcccuggucuaaggaaugauacugagugagacucugucucaaccacaccaaaucaagacaaagguaaccaaaccaagcaggagagaaagcagcaggcggcuuuaaagucagaugagcaagcagagacacugacuuuagcuugaccaaucagcaugguguguuuccuugaaggguuguaagucaaagcugggcuuuuccggaguccgaguaacaaaacuggaugguguggucacaguucaggauccugcaggauauauaacuuucuaggaacacaaggggucaugucaaugagcuguacaccuagggaagaagauccucaauacgcacacgaggcugaugagcaucauuaaggcgccaaacgcugcugaaccggacccugcacucaccagaucugggugguccauaaagcuggcugaggcuuuuuggaacuggggagcuagcaggcuccagcuugaacuuaaggucucaagcuggagcgugcuccugggggcagaaggaaggcuagucacaugguuggcaagaucuuccaugcugggcguuuuccauaggaugaagaaauaugguauuauaacucacuauaacucaccaccaccaccaccaccuuuuuuuuuuuuuuuuuuuuuuuuuuuuuggagggggauagcaaugaaccuuggcuggccuggauggaacucgcuguuguagauacugugauaccaacccaggcuggucucaaaccagguacauucuugaggcguccuccugacucugccuccugagaggugggauuaaaggcgagagccaccaggccuggcugacaucggggauccuaaacuucucugugaucaaaaagggauugccccaguucuccuuaagauacuuuguucgauucuuauccggccagguggugauuuguuuagggaacguccgucuuaguucuucaagacuuccaaaaguagagcugaccccuuuauuucucuuugggcucguccagucucccugagucauucgcagugggacagcccgucugacuccucccuuucccgacagccgacuucgcccug

SEQ ID NO: 2302 - RNA, 3126 nt, Mus musculus
ucccuuuuucaggagacaagaugugggcugggcauagaaaggggguggggagagagcaagauaggagggccuggauucagaaauuguggaucagggagggagaagggguuguguuggacucacuguuuggggucuccaccagccauggcugugcucucaacaggaaaaggggggcugagcagagagaacccucuuugcuccaaccuggguguggcaucugaagugcuuugcaugugucucuugagguucccaagugcucuguuacacagucaugcccagggucggaccuuuacacccaugaaggacggugccaagguccaacugucauccugauuuuacagccucugugugcuuugguugcucucagaccucaggaugacugagauuggcuggggagcucugugagagguuuacaggucugucucuccuuccugaaugggguguggcccaccuccuuaucaccggacucuucuuuaaaaacaggaucucacuagguggccuggaauuuagcauacagaccagcugaccucaaacucagaggccgggcuggcuaccuuugguguggucccucucccugugguucugggucaauuuucccuucuucucuuucauaugacauugcucugugggggaugcuuuucgaauccacuugcaguguuuccuccucacugucuucucugagaggcgggauguuuuuaugaugugcagccagcagaggaggaggcccaguggaggaaguauggggacagcugguucagguucugccaggacucagacucaucuuguacuccacuguggugugccggcauggcugugggggugacccaggauaugcuggcuuuauugggaagaggcagggcaggggagaagagaggagggcuugggggucggggcugcagguuaggguccucucucccuguggguagacaucuugccuaugcuuugguagauggauggagaaaagggaccucuagccugagcuccacgcugccugcuggguuccagcucugcccacugcccuccuacccagcucuggagugugucuuggcugaguccuguccaggccaggcuuucggcuuuagcaagccccgccccuuauccgugcuuugcacaggcuguugcugcuucugcuagacaucucaguccgcuggaggcgccuucccaccucccucgugcccucuucucccucuggcucuaagcugcgcuggccacuucugccccccucuugcacuaccccggguauggcagugucuucuucccaguuagaggcucugagcagcuaccaggcaacaguugucuacccaugacccaguggaaaaacgucugcuuccccgucagcaucaucagcauuugaggguugcugcucuugccugggugugguccacuuguaucgggaguaaagggcaucugugguucugaaugcagacugaucuggucugaguucccugccaggacacacggugaucaacugguucucccuaguuaccccagucucugagcacgacuauccacaccagccucugugugcacaaucucccugguuucucucaccacugugcaguugagagaguuuaaguucaggugguuacaaugacuugaacauaucccagacuagcaaggauccaugggcaggccauucagguugcagcugcugucuguggugcugaaguguauggugugcucucucucucucucucucucucucucucucucucucucucucucucucucucucucucucucucuguaucucuuggacaugaucuugaagagcuggcuggucucuguuaccuugggggaagggacuguccccaucugaauuccacugggaacuguggcugugggguuccauguuaccgacaggugugggagcugggaguugccccuuggguccagggcagagucaguauucugagaaagcaaggagaccuugucagcgugcugacuuggugaucgauuagcaggugacaggugcagucuucuaugagggagacugagcugagcuuccgggagagccuaagagagccuaugggugggguugucccagccggacugcagggaagaccucagcgacaauaauugauuggugacauguccaaccucagcuaauugaugggauguugcuucauuggaaguucucuacugggacaggcaagaaaaugguucaggguccccccaagauuguugccccuucuuccccuucaucuccuuucuuucucuccugcuucccucuccugacugucuuucauagcuuagucuucaugucuccagcuuucucuaucucuucucacaccugucguugcuuaccugaaaaauaucucacagcaaucacaagggggacaagucccgaacugguaaucguagugacggcgccagccugccccugcagaccccagugggagaggacagggcucugcuguucucuugccuccaaacugggcaaaccauuuccuuccagggacgguaucuugcugguggguaugcuaugacuguaaacacccucaucuccauauaaaugggccauuuucugccuguacagacaggaaacacaauccagucaauuuuaagagcugccugauuuaccuuuuucuaugguugagguggaguggccagccuggagacaggcuuguaccguggcugcucuggagagcugguccuccgugcauucaccccauccacgggugcaguacagggugcaggguagacgggucggcuccugucuggaacuuuccuuggcuauuuggcuuuggucaucauggccucuaccaggaguucuugggguacaguggcauuauauuucccaaauccacucugacccaaacagaagcugacaccugccuggagaagucugguuccucuguggaucaucucaccaucugccacucaccucugcuugugcuccuucaccagugcacaaugggugaagaaaguugguggccgaguaacuuaaccaggccuugcugccccaggucuucggcauucugggguguccugcgcccucaccgcuccccuugucuuuuccaggggagcaaugacgagaugucagacaacgaggaggaccuggaagagaagucagagagcgaagguagcgacuacucccccaccaagaagaagaagaagaaacug

SEQ ID NO: 2303 - RNA, 3731 nt, Mus musculus
gaaagguuuauugggggaaauaaauaggauaagacugcaagcugggccaugagcauccugggugguggccucugguauuguaaccaugacguuugcugacggcugacaggcgggggcaguuccauaugaacacugacccugugcugaccuggguacaggaggaauaucgucuauuaacacagauauccuguaucucugugcugacagcugcugcaaagagauauccucuacuaacauaaggcauucuguguaucugauagggagggggggacauccucuacuaacauagguauucuauguguuugugcuaauaacugguagggagggggauauccucuacuaacagauauucuaugugucugugcugauagcugguggggaggggauauccuacuaacagguauucucuaugugucuauguuggcaccugcggguuucugcacaguauggugggaagaggauagucuauagaaagacucaugccccucccuguggcuaucagacgaucaccagccuccaccugcaaagucaguguguccagcaggcauucagaggucagagcugaagcuggccuccaaaggcgagcuggccuaggcuuccacaccacaccugucaaagggacagguccaagacagaacuccaccaggcaggagugggcaagggucucacaucuuacuccugauguuuugccccuuuucaaaaugggaggacuuuaagucuccuaauucucagccuggguuugaauaaaagcugucccuguuacaauacaaggauggaggauaccugggcaccagauccccuuuguaccaguuuaagcugccucaugguaaacugauaauguccuggauaugcccucuggauuucuguagaccauaagauaguggauagaagauuagacuucucuccauggcccugccccagauuggccaaacuagaaauaaauccauuuuccuuuaugacucuaucuccuaauuuaauggaucuaagugcccaagagcuggaauggcugguggguguggcagcagguacguguaaacugugggauagagggaagcugugggauagagggaggcucucuugaccaucuuggugugugugugugugugugugugugugugugugugcgcauuuccuccuaaggccuauccuuggcuugaggauggagacaucucucugguaugcuugagugaucauccuuuagauucccgcugucuccuuccucugaggacacggucccaucggauuggggucaaccucgugauuccauucuacacuaacaaccuccugaagccuuugccugugcagaaaagccacgcugagguuaugggauuccauguccugaggacuagacccuucugggaugggaccaccauugcagaucuagucagggcucuggcuucuagagucggaccgcauuccuccugaccaaaccuuggccauuuuccaagaccaucaauauccaaagagcugcaggcauugaaacagaaaaccagccgcaggugcacuggccagcaagcucagggucaggaggacgaaugucaccauggcuucaguccuucacaccugucucagaagaggcaagacaaucccugcuugggucauccagccuucacaaggcugaagcaaacccucccugcauauccucucaaagggagagacagaucugagaggaacauaaguggggauuccugggaaggaacugguuggaggacuccacucaaagcuggcgggagcacggagggagcugcacacaugcagggcugucuuccuuuguguccuccuauucagcugcgaguaagggugccgucucccucccuuaccgcuucuggcccuccaagauagggcaucuggccaugccuacuugcaucucuugagcccacaagguggcuccuagccuccagcucuguucugaugcagacagagcaaaccaaaaaguguccauugcaaggggagagaacccgggaggugagggcacugcagagugaugcuuuagccaaagaccucacuucccuaaauccucaaagccuucccauuggaacucagauucaccccaugacacaccacaaagcaccuaauccucugcaaacaaacaaacaaaacguugggccuggagagauggcuuaguaguuaagagcacugacugcucuuccaaagguccugaguucaaaucccagaaaccacauuguggcucacaaccaucuguaaugggaucugaugcccucuucuggaguaucugaaaacagcuacacuguacuuacauauaauaaauaaucuuuaaaaaaaaaaguuggcauugucgacuccuccccaaaaugucacuaagcugucaccccuagccacuagucuaaccccgugcaccccagccccaugggcuaccaguuucuaccagaguacacuagccugcuugagauacgucaucugaaagcaauggugcauccuauugucuucuagauccaaccguucuaagaacaagguguuuccccaagggucgcccucccuguggugcauccgaaccugucacuuaucuugacauuuagguuaugagccucaucuuuaauggcugagcuuucucucugucacuacuucauucauuuuaagggaaaauaguagccagggcguggcuacugccaucccuccuugauggacagucgguggcucccucuuugauccaagugugacaucauggcuccagaucaccagacuugugcacaagcugacacaacccuggcguuugccuucugucagugaaccugauucaaaugagaaucaugagacaagggauuucccaacugaggaacuguucugauugcccuaacugauggaggaugcccaccugaauguggguggccuucucuggcagcccagauuaaaggggcaggguugggaagaugacucaguagucaaauguaaaaacauauugucuguuuuucuuuucccuuccccugcucccggaaugacaagucugagacuaaucguuuauuaauaaacuccuaggccauaagcuuugccucauucucuaacuagcuuguaacuuauuuaacccauccaaacuauucugugucuaccacuugucaguuaucucuccuucagucccagcugugucuuccucagcaucucccucagggucucucccugggcuuccuuuuauucccucacuauuucccagaauccucucucuuccugccagugucccaccuccuacuuccugccucaguucauuggcuaccggcuuuuuuauugacagguguugcuuauaagagauucucuuuaccguuaagagcucccuucacugggagcucuuccagaggaucuagacgagguucccagcaucccacggcaggucacaacccucuguaacuccauuuccaggaaaucacaaacucuuccaaccucugcugggacgggggucacgugugauacacuugcauacaugcaagcgaaucucucauacacagacaacaaaugaaccuuuaccuauugucuuugaguggcauggugggaagaggauucacccuccucuccggccucuccucucaccagagcugauucauccugcuaaugaugacgaugaugacuccuuccuuccccagugucaaaaccauuguuaccacacuuccaccauggacugaggaccagugguucuccgagaaccuuccaggguguggagcagacuggggcucagcagccugaggcaugcaaggcuuguggacugaaauucggccagauuucug

SEQ ID NO: 2304 - RNA, 3731 nt, Mus musculus
cagaaaucuggccgaauuucaguccacaagccuugcaugccucaggcugcugagccccagucugcuccacacccuggaagguucucggagaaccacugguccucaguccaugguggaagugugguaacaaugguuuugacacuggggaaggaaggagucaucaucgucaucauuagcaggaugaaucagcucuggugagaggagaggccggagaggagggugaauccucuucccaccaugccacucaaagacaauagguaaagguucauuuguugucuguguaugagagauucgcuugcauguaugcaaguguaucacacgugacccccgucccagcagagguuggaagaguuugugauuuccuggaaauggaguuacagaggguugugaccugccgugggaugcugggaaccucgucuagauccucuggaagagcucccagugaagggagcucuuaacgguaaagagaaucucuuauaagcaacaccugucaauaaaaaagccgguagccaaugaacugaggcaggaaguaggaggugggacacuggcaggaagagagaggauucugggaaauagugagggaauaaaaggaagcccagggagagacccugagggagaugcugaggaagacacagcugggacugaaggagagauaacugacaagugguagacacagaauaguuuggauggguuaaauaaguuacaagcuaguuagagaaugaggcaaagcuuauggccuaggaguuuauuaauaaacgauuagucucagacuugucauuccgggagcaggggaagggaaaagaaaaacagacaauauguuuuuacauuugacuacugagucaucuucccaacccugccccuuuaaucugggcugccagagaaggccacccacauucaggugggcauccuccaucaguuagggcaaucagaacaguuccucaguugggaaaucccuugucucaugauucucauuugaaucagguucacugacagaaggcaaacgccaggguugugucagcuugugcacaagucuggugaucuggagccaugaugucacacuuggaucaaagagggagccaccgacuguccaucaaggagggauggcaguagccacgcccuggcuacuauuuucccuuaaaaugaaugaaguagugacagagagaaagcucagccauuaaagaugaggcucauaaccuaaaugucaagauaagugacagguucggaugcaccacagggagggcgacccuuggggaaacaccuuguucuuagaacgguuggaucuagaagacaauaggaugcaccauugcuuucagaugacguaucucaagcaggcuaguguacucugguagaaacugguagcccauggggcuggggugcacgggguuagacuaguggcuaggggugacagcuuagugacauuuuggggaggagucgacaaugccaacuuuuuuuuuuaaagauuauuuauuauauguaaguacaguguagcuguuuucagauacuccagaagagggcaucagaucccauuacagaugguugugagccacaaugugguuucugggauuugaacucaggaccuuuggaagagcagucagugcucuuaacuacuaagccaucucuccaggcccaacguuuuguuuguuuguuugcagaggauuaggugcuuuguggugugucauggggugaaucugaguuccaaugggaaggcuuugaggauuuagggaagugaggucuuuggcuaaagcaucacucugcagugcccucaccucccggguucucuccccuugcaauggacacuuuuugguuugcucugucugcaucagaacagagcuggaggcuaggagccaccuugugggcucaagagaugcaaguaggcauggccagaugcccuaucuuggagggccagaagcgguaagggagggagacggcacccuuacucgcagcugaauaggaggacacaaaggaagacagcccugcaugugugcagcucccuccgugcucccgccagcuuugaguggaguccuccaaccaguuccuucccaggaauccccacuuauguuccucucagaucugucucucccuuugagaggauaugcagggaggguuugcuucagccuugugaaggcuggaugacccaagcagggauugucuugccucuucugagacaggugugaaggacugaagccauggugacauucguccuccugacccugagcuugcuggccagugcaccugcggcugguuuucuguuucaaugccugcagcucuuuggauauugauggucuuggaaaauggccaagguuuggucaggaggaaugcgguccgacucuagaagccagagcccugacuagaucugcaaugguggucccaucccagaagggucuaguccucaggacauggaaucccauaaccucagcguggcuuuucugcacaggcaaaggcuucaggagguuguuaguguagaauggaaucacgagguugaccccaauccgaugggaccguguccucagaggaaggagacagcgggaaucuaaaggaugaucacucaagcauaccagagagaugucuccauccucaagccaaggauaggccuuaggaggaaaugcgcacacacacacacacacacacacacacacacacaccaagauggucaagagagccucccucuaucccacagcuucccucuaucccacaguuuacacguaccugcugccacacccaccagccauuccagcucuugggcacuuagauccauuaaauuaggagauagagucauaaaggaaaauggauuuauuucuaguuuggccaaucuggggcagggccauggagagaagucuaaucuucuauccacuaucuuauggucuacagaaauccagagggcauauccaggacauuaucaguuuaccaugaggcagcuuaaacugguacaaaggggaucuggugcccagguauccuccauccuuguauuguaacagggacagcuuuuauucaaacccaggcugagaauuaggagacuuaaaguccucccauuuugaaaaggggcaaaacaucaggaguaagaugugagacccuugcccacuccugccugguggaguucugucuuggaccugucccuuugacaggugugguguggaagccuaggccagcucgccuuuggaggccagcuucagcucugaccucugaaugccugcuggacacacugacuuugcagguggaggcuggugaucgucugauagccacagggaggggcaugagucuuucuauagacuauccucuucccaccauacugugcagaaacccgcaggugccaacauagacacauagagaauaccuguuaguaggauauccccuccccaccagcuaucagcacagacacauagaauaucuguuaguagaggauaucccccucccuaccaguuauuagcacaaacacauagaauaccuauguuaguagaggaugucccccccucccuaucagauacacagaaugccuuauguuaguagaggauaucucuuugcagcagcugucagcacagagauacaggauaucuguguuaauagacgauauuccuccuguacccaggucagcacagggucaguguucauauggaacugcccccgccugucagccgucagcaaacgucaugguuacaauaccagaggccaccacccaggaugcucauggcccagcuugcagucuuauccuauuuauuucccccaauaaaccuuuc

SEQ ID NO: 2305 - RNA, 2096 nt, Mus musculus
cuagcagccugcacucagcacugagcacccccucccucaccuguacucagcaccaagcacccucucccucaccuauacucagcacugagcacccucucccucacuuguaaucagcaccaagcacccucucccucaccuguacucagcaccgagcacccucucccucaccuguacucaggauagggcaccuucucccucaccuguacucaugaucgggcacccucucccuuaccuguacucagcaccgagcacccucuccuucaccuguacucaggacugggcacccucucccuuaccuguacucagcaccgagcacccucucccucaccuguacucaggauagggcaccuucucccucaccuguacucagcaccgagcacccucuuccucaccuguacucagcacugagcacccucucccucaccuguacucagcaccgagcacccucuuccucaccuguacucagcacugagcacccucucccucaccuguacucagcaccgagcacccucucccucaccuguacucagcacugagcacccucucccucaccugccauguagucaucaucugccugcaugaacuauaagauuagggauagugucuugcuaagucugucuccacccaaucagacuauuccaauggguuucacauacacagcuacagguacuacaacccacacaauauggagaccagucuggagggaugccaaggccgaucuuccugacucuagccucugugaacccuagaagauugcaucacagcagagaccugcugauuguucaagacauggaguaccugccaggguccucagggagccugagcacaauccccacgugcccccacccugaggccagcucugaccucuggcucgcccugcagaaggccauguaguuccagcuguucguacaccugggcacgguagcgagccaucugcuguuucuucuccuuggccagaucguagucuuccuucuccaccgcacagcgcuucuccacuucauagcgcccuaggcgcucaccgaccugcagcacacaacgugggcaucuacucucauaggacaugcgugggugggagggucugugcuguaugcugucucaauaccuggcacucaggagucccacacggccaaagccucuggcucacugauccccaacgcuaccugccugggacucuaacugcaucucugcuccucagccuucaggaaccuucagggguggugcagaggagauccagccugggcaggugaggguaugugcucagaagcuguaccuucugcaagucagcgaucgcuugcuucaguuucuuugcauggucauagcgcuccuucuugacagcuucccguuuccuuucauccagccugcggaugaucugggcaacuucagggucuugguacaugucaaaagccaagucaucaaguggagagauguagucagaucgccuaaggagagaagacgaccccuucggucaggagagccaagagcucaugcugcacacaggugagaagguuagaaaagguucagggguguucacagggcccccucucgaggccugacucagagaggccguucaggcugcagccaugagcgacaggggcuccugcucccugugacucagagaggccguucaggccgcagccaugagcgacaggggcuccugcaaccugugcuucacugggcugcgugucaggcaggccgcagacacucagcacccgugaccuguugugagcacagcaggaaguaccuuuguucugagugacccaaaugcaagcuaugaccuggguaguuacauauagguuaaguuuauauaaauaguaucugucacaaggaguuuagcuggaaaacuuuaaucaggucaaacgggccugggacacaugcuuuauuuaaaaauccccaggcccccuucugcuguccccaucucuaaucaggcccuuugccuggcagcccagugacuaauacugcaaugaacaucccuuccaucaguaacguaagggucgacacagcucacacuaacugucaacaccaugcuugcaagccuacaccacucugccaugucccagaaaccaauacaaagguuuuauuuuaaaaauucucaccga

SEQ ID NO: 2306 - RNA, 10334 nt, Mus musculus
aacagacaacuccacccccaccccuccacucacaggcuccaaaugagguaagacggugguguguucuccaccucacccgcaccccccaguccugagcugccgcaaggcgggcaucgcaaggcgggcaucgggaggaagucccagugaaggacccccuaaggccuaguggagcucuugucaagaggucaucuuuggagcagguguguagcaagacagggcagacauggcugagccagggacaugggugcaguagagaggugacaggaaggaguaguauuugaugcaggaggcaccauguggaaggaaaggaacgggagcacuguccucaggcgucuccuguagucccgggcugacagugaggcgggcuuccagccacauucugcacuccacacugggucaggugcucccagcccacuccuggcagcugcccaguaaucuugcggagcugcucagugagccccauggucauggacacccuacccugguggggguucgggcugcucucccauguaugaugucugcuacaccugaggacuggugaacugcaacacuguccugggagacgcaugugcuaaggcugcugaugcagagaugucguuaccaaggguuuuuauuagaacaaagaggcguucugcuugaaucuguaaaaacaguuucaaaaaucucaaugaaucucacaccugggcugggcugggcuggagggaacagcaggaacuggggggagacagggugagcacaggauagcuccacccuaaacacuuaguaggugaguacuugccacagccacucaaagggaccugugagcagccgugucucauggagaacagcuaccagcguuguccagggucugccacgaggagccuggagcuucacuaguucugacagcuaacggcucucgcacggccuuaggaugaaagccgcacgcaaccccaaacagguguucuuuuacagaagguagaaaugguccuuuaaggucagaggucaccaacgagaaggugucgagggggaaggcugagggucugguucucuucucagccagauggcaaggcacggggccaccaaguccucugugcagcugcuggguccuuaggaccaggcacuguggcucgagggauggcagcugugugcugguacagaugcguacacaugcggagaugggaugugcgcagucaggaugcacagagaugggacaugaauagugggacacgcugacauggagccugcagggccaugugugaggcacaguccacgaagcaucugucugacuacaaaggacuacacggacauagauaacuuccuuggccaaggcgcagaugugccaacaacgaccagcacuacaguuccaagcacagccguggaaggcagaugcugcccugggagcauggcggcagcacggugccuggaaacaagcucuaagaagauuacacucacaacaugauguucucaacugucuaugcacagcugauuuaaaaaaaaauucuauuaacauguuguagaaaaauaaauacuguucaauagaaugccugcguucaaccugacucuccagcacggccacaggccacaugauucagaacauccccagcaguuacugagugauccaugaggacaggagacaggagagucacauuggagcuaugaugaugaugcaaacucacauuaccacagucaccuggacaaaagcagacaccuuaaaacacccagagaaacagcaaagaaccaguuacacagaaucuacagcacacccacaccuauacccacacagaccccuacagcacacccacaccuauagagaucuacagcacacccacaccugcagcauacccacaccuacagacaccuacagcacacccacacagacacccacagcacacccacacccacacagacaccuacagcacacccagauaccuacagcauauccacaccuacacagacaucuacagcauacccacacccagauaccuacagcauaccuacaccuacaaagaucuacagcacacccauaccuacacagacaucuacagcacacccacaccuauacagacaccuagcacacccacacagacaccuacagcacacccacaccuacacagacaccuacagcacacccacacagacaccuacagcacacccacagauaccuauagcacacccacacccacacagacaccuacagcacacccacacccacacagacaccuacagcacacccacaccuacaggagccugucagcggaccacagucacguggggagggagggugaucagguccgucuuggauggguacaccaccuucaagcucccuuccagguccaccacucggaccugcuccaccaccagagggcacuguccauccuucccagagcucagagucaaguugggaucagaaagcccacagccggcaucagcuuccgucccugagagcaugucuuccucuuuauuuucugaagugcuuuugcucaguucugccauucucugaaaaugaaaauaccuuuuuaacagagagaaguggcccaggaagucggcugugguaacccacagagcaagcagacagcagcuguguaagggaugggaaugccaagcugcccucagggccggggucuagggcuggcccucacucaccaggauaaggcuguccaugauguccuuacagagcugcaggcuaguggcacucguuacuuccaagaacaaguugcaggugguuuucuuaaucuuaagaauuggauuucagaaaagaagaguuauugguguugggcugccagccgcgcaccguguucagaagaaucuauaagcaaagcuacagaaggcuggaggugcagcaugccugccuuggauuaaaucccagcacugcacacaccaggcagggugugugccugccuauuaucccagcuuuagugaaauggagacacgacggucagaagcucacgguaacucuuagcuuauaaaaaccugucucagaaccaagagcauguagcaaagggccccaggccuccucucugcacuucuaucguaagcaggcuaccgugugaugggcuuagaggacaugagcaaacuucagaccccaccugccuaccuuugucuucucacuguuuguuauaggagggaaagaaaucacgucucccucggcauccacaagacagggguaguucuccuucccauccaggaggugaagguaccugcgugggagggaaccaggcaggugugagccaguggguaagaugaguggaggcaaaacugcagauggacuaggugcaacauuaaaggccaaguguagagccaugugauaccagagcugccuuagcccagcauccucaccgggccauagacccuggaggugacacuggacagaggccuuaggucugacaacccugacccuaccauggagagccugaugguugccaggagcaaaagaccuccuccacccuggaacaggacgcugccuacccuccccaccaccacuggagccugguacuuucaggacggagagucggccucucuuagaaggaagucuugggagacucccuccccaucuggcuguuuuugagcuucuggcggcuguagggcuggcugagguacagcugacaugguggcagcaugcugaccccugugccgacacugaccugugcagcccugagacgcucugccucuucuucugcuuucucuguuccucggccuccagcugcagcugccgcacgagcuccuuggccuuggccucuuuccgucccaaaggcacaaucuguaggagcagaagccacagcucauccugcggccgaggccaccuuugagcacgagggaugcugugcaccucucucuaccuuagucucuagcugggaaugggucaccaacucuccagaucgggaagcaagaggcugaggcccaucacauggagcacacuggcuggcuucacuuccagagacuccucuggagacggggugcuuaacacucagugccuagcugagauucacuuuaaaccuagcccaaaaacaacuauuucuaagaaccugcauuugcugagacggcugauggagagauaggauuuagcugcaugagccgguugauucaggcaugcagcugacaccugaguuccuuuacccuggaccccuaagccaacagccugcagcagcacccucaugagucagcucacacuacagguguucuguaagcgggacauaaaccaaaaucauuggcuaaaaguugaugagcuggcuaggcaugguggcacaugcccuuaaucucagcacuuggugagugcgugcgggggguggggggggugggggguggggggguggagggggcagaaaaaaagaucugaguucaaguccaguauagucaggacuacagagugaggucucaucucacagaaguugaggcguaagggaagcaccuuccaaacccaucccugacaaugggcauuggcauagcuaugcacugggccccagaaagaaggcagaaacuaugucccauaugcacuugcuguaaaauaucagguuaagcuucccaggcccaaguccauccugagagucugcuaaagccaagugcaagugcagacugaaggggcagucaguuggcaccuugagguccucgggcggccgggcugcauacagcagggguccacgcacagccuggaggucaugggucgcgauggucgcugcuguccucuucucgcagaggucgucguggagcuucgucuacagaggagagcacagcaggggcuucagggucccugcuguccagggagggaccuucauggaagccaugggcuccagucugcaagcucaccacagcaaaguggcaccgcccgacaccucugucucccaaccauacucuuuucugguccccggcagcuuuucucuucucuuuaguacuagaacacggcacuuacacuuuagaggacuuucauuucaaccucuuacuucaucuacaagacagacugcagguuuguagcuaagcugggcaugucuugggggcagggcaccacuggcuuccucccugagcugcugagggaagucucacacagcaacuggucuugcuggcacaggcuguaccugucucuccuaggcacaaaugcacagaggugcuucuuauuccucaggggaggcagaugccgaggcgccuuagggagugguccagccagccugaccgagagcucgcaugagugugcugugacacaaggugacccgagagcucgcaugagugugcugugacacgaggugacccgagagcucgcaugagugugcugugacacgaggugacugcucauccucaccaucauccuuccuuccuuuuucaguuguuguugauuuuucaagacaggguuucuguguccugaaacuaccucuguagaucaagcuggccuugaauuaagagcgauccuccugucccugccucccaagugcugggaucaaagguaucugccaccauugccuagcuauuauuauuuuggagauaaacucucucuaugcagccuugguuggccuagaacuugcuaugcagacuaggcuggccucaaacucccagagaucucuuugucucugcuggauuaaagguguguacuaccaugcuuggaaaaaggagacaauuuuaacauggucugcagaaauuagcaauguccccuaauaucaaacaucgucaauaaauuuaugucuuaacuauggcaacauguggaaguguguggaggaaccauggcccagcagacacuugacaaggguaugcucuggguaccaagcaucuacggggauaggcaaaggacccucuucacccugaacuagggaaacagauacagaaaccaaaccaacuuugccuccugucccugccccaaugguauacccaacaugcagacucccccaaucugucucuugcaugcaugcccaccccagcaugcagcauccaccaagucagccugcugaaugcaugcccacccuagcaugcacccaagucugucugccauguauccaccgccagcaugcagccuaccaagugugccugccgaaugcccaccugggaguugagaaagcgacggagugcauuuccuggcugcagguccaugccucucacaauggccccgacgauguaugggcgcacauccuugaccuccgggcucacccugacugucaggggugugggguucucagagacaugcaagaccuugagcaucagccuggcugagucugcuaccuccuccucgcccuccccgcuuucccgaugcugcuuccgcucccgucucuucuuucuguccuccuucucagaggccucuugccggcccuugcuccggccgccgcggccaccagcacgaagguacucuaggauggacuuggucuggcagccacccaccaucuucuccaggcgcuugucucgaagccuguuuccucgaaaguugaucucuuugagcuuggggcagucugccagcucagcagggaucucuguuaguugguuguuggagagguccaaugucugcagugagaaggagagucaggacagccaggccuggacaggugacaacacugagaagagucaggacagccaggcccggacaggugacaacacugagaagagucgggacagccaggccugcccacugguuacuugcauggccacagcugccugcugccaugccccucccccuccuugguucacagaggcagccaauucaacacgucaggccuacaauuacaauaccaaacauucagaccuaucagcaggcuagggaacagaccaggaccccuuccagucucaaacaggcuccccaaaugguguccagcuaucgcuucaauguaaugacaaaaaagagcgauaccaacaaacccuguccccacaccaagcaugacaucaccagggguacauggccccauugcugucuuucauaagaugaggguggacuggaaagagguaguaguguucauaccacacacacaaugcccaggggucugugggaaagagcucccugccgcuagacaaaugugcugcuuucaacgcaguggaagggugugcagcccuauaaccauaaacaucccuuucucaggugguggggacucuggucugcuuuauuuuuugcucuuauaucgagcaccgcucuggaggaaccagggagaggucuacagcgaccacaggugacaccucugcucucagacacaaucuguggcaguugaguccuaggaaccuggguguggaacgaggauggccguacaggccugacugcuaugacacacgucucucuggauggugcagcugcucagccucuaccucugaagcaagugagaaggaaucaagccaucaggcuacuugguguggagaagacacaggacacaggggcucuguccauaccaccaagguauagcaggaauucaggaggcagaggacaacuauaaaagcuaaaggagaaaagcaugaaaaggagggacccggcccuuguggggaagaggccagauaacagcaaugccugauaggugaaugcaaggcagguuacccugcaggggagucaccaggagcaagcucaucaggugucucggugugcugacucucacugcgaccugccacauaaaguuggacuggcauuuucuauggugcagucaucagccucagaugagucugggucucagaucuguaccccaugccacgcccaacaccaggucuucacagauccacuuccacuggaggcagagccuacccuuucaggaccuaucugguucccaaguaacuacucugaggaccacugugacauuaucaggaaccaaguaagggggggcggugucugagccagacuagcaaacuuucuucccaacccugugaggucaccagcccagaggaccuagcucuccaaaagcaugaccgaugacaugggccuuauuugacaguaggucugcaacagccugucuguaauucuguggauucugagcuucuguacucccuugaaggacuucugugaaaaugcccucccuugacuacagugggaucaaaacacacuugucaaacacuggguugaaugacaugcuucugcucccacuguuaagaugcaaucuacugaagaccugggggagaaauacgcagaagggggcagcgguggggcugagccucagaaagagcccuuagggaggggaucuuccagggauaccaucugacaagggcgggucagagcaggaagcaacaaucccaaugccaguugagcaucucccuggggcccugugaggacagcagcaaaggugaagagugagucgaagagaggcaggugggucuugccacacagagacacagggugaagcguccuggugagaaaggugaugcuugcccauguuuacccagcccucagugccuagagcggcaaccuugucaugggaguggggccaggguccaaggugugaugggcaagcacagacgugaagccuuuugggcccuccggggggagggggggagaggcaauaccaccaaaaggugaagcagggcggaugugccagccuccucccagugcccacgggacugcugugcuuggccggcuguaugccuugcaggguauauacgcucaacaccuuacaucagaacuuccaggagaacacaaaccccagccaguacagugacaaccagggcugccucugcugggaaagggaucacagcaugguggugagggccaagugagacacaugcaaggggcuucagucucagaaaccacagcacgucaauggcugauacaaagacaugcaccauauugaacagucaucagccuucuggcaaaccaauauaucuacuacauaggaaggcagaacaguguacagccugugucauacccaagccauggggacaccuguaacauagagggccaagguaccucagggaguaucaucuuguagacucgcuggccuaucucuccacacccccaccccgagaaagcaagagcgagagcgaggagggagggacaggugucuuaauuaaacacacacacacacacacacacacacacacacacacgaauacuagcaaggugagcucugaucucucaagagcaaauuuccuugccaauccaucauuaggaaagggcugcauaaacucaaggaugagaagacacacaggcuggcgcuaccaagaauacaaaggguagggggugugauggagggggugugguaggggaacugacauggccagaugacaggacuggacuguggagauccuagaguggagucaggucagguuguggcuuugcaucuucugccuucucaccccucacucaacacacaaugagcaccuggugggcgucaggcacaacgggagccugggaccacaaagaagccaaucucuuacacaaggcagccccgaagaaaacucuaggugugcuguuggcuuuggguaagcacuucggcucucuauaaaacggaagccaugaucccgcccacugaaggcuguuguuaugcgugauuuugugccuugucuggacgcuccgccauuuggaaacccaaucaguuacgcacacgcacacacgcgcgccacaccuggcucucugcucuugaauuucuucccacaugagaagucuaacauugauagcaacuuuuaaacugccacacguccagagaccucugagcucgcaggucugagaacugagaggagacggaccgguugcgggggcaaagacauccuccaaggagggacagcagggcgcgcgucucccuccccucgggucccacugaccuugagcgaggcaagaugcgcgaugucugggcugagcucccgcaggcaguugucggcagcugccagcucacugagcaggggcagagcuccuggccggaagagcucggggggaaaggcguccaggcgguugccggugagauugaggcucugcaggcgaggggcgcagcgcgccaggucggcgggcagcucgcgcaggcgguugccgcugagguugaggcucugcagcugcgguaguccggggggcucggcggggcccaggcccucgccgggcggcagcgucuccaacgcguugccggacaggucgaggacgcgcagcgcgggcagcggccccagcucggggcucaggcccggccccagcgcguugcgccgcagcaccaggcugugcagcugcgggaggcccugcgcgaggccgggccccggcgcgcgcaggcugccgcagccgcucaccuccagguagugcagcagcggcagcgugaagagccgcggcggaagccgcccgcccgccgccuucacccgcuccuccagcccgggcccggucagcagcagcucgcgccgccgcucgcgcucggccagcuccagcuccggccaggccucggacacggccaucgccgccgccgccaucgcgccgcccgugcgccgcuuccggagugcggcgccacacuucc

SEQ ID NO: 2307 - RNA, 6502 nt, Mus musculus
ugcaggcgucugggauggcuuguacgguucugcagcaggcugggaaaaguccgagggggguccgccccuccucaucuagacuagacuuccuuggcgacugugacugcaggcuucccaggcuggccucucucccuuggccccgcccuucagacccugcccucuccccggccucggccccgcccccgucaccccagggggcuggagaagccucccuggcgugcgggcggcccuugcaagaggcacaggugagucgcacucgguagagaccgcggcuucccucccgcacagcccaaggaggugggccuggcagcacgccccaccauucccuguccuccggggccagagcuucccuggccggagaauuccggacugggaaggguuagggaggccuaaccacccaaggcugucaggccuggaacugccggcucagcuccuggggugggggugggguggagggaucacccuuggggccaguuucuuccuuuccucuagcugacugcuccucuccucgccacuguuuucuuuauuuaaggcucgaagcaccaaccuuaccucucagcauaauugguuugcccugcuggggaaaggugggauccauugaacagacccugacagccuuccugagcaccggaggcuuccgacgcgccuuuguaaguuggggucucagaggugcuccgugggcaaaccgguuuaaugagcagcugcauguuggauucccuccaggggacacucuguguuugaaagggccuuguaggcccuuccgacugcgucuaugacagauuaccacgaaggaagccuagacuagccuggcccaaagagcucacugcuaucuggcggccuguccagccaaagauagucugcaaauaacaggauccuaccaccucaggcuugaacaaacuggggagacucucuucacaccccaaagucuacaagugggcagguuuugcuguagauuuagauagcccuauugaggcgaguguugcauggauaucuagacugcauauguggguguagcagcuccagccaucacacaggcaggaaagagguggcuacucuuaauuuggggaaagcaaaaguccccucuccccacauuccacuguagagagcacuuugcccacaacuggugacacgguaaaggggggauugggaucuuuaaccugucucagccuaauguggcugccacaggaggaagggacagcccugugcaagcagcuggcagauucuuucugaaacaacagcccgcccacacuccagcaacacucugucaccucaggcugucagucagaggcuccaccagaagacacgcgcggcuguuaagauggugcccuuccucuucccauucagccgagcguccugagguucuggagcccagaaccucagcccauuuccugcagcccaguggccugcuguaccuucagguacacaggguuauguaggacgggcuguauccccagugcccccgcugcugggagacaggguccggguccuggagcugggugccacaagggaacauuggguacccaguaccuaacuuuauccguaucucacggccuguacuucuaguaugugcccugcucccuuuagguaaacacgagguaacaggagaggucagaggguaaaugacaugcuaguguccacuauaagccuguuggcaguaggucggagcaaccaugcauggcagugaugucacugugucuguccuuuuccugggguggcuggcccugggggagucagggaugguuuggugcuaggaaccuuucuguucugggcacucgugugucuuuauuuccugcccaucuacagcccucuggagcccccgcacccacagaagcccugccugacuccucucagaagcagcagguggaggaggggcugaggacagcugcugcggggccuccucccuggcuggcugggcuggccguaccagacaccagccacugcucaucccuccccuugccagccucucuggagagcagcuccaggccuuaucuguagggcuggggaggaagacgguuaucagguuguuggcagcuacacuuuccuggucucugaaggcugcacuggcugucuccccugauaaauaggagguaggagagccccucagaggccccaguuguaaaugcagaggcuuacuuacauucccgagggucagggcuggccaccacccugccucccugggcuggaauuccuuaucagguucuucugaugugacccugagcuaguuucugguuaucauuggcaaaucccuuccccuccuuccaggcagacccuccccaaccagcagcuucugugagucuggccugauaccugccuuaucuccucccugaaugugguagcuccaccccaggccuacagcaugcagucccaggagagugguguucacuacagcaggugggacagcagcagccgggaugaagucagcaugaccgccauguccagcucggaagaagccucaugcuauaggagguacaguuccaacaggccagcagcucccacugaccugaccagcuuuguucaagcccagcccguccaggugcccacggcaccuuugagcagauagguaacucccaccuauagcauagcacucaggucuaaccucugcccaucuuuucccgaucuagcccgccgcuuccccacccaugcccacucgggaaccuccccguaucguuggugugggcucacuggcuguucuuauucuaggaucucccagaagcugugcucuggcaagcuggggauagccaugaaggugcuggguggaguggcccucuucuggaucaucuucauccuggguuacaucacuggcuacuacgugcacaagugcaaauaaaugcugccccacucccagcccuggggauucccucccauguacacaggccauuugugcagacacuccuccauacagaccccagggcauaugaagaugccagugugcacugucaacauggcuccccaucuccaguacacaggguagacccaagacugaaaccccagcccaggcagccaccagcgagagucacacaggcuggagacuaggcuaagcuccagcugagcagcagggaaccacccccaccccccacccccagguugggcuuugugccccgauuccuuuggccagugcuccaucuuccccagccuaggcccgucccuagcugagguuggaaugagugauggucugugcaggggggugcuuggcagcccucaggggugagcuucucccugugggcagggcuccuggucuuuuggccuuccagauuccugguugugcaggaugggcccugaauaacgacuguggcuccuauuuuuuccagggcacacagacagggccucaaaucuuucugugcagggcacaggggcuuaccaccucagggauggcccggagagaagcugugugcccuaccggcugccuccccaccagcccccacuccuuagagacuguagacaaaucacugcugaaggaacagugggugacagacucucuccacuagcacugcccagccaggcaugacuuguuccaggccugacccuccuccacagcuccuccuguuuggcucugucuuggaaugugccccuccugacugggccuucucccaagaacacagagacccaagggucaggauguggcuggaccuguucccuccuuacuggaccaugugaggacaugacgcugaacaagggcacugugacucgauggggacuuugguccccucuccaguggcccauguagaacuucucuggaccacaccuuguucccaguaugcugugaauuggcgcaaggcuggcgggcuguggcuagaaaacugugaggucugcacacugaccugagaggguggcaggcacaggggcugcugcuaucaguggccaaaggaaggaggccagaagccaaccccugcuucucccuggccagcgaggcugguauggcuggccuccucauccuaagaggcuccugguuaggcccgaccuaagcuucagugguccuugugugggagauugcaguagagcuacuccaacugaccuggaccucuguaguacaagucuagaccccaagucuaacagacaacuccacccccaccccuccacucacaggcuccaaaugagguaagacggugguguguucuccaccucacccgcaccccccaguccugagcugccgcaaggcgggcaucgcaaggcgggcaucgggaggaagucccagugaaggacccccuaaggccuaguggagcucuugucaagaggucaucuuuggagcagguguguagcaagacagggcagacauggcugagccagggacaugggugcaguagagaggugacaggaaggaguaguauuugaugcaggaggcaccauguggaaggaaaggaacgggagcacuguccucaggcgucuccuguagucccgggcugacagugaggcgggcuuccagccacauucugcacuccacacugggucaggugcucccagcccacuccuggcagcugcccaguaaucuugcggagcugcucagugagccccauggucauggacacccuacccugguggggguucgggcugcucucccauguaugaugucugcuacaccugaggacuggugaacugcaacacuguccugggagacgcaugugcuaaggcugcugaugcagagaugucguuaccaaggguuuuuauuagaacaaagaggcguucugcuugaaucuguaaaaacaguuucaaaaaucucaaugaaucucacaccugggcugggcugggcuggagggaacagcaggaacuggggggagacagggugagcacaggauagcuccacccuaaacacuuaguaggugaguacuugccacagccacucaaagggaccugugagcagccgugucucauggagaacagcuaccagcguuguccagggucugccacgaggagccuggagcuucacuaguucugacagcuaacggcucucgcacggccuuaggaugaaagccgcacgcaaccccaaacagguguucuuuuacagaagguagaaaugguccuuuaaggucagaggucaccaacgagaaggugucgagggggaaggcugagggucugguucucuucucagccagauggcaaggcacggggccaccaaguccucugugcagcugcuggguccuuaggaccaggcacuguggcucgagggauggcagcugugugcugguacagaugcguacacaugcggagaugggaugugcgcagucaggaugcacagagaugggacaugaauagugggacacgcugacauggagccugcagggccaugugugaggcacaguccacgaagcaucugucugacuacaaaggacuacacggacauagauaacuuccuuggccaaggcgcagaugugccaacaacgaccagcacuacaguuccaagcacagccguggaaggcagaugcugcccugggagcauggcggcagcacggugccuggaaacaagcucuaagaagauuacacucacaacaugauguucucaacugucuaugcacagcugauuuaaaaaaaaauucuauuaacauguuguagaaaaauaaauacuguucaauagaaugccugcguucaaccugacucuccagcacggccacaggccacaugauucagaacauccccagcaguuacugagugauccaugaggacaggagacaggagagucacauuggagcuaugaugaugaugcaaacucacauuaccacagucaccuggacaaaagcagacaccuuaaaacacccagagaaacagcaaagaaccaguuacacagaaucuacagcacacccacaccuauacccacacagaccccuacagcacacccacaccuauagagaucuacagcacacccacaccugcagcauacccacaccuacagacaccuacagcacacccacacagacacccacagcacacccacacccacacagacaccuacagcacacccagauaccuacagcauauccacaccuacacagacaucuacagcauacccacacccagauaccuacagcauaccuacaccuacaaagaucuacagcacacccauaccuacacagacaucuacagcacacccacaccuauacagacaccuagcacacccacacagacaccuacagcacacccacaccuacacagacaccuacagcacacccacacagacaccuacagcacacccacagauaccuauagcacacccacacccacacagacaccuacagcacacccacacccacacagacaccuacagcacacccacaccuacaggagccugucagcggaccacagucacguggggagggagggugaucagguccgucuuggauggguacaccaccuucaagcucccuuccagguccaccacucggaccugcuccaccaccagagggcacuguccauccuucccagagcucagagucaaguugggaucagaaagcccacagccggcaucagcuuccgucccugagagcaugucuuccucuuuauuuucugaagugcu

SEQ ID NO: 2308 - RNA, 863 nt, Mus musculus
ggaaugggguauuauuccacaucccugggccuccauuuuuaucuucugcauagugagaaugaaauccacacauagcuugucgcaugguugugggggcgaggucugggagcaagaaaaccuauggcuguucuuucagaaggaacaacccugcuucagccaccaggacgccagaauccaggagcucugacacuuugcaacugauccaucaucagcaccagcccacuaacacaaggcccagugaggaagggacagagccugucugcccacaaggagcaaggcugucuccaaaggcugagcuccagaggcagcugagcagcgucauaaagcaggggacauggggaacagcagccggggucucacucuuggacguguacugguuguaccaacacguggcauugaaguggauacccaaccauaguuagacaagcucuuugaugccugauugagggcagggccucccccucuauccucuccuuucuccaccacucucuuguccuaaccagacaaggaggcucuuaccguccugcuaucaggcuccugcccucacaugcacacauuggauacuaugauuuuaccccgaagacucccaucucacaucuuaacuguuucuaaccuacaaacaaucucaucgaucuguucuuauauauguagacagaaaaugaacgaccucuuaaagguugggagcaggugccuuccacaccgacuccucucugacuucaguacccacggcagccuuugcuauagcacagaacaccaagacggaccucagagguggacuggcugcauccagugcuuagcaacaaagggcauauuacacccaauucccccgagaaguuuauuucucaaauaaaaacagugacaga

SEQ ID NO: 2309 - RNA, 863 nt, Mus musculus
ucugucacuguuuuuauuugagaaauaaacuucucgggggaauuggguguaauaugcccuuuguugcuaagcacuggaugcagccaguccaccucugagguccgucuugguguucugugcuauagcaaaggcugccguggguacugaagucagagaggagucgguguggaaggcaccugcucccaaccuuuaagaggucguucauuuucugucuacauauauaagaacagaucgaugagauuguuuguagguuagaaacaguuaagaugugagaugggagucuucgggguaaaaucauaguauccaaugugugcaugugagggcaggagccugauagcaggacgguaagagccuccuugucugguuaggacaagagagugguggagaaaggagaggauagagggggaggcccugcccucaaucaggcaucaaagagcuugucuaacuaugguuggguauccacuucaaugccacguguugguacaaccaguacacguccaagagugagaccccggcugcuguuccccauguccccugcuuuaugacgcugcucagcugccucuggagcucagccuuuggagacagccuugcuccuugugggcagacaggcucugucccuuccucacugggccuuguguuagugggcuggugcugaugauggaucaguugcaaagugucagagcuccuggauucuggcguccugguggcugaagcaggguuguuccuucugaaagaacagccauagguuuucuugcucccagaccucgcccccacaaccaugcgacaagcuauguguggauuucauucucacuaugcagaagauaaaaauggaggcccagggauguggaauaauaccccauucc

SEQ ID NO: 2310 - RNA, 3910 nt, Mus musculus
cggcccaggaggggccgccguaaucaugaacggcagcacuuuagacccaauugcagaagacagcuuaggggaaagccaaucgcgagacgcagucgacggagcuggaggcggguccggaaggcgggcucugcaggacucaaccaaucacaaggcgaacgagggagggcggggcgcggccgggcggacgccggggcggcggccgucgguggaggcugccgguggcggcgcgaugcugcagcugcgggacacgguggacucggcgggcacgagccccacggcggugcuggcggccggcgaggacgcgggugcgggccggccuggggcgggcacaccgcugcgccagacguuguggccgcugaacguccacgacccuacacgccgcgcccgcgucaaggaguacuucguguuccggcccggcaccaucgagcaggcggucgaggagauccgcgccgugguacggcccguggaggacggcgagauccaggggguguggcugcugaccgaguaagccggcgcgaggggacugcggggacacugggcgggggcgggcgggggcaggcggggcucuuggugaugggcggccccucuccucuccaggguggaccacuggaacaacgagaaggagcggcuggugcuggucaccgaccagucgcugcucaucugcaaauaugacuucaucagccuucagugccagcagguggucaggguggcgcucagcgcgguagacaccaucuccuguggagaauuccaguuuccuccgaagucgcucaacaaguaggugcaccagcgcacuacacggcagggccccagcggauccuguaagugguauugacccacucucuugugagguaaaggucucaucuugaagaaccaguggaaaggaccuuuaaguagaggcuggugauuuccggguugcucaguaccuccuugaaagggaugcuggcacagucggccacucuguccccacuaaaaaccauucauuuaaauaccguuaagauacauggaaucagagcccacugucauaagcuauguagggagucugggaguuuuaacuccagcaggagggagacacagggcaugugcucaguauuacuaaaaauucgauacaucgcaaaacaccuaacagccuucagagacugguuggcuugcuauaaaagaauuauuugacuagggacuccaggaagcuaauggcuacuaacuuaagcaucauucaguaacauuaagaacaaacacggccauaauuaggccagguuggacugugugccgguuucauaggcugcaaaggaggcucauuaacuuguuacgcuuuggaagugugugaagcuguuaguggaggccauuguuacacuaggucacagguuccccagccaucccugauacugaaugcaauguuguauuccugugguaagcaaggcuuucucccccucccccaucaggagagaaggcuuugggguucgcauucagugggacaagcagagccgcccuuccuucaucaacagauggaaccccuggucuacaaacaugcccuaugccaccuucauagaacacccaauggcuggcauggacgagaagacagcgucucugugccauguaagcaggccaaggccacugucagugugaacccuggaggugcaguuccacaguaggaagcuagguggugcuguuuaagaacagagucaccaucccauugcaggaugcucagucuggacugggugggugagcgagcaugggaaaagcccacaguacuggcggggcuuggcaggugcugcuggugacacagguacucuggaaguucccaggagaggugcugagggagcgcugagcauucugcacaguuagaguagggcugagaaagcccugucacuuggugacaucauaguccucaugaauuccuccaucugugaugcuaccugucagucagugcacagcacaccagugcaggcagcgugugcaauuacagcaucaccugcuuagugaggugcacuccagagcaugugcgucuguaaaaaagauuuuccaccuguuggcacuggcaguaccuugucucaggcugccgaaucuccugacugcaucuuuagagauagacugguacucucuagguuggacuuaaggcaggucccuucaugauguuuguacaugaugaaccaccugaugacacagcucauagggcccaaccugucauuggugaugucaucacuaugugguauuugggaggauuugaacucagaauccucguuucccaguacugcugucuuggcaugagguuaaggcuccauguuuauucucuucaaaguuggaaagcuucaaggcucuccugauccaagcugucaagaaggcccagaaggagagcccacugccagggcaggcgaauaccgugcuggugcuggagcgcccccuccucaucgagaccuacguggggcucauguccuucaucaacaaugaagccaagcugggcuacuccaugaccaggggcaagauaggcuucuagacagcugcgucccggaaaccaaggugguggggacucccugugccaccucaugccacccacuggcuggagggaaggagggcauguauccgauuagaauagucaaguggauuauguauauuuaguuggauauuggacaucuuggcaacacaaucuuacaaaggcagauucagcugcccccauaccacuguguuccuucuguaacgccacguucucccuccagcaugccgagcacaauguccacccacuugugcuguguagacuguugcauacagcugaguacagugagcggcuucugcacauauuuaacucucccuauauauuaacucucaagugcuguauuuuaaaauucagcccguuuuuuaaaaaagcuaaauacaguagcagccagcagccagucacuaagaaagacagucugccuggcagcuccuggugaaccugccuuucugugaaugugucugacuuagaaucacacuuuauaaauuaauccagguuguguuaauacagcaguuuuccuaggcccaaaagguuacucucauaacauaagcuagccccuuccggaagucauggugguggguuucuaucauccugucucuguuuaaaagggacugaauaguuggguuuuaaaagugcaugcuauaaacagacgagcauccuagagcucacugagcacugcugagcuuugacacgccagccacacacagcuugcugcugucguucuagccuugccagugcacuguagaugcuggccugucacucuauaccucucgcuuuaguuaaccggcauggaugugaccggaaugccauggccuauccaagaggaaaggugaccucagaugcaccuguuuucagccugugcuuuuguucuaguaaagacauuuaaaccaaauggaguugcuccuuuuugaaguuauugucacagaaucaggagugccaaagacugucuugaggacugaagucuggcugacugaggacccuugugagcaugguccucuuuacagaaacucagauacacaagugugcaguccuggugggaacccuggucaccaguacagacauacuggucugucugcuuucaaggcacuuacuagagauagagagguuugggugggcugagcucuuccacucuaccaggcagugacccaggccucucugcagaauucacuuguaaggccagagaccugcccaacuguugugggauuuacagcucacacggggacaggcacaggugcggggcacuucugaguacauccagcugcaggagggcuggccagucugacauuaguccaccuuguuccaaagcccacugacagaaaaccccucagggaaugcugacccugccuacgaaugaguguggcacugaccauuucuugaugccaggaaguagcuguuagagcugaaagccagcaucccuacacccauccu

SEQ ID NO: 2311 - RNA, 3640 nt, Mus musculus
ugggcaugcuguuguugucaagguagugcaugggucaaaacuccaagggagggagggaacgaagcggcaaacacagagaggggagcagugcucaaccagagcauggccaugcaaaggccccgaggcaggagcaucuugccaucaggcaccaacauugaugccagcacagcaaaccucaggacaguaggugaggucagaauagucagugaucauagaacaguuuccgguacucucggaccccaagaaggaaggaggggccucaacuacaugcucuguggccucccuccaggagugaccgggcccgguggaucacagcacucaccuacaaggagagacaguggcagggcaucaccaacaaaggaggugaguguggguuacaguccugggguugagcugguuggaacccaggccacaccgcagcaucgccagggugccucacucggcagcuggaccuuggccugcuguacacacugugacuagguuaaccuuauuuguccuucuuaggaagccugagguccaaggaauagaauagggcuggaccaucaaaaugucaccucuggcccuggauggcucuuaagggggaaaaguagaucugugggugccagaugucuagccuuguaucccuggaaggccagucuuuauccaagggaagcugucuaucuugugcugagacagcuggugccaugugucugugggaggaguacugcaggagggaggacuaccgcgggcagaguacuacugccccuccccaagggcaacagagcacuccuggcuuagcugucuuuccauuuccccccagaacucccccagguagaggucaccaaggcguacuuugccaagcaggcugaugagaucacacugcaacaggcugacaucguccugguccugcaggaagaggacggugaguguggguggggccaccccugagugggugucaaccagacacagcugcagaguguacugggcuguggcaaccagcacacacucggccugccucgugccccccuaagaacuuccucagaggcgggaacuggggagcuggcucgguuggcauaaggaccugauugggguaugguggcacauggcuuguggcaucucauugccagagaagcaaagacaugcaaauuuuaagggccccuugaucagccagccuagcuucauuagcaagcuccaaggugacgagagacagaguggacagcaccugaggaacugucaugacgacuaugggugcacauguaugugaauccacauguauacuccacacauacacaccacacucaguaccuccaaagggagaauacuggaaucacgggaucgaaaugaguucaucacucugggcccuaagugaagcacguggguauccacguguggccuugggcaaggcccccuuggcucucuugagucaggaggggcagucaguuccaacagucacccaugcccuagaacccuccagagcaaaggaggagacgagagggcucccucucaucugcugucugcauucagguuggcuacacggggagcggcuucgggacggagagaccggcugguuucccgagagcuuugcucacuccaucaccagccguguggccguggaaggcaacgugcgcaggauggagcggcugcggguggagacggauguguagcuggaccgacugcucaaaggccaagccaugguggacacagcuucagucccccgaccagcaagugguccugccugcccccaaggaguaugagggguuugucaugggaagcccuuccccugggcucacgguugagugcagaacacugaacaucuauagauccggcuugcuuagacaucuuugaggcaagucccagaggcucacauucuggaaggagccuagccuggccucuuacaggacaccugagcuacaccggguaacagugucauugaagacaccauaggguuaccucccagcugcaccccuccaucccaggugggacaaaaagggcugguguucugagaggacggugcugguggcaggugaccugaggugccagcagggauauugugauuacagaucuaaauaacauaaaaguauuucuuuaaaauuuuguuuuacaugugagccaccuguuucagugaaauauaacauauaacagguagguggagacuggucucauguucuguccuuaguucuugcacaaggcuccgcuuguguggucagggaugguagcagcuggaucuugcaugcuuagccuggccacagggcucugagaacugggacacaauggggacgcucugguguggugaucuuaggcccuguauaccucccggccagaaaggcagccucugagcugacuagggcugggcuaggagcgaacacgguuggucuggcuguucaggucucuccaacaaucccuucagucugguacugaaaccugugucuuugcuuggcuagcgccagaucaggacggagcacccaacauguacuauagaaucugccucccuucccaccgggcucuaccuugcuauagaugugacaggcacagacggugauaucucucaggccugaggaagagcugugcauccaaaaaucaagggcccaaggcagccagaagggccaagucuaggcucagccugacaucaguccucagcagaacgagugcucacccacuuaccugagggccaggccagaguucaguaggcauagcuggguugacucugagauggggccuaguaccuccuucaaccuaaaagggauaaauaucuucaucuucaccccagugcagcugcucuguguguguguguguguguguguguguguaugcgugagugaaggggacagcacacuggugacuggggagggguuugugugcgcacagaugcuguguguacgcuaauagguaccuguggcagaagcuuaggugccuugguguaaacccacuuccucugguuuguuuccucuacugaucgccccgaggaacaggucaaggagaagcagcaggcugucaccaagcacacucaguagcuagagcuaaguggacuggaaggcugaggcucugacucuaaacccacucagggucaggggcuugcaggaggccaucaaggcuucuaauacccuaaccaucuccagggaggccugugcccugguuggggcuuuguaggaccagaucaccagcccuuggguguccugagcuaccugcagugacauugccagucaugggugcuucaauggcugcuggucugagagacaguggaaggcccuucaucucagcaagccauagugcccagcccuguaugagcagaguagagugggcuagggcccgggggacacucgccuucgcucucuuggggagacauuaguaagaggcauguuacauacugagaugcuguggaccauuuccagagacaggccaggccuuuggccuuuccuccagggauugugaaaaaaacaguccagccauaaaggugugcacacaacuucaucuucagccuuggaacuguuccccucugcacaucaguccuuucuaguccuuccagaacauuccugacuccuuaugccgccgggcugccuaaugacuaucaccaccagccacaaggugaggguuucucucucaggccuucugguggcuacaagagacacugacaugggggcucuaccccaggacccaacuuccc

SEQ ID NO: 2312 - RNA, 2065 nt, Mus musculus
ggugucagugaugggggaaugccccaaagcccacugccuuuacugguaaggcagggguaaagcaggcagagagacagacacaggcacaugaaacugacucccagggugggagugggggaaaaggagucaggaggauguucuaagagacaccagucucucuucuggucucccagaugaccugcaccugaccugcaucucucuugccacccagcuaucuaaucagccccaggaaaaccaucuuuuagccucugaugagacuuaaguuuuuccuucuaucucuccucucuuuucuuuccuccucucuccccuccuuuccuuuugucuuucugcccacuuucugucuuucugccucccccaucucuucuucuuccucuccuguucugucccucuccaaauuuccagggacaauuuaaaaagaaguccugucagugguguguugagaaaagccaccaaaaguaacacugugcagguucguuaccucuaguuucugucccacacacccuuguuaucacccuuagauacuggcaacuucaacugccagggcuacccaggacccaggcucuucucuccuuggauucaggugacauggcuuggauuuguuuccuguuccugguuuuacugugaagauggucuguggagaguggucucgccuccugacacugggugacuuaucaauucuguuuuauuuucaagugggcaagucuauguaugccaggagcccgugcuucccccacggucggcgauaaaucgugacugagugcuaacagcauacacauugccucccauuaaugcuuccugugucgggaugccgggcuagagccaguugggcugcacgaggagcuuucccgcuggaggagugaggccucugggcugccuuccaguccuaacuggaagcuaaugcuuucacacauucacaaaacccaugcuaggggugcaggcgcagcugggguuggccugggucagagaucacaauggguccucaaggcccugggugaugacucccacccagguggggcacacagaagaguguggggugauugcacggcaggaccccggagggcgugacugucaagguccugaaacgacagcuucugguuucuguggauguuuuaaucuuuuguuuuucccuguuuugcuucuuguuuugccugcauugggaggggggggggcagacuuugcaccucugaggcccucuguccugccugauuugagaggugggagccagucucugcaccccugaggcccuccugcuccuccacaccggggcuccugggacacugcgcuccuaugccuggcaagccuucccauccugacucaggcaccggggaugacuaaucaugacagaguguggggaucaacuccggucccuccagagccaagcggaacucccgggagcauuucguagacagcuagugguuaaauuccuuuucaacgaaauguauucucgccuuuaugucuaacccuccgugggcugaaggcuguggaugaggcggcagaaaccacauccuccuucauccccacccggcagaacagaagugaacagcaacagcaggaguccugccaccgaccagcuccuuuagggaggaacagccccgagugcccauguggguuucaccgcacgugcgugacaccaacuuaguccuuuauagacaaacucauggucuucucaugaccgguguacauguugccuuuuaacccacacgccaaggcacagaugugcgcgcuaugugcacgugugugcgcucaugccuugagaagcccuugucccugcaugcuaaggucacacguguuccauacccaagcacacuuuucagaauuauuucuggaagaauguugaaucucauaacagcaauaaaaggaaaacacuggcucagccaacacaaacgugugucuggaacaugcuccaaaaaaacaggaaugugugugaguuugaaaucccagccccagcucuaagcucugccuauagcugggcuuuguagaaaagggugaaggaugucuucccagaagccccucacaucaucggaguagucggugacugcuggccccagguuccugaggcgucccu

SEQ ID NO: 2313 - RNA, 9567 nt, Mus musculus
uaauuaaaauauaauuccaugagaaaucagcauucaaauguaaggaacucuucuucuaacuuuccccaacagacaugaacaaaugcuauucaccccaaauauggcacuaaggacggaccccuagaacuaguguuacagagguuucgagccaccaaaaucaaggcuaagguugcuugcaggaucacaagcaacuuaaaagcuuccccucugagcacugguuaacugcaucuguaucccgggaagggagugauggugccuuuaugguacggguccugaguacccucccaccuugaaagaguguuaguagguucaagcuugcaaggguuucuggguuucuaauauguaaucacaguagcucuggguucaagacagcuauguccauacucugcccagaggaaaaagcuccacaacuccacacucauguucaaagcuuuagcuuucaaagugaccacacaaauacagaauggucccagcauccuggaacaguuuggagaguagccuacggacaccagguccaacacuuaggaaaagggugagcccgugaguguauucuucacggcuaccccugcagcuggagggcucuacuguguagguuugaauuuaaccuaucccuucuuuggauguaauuaaccaaacucaaagcaagagaggacacacccgucaccauuucuaccuguuucuaaggggugaguaaaaaguccuccacccacucccuguggguuaccaaucagccacaaguaagagaguguuauuauaacccuaacccugaccccagugugugugaacccuggcaauuccaugaagaguuaaauagagccagucgcugaaggucacauggugugugauuuaaaaaaaaaauguccagaagaggcaaagcuaccaagacagaauguagauuuuggcugcaaggaacaacugagaaaguagugauguccccuguguggcagguggcaguucuaggccugagagcaggugagccauacaccaagugucucuucagccuccagacgacgauggcagagguucauugggggaaacacaggaaaauaucgcugacccagaucaggugcccaacagauugaacuguguggcuuuuauucuucaagagucacugcaagcgcuggaaagaugacuuagcucuuaagagcacuugcugcacccacauggugguucacaagcuucuguaacuaggggaucuaaggcccuccucuggccuccaugguaaacauacacagaggcaaaaagucauugcacaccacuuaugugcuaugcaguuacaggccccaagaauacagcagugacccaauuagaagggccuccaguuuuccucgaggucacaucuuuauggaaaggcaaggcugaaugcaugacuugccuaguaggcuacaaaguuucgagugcacugaggacacagagugggugaggacuuggcccaggaaaaguuuaggauauaacucuuaggacuucacaugucagaaggcaucuuuccccagcaauagcugauggauaguugagcugggaauagaauucuaguguguggagacaaauuuuucauucagagcuagaguguuggccagcauuguuuuucuuucaggggagcugagaaguccaagggagauuccacugccucagguuuugugugacuugcuuuuucucuuggaaaagcguagaaucuuccgccugagguguuuccauguuuuccugagcguguguccuagaguggguaucucuuuccaucugcagaggaaacuuuaacuuuuggcaauuuucuuaaaacacacuauugguggucuuccacuuuauguucuccauccuugaauuuugcaacuugaggguugagguacuuuccuguccucguauaggacaugcauaugccagaugucugucgccccuuggcugacucucagauucagggcugguuguguccauauuugagcuccaucacugggugguggauccugaaugcugucaucuugaggaacucauuuggucucccaggggaucuuccagagagccacuggaggagucuggcugucucugcagcucuggagaauaaaccuugggauuuuugcuaacagaagagaaagacaguuaguugcuccauggggaagugaaggggagcuagggauuuauaugcucauagcauacugccagucuaaauugcugauuauagcaacucccacacuccucccaggaacauuuuuauuaauccugaguuuagggugcucuauccuccagcccagggcaauuuuucucuugcucucuguguucucuaggacuuauauagacuucagcugugauuccagacccagcuaguuccuguaggagggagucacagcccugauacuccagccccaacacaggcaagggaaggagcaggcacaucugugaauaugaaacacugaagugagauguaacccaacggcacagagggauguaacccaaaggcauggagggaagguaacuucuuugcccuguaccccaaaucuucuucacccucauucuggugaaacagcucucagaggucccugagugauccuccccauaaccacacccccccccccggaaguucuugcaucugggucuagaggacagagccccuccaggaccuuguggugacugucuacuccggucuuccagccuccugcuuccugggcauucugaggagggcaggagaccucaagggaggagccugggacaggggagucucccagaccuuccucuugucauaauacccuccuucugcuuuaacucaugcucagucacuacagguuuucauguaggucagggaacagugcucucccagcaagcuucuggcgucuucuguccuacaugggacccucauggaugaauucagcagcucuggaagcugaagcagccuuuuccugcagaggaaaagaaggaugauaaagcugaagcaggccccuccugagacccuccuggguagagucugggucacucugaggcucacugugauuccagccaggugugguagggacacugugguuggguugggggcuaucuucucuguagccucuauccaaauaacccugugaucccacacagucaccuguugggucaugcuggacucccugcaaaugagccauggcagaaacagcugcccuaggcuccaaggcuuuuauagguuugccuuaaagauuuuauuccagaaaaaacccaaagcaauuaauucaaauuacagaguagucguuugcgauaauauuugcuuuaaauauaugguuuuuucuuaaaaaaaaaaaaaaaccccucagcugugggccuugagugaguucgaggugaaggacaccuugaaauaauuacauuuuugcucauuuuauguugugaaaacggcuuagucaauuugggaagaacguaaaguguucagcugacuccccuauaaaggcugugcuauuucucuucccgucucugccagcgugaccacacugggaucguucgcccuuucgccucaaagguggaugucuuccaaaaggcgcccaggcacuggcccagcugccucuccgugcaguucuuggcagcagugaggagcaaggccucuucuggagguccaccugauggguggcuucgggaagccuggagaacaggcucuguguccgggaguccuugugcugacccacagcuggccaaccguuccaguggaggugugagggaauaggggaucccccuacucaguuugccccaagaauggugauaggggcuugaccagagaaugaguguagcucagagcagggcagcgggcccagcuaggauuguagccaguaugugccucuggagagaggcucggagccuggaaagugggauuucauuaagacgaaacuguguugaacagcaucagaaugugggucugcucagacugaggagccugagugaugcucucacagauuaucaaggauccuaggcaggacccuccccuccccucuaccacaccaggcgcaugcguggaguauagguaaguucucuuugcguaccgcuugcccuuucucucaauuguuuuugguauucuguggaauuaaaauuuuucuuucuauuguucguauuuaacauguguacaugugggugugcacaugucaugcgcucgagcagaagccggaagacaguuucuaagagcuuauucuuuccuucuaccgcguggguccuggggauugucaucacaccagccugguccuggggaaguuaauccaggucucacaagugcuaagcaauuacuccaccauggaacuucacccuggcccaucuuuacauuuucucaugucuuuuuaaaacaauuaaaagagggucucauguagcccaugauagccuugaaccugcuguguuuguaacugaagauaacucacuuccuuguguuuaggaucacaaguacacacacccccuccaggauuuauucagugcugcaggcagacccagaguuucccaucuucuggaccuguaccaaccaagccaccccugcuccgcaccgacucccccacccccgugguuuuuuuuuuuuuuaaggaauccacauuuuaaucacgcccuacauuuuuuucacuuacaaauuguuugcauuucuguuacacuuuaaaaaauccuugccuaacacaaagccaaaacuuccuacuauguuuuucucuaaaaaucuuauguauuuauguuuagacugaaauauacaucaauggccccagcuacucaagaggcaagggggucacaugcacccggaaguugggggcaaguuaggacagcacagcagaaagcccaucuuuaagacaaaguuaaggggccggagcaauggcucagugguuaagaacacuggcugcucuugauagagguccugagguccuggguucaauucucagcacccacaucgggugguuguguaccaacugcaaacuccagguccagggaucugaugagcucucuggguucuuuuguacacagggugcacacucauauaaacacacaaacguagucauaaacaagaucuuuccaaaauggaaaacuuacggggcuaguauuuauguguugaaggugcuauuuauuuauuaaauaugugugaagguuuugccugcuuugcauguguauguaccccaugcccuuccaggucagaagaagacaucagauccccugguuggccugcagcuuguagaccaggcuagccucauacucauggcuauacaccugccccugccccugccccugccccugccccugccccugccccugccccugccccugccucugccucugcuuccagagugcugggauuaaaauuaucccagcuguaccaugcuuugaaauauagcaugucuuuccaauucugugggguuuuguuuaggcuacugugcuggcuaguuuuaugucagcuugacacaagcuagagucaucaaaaggaaggaaccucagcugaggaaaugccuccauaagaucugcuguagggcauuuucuuaauuagugaugggucggggaggccccagcuaauuguaggcggggccauucccacuuacaguuguccugaguuuuauaagaaagcaggcugagggcuggagagauggcucagcggugaagagcacuaacugcucuuccagagguccugaguucaauucccagcaaccagaugauggcucacaaccaccuguaaugagaucugccacccucuucuggugugucugaagucagcuacaguguacuuaugcauaauaauaacuaauucuuugggccugagcaagcggaguugaccugacuggagugagcaaagguccuaaaauucuauuuccaacaaccacaugagggcucaaaaucaucuguacagcuacauuguacuuacauacauaaaauaaauaaaucuuaaaaaaaugauaaaggccugugccuuuaacaccaguuaagaguucaaagccaguuaagccuauauaagcaagaccuugucucaaaaucccuaaaagaaacaaagagccuauuuauguagaugaaaugugaccugugcaaaaauucuaaauaaugacaaacauuauugucaucauggucaucaucaucaugaggucaguacuaaucuauauaaaaggucaacacaugaacacccagcacacaaguacauaacacauauacauacaacacaaguauacauaacauacauguacccacaacacauacucagaacauaugaucagaauacauauacacauagcauacaguauacacacaacauguaugcagagaauauaauauguacauacaauauacauagcuguuuguauaacuuccauauacaaacacacauauauacacauauacacacauauauauacacacauauauacacacauguauacauacauacacaaaacauauauauauauauacacacacacacacacacauguacauacacacauacaacacauaccaugcacauagcacaggacauacauugaauaagcccauagaaaucauguaugugugugugugugugaauguguguguguguaaugauacauacacauaauauauacacauauuccauagaauggcugcccaaggcagaggaggaauggaagaaugggaucaugaaaaaugacagaggcaggugcugaggaguggcagccauauccaugagugaggaacucagguagcuggacuccuuaguuuucuaacgggggugggggcacagggggcagacacaacaccucaggcuuggcuggaagcgcucaauuacccagcauuaccaucugucucugugucucuuucuccuccugugugccuuuugccucccaaaaucuggcauuccuggaguccugaaaggcugaaaggaggagggcauguccucccuccccgugaccaccccaugggucgcuccugggccacagauccuguuaacuugcccaaugcacuugaccagugucuggguggucugcuacauugacuccuccggaaaccugaugcccuccagccagugcaucugucugguagauuuccagugggaggggcagggcuaccuccccgaagcacagagccugacagccacaccacagcauucccaggcugcagcagggggaugcccccuccagucucaggguuuaggagcagaaggaccagcuggucccagcugcagcucagcgggacagagaccaugagaagauauuccccccaccccguccucucuaccucccuauuccaguccugucuuacccucgugcuggaacccacaccagccacuucagcuuccuccaagguaugcugagggggacucuagauucccgaaguggcuuccacagcugaaggaaggagcuggagcugaaacuugccuccugcuggccaccagugugcucuuucauucucaugugcccacccugucaucugucucuaagcugacuucuuccucucaacaagauuuucacacugucuguguuuuccacacgaggagcuugcccuuaccaaggucacagagcugagcucugaaacuugacugguuugcugucuuggcacauggaucuuagaugcugucugugguagucugaggcauaugaagaaggggaacuucucuguggcagugaggagacacagggagaugggucaggggcucggaacaaggucaccugaaggaugcugaguuugagggugucaaccagcucuaauuaugucauuccugcuucuccugcccaacuuaguugucaggaccuggggaaggaugccaugucugaguguucuuggaaggaaaugaaaguguaaucucuuaagaggcugaaaccaccgcucugagacaauguuuuuaaugggacaaccauuuuacuuagcucaauucauugagaagggugaauccaaaagacaaaauggagucaagaccuuuugggcagccaggagacuaaggacuuugccauggacauccacuguagauccucacuggaggaaaccaggagucuaaggaucuucacuguggacacccauuguacauauucacuaacuccugagacaagaaucuuagacauguucacuucguccuguucauggaaagggacagcucagaguguggagaacacagaucuggaauucacagacgcuggaaagggccugccagauaaguggucucugagggacaucuagaaaguucucuuucaaccuccuuccuuccuuccuuccuuccucuuucuuccuuccuuccuucuuuucuuccuuccuuuucucucucucucuuucuuuaaaauauuguuuauuuaauguauaugaguacacuguagcuaucuucagacacaccaaaagagggcgucagaucacauuacagaugguugugagccaccaugugguugccuggaauugaacucaggaccucuagaagaacagucagugcucuuaacuacuguguccauuucaaagcuaaaguuucuacugacaggcuucaauaacccuuauccuccccaugugacaucucucaguggggccauugauucaagugagccuguugucaccgcccuggcuagacucugagcgaacaagggcuguguuucucucccugacaugcucaggcuagcacaggauggugauaaugauggguggccaugucuccaaucccacugcagcauccauugacucuggucugaguggagggaggcacugcuguugccucuggaucuccaaggaagaagccgaagcucuucacaguggugauacuugagcagcugggaguugaggggagaucucacuacccucaggucccuccugcaggccacuuaagugaaagaccagcaccagaagaugucacacagggggcaacccugcagcagcagcaggacacugugauggaauggcuucagguaccugagcugaggcuagaccuggggagagcugacaguuucccagcuuaggguauccagugagacaaacacacuggugguuccuugcugcccugugacaggacucaggcuucucauaagauuuauaggaggaaugguuggcuaggggugggcggccucaauggagcaccacgaagggccauucagcugggguuugcaucagccgcuuuucugguugcugugauuggaaaugacuuacuuuggcucaugauucgaggguguuauccauuccauaaaggaagcacggaagugcgagacgugcggcuguggcaucaggaacagagggcugcuuguucauaucucagcggaucagggagcagagaaagcagacaaauuccagagcuugucuggcucuccucgggaccacaguucacaggugggucuucccccacccuuaauccucuccaaaaagcuucagucuccuaggugauucccaaauguaggcaaacagacaaugaggaucagccaucagccacucgucucagguccaaggccaguuccaccaucuugguguguuuccugugacuggaguagaaaucccaagacugagugaccguggacauagaggcucguuuggcuuccgguuuuggcagcugggacucugagaacugguccagcuucuggcaagcagccaugcugcuccgaccucuggcaggaggcaggguaaguagagcuugcagaggagacggaccaggggacuggcagccucucccggcagcugcccucacug

SEQ ID NO: 2314 - RNA, 9567 nt, Mus musculus
cagugagggcagcugccgggagaggcugccaguccccugguccgucuccucugcaagcucuacuuacccugccuccugccagaggucggagcagcauggcugcuugccagaagcuggaccaguucucagagucccagcugccaaaaccggaagccaaacgagccucuauguccacggucacucagucuugggauuucuacuccagucacaggaaacacaccaagaugguggaacuggccuuggaccugagacgaguggcugauggcugauccucauugucuguuugccuacauuugggaaucaccuaggagacugaagcuuuuuggagaggauuaagggugggggaagacccaccugugaacuguggucccgaggagagccagacaagcucuggaauuugucugcuuucucugcucccugauccgcugagauaugaacaagcagcccucuguuccugaugccacagccgcacgucucgcacuuccgugcuuccuuuauggaauggauaacacccucgaaucaugagccaaaguaagucauuuccaaucacagcaaccagaaaagcggcugaugcaaaccccagcugaauggcccuucguggugcuccauugaggccgcccaccccuagccaaccauuccuccuauaaaucuuaugagaagccugaguccugucacagggcagcaaggaaccaccaguguguuugucucacuggauacccuaagcugggaaacugucagcucuccccaggucuagccucagcucagguaccugaagccauuccaucacaguguccugcugcugcugcaggguugcccccugugugacaucuucuggugcuggucuuucacuuaaguggccugcaggagggaccugaggguagugagaucuccccucaacucccagcugcucaaguaucaccacugugaagagcuucggcuucuuccuuggagauccagaggcaacagcagugccucccuccacucagaccagagucaauggaugcugcagugggauuggagacauggccacccaucauuaucaccauccugugcuagccugagcaugucagggagagaaacacagcccuuguucgcucagagucuagccagggcggugacaacaggcucacuugaaucaauggccccacugagagaugucacauggggaggauaaggguuauugaagccugucaguagaaacuuuagcuuugaaauggacacaguaguuaagagcacugacuguucuucuagagguccugaguucaauuccaggcaaccacaugguggcucacaaccaucuguaaugugaucugacgcccucuuuuggugugucugaagauagcuacaguguacucauauacauuaaauaaacaauauuuuaaagaaagagagagagagaaaaggaaggaagaaaagaaggaaggaaggaagaaagaggaaggaaggaaggaaggaaggagguugaaagagaacuuucuagaugucccucagagaccacuuaucuggcaggcccuuuccagcgucugugaauuccagaucuguguucuccacacucugagcugucccuuuccaugaacaggacgaagugaacaugucuaagauucuugucucaggaguuagugaauauguacaauggguguccacagugaagauccuuagacuccugguuuccuccagugaggaucuacaguggauguccauggcaaaguccuuagucuccuggcugcccaaaaggucuugacuccauuuugucuuuuggauucacccuucucaaugaauugagcuaaguaaaaugguugucccauuaaaaacauugucucagagcggugguuucagccucuuaagagauuacacuuucauuuccuuccaagaacacucagacauggcauccuuccccagguccugacaacuaaguugggcaggagaagcaggaaugacauaauuagagcugguugacacccucaaacucagcauccuucaggugaccuuguuccgagccccugacccaucucccugugucuccucacugccacagagaaguuccccuucuucauaugccucagacuaccacagacagcaucuaagauccaugugccaagacagcaaaccagucaaguuucagagcucagcucugugaccuugguaagggcaagcuccucguguggaaaacacagacagugugaaaaucuuguugagaggaagaagucagcuuagagacagaugacagggugggcacaugagaaugaaagagcacacugguggccagcaggaggcaaguuucagcuccagcuccuuccuucagcuguggaagccacuucgggaaucuagagucccccucagcauaccuuggaggaagcugaaguggcugguguggguuccagcacgaggguaagacaggacuggaauagggagguagagaggacgggguggggggaauaucuucucauggucucugucccgcugagcugcagcugggaccagcugguccuucugcuccuaaacccugagacuggagggggcaucccccugcugcagccugggaaugcugugguguggcugucaggcucugugcuucggggagguagcccugccccucccacuggaaaucuaccagacagaugcacuggcuggagggcaucagguuuccggaggagucaauguagcagaccacccagacacuggucaagugcauugggcaaguuaacaggaucuguggcccaggagcgacccaugggguggucacggggagggaggacaugcccuccuccuuucagccuuucaggacuccaggaaugccagauuuugggaggcaaaaggcacacaggaggagaaagagacacagagacagaugguaaugcuggguaauugagcgcuuccagccaagccugagguguugugucugcccccugugcccccacccccguuagaaaacuaaggaguccagcuaccugaguuccucacucauggauauggcugccacuccucagcaccugccucugucauuuuucaugaucccauucuuccauuccuccucugccuugggcagccauucuauggaauauguguauauauuauguguauguaucauuacacacacacacauucacacacacacacacauacaugauuucuaugggcuuauucaauguauguccugugcuaugugcaugguauguguuguauguguguauguacauguguguguguguguguguauauauauauauauguuuuguguauguauguauacauguguguauauauguguguauauauauguguguauauguguauauauguguguuuguauauggaaguuauacaaacagcuauguauauuguauguacauauuauauucucugcauacauguuguguguauacuguaugcuauguguauauguauucugaucauauguucugaguauguguuguggguacauguauguuauguauacuuguguuguauguauauguguuauguacuugugugcuggguguucauguguugaccuuuuauauagauuaguacugaccucaugaugaugaugaccaugaugacaauaauguuugucauuauuuagaauuuuugcacaggucacauuucaucuacauaaauaggcucuuuguuucuuuuagggauuuugagacaaggucuugcuuauauaggcuuaacuggcuuugaacucuuaacugguguuaaaggcacaggccuuuaucauuuuuuuaagauuuauuuauuuuauguauguaaguacaauguagcuguacagaugauuuugagcccucaugugguuguuggaaauagaauuuuaggaccuuugcucacuccagucaggucaacuccgcuugcucaggcccaaagaauuaguuauuauuaugcauaaguacacuguagcugacuucagacacaccagaagaggguggcagaucucauuacaggugguugugagccaucaucugguugcugggaauugaacucaggaccucuggaagagcaguuagugcucuucaccgcugagccaucucuccagcccucagccugcuuucuuauaaaacucaggacaacuguaagugggaauggccccgccuacaauuagcuggggccuccccgacccaucacuaauuaagaaaaugcccuacagcagaucuuauggaggcauuuccucagcugagguuccuuccuuuugaugacucuagcuugugucaagcugacauaaaacuagccagcacaguagccuaaacaaaaccccacagaauuggaaagacaugcuauauuucaaagcaugguacagcugggauaauuuuaaucccagcacucuggaagcagaggcagaggcaggggcaggggcaggggcaggggcaggggcaggggcaggggcaggggcaggggcagguguauagccaugaguaugaggcuagccuggucuacaagcugcaggccaaccaggggaucugaugucuucuucugaccuggaagggcaugggguacauacacaugcaaagcaggcaaaaccuucacacauauuuaauaaauaaauagcaccuucaacacauaaauacuagccccguaaguuuuccauuuuggaaagaucuuguuuaugacuacguuuguguguuuauaugagugugcacccuguguacaaaagaacccagagagcucaucagaucccuggaccuggaguuugcaguugguacacaaccacccgaugugggugcugagaauugaacccaggaccucaggaccucuaucaagagcagccaguguucuuaaccacugagccauugcuccggccccuuaacuuugucuuaaagaugggcuuucugcugugcuguccuaacuugcccccaacuuccgggugcaugugacccccuugccucuugaguagcuggggccauugauguauauuucagucuaaacauaaauacauaagauuuuuagagaaaaacauaguaggaaguuuuggcuuuguguuaggcaaggauuuuuuaaaguguaacagaaaugcaaacaauuuguaagugaaaaaaauguagggcgugauuaaaauguggauuccuuaaaaaaaaaaaaaaccacgggggugggggagucggugcggagcagggguggcuugguugguacagguccagaagaugggaaacucugggucugccugcagcacugaauaaauccuggaggggguguguguacuugugauccuaaacacaaggaagugaguuaucuucaguuacaaacacagcagguucaaggcuaucaugggcuacaugagacccucuuuuaauuguuuuaaaaagacaugagaaaauguaaagaugggccagggugaaguuccaugguggaguaauugcuuagcacuugugagaccuggauuaacuuccccaggaccaggcuggugugaugacaauccccaggacccacgcgguagaaggaaagaauaagcucuuagaaacugucuuccggcuucugcucgagcgcaugacaugugcacacccacauguacacauguuaaauacgaacaauagaaagaaaaauuuuaauuccacagaauaccaaaaacaauugagagaaagggcaagcgguacgcaaagagaacuuaccuauacuccacgcaugcgccuggugugguagaggggaggggaggguccugccuaggauccuugauaaucugugagagcaucacucaggcuccucagucugagcagacccacauucugaugcuguucaacacaguuucgucuuaaugaaaucccacuuuccaggcuccgagccucucuccagaggcacauacuggcuacaauccuagcugggcccgcugcccugcucugagcuacacucauucucuggucaagccccuaucaccauucuuggggcaaacugaguagggggauccccuauucccucacaccuccacuggaacgguuggccagcugugggucagcacaaggacucccggacacagagccuguucuccaggcuucccgaagccacccaucagguggaccuccagaagaggccuugcuccucacugcugccaagaacugcacggagaggcagcugggccagugccugggcgccuuuuggaagacauccaccuuugaggcgaaagggcgaacgaucccaguguggucacgcuggcagagacgggaagagaaauagcacagccuuuauaggggagucagcugaacacuuuacguucuucccaaauugacuaagccguuuucacaacauaaaaugagcaaaaauguaauuauuucaagguguccuucaccucgaacucacucaaggcccacagcugagggguuuuuuuuuuuuuuuaagaaaaaaccauauauuuaaagcaaauauuaucgcaaacgacuacucuguaauuugaauuaauugcuuuggguuuuuucuggaauaaaaucuuuaaggcaaaccuauaaaagccuuggagccuagggcagcuguuucugccauggcucauuugcagggaguccagcaugacccaacaggugacugugugggaucacaggguuauuuggauagaggcuacagagaagauagcccccaacccaaccacagugucccuaccacaccuggcuggaaucacagugagccucagagugacccagacucuacccaggagggucucaggaggggccugcuucagcuuuaucauccuucuuuuccucugcaggaaaaggcugcuucagcuuccagagcugcugaauucauccaugagggucccauguaggacagaagacgccagaagcuugcugggagagcacuguucccugaccuacaugaaaaccuguagugacugagcaugaguuaaagcagaaggaggguauuaugacaagaggaaggucugggagacuccccugucccaggcuccucccuugaggucuccugcccuccucagaaugcccaggaagcaggaggcuggaagaccggaguagacagucaccacaagguccuggaggggcucuguccucuagacccagaugcaagaacuuccgggggggggggugugguuauggggaggaucacucagggaccucugagagcuguuucaccagaaugagggugaagaagauuugggguacagggcaaagaaguuaccuucccuccaugccuuuggguuacaucccucugugccguuggguuacaucucacuucaguguuucauauucacagaugugccugcuccuucccuugccuguguuggggcuggaguaucagggcugugacucccuccuacaggaacuagcugggucuggaaucacagcugaagucuauauaaguccuagagaacacagagagcaagagaaaaauugcccugggcuggaggauagagcacccuaaacucaggauuaauaaaaauguuccugggaggagugugggaguugcuauaaucagcaauuuagacuggcaguaugcuaugagcauauaaaucccuagcuccccuucacuuccccauggagcaacuaacugucuuucucuucuguuagcaaaaaucccaagguuuauucuccagagcugcagagacagccagacuccuccaguggcucucuggaagauccccugggagaccaaaugaguuccucaagaugacagcauucaggauccaccacccagugauggagcucaaauauggacacaaccagcccugaaucugagagucagccaaggggcgacagacaucuggcauaugcauguccuauacgaggacaggaaaguaccucaacccucaaguugcaaaauucaaggauggagaacauaaaguggaagaccaccaauaguguguuuuaagaaaauugccaaaaguuaaaguuuccucugcagauggaaagagauacccacucuaggacacacgcucaggaaaacauggaaacaccucaggcggaagauucuacgcuuuuccaagagaaaaagcaagucacacaaaaccugaggcaguggaaucucccuuggacuucucagcuccccugaaagaaaaacaaugcuggccaacacucuagcucugaaugaaaaauuugucuccacacacuagaauucuauucccagcucaacuauccaucagcuauugcuggggaaagaugccuucugacaugugaaguccuaagaguuauauccuaaacuuuuccugggccaaguccucacccacucuguguccucagugcacucgaaacuuuguagccuacuaggcaagucaugcauucagccuugccuuuccauaaagaugugaccucgaggaaaacuggaggcccuucuaauugggucacugcuguauucuuggggccuguaacugcauagcacauaaguggugugcaaugacuuuuugccucuguguauguuuaccauggaggccagaggagggccuuagauccccuaguuacagaagcuugugaaccaccaugugggugcagcaagugcucuuaagagcuaagucaucuuuccagcgcuugcagugacucuugaagaauaaaagccacacaguucaaucuguugggcaccugaucugggucagcgauauuuuccuguguuucccccaaugaaccucugccaucgucgucuggaggcugaagagacacuugguguauggcucaccugcucucaggccuagaacugccaccugccacacaggggacaucacuacuuucucaguuguuccuugcagccaaaaucuacauucugucuugguagcuuugccucuucuggacauuuuuuuuuuaaaucacacaccaugugaccuucagcgacuggcucuauuuaacucuucauggaauugccaggguucacacacacuggggucaggguuaggguuauaauaacacucucuuacuuguggcugauugguaacccacagggaguggguggaggacuuuuuacucaccccuuagaaacagguagaaauggugacggguguguccucucuugcuuugaguuugguuaauuacauccaaagaagggauagguuaaauucaaaccuacacaguagagcccuccagcugcagggguagccgugaagaauacacucacgggcucacccuuuuccuaaguguuggaccugguguccguaggcuacucuccaaacuguuccaggaugcugggaccauucuguauuuguguggucacuuugaaagcuaaagcuuugaacaugaguguggaguuguggagcuuuuuccucugggcagaguauggacauagcugucuugaacccagagcuacugugauuacauauuagaaacccagaaacccuugcaagcuugaaccuacuaacacucuuucaaggugggaggguacucaggacccguaccauaaaggcaccaucacucccuucccgggauacagaugcaguuaaccagugcucagaggggaagcuuuuaaguugcuugugauccugcaagcaaccuuagccuugauuuugguggcucgaaaccucuguaacacuaguucuagggguccguccuuagugccauauuuggggugaauagcauuuguucaugucuguuggggaaaguuagaagaagaguuccuuacauuugaaugcugauuucucauggaauuauauuuuaauua

SEQ ID NO: 2315 - RNA, 16813 nt, Mus musculus
cuggccgggcacuuucaaaauggcggagcguggagcgaguggcggcgggagcggcggggacagucuggacaagagcaucacgcugccccccgacgagaucuuccgcaaccuggagaacgccaagcgcuucgccauugauauagguagacacggaccggguacucaagaaaguggccggagcagugggcgcgggcggccagccagcgggggcggcgggaaggacgaagggcgggggcgcgggccaugcgcacagccucacgggucgccgcacagccucucgggacucauagugugcgcggcgucaaggugcgggaccgagcgggcugugggacuccagcucccgguaggcgcugcgcgguuggagcggggcacgucgggccucguaguccgcgcagcgccgguggcucaguggagggacgggcggggcggguggccucggggguccucaucugcucagagucccccgggaugaggcuggccauggccccgcggcgcacuccgccggaguuccggcuucccagugagcuguggagacguugggccuggacacuugucgagcgcugcagcguggaccguggcuacggccgccgccuccugcgcgccuaggaguucaccuuccugccgacccgcuacaggcccaccuuagauccccuucgcgcguugggcagccucaugcccacuaacaaguccucgggggagguucuuucaucgcccuggugugcagaugcggagaccaaggcacagaagaaggcuagcuuucuccguggucucucuauucguagauccaggaugggagccggccaacgcucccccucccccucccccaccccuaccccugucccccaagcucucugcucugcauccuguuauugaggagcuuuguacccaauugcuugcaggcguuuccccgcguaucucuugaugccagcauugucagugaggccccacacagccgggcagcauccgcagucuuggacuuaucuccgugaaucaaugggugugcugcuggcucuuagccuccuuggaaagccuagguuguuaagagacugugaagaaucucguuacuucuggaauauugaauaagucccccacccucuugcuuuuggguugucucucugacguguucuuccuugggaggaaugaggaauggaagagaaaguaaagauggccugcuggcuuguccuguguuccagcuuuaucaagggcucaggagggugguggagugggccaagauucuacuagcaccugagauaacucggugacuggcuguauauuaguuuagaagugaugagcuugcagccccagcagaggggacuguccacaaccugaccucuccaaaggccccaaggcagcuguuccaggauccugaaaccuucacuccagggcuggguuuuaugcuuugcccuguggucuuauacuuauucauuaggaaggaggcaaaauuaaauaacugugucuggaaagcaggugaaaaugaauucaaacaucaucaggcaguuaagaaaauaggguucaccucagauaaucuauuugguaccuagagaccaucuaaccaacagccaauaaagcaugagcuguaguagagaggugccuucgagcugaaggccugaggccagaccagggcugucuggacagaaggacauugcaagggauguucaguguuggguuuugcuuccaucgucgucuggguccugaaucugagauuggaaagucauguguuccugaaaacagaccuuuuuucuuuuguucuuucuuucuuuuuuuuucugcaacugaugggaggucacagcucaggaugggguugacagcuuaggcaccuacaaaacaucuugucgcaguguuguuuaaaaacagccuucuccuguuuccuccuuccucacugugucccuggauccaggaaggcucagcugcucuguguucuuggcaagcccuuuuucuuucuuggaugggacaccgaugucagcugaguuggaaacccaggcaguaggaaggacauacaggcaggaagagacucugggguaguaaaugcaaggcuguccugcccuucuuggugccguggugaaagucaaaggacaacuuggugggauucucuucuuucaccauguggguccugggaaucaaacuccagacagcaagcuccuuuacucccggauccaucacuggguaaaguacaccuccauccauuugcgcagcuuugucuuuuaggaaacaguguccucggagugaguuacaaaagcauguaggaucagacaagccugaggacaggcucggauugggggcaggagagcgagaucaggaggcuuaggacuguggccggggaugagauuaagcacaugauacacucacuaaaccaaaaaugggccucuccgugcccugcuuggacaggacagacugcauugugucaguuucacugaggggagaacucuggccuccaaacaccuugguccugcacgucugugaauuugagcaucugcucuccuguagucccugaguauuuccucaaagccaacacuuacagauaucuuagccuauuuacuuugccacugagaaaccuuugccuggucaggccucugagagauggagcugcaguagggugcagacacucccguuuucccccugugucaccugggggccugugaaucugcaggugcuucuacaaacuggaaagugucuuuucugccuacaggggcuuguccuugauauguccuucucuggaacucuggggaacucuccccggaguguguggcucaaguggacagaggucuugugcuuuuucuggagcccagagguuggcagugugcaguauuccauggugacagggcucugugaagauguggaaagccugccugacuccagguguggugauuggugcacaccuuuaaucccagcacuugggaggcagaagcagauggaacgccauagguucaaggccagcucggucuauauuacagagacccugccucacaaacugaagaaaauggauaagcaguaggaaaaaaaacacugacuuuuuuuuuuuuuuuuuuuuuuuuugguuuuucgagacaggguuucucuguguagcccuggcuuuccuggaacucacucuauaguccaggcuggccuugaacucagaaauccgccugucucugucucccgggugcugggaucaaaggugugcgccaccacuccugaugauucuuuaagaggacucuccuguuccauucccaacaaccaccuguaacuccauuuacaggggaaccgacgcccucuucuggccuucucaggcacuucauggacauggugcucaggcauuuauuuaggcaagacauccauacacaugaaauaaaaauaaacuccccccaaauuaaaaaauauauaaaaaugaaaucuuuaaaaacagcaaacaaaagagccuggggccugugaaggcuguuuacuuucuuccuuugccuacuuguggguccugggcugcuccaugggcucaaaguccuaaaggcuguggccguuccugacccucagucccuguagguaagcccucccugcugaccccgugcaucucagaggugcuguguguuacccaccgugaccucuuaagaugagaggucagguguggcagacagcucugcuuauuuggggccugcaugugcaggcacgugucuaccacugagcuacaucccaucccucucuuuguaggauguuuuuuuaacaacucauacaugugucaugugucauguaugcaggggauauuucugcucaaguucucugcuugugcccguccuucuccucauuuugucuccccagacaucuuacuucucucgugucucacacgugugcgcacaugcacgcacacacacacacacacacacacacacacacacacacacacacacacguauaaaguccaggaagcacaaauaagaggaaugugcauucgucuuucugagacuggcuugguucaccaaaucugaucaucugaucauuuccccuuuucugcuaauuacaugaugucauucguuuauggcuggaagaaaacauuccauguacaguagaccacacuugcaucauguccucugcccucagcccacgucuuauguuuuaucgugagacaggaucucacuaagcggccugggcuggccuugagcuugugauccuccugucucugccuccaccuccgccucccaguuagcugggguuacaggccugcugcaccuccaggccuggcuuuguaaccgaguguuuagagagggauggucagagucccacgucagucugcaccucagaccuuucuuccccuuuuuaucucuagcuggcuuggagcuuuaccaaguaggcuggaguagcuggccagcaagcccuaggaguuugucugguuuuuuuccucuuccauuuugugauugcgggauuauaagcgcacaccaccauccuauggguucugggcaucugggcucagccccucaugguggcaaggcugaggcuuuaucaacagagccuuuccccagcucuugaaaaguaaauuucuuuagaacccaggacagccgagugcucuccaaggcaaacuggcucuggcucugccuuggggcuuugugagggugggagggaagccuugaacccagauucguuaagaacagcgauuggggagcuagagagauggcucagcgguuaagagcaccgacugcucuuccgaagguccugaauucaaaucccagcaaccacaugguggcucacaaccaucuguaaugagaucugacucccucuucuggugugucugaagucagcuacaguguacuuagauauaauaauaaauaaaucuuaaaaaaaaaaaagaacagcgaucgguacucucuccucucaucuaugacuucaaguucauaaagcacuaagguccuuauccacagacucugguguucauggaagaggcugcugaaaccccagagcauccgagagccugaggaaggagguggaucucagggucuccuuuucucuguucugaauuuuucgugguuuuugucuuguccgugcagguggaucauugaccaaguuggcauacuauuccaccguacagcacaaaguggccaaagugagaucuuuugaccacccgggaaagguaggcaaguauaucaguggagccggacggggugcugcuucccgcuggucuuggacuucauagugucauuuuuguuuguugucccuugcuguuuacauauguuaacacuaugguccuggaguugauugcucuucccugacuccuugugagguguccuuuccuacccuuugugagaauuccuccccuuccccugcuccuugucugaagguacgcaggccucuuaccugucuaugcugucuaugccuuggccuaagguaacaucaaguauuuuguguaucacaguugaguaaaugccuaaugugcuggggcagggugcucggggcuauccuugccucuugaagacuucuuaacucuuuccaggacguggagcaggaucaugagccacccuaugagaucucaguccaggaggagaucacagcucgccugcauuucaucaaguuugagaauaccuacauggaagccugccuggacuucaucagagaccaccuagucaacacugagaccaaggucauccaggccacuggggguggagccuacaaguucaaggaccucaucgaggagaagcugcgucugaagugaguuggggccguacuaguggugccugcgguacgguggggggcccugaacuucugugcugauuguggugccgagugcgggugcugccuagguggccuugccggcugcagaccuagggcccuuguggcacagucuggcugcccuaugcugccuccuaacaagugcaccaugguugacucuugugacuagguucuuuucuuuccaggguggacaaagaggauguaaugaccugcuugauuaaagggugcaacuucgugcugaagaacaucccgcaugaggccuucauguaccagaaagacucagacccagaguuucgauuucagacaaaucaccccaacaucuuccccuaccuccuagucaacauuggcucuggcgucuccaucgugaagguaagaguccacaaaaugacagcugaaugucucagcgccugcugacugugugugcugugucacagccuucacugggcuugggcagguuugacccuucacagagccauccucggcgugaucguugagcaccuaccauuugcgucggugccaccgaggguucacuuggaaaaguauggcagaaacucuugaggaaggacauggcagcccugaccccagcauccuagcagccuguguggccugcagcccagugcaugccuuuucuuccucagguggagacagaggaccgguuugaguggauugguggaagcuccauuggaggaggcaccuucuggggccucggggcucugcucaccaaaacaaagguauucccugcagaccguccacccuguggcccuuagaggggccguggcgcaugucugcagaagccacucccaagacucucuccuggcucuagugagaggucuuggauccccgugacugagcucuuuguacucugaagggcaagggcuuugaacugccggagcucugccagcucagugguccagcaucuagcuuuccaggccugcccuugccccuuaugcuggggagggccauucacgucugacugugcagucuccucucugcuauccaggguggugagggugcccuggcugcuagacccucaccaccccgcggugcucugcuuugccuccacagaaguuugaugagcugcugcagcuggcuuccagaggccggcaugccaacguugacaugcugguccaggacaucuaugguggggcccaccagacccugggccugaguggcaaucucaucgcaagcaguuuugggaagucagccacugcugacagagguaccugccgggauccacccuucaugacccagccacagccagcuucagugcccaggacaucacucugcccacuaguguggagaggcagagcucacagauucccccgagacuguucuuguugggccuccagggcucaccuucccagaauccugcucuagcucguuagaacauugccagauggcuaccucagccucuguuuccaggaaaauacaagcuaggaaaagcaguuaggauauuuguuuuuucuugaaaaugaagccuuguuccugcccucuucccuccagcugucugucacccggugacacugaccucacacucuggguucuguuuucauuccccucucagaguucuccaaagaagacauggccaagagccugcugcacaugaucagcaaugacaucgggcagcucgccugucuguacgccaagcuccacggcuuggacagggucuacuuugggggcuucuucauccggggucaccccgugaccaugcgcacaaucaccuacagcauuaacuucuucuccaaggugacugcacccaguuuccugccccuguacuggugugggcucagcucauccugguugcuccaguguaccccugaaagucuccccaaauggcagcaugcugaccacaacccauacccaaggggcacauugcaacacucugagcugggacacagucacaguuccuugccagcaggcuccuugggaagauaagucccuacaggccgacagcccucccaggcacccagaccuucuggucaacugcaccuuccuccuggccaguuuggcauucuguguauugaguguaagccuguuacaaugaagggcagucagagacuguucuuuagugagguaaccccauguggggccgggguaucugggccagcaaagugcuacagauuggcgcucaggaauaggcaguagcaagcucaagguggccuuguggaggcugucuuccugucagguuccacaguggacaggcuagccaguggcaugcagguacucucuguuggcagggucuaucaggcaaccuugaagacacugguguacuagugugguggguacacaguggaucugacuggacacugaccaguuaugugugggcuugggcuggggcagggugaaguccaggcacucuuccugagacaugaaggcuaccugggagccaucggggcauuuuuaaaaggagccgagcaagacagugaguagagucacugcugugagcaguggcuggcugugcaggacguggccugugcccuggcugggcaucugggugggagagcggggaccagggggugggcacgaggcuggaagaagccacagaaagggguaauccguagcguguaaauagaccaaugauuuuaucccuuuuccuccucuacuuuccccuuugaaucaagggcgaggcugacacggugaccagcuucucguuuuuccagauccuaaccaguacagcuggggugagaacuacgcagccagcuccgggcugaugagcacgucgcccgagcugugcccgacacagcgggcaaggagcggcacagugaguagcaggcccuuccggagcagccugcccagccgucuccacuguggccucucagcacacaggcugcuuuuauguugaugacaaguuagacuugagggcaggaggcauggaggcuuccggagcccucgggagccugagagaccugguguuccuugcagagcacccuggcuggcagcugccgcgauguuugcggcaagagcggagaguaggccugccucugucugagcucgcagccagcagcuuuguguuucuggggaagucugcucucccuggaauguucuagauccauuccucaugucuccaugaggaugaaauccacuguggcugcagacacuggccucaccuggccagaggcaggcugagcacugcggagcugguggguugggaggcuccuuagcacaugccuccuuugagcccuugugaugcgggcuccugcaggucagaugccgcuauggugugguagcuauuuugcgagcuguuugggcgucugacaauuggcuguggagcuuuuguagcucagacaccauauaagucugggaagagcagcuggaguaaaaggcuacuucuagaagcaggacguaauccaccaccucgcacacagcugcaggcauggugucgacccagcugcaggcauggugucgacccagcagcccuugguagugagcccgggccucugcagugagagcgcuccacgugccccugggcauuugucuguggaccaggccggguggggaacgguugcucugaaaugggcaucucccacccuugguuuuuaauucaaguggcccugcugaggcccgccacauggcucccaagauggagacaacagcaagcaaaguuguccuucugucugaacugaaaggaggcccaugcuuccucaguagaacacggcagggugaguggcacugccuagcucugucccacaccuuggagccugcagagccuguagugcugugcugggauguugugucacagagacacagcugacacagcccaggugcugagcagucauuagaggcauauauugccaagagagacagaacuaagccaccgagacccuggcaauggcaagaccuucagaacaggaaacuugguagcauaguaacuagugacgugaagcuggagagcuauguguucucgugcguagagggcucugaggcugggacgcucaguggugagccagugguuauguagauaaccccugcccauuuuuggucagcuugggaguuucucagaccuuucaugcuaaccuugccaccgguauguguuccuaggguuugcaagcauuuaccccuguggcucuguccaagcugugagucuuaacccagaguucauguucagucauugcaguugaaauccccuggcugaaggggcuugaguucaggagugugguguggcagauagacacucaagaucaaaaagaggcggccuuggagcagaggucacacuucucuggggcgagagccacugcugggcacgaacagcauagcacggcucaccucacugcggugcacugccguuagcuaggcgguccauguggccaccuaaguaucuggucuuccugacugcgucucggggccaggguaugaggagcagccccguagugcuuugcagacagcacaucagcuggacaagacagaagccaaggcauguaccagcagcgagucugccagaacucacgcagacgagaccgagagccaaagggcugcugggacuuagcccugcaacuccccagcacuguugagaaccagagcuggaacucaggcugagugcugggagggaggcagcgugagccgguguacgagcagccagggccagcuuaggaaccacaggcugcugugggguuaaggggcgguaguuuagggagcuacccugaucugaagcuuucaaguguagacacacuccacagccaagccguggacagaauccaggaagucuggccggugcugcaggaagaaggguggagcugcugcauucauguugaaagccagagcuuaaguuaggguugugaccuuucugacaguagccucuccacugaccucuucuuguccuccuaguuugaccugcuggaaauggaccggcuggagaggccccuggucaaccugccccuccuccuggacccguccuccuaugugccugacacaguagaccucacugaugaugcucuggcccgucaguacuggcucacgugcuuugaggaggcccuggauggggugaggcuccaagacacagcaaguggagagcguguggucucccaaaaccugggcugcucuugggcucagcuggcuccaucccuaugagggucaacaggggaaagaagggaaagagggcagggacauuuccaagaggucacauggucuuaguaaggaaagaguaugccugucucuacaguguguaggguaagggcgugacauagugacauggccucuucauggcaguacgugccuucacuauuuacagcuuuucagcaggcaagccaucacaugggucuccuugcuuuuggccuuuuuuggagaaaggguuuuccucuguagcccaggauuggauguacucagcaugauccuucugccucagccugcugagugcugggauuaccgcagccugcaccaccacaccaggcaccuguugugauucugauguaaauaggcuuuuauguugcuuuguggggcuauuucuuuguucauuuuuuuucugucucugugucagauucugacagaaaugguaggaagacccuguggcgaggcagggcacacuacagcaaagcugccuucucuguggcaaccaggagcagagagggagagauuggaaggggccaaaacacgaguuaacccuucaaggcuguuaugguggcgcacaccuuugcucccaguacccaggagggcgaggcaggcagaucucagugaguccaaggccagucuugccuacauagggauuucaaaccaaccagggcuacauaguaagauccuaccucaggacacacacaucucucucucucucucucucucucucucucucucucucucucucucucucucucucacagcaagccccuagugauuuuuuuuccucagccaggccccaccucccauauucugcuuuacaaugguuguaauauuuugaguccaucagugaaagcucaccuuccaaaggcccaccucugaguaccaagcacaugggcuuuuggggaagcacuucaaauucaaaccauacgccuccuugugcguuuucuaccuuuuccagugccagcucuguguauaguggcagugccggcuucugggagguguuggggcagggcugcagcagcuagaucucgagcuccaccaggcucgaagguuguggccacaguaggcauucccagcccucuuucagacaucuggguauguggugaaugaggggcacagcccugggucccaaguagcaacucuuggaagaaaucagagccuuagucuuuguagcugccagggaagcaccgcggucucuuuaugucucccaaagcugcggcaggauguaggcaaggguggugucuuugaaagcugaaauaccagacaacagcacgaucugucacuguuacugugguuguagcugugcaagugugccccaguguagcugggcagagccccaccaggcugugccugcccucagccugugcugucucugcagagcuuauuuggcaccucugcuguuggcagguggugaagcgagcuguggccagccagccagaguccauggaugcaguugagagggcagagaaauuccggcagaaauacuggggcaaacugcagacccuccggcaccagcccuugugaguccugugaccccaggcuagucccugccuguggccacugaggaaggguucccuucuuagcacagggaccucgacuggcauggugggaggaugaagcccacgcagcaaggucuuuuccagcugugugcagaggucucacugggcuuuccugggcucugugagaccuaucuuguucagccacacuccauccugguuuuguccccagugcuuaugggacacugacugugcgcagccuguuggacacaagagaacacuguuugaaugaauucaacuucccagaucccuacuccaaggugagccauguagacuacaaguagggugcagaggacucaguagcauuuuguugugccagccucaggaggucuaagcucacacuggcuaguucuaggugcacagcucuacucuaggcguguguuagcacuccuccaucccucuggcuaggagccgugggccccuuguuucccuguugucagccaccuugcccuuccucagcugcccaugcacaguggccucugggggugcauacccggugcccuccuaacuccacuaagucuugugggccagagugccucccugcuucacccaacaccagguagaccugaggacugccccaaaucaguaaguagccugguacccagcccugagcgucaccucucgggagcacgacaccaaaugcccccuucucccugguuaguguuuucaguccucguugaggccccuucaucugcugcccugcagagaccucccuagaggguacaaggaguggugugggccuaccuucagagugagcaccaauaaagcaacgccugugugucuuucccacaggugaagcagaaagaaaacggccucgcacuaaaaugcuuucagagcgugacgcgcucgcuggacucacuaggcugggaagagcggcagcuggcccuggugaaggggcucuuagcugggaaugucuuugacuggggagccaaggcugugucugaguagguaucugaggugugcgcgccugcuccuucucccucugagguggcuuggaacugguucuguugcagaaguaugcuauucugccaccaggcugucuagacccagagccacuugcucuggguuggcuggcccugacagugaugagcaagagcacacaugaagucauaggucuuugugcugcggagaucugggcaggcaccauggggaggcugauuugugcuuuagggaugacauuuucaggguaaaagcccaaauuuguaguuaccaaauacagcagggauugauccuuuuuggugccugauguaaccaaggugcuuugccaaggugcuggcaccugcagaacacugggacaugcguguuccuaaggggcaucgaggguccucuccuagagcaacuguagagucucugucuccauggugauccaccugaggccccagccucccugggugaccaugcuacuugacuggugucagagcauauugcaaaggguuguucacucuccugccucacccucauucuagccgcccacuugaggugcagaccccaguaugugguggucaguccuagaaggagcuagcuccaucgcccugagcaggucugagcuuuaacgcuauacugaaaggauuuguuccugucugaagcgugcuccuccgugagcagcacuggcuccuaaggggagguguggccaguccagcgcagugcugcugggagaucccucgcuguggggagggaggaauggugagguugggcuuuguuugugguuuuugcuuugugucaauuuucucauuucuacaguguccuggaaucggacccccaguuuggguuugaagaagcaaagagaaaauugcaagguauggacacugugugcucuguggcgcucugucuggcucugcagaaguuaagcagcaggucggacggggcaguucugguggcuauguggccguguugcucaggggaugagaugagauagccuuggugaaacaagccccugacacuaggccucagcuucccugacuagaguuccugucuccucacagaacggcccuggcucguggauuccuacaccaaguggcuccagagguuaaagguauguaaggugccgcugcaucugcccuuggggguuggagcacagagucuggaccuagccagagaggguggccaccaaagucauugggcuuacggugacaugggugugacacauacagcacauucacauggccugggacacagguauaaccuguagcccaccucuuagaacuuacaagccaccagcugagagucucaugucagaaauucccauuccccgggucaggugugacucagagaaaagaacaguagguuguucgguguguaugaggcucuggguuccguccccagccccggcaaugaccacuggcugggucaucugcccaugggaccaacugcccugucccuguugccucccacgcucugagacccuguggcuggacccaggcgcccagggaguuggggguguagagugcaguggagugugaaacgcuugagugcaccuguucccaacugaacguccugguuuugucuuacaggggcccccucauaaaugugccuuaauuuucgcagauaacaguggaauagacaucauuuugggagucuuccccuuugucagggagcuacucuuuagagggacagaggugagugaaaaggcugggugggcgggacccucccccugggcuucuccgcuguuggugggguuggcguuccugugggcuucuggcgguggucagagcuccuacauuuguggcaggugagugcaggugaggacacggagcgcccgggccuguugggugcgggcuguagcuuaaggccuggcuucccugcuuccuguuuccugggaaggcuugacccagaagcuugagaauagugagagguuagccugauccaggaggcaggcugaggaugggauggaugggaggcaguaaaggccucuaggcacagcccugcuucgcccagaagccacagagcccugagauuguuuggggcucugcugcccagcaguuggcugcugcuuggagccugccagggucagcuguggugaacuugggccacauaaguaacagcccagguucuaaagagcugcugcucccucccccaccguaggucaucuuggcaugcaacucaggcccugcccugaacgaugugaccuacagugagucucucauuguggcagaacgcauugcagccauggaccccaucaucugguagguucuggcuaccccuguugagccaggcaggggcugggcccaaccaguucugggagacucacaaaggguugcugaggagggucagugucacagggccuuggcugggcccugaccgcaugcuuuucuauagcacugcucugagagaagauaggcugcugcuggugcagaccgguuccagcucuccaugccuagaccucagguaacccagcuuuucuucauccugcucugcaaggcaccaaaaccagccaugcugcugcuugcccuaaaugugaccuauguggccacuucuuccuguagccuguagggcugaugggcaacugacccaggcucccugcuacaggacagaccuguggcaggaagcugucccauuuucccacuuauuauuuacucugugugugugugugugugugugugugugugcgcgcgcgcucgcgcucgcgcgcgcgcgcucgcgugugugugcccgcccaugcacauacaugcacucuugcaccacagcuuguguacaucucggacaacaacuugcaugguuuuaccuuuugccauguggguucuguggaccaaacucaagucauugguagaaaagugccuaagcccauugagcauccugcuggccuguucagugcuuucugcaaagaggugcgcaguagacaaaggaaaugucagacaugggagcaucagaaaagcagguggugcuggaaguucaguuccuggccaguagggggaaggccacuguugggagucuggguuuggacaugccucaguuagcaaggggugcuggggaaaggucccuguguucuugcuggucgccaccuccaaggaaacagguugguguccaccaaggugugcuuagugcuguccccugcccaaccucggugccaucuucuucuucccugaagccgucuagacaagggacuggcugugcuggugcgagagcguggugccgaccuggucgucaucgagggaaugggccgugccauccacaccaacuaccaugcauugcugcgcugcgagagucugaagcuggcagugguaaagaacgcuuggcuggcagagcgucuagguggccagcucuucagugucaucuucaaguacgagguuccuaccaagugagauacccacucugccagacgugucugcauaucccucaucaggaaugugauuuacuucgaggaaccuguguucacaccggaguauugacugacagugcguguaccagggacacccaacccagcauuuguccugugggacacuaguguuggaauguauuuaacuguuaaauaaucuuuuauauauauacacauauacauauauauauaaauauauacauacacaugugcucau

SEQ ID NO: 2316 - RNA, 5406 nt, Mus musculus
aauacaguuuuuaaaaaugugcaacucagggagacccccucccuaccugcuaggccaagaugaagaccuucauuuucuauuuuucuuuuuuuaaagauuuauuuauuauguauuauagcguucugccugcacaccagaaagggcaucagaucccagcauagaugguugugagccaccguguggcugcugggaauugaacucagaacuucugcagaacauccagugcucuuagccucugaggcaucauuuucuuagggaguuggcaacauggguuuaggggggguacugguguuggugagcccagaguguuauacuucccuuccagccuauccugagcccugccucagcccgaugguggccucuucuuuacaggccugaguaaaacacccugaacuucugaagcagugcucagcuguguggcuugggaagggaggggaagcccacuaucuccagagacugaagaagcuguaaauuacaugugacagacucucccaccccacccccauacugaauuuuccccacuuguaccugacccccccuuuuuuccagguaacuguaguagcuuaugugacaaaagaacgguguggagguuuuauauuucugugcagccacaguucugaggagaaacucuuccaugaguuccauccacuucuuggagcugucagcgguagugucucagguagaccagcuucugagguggaaacuucucccggcacaggggacauucugucugcaggguaggguaugauugucacauuggcugugcaccguagcuggcccugauccccagugcaucaacuccucuuuuacaucaugcacagcugucaaucaaccagaaaucagccucucccagggucccgagccccagagggguuaggcacuggauaguguugacucagcauagcagugcccaccccacccuuccucaguacuuaugaaccuuggaucucuaggaccucuccugggcucuacccuuugacugagccucugccauaucuucccagcaagccccaccaguaagguaccagucugugcgugcuacucuagccccucccuuguagaacuuccgcuaggucucacucuagaugaaucccagugcucccuuucaagagaaaaggcuugcucugccaucuaugagaaagcaggguacacauuccacacuuagacagcugguacacagugcccacuaugcagacugcugacuuagcaaaguaaaugcuuauguuuucuguacugcggcccaggacaccagccucuuaauagcagggcacagccacauaaaauucccuuucacuugcagccuaggcuucuggccaggacaguaaaaguagcugacuggcuggacaugccagccagggcccggcugcuuacugaagcgguauguucugggcaccuguccuggaaacgguucagugguguguacacauguacuagcauucugaauguauaaauuaagacaguaaguguagccugauaugugcacccaacaugcgccauucaccugcccucagucaggccucaagagaggaaggcugggacuucaaccccaagcacgguucaugucucacagaugcccaccucucuaucuccaacucaagagguuugggagauuggggcagugaaaccgccaugggucgcaggcccgggagcgcgaguaccuugguguugcaccacucggugaugcacucccagcagaagagauggccacaagguguggccguggagugucuucguuccucuaagcauagggugcagagugggguucugcacacggcucugucuucaagggaacuccuauggggguaaguacacaggugaauacaccuuucacaaaaucggggcauaccaaaguaccucaagcucccugcacaccugcggugggauagauugcggugcagccgccacuccuuccuggcucgcugcuucugccugaagcuguacaaccgcagccccauggacagcaccagaugcaagagggagaucagccccagcaguccguagcuagugcgagccuucugguccucuccaggcaggcgacgagugcggagcuguuaagacaggugaccuuggccaucaggaucccuuaggaccuggccucuugucugcuggagguuuuauauucagccaggccuccuguuggccacuggcagugucccgagaacaagaaccaacauggagauggguuuaaguagugacugggaacccuagcuauagggugaccuugaggcauccgcagcacagacccaggagucuggauggaccaggcaaauggaugaggguucuagagcugucuggggacuacuucagggggagggaaggagcccaaggaagagugggguggagaauagcaaggggaccuggacaggugguuacugucccucugauacucuggcccuuaaggaugcuggucuagccucugcucuggcuagugguguaucugccauacacaucacaacaaaacuaugcugccuuccacuucugccuucccacuggcagggaaaugaagacaccagguuacaucgugccuugggcuggaacaggaaaacugcaagcccuacagcaaaacccagugcccagcauucagcagcuacugggaaaggaggcacaucugcuaaacuagaugacugcuugggcagguuuugcuuuaucuggcaguauggaaggaaguuaaggccugagaccagacuaugggugugucuauaauaagugagugugggaggagcgcacuggcuggagggagaggggagagguggcauuugauccccugacaggugagguagguggugaggauggaggugauaccagggcgaggucuuuggugugacaggauacaagggcacugguaggaaacuaggguugaggcaggggacugccagaggcaacaacaaggucaguauggacuguuguguggccagcgcuguggugaggcgauguacucacucuaggaccaaacccucagaucuugccuuucuguuagggcucuggauggugaugaacagggcccucugcuggcagggaugcaugggaaggccagccucugggcuagaaccugcacuccacacacuucuccaaacagugaaauggacacagccacaggcccucugccgaggccagaccuggccacucagucacccgcccacgcacccaagucugcugccaccuucagucugugggaacuggauuucuuuuccuuuuccugggcuuucuuggaaaauaaaacugaacuccgcucuuucccaaguacagaauuucgauugcaacuuggaagcagaacacuuggcugcgaucaugucagcauggguccccaaguaugcugcucagaggaucccugccugaauaucaguccccuuggcauggcuacuuacauacgugaucccugcuagucucuuggccaggugguagaagguaccaugaauauaaaaccaagccacguggagccgauggaggcaggcgaagcccugucucaggaugaagacugcccgcuggagggccuuccucuguuguucagucaggguggcugcguggugacgcacccagcgccgugccccugaucggcugcguccuccagguagcagacugcccugugaagcccggggagcaucgccaucggcuugcagcuccugcuccaggggcagcagugccuugucuagcagguagggcaagacagcaugcagugcaaccagcgcugcacggcggagccuggagggcacacgcugcugggauggguccacuuggaugaucccaacguacuccuccccaagggucugguagccugaggauuaauacacagugaugaggguccagggacaaguuuccgggccagccugugucgucguccccccuccagccucaccagucacccugagaccuagccaaggccagcacaacuucuuguuaaacccacuguggccuugcugugauuucaccaugucacagagacggccacucuggaaugggccuugcaucuccuguugguuccuacucccuuaagucuuuauucuguuuuccaguccuuccucugcugaacucauaccccuguccaagugaugggauccgaucuuguggcuuucuaccuucuagaugauggcugaguccuaaguaucaggcauacauaccacugcuuaccugacgcugucacauggagucagaauaaaaagcccccaagccuacccauggcuugcagcuagcuucuaguacuccaccaugcagacgaugaauccugacuuccuguuccugaggccagcccuguggaguaccuugugaucuuuccaugugucucaccaugacccugcucguacccuuccccccacucgauagccucuuccuuuuuaucugccucguaccccauaaauggaaaagcccauccugcugagagaaagucuggggcagugagugcccucuggccaguaucuuccuucccggaaacagagacuaaugcaggugauuuccaggagccuucaagcauccccuccagaccuggguggguugugggccccucagugcccaggaccugccgagcacagacagcuaccugcaauuguggugaggccaaaguaggcuauguccgagagcaacucgaucucuuuccuccauuccagccauuucuuugcaccugagagaagaaaaauauuagcucuagagaggugaagugguucucuuaagaugacucccagccggguagugguggcacacgccuuuaaucccagcauuugggaggcagagauuucgaguccagacugaccagagugaguuccaggacagccagggcuacacagagaaacccugucacucccgaagggcagguaaaguccaagucaagucacuccuaagacgacccucaacaacucgucucucccuucaccuccucugcugcccuuggugaccggaaugucuccgagacgaagaccgccucuuaagaagccccgacuguaacugucuugagucagguacuguccuagagacauggagcccaggaaagucuagguagugcuaacaacauaagccagaggcgaccuguuuaguaucaaaccucggcucucugaaaucccaaaucccugccugugugauccacgugucuaccuaugagaguaaugacguuagguccacccuguaggggcgucuggagaauaaaugggcaaaugcuugagaaacacuaaagcagagaccugcaauguggucagcaguguguaccucuguuuugauccccgcuuuccaagcaaacucuggagcugccgccugucugggugcccggaacgcucacccgcuaggcugugcagcgcuucacccgccgcgcuccgcaggccucccagguaguacucguccuucugcgcugcccggaucacuucaggggcacccgcccgcgccauggcccgaaucgcagagcucgcaccgcgccugcgcaccucg

SEQ ID NO: 2317 - RNA, 14838 nt, Mus musculus
cucaaagcccagugaccacgugggcuacaaaggugacuuuguagguuuccuuuacgucuccccggagcugcagcaggguugacaccaugaguggguggucuggcuggaagaagaagaauccuuagacuuuccagacaaaucuguucuacuucagcucacaggucugucauagcuaccccucccugcccggccuggggucccaacaccuacaucaaagucagcaggugguacccaggagauguugauggucuuagucuggccacgcuccacagaaccccuggagggcucaauggagaagcccuugugcugaagccaugauacaccauccaggcugaacuccacagucugugaggcauugauacuacuggagguuagagggucagggacucccaggaguaguaggacuaaaggggugagggggccccggcuuuaccuauccccgaacucucaccagggguggggaagucgccaccccacaucugcugcaaaaauccuauaugaggccagugagguacaaggccaggggaggcuucugggguuuaacucgagcuagaguugugcucacccuccuuggugauggcugugugguccggauacagcccacuuguagcucucggguggcaggggagguuguugugucuguguccagcuggacauaguucaaggucaccaggaugggcuuuagcuccucagcuucuggagagggagaaucuagcugaaaagugucuagaggaaggguauggccugagggugagaggaauuguucaggguggcaccacagagguggagggugaaccuggagcccuggcacccuucagagcaguccucuuggcucugggguugaugguccgcaauucuaucugcccuuguccacugggccucauuaugcccacuagcuggcgggccuugucacuaaucucuaagguaaguuaccccugccccccuuuucuccgagccagaaaucacacggugggggcucaccuucuuuaugcucugugucaaaagcagugacuacugccagggacuccacaggcacauccagugggucuccucccuccacaaacaucaugugcucucgggcagcacccuucaagaggaucuggugggagacuuucugggggacaagaaguauagcagccugcccugaagcuugacaauugagaacugaggcugcuugaggcauggguggguccuggagaaccagggaugcuguucucuaacuggcagcccccaacauaaagggccagauaauagaagcugccaagaaggaccagaugagggacucguauggaccccucccaggcuggggugggaucucugggggcccagcucugaguuccaccuuuucaaagagcaccacuuugagcaggucagagaagaagaggcucucgugguccggacugaaggugacaguaaacucuugagccuucccagggaacaugaggcccucaacugggacgauacugaacacacucuggccauuguaguucugugugccugugggugggacagcagcuacggucaacacuaccauccuccuucacugagcucagaccccuccgauucccccucugcccagccucuccauaaacugucuugacccccuccacuccaaacaccacccucauucccuagcccgcaucuccucguggagcuguaccccugugguuccuggcaguguguuaguuagcucaccaacuauuucugcccucugcucaugggagguaaugaacuuuggcagcugcuggugggccucagccuucuuucuggagaggcucuccagacgcacccagaacuugaugggaagcgaggacucauucugaagcuguaagagcaagaugucaccugaugucaccugaccagcgugccguuggcugccccagugccggugaccaggcugccagcugccggaucacugcucaggacuagguggcauugcuaacaggaaccacaaugagcaagaugucaccugaccagcuuaccgugggcugccccagugccggugaccaggcugccagcugccggaucacugcucaggacuagguggcauugcuaacaggaaccacaacaucaguguuugggacucuugguauuuggucacuccccucacccugcuccuuuccuaaggcuggcuggcagccugcuucccugcccagcuguguggccagcucugugcccgucagcuguugacugaacuguauccucaucugaucucuuccccuuccuugauacccucuuugagaagcacuagaaaugacagccucuugggaacagagcauuugagggagacagucugugacuccagugugauuccccaaccagcugggugcuuccaagugcagaguucauuaccuccaaaaaacaauccuuuuccaggaagcugggccaagacaaaggguuaauucaccuuaaaauuuguugagacagauucucuggcaagcacguagcccauguugaggauguugccgucaauggagcacguaaucauggacgccacacccaugccaaagagggugagacugagagugccucucuuggugaugauguccagaguuucuugagccuaaggagaucauguccuuuagcaaagagcaaaugugggagcucuacucaugagcggcuggcuggaagcauugugcaacagagauagccuggagaucucugccuccagacuuguuggcaagagcuggagucuggcgcacaggcugcuuucaggccccaguagaucaucugggcccaagagcucagugguaucucacccucccuccccuuggucacaccaugguccugaaauguggcuggagaucccagggcagcagccuugcccauucaugcaugggggcugcacucaccaguauguucucaugaggcgagaaggacagcacuaggguuugugucucaccagagcgcagcuuguugaaaggguuuagccugacgaaggggccguugggguucaacacugaguacuccagcugaggauuaucaaggaugaagauacgcuuuuucgggcucugcuacacgccucgccccacccccagcucuggaagcuagcuugcuggguauggguaaggauacaguaagguccucauugcaaauguucuggagagugaucuucuuuacgcuucgaugcccugaaauacggcagagucagcuaacaggcuccucggccccgccccgagcggcaccucucucaacagcaaggucaggaugcagacgguggcuggagcagcucuguacccagggugaaagcugugcucuagggagugagggcugucaguauacaucaggacuuacccacagcaauauccccgaaguuaaagucagucuugccuuugugggaugucaccacaauaaauggagccacugcugggcaccacagcuccagauauagaguauuaugggggcuagagccaggacaaggacagaaaagggcagauuagggugacccaguggcccucgggccucagaucugaccagcaguagaggagggacaguggguuuauggccaaccacacccuacccuggcucaagaaccccacaccugaagcucagagguuccgcugucuuccugucuuugaugucaccacuggcaacgacacaggggaucacaaaccuguuaaacuuccccuggaaggcuuuggacaagguggcuugugcaaucuggaacucaguggaacuggaaggaagcagcaaaucacaucaguuggguguuccuaugaccucucaggaugugguccuugggguacagugugggacuaggucuuccacaucugugaugcguaugucuacucucuagggcuugggcucagcuguguuaagaggcauaacuugaagccaccauuggucccagauggugguggccauaccaguuuuaucugauaggcuagccuuccuacucuucuuuggcuccuguagggaacuucuuccccacugcagauccuggccauccagacagagugaguaaaugguuuugucacuacugugccauauuccugggucuacagggacaauuucugggcuggcaaggggcccaacccuucagagcuugcuuaggcucguuuguuuauugggaaggcuacagucagacuguggaguagucuguucagggggacacaagguccacaggaauagcaaggaacagauaccuagcaagaagagccguggguccagcuauuucugaagccagcuaguccugcagauacauagugaagcuuugcuccacugcaaugugugggaaauccucuauugaacaaggaagucucaucugagcagggguugggaggugggugggggcauggguauggugggugggauguagguugggaagaccccuucauccuaccuggaauugaucacuggccucugcagcucuguagcuuggggaguggagacccggguuggucggucccgguugugaacccggaccacagagaaggacuguuuccaaaguucuuuccuuugcacuauuuccuucugggacuguaagcaggagcagaugcuguagggcugccccaggggcucaguccucugcagagcaggcucuguaacugcuccccuaccacagguuccucuguggccuggccuagcuggcuuggucugacugcuugcugaguggcaggagccaccaguucaaguuuggaguaaauggagaccucagaucaacagguucccaagggagucugacaacaggugugacaggggauugacacaguaagcagccagggccaccugggaaggcccagcacagagacaaguucacggccugaaaugucugaacuuaagagacaccaagccauagacaaguaagaaaucuguauggcuaggguccuuaguguccuccagcccacgacucucuuguaccuuacugccucaucaggggucgcaaugucagggcucucugcuuguguguguacuauaaagacacggggccacgguguggcagaaggccaagcucacagccacuggcuucacaacucccuaggcugcaaagccugagcauaacauugggggaggcucagcuucgguuucaaggcugccuucagaaggugguuuucauguuacccuuggugagaagguuacccuugcuguguuuuuauuccagucucgcuuugguuaaaaccucagccaccuuuagggcccgccuugucucccacugccugguggugcuuccaggagagggagaggucuugcaaaacaacuuuuugccucucguggaaacagcuuaaagcacagugccaggagagccugccuuguucuucugucacaggggcuacccuuaggacaggcugcaaucccaagugccaggggcccacacaucugcaccuccuucccucugcuggugccccuuucuucuuuccuccugucccuccccuacggccacuaugcaccuccccuaaaauacuucacgcaccacaggcuuggucucuauuucuuuguucaggaucugggaggcuuccuuauagauuauuuccuuuggcaguacaggcugaaaggccaccuggaucaagcaccucugcaaagagacacucagauugucaacucucccccagacagacgcccagagggcagagguggccuugcuggcacaccucucuccuuucaugguucucucucucccuucucucuucucuucucuccucuucucuucucuccucuucucucuucccucuucccucuucucucucucucucucucucucucucucucucucucucucucucucucucucuccauuuuccccccaagauagacaagacagagucuuucuguguagcccugacaucuauggaacucugucuguagaccagacuuagccucagacucagaucgaccugcuucugucccucagaagcucagaaggcaaugugucacugagccuggcugcauuuuucuuaaggucauuugguuuugagauuuuaaccugcuaugccuuccaggaaaguucuuccugaugacuguaggcuggaguggacuuuaggcgauguguguuggggaucuguuaacuggaggggcugagaacagaguccugaauggaucagaaccucaccagacuagaguaagaaaugaaccagggagcagggagcccucccccaucugcagcaagucuccaugggacacaucucuggaaagggugcaggaauaaguuccuggccaagcauggaacccuggggggaaggccgggaagcuccgccuccuggccugucaguggggcccaugcucaccuuuccugguaacacaguccccacagauggggagauggugauaggugaauuaggaggcagcaagaacucaaaggauguuggucccacuggggcggcuuccucugagccaauccgaggcaaggaguggaucaucuuguucaugcucaggugggaguugaucacauacaguguggagacagaggugucauacagggacguggcugagaacuugaucugauagugggacagcuccagggguggguggacaccuacugcuuggcaagacaccuugaagcaccugaaagccaccagugugggcaguguucauccugugccguggcaucugcggccccucugaagcccugggugaggagacacagagcuccccacaugcuaacuaggacggacaggucuguuguguuggugacgucccagguacccaggacuuauuccugcaauuaauuaucacaguuuuuacuaccugaugaaccaauuuggaaaaaaaaauguguuggcugauacguauuuuugauggguggcuaaaaaaaguguaagcaaaauuauauaaacaaaauaaaaaccuguaaguugcuuuaaaaauaagugauuucaccuggcaugguggcacacaccuuugaucccagcacucgggaggcagaggcaggcgaauuucugaguuugaggccagccugguuuacugagugaguuccaggacagccagggcuacacagagaaacccugucucgaaaaaaacaacaaaacaaaacaaaacaaaacaaaagugauuucagggauggagagacgggcagaccagugucucgcaaccuucccaacacugugauuauuuaauacagcuccccauguuguggugauaccagcugugaaguuauuuuguugcuacuguuuauaacuaauuuugcuacuguugugaaucguaauguaaguaucugaugugcaggauaucaucugaugugcaggauaucgucugaugugcaggauaucgucugaugugcaggauaucgucugaugugcaggauaucgucugaugugcgcccucccaagucaggagcacuggcugcucuugcugacgacccagguucaguucccagcaccugcgugggggcucacaagcaccuguaacuccaguucaaggggagugaagccuuccucugacuuuuguagguaaccuguauguacaucgugcauauccagauaaucaaguagcccacauauauguaaaaaaaaauacaaauuuuaagaaaaaaaagucguacaaaggguugauuucuggcuuauuauauugaauauuuauugacaauuaaaaguccuccuuucuuuacccgcugagugcugggauaacaggacuguuucgccaugucuuuucugcggggugaugggcauugaguucaggguuuugcacaugccaggcaagugcucuaacagcugggcugcauuccuugccccagacagguggucacuuuaaccacugcaaguuuuacauucuauauuuucucugaacuucuaaaugcucuccuggacaacuuuuuguuuuuguuuuguuuuuugagacaggguuucucugugcagcccuggccgugcuggaacucacucuggagaccagacuggcuggaacucagggaucugcuuaccucugccucugccucugucuuccgagugcugggguuaaaagcaggagccaccagggccucguucaucaucaacuucuaucuugauugcaccuguuuucuaugcugaggauugaaucugaguccuugugccaguuaagacagagcuugacuguucaguugcacacggcgcuccuuacauguguuguuaugucaguggccauuuugccguaugucuaugcauuccaugcuuuuaguggucaaggagggcauaagguccccugggauugggauuauagaccagggugguggaaauugaacccuggucccuuaaaagagcaaccaggacuuuguuuguuuguuuguuuguuuguuuguuuguuucaagacaggguuucucuguguagcccuggcuguccuggaacucacuuuguagaccaggcuggucucgaacucagaaauccgccugccucuaccucccaagugcugggauuaaaggcgugcaccaccacgcccggcugagaaaucauuauuaauacuuaacugaauaaauguguaaaguaugguaauaacuaaauauaaaauguaaaaauuuacuggaaucuaccugaguuaaaaauccuaaauaauuuuucuucaguuuguguguguguguaugaugcauguacacauguacauauaugauauauguauauauguauaagaagauuuauuuauuauuauacauaaguacacuguagcugucuucagacacaccagaagaaggggucagaacacauuacaggugguugugagccaccaugugguugcugggauuugaacucaggaccuuuggaagagcagucagugcucuuaaccacugagccaucucgccagccccaugauauauguauauuauguguguaagugugugcuugcacaugcuauagugcaaggauggaggucagagaacaacuuugaaaguugcuucuugccuuuugccuuaguuugagguagggucucugucugucugucugucuguuuguuuguuuguuuguuuguuugagacaagguuucucuguauagcucuggcuguccuggaacucacuuuuuuuuuuugagacaggguuucucuguauagcccuggcuguccuggaacucacuuuuuagaccaggcuggcuuugaacucauagagaucugccugccucugcuuuccaagugcugggauuaauggcacaugacacuauaccuagccaucugucucucuuucuuuucucuucucucucuuauuuaaaaauguccuuuauauuuacuuugugugugugugugugugugugaugcaucuguagugacaugugugugaugcguguagaggccaguucucuccgacuaccagauucccaggcaccugccuucucccauugguccaucucaccaucccaaggcucugucuuuuuguuguucacugccaugcaugucaggcuagcugguccuuggguuuuuacgaggauuuuacugucucugucucccaguuugacauccucacagcccuuaaaccuuuuuuguuuuguuuuugaaacaggaucucacuguauagccuuggcuguccagaaauucaugauauaggccuggauggucucagacucacagagaucugcuugcugagggcuggaauuaaagcuaugcuccauugcaccuggcuccaaucuuuaaauuaaaauuuuguuuaaaaaacuuuaugugugacacaugccuuuaaucccagcagaggcagguggauaucugaguucgaggccagccuggucuacagagugaguuccaggacauccaacgcuacacagagaaacccugucucaaaaaaaaaaacacaaaaaaauuaugugcaugugugaauguacauguucaacuguaugaguuuauguguaccaugugugugcaggagucugaggaauccagagagggcacuggaguuacagaugguugugagccaccgugugggugcugggaacugaacugggguucucugcaaaaggccgugagcgcuuuuaacuggugagccaucucucugacaccucuuaaaucuuaagucuuuuuuguuuguuuguuuguuuuuguuuuuuuuuguuuuguuuuguuuuuuguuuuucugagacaggguuucucuguguagcccuggcuguccuggaacucacuuuguagaccaggcuggccucgaacucagaaauccgccugccucugccucccgaguguugcgauuacaggcgugcgcccggcuuuuuguuuucuuguuuuggguuuuuugaaacauuacauggccaaagaugaccucacuuuuacucuccugccucugccucccaugugcuaguauuauagucacuaauuaaaauaccugcuccauuugggccucuagcaugugaagcaaaaacucuaccaagcaaugcccaagguaccaacuuacaaaggccaacacacuguaauaacaucagaacucccaacagaaacucggaaaagccuugacagugacuagugagugaauacuuauaccaagaacuuuucacaguguacacauauacacacacacacacaccacucauguuuacaacacucacguuuagcagaucaacauuuccuucucuccucacauacaaggguaaaaaaggauauugucacuuugugaacauacaaagucaaaggucaugggaacccaaaaccuaucucuuccuggguccugggcucuugugggccacuaguacugucuauuccagcccugaggucagccugucagccuagugagaucugaggaguggagcgguggaaagaaaggcacgggucacgugcucccucuugucuugcaggcuuaccgguuuaucucagauuugcagaccagcucaaauuuguauuccuuggccuugaugggcuggaagaucacaucgagaugcaaaguuuccaguggcaagaucgucccaaacccgucauugggcuggauguccacauacuagaaaaugggaacacauuagaguaaaaaaugaaagccgugcuccguagaguagaugaucaggaauggcguacucugugcggggaagggagaugugaacaugcuaguuuuggagcacauauggaggauaugaggugugugugugugugugugugugugugugugcgugugcgcgcacgagugugcaugcgugagugagugcucaaccuuacugagugugaggcuaaagugagcugaaugugggaauggauaggggacagccuagcuccuuaggcugauggcaaucaggccugggcguccuuuuggacuguccugugggucuuggucagguuaaguuuuggaagucugcagcucuuuuggguguaccuuacagccaaaaaaaugagaggccagggaggaggccuuucccuccuggacaaggagagggucagagggaggaauggagcgcggcagaguugcugacgccuggaccuggaggucagcuguuacgucucaccccaucuccccagggcugaccacagcagguaccuugggaaguccaacgaacccaaacuccuggggcaacagugagagguugcugaggcagaucuccguccugauggccucauagauggugcaauagccaaaguuuauuucugagggguugauuuccaagucugagguggugacaauggcuugcacagugaaccucaccgguuugaucugcgauuuggaaggcaaagaacguucucagccacuggaagcuuuaugcaaaaagcccccagauaauaaaggcugcccuguuguggccuacagcguucuauuuccggaacaugacuuccucaagcagcucacuccucaguguuacccggugaaugggccagagauccacggugaagauucaagaagggcuggcagccgugaaaagaaucagcugugacagugugugcgugugacuacaugugcaugacagugagugcgugugacuacaugugcaugacagugagugcgugugacuacaugugcaugacagugagugcgugugacuacaugugcaugacagugagugcgugugacuacaugugcaugacagugagugcgugugacuacaugugcaugaguuguuuguaagcacacguaugugcagcccugcugaugagagcagaacauguauaucuauguguguguggugcacucauguguguaccccuauuuaguuaugcaggcauguuucuugugggcauauaugagugaaguauuugaagcagcaugcuuggaccagaauaagaaggucuucuugccaacccacagugccccccuuuguuucauacuuuuguaagaguugugugguuagauggcaaagaugcuagaccacugggcauuaucagcugggaaaugaggauagguucuaaaaccuggguucuguguguguagcuauuaucacuggggguacaggguuuggccucccacagcagccaccugauccccggagacagucccagaaagcguccuguacagaccuggucagcuacccggauggucauuggagccuccagaacucgacuggccgggucaaaauacuuccuugcaucuucugggagggauugucugcaagaaguaggauccacuugaauauacuuuuccucucuauauuuuguacaauaaaacuguucuaaaauggaagggcaugggcgagcaagaacauguauacaucauaugcagguauaaugccauauguaugaacugacauaaggaaacccauuccuucauauacuaacuuuaaaaacaaaaugucuugccacugagugguccaccaagucggcuaagcaggauuagcguggcaagcucaaggccagcagggggaccugcaucaggcccucuggguauacguuaugugcuuugcuuaguguuccugugggacuccuaacagcagagcacguguaucucuaucucugacuccuucacauguucuucagacuccuuccuuccuguuagguugccuuguccacccugaaucugggggcuuuuugccucaucuuauuguauccuggguugcccuguuuggcugccgucuucuggagucuucaucuuuucuguuaggaaauggagggaggucuuggggagaggggauguggagggagggggaacugugguugcgauauauuguauauuguaugagagaagaaucuauuuucaauuuaaaaaauugaaaaguaauuagcuuggcuuagccagaugugauggccuuuaauuccagccagaugugaugccuuucuuagccagaugugauggccuaugccuucaauuccagccagaugugaugccuuucuuagccagaugugauggccuuuaauuccagccagaugugaugccuuucuuagccagaugugauggccuuuaauuccagccagaugugaugcuuuucuuagccagaugugauggccuaugccuuuaauuccagcacuucagugggagaggcagguuauucucugugucugagaccaaccuggucuccauagugagauccugucucaaaaaaguaccaaaguggggggggcuuaguuuaauuaugccauauuauucccuuucccccacucccugugucuaucaagacauauuuuaucucauaaauauguacaacuguaguucuacaauaaaauuaaguuuuuaugguuuuauuuuuagggggaccucaugccaagguaagggcuuaacuuguaggcguuugaucgcuccucucuuguggauucugguaugugaacucaggccgucaggcaagccaucucuucgguccaacauaauaaaaguuuuaaugacaaaaaucaaucaacuuguaagaagcuuauuauuugaaggaauccuaaaauucucucucaaaaucacuuuaaaagcagacugcucgcgggacugguauauaucucagugguagguagagcgcauggcucuggcuucgauccccaguacagaaacacacaguguugggugguuacaccugcaauaggccagaagacccuaauguaggccaggccugagauacuugguuaugacugucucaaaaaguuuauuuuuugauuauaaaaaaaauuaguaucauuauagaaauauuaaaaaaauacagaggaaaaauauucccuuuuaccaugaugagcaaucugcaagaauguccaagaagcagcuuagauuuuuaaaagucagcuucagcuccucuucauuacccugugagugugcggccugguggcagaugucacuuggccacccagcucccuagccugcuacaccuacuucucuaguccaaacucuguugacagccuagggucuguaucuuagcccugagaaauaggcucaauggcaggaaccaagggucacuuagggaacuugggcagcaaaagugguaagcaggguucuggguugccaaagcaccagaaaagcugaaguccgucugaggaaagucagaagccaaagaaaggacacaccauuucacaaaacagccuggacacuggcugugcagcuaucucaagggcaagagccaagaagggcucugaaaggguaggauguagggagaacugggagauaggaacaccuuauagagcuucaugacagagguucaggucaugacgcagagccucagggaagggagcggcaggaagagagaacggggugcuggggugcuggggugcuggcuguauccaagcaggagccaggccagggccagugcagggagguucagggguucuuagcucagcaggggcaagucccgggaugcagggaccagcauccccccucccccucccaucaugcuccggggcuuucccaguucucaccgaggcagaaacuugagcuguacggaguagguggacugggccuggauguagccuguuucuggcagaagcucuauguggccucucagcuccuuacagacuucaaacuuuaggcgcagggcugcuuuugaucuguaaguggucacgggugacagugcguguuuaauccuuugacucguuaagguauuuguaaugacagaacaggugugcaguaggcagugcacauauugacucugagcac

SEQ ID NO: 2318 - RNA, 20464 nt, Mus musculus
cugcgcagugagucgcgcccgcggcgcguggugacugcgaggagccucgcgagucacgcuccgguacgguccgccgagggcgcgcggagcuugcagaccaugucguggcucuucggcaucaagggccccaagggcgaaggcacagggccuccgcugcccuugccgcccgcucaacccggggcggagggcggcggugaccgcggggcgggagaccggccaucgcccaaggacaaauggagcaacuucgacccgacgggccuggaacgugcggccaaagcggcucgcgaguuggagcacucgcgugagugcgcgggcugggcuuggcgggccgaggcccugggaaaugggagguuucucucggaggcacuagcugcugcccuuaggacuuugguccucuugacgucuuagcagcacaguggucguucgcagccguaccuuucaggugaccugaauggccgcuuaugggacauuuggucauagccguccugcauugggggagaccccgauccugccacccucuugcacuuguagcugucaacacguaggucguaggagagacccugugccaauguuggccuuaccuacuuuacuguugggcuuucuagcugccuccacguggugcaggccaaaagucauagccaggucaggcgauccuguguugugguaguuaauagcaaucucucacuuaaaaaggagagaguagaugucguguuuacuauuggaugauagcauuccacuguggaacgugaggugaggguguccguaaagguugauccucucugagacagauuuuagcauugauggaucccaaaggccaggacuuuucccaacaaaugacacauuuuuguuuugauguugacaguuugugccaaaguguaauguaagguggauuuuuuugauuauuuugcuuuguuuguucuuguuuuuauaaagacugugcagcccuggcugagacuccuguagaccaggcugucagagaaaucacagcuccaccugccacggccuccugaggcgugugucacuaugccuagcuaguugaaauauuuuuaagagccugcagggggcugcagagauggcugaaaggcuaagagcacuuguugcuauuguaguggaccuguguucaauucugugcaccuauaugacagcucaaaaccuucuguaaccccaguuucagggcauccaaggacuccucuggcuucuaaggguaccagacauauacauacuuauaugcaggcaaaaacucaaauacauaaaaaauuuuuuaaaagccugaaaugucagcuuuguugaaugaauacuuauugaaggauguuuccauucucaauuuuguguuuaugcggguguucuguuuuucaaaagauccuauagggaagcccuaauuuaaauagguauaauaugcagacccucugagagagagucuggcacuuggugagucaauucucugcucuuguaggaaaaaaaaaagucuugagcucaugccuuuaauuccaauacuugggaggcagagacagacagaucucugaguuugaagcuggacugcucuguacaguaaguuccaggcuaguugggguacacugugagauccuguccacuuuuggcaauggucucuugagccccacagacucaaaucuccauauagacauucagagccuucagauugagguccagggucaccugucucuugagguccagcagagcuaguaauuuuguaaauaaucuauuguguuugcuagauaaucucagugauuggguugaaaugaggaaaaguggcugguuuucaaggcauuuccaguauuagaagacuuggcagaugaucccguguccuguuacacuguuacguaggggacaacucucgguaacuccuggguuggggagaucacucucuagacacaccuagaguuucagaauugaaucuuggcuauuagucucacuaaugcaggcuguuguauagacuauggagaacaguaguuccaacccucagcuacauccugacuacucuugcauguaaauugcucuucaggcgcuuguccuggcaguccuggagggcuugcccagagcaugcgcuaucuagguucagugcccuggccucuacuaugcuuuaacagagcucucuuuucugggccagcaacaaauuccauggguucugcaugcccucaugggcugucuaggucugugcccuuuucuuguagggcagucucaggugggcacuaaaccugugcugagguuuaccuauucugacucacuuuacaagaaaauggacucagagaaguuagcucagcuugccaaagccacaugaagaagaaacaggagcuggagguuggccccaguuuuguuggacugugcuaccuccauuccugccuacugugcugggaugagaccccaaagagugcuucuguccccagcccuguccugucagagagagacaguguaucagaggccauugugauaaccugcucagcacuuggccucgcagcugacucucugaauugguguagggcugugccuugcugcucucucucugcucaggugugaguucuuuugucuucuguccuggucacugaagacaagagagucuagggcaagauugucuuggaagguccuucccaagcucugacacuguugcucauuggucgaguucaugccaaacugcauguucugucuaaauugaucccaaaugucaggacaucagccgugcucaucuaaaccuguggaaugcucaugccauguugccuccugucuuaggccauuuucccuccccauaaucauaccacuaacagucguaaagcucuggcuaacgacaugauugugacauuugaaaguaacaugaagaaauugcagcugacuuugaagacuucaaaaauauaagaaagucauggggauagaaaguaaggguuagaauagcaaaacauggacaucguuguauuagguauggguuuccuuggugaucuucacucccguguuuuucugugguagaaacuuuuuacaauaagguauuaguaauggaaaacuaucauggaaauuuagacuagacuuguuucuuaggccucuuuagaauauacuagaaguaaaguuuuucccacuaagguuuuuuuuuuuuuuuuuuccugagacaggguuucucuguguagcccuggcuguccuggaacccauucuguugaccaggcuggccucgaacucagaaauucaccugucucugccucccaagugcugggauuaaaggcgugcacuaccaugcccggcuuucccacuaaguauugacaaacaccagugcccccugacacacaaaacauguagaagacauuaauaaccuaggcgcguugucugauaucugauccuuacccauucuuuuuugccugcguguuuuuugcaacaucaaugguuacagauacagacaccagcuagagcucugcuucccuaacuggaagaugccugacauguuauaguugcacagccugaugcuggaugagugugugguggucuuuugauggagcucuuggcaaugcgaugauccccggggaugggacucuuacauguucuccuucccccaacguuucauggcuacugggcuaucucaaacucacuacgccgcugaggauccuuuggcuuccaacuucggaauacuaggaucacaggcgugcacacaacucuugguuguguguggugcuagggauccggccuaggacuuuuugcaugcugggcaagcucugugacaaccaagcucauauccaaauucuccgggcucucugucggaggcgggacagcggcuuugaaaggaacgguuauugugaaucgaggcaggggugagacuggcugagaaggcacacgaacgauccaagacugaaagccccuuggcaugagugagagguuccauuuuuagccacacagauaauguugacuggcagcguaguaauacccucucuucuguucccugcaggccaugccaaggaggcacugagucucgcacagaugcaggagcagacgcugcagcuggaacagcaguccaagcucaaggugagcugugggccaugagggugugagagggccaggcaagaugacaggcuauggauguguucuccagucuaugagcgaauuggggggcguaagggcuggaagcugagcauauuuggcuaugacccuguagucgagguaccugagagggaagucguaggugaggaacgucugggcuuagaggcaagggaucuuucuugaaaauuuugggguuuuuuguuuuguuuuguuuuauuuugagauggcuuccuuccuuccuuccuuccuuccuuccuuccuuccuuccuuccuuucuuccuuuaagacaggguuucucuguauaccccuugcuauccugguuucacucuguagaccaggcuagccuugaacucagagauuugucuguucuaccuccagagugcugggaauauaaccucauacuccaugauaccccuggcugagaguuuuucuauguaucccaagcuggccucaaacucuuggcaguccuucugucucagccuuuuaagugcuaggauuacugguaugcaccaccaugccugguuuuguuuuguuuuguuuuuuuuuaauuucucugugcuuagaagaauccuugaagcuggauggggucaugcaugccuuuaaucccagcacuuggaagacaggcagguggauuucuugaguuccagggcagucugguuacagaagacauuccaggucagccagggcuacacagaaacccuguguugaaaaacaaacaacaaaacucaaaagaacacuugaugccaggguuuucaaugagcucagaacagucuccaucuuuaguccuugucuguuggacaacacagucgagcucaggguaggaggggaauacuauccuugccauuugguaaucugcagcccgaugggauggcuguagagggugagucuuacacagauucuccuguacucucuaggaguacgaagcugccguagagcagcugaagagcgaacagauccgugugcaagccgaggaaagaaggaaaacccugacugaagagacacgacagcaccaggcugugagugcacaggcaggagugcgagugggacagugggguaccccuccggaucuuuaacucacugacuaaccaaggguuuacaaaguggugguugcuguacugagaucuggaccacuauuguaaaaacaaacaaaacacaauaaccucgaagccauggacuccuugguacagagccguucuguauccgcauauuuguaggagguggcagcucaucugccacuuaccucagcagccaccccaggguagguccagaucauguucucugauucuucuaguggcuucuccagccagagcgagucuuuacuucugucuuuuccccuagagggcccaguaccaggauaagcucgcucgacagcgcuaugaggaccagcugaaacaacagguaagcaaggcacaccucugggaaucgugcaguguucuuggagugacauaggagaccaugcagcugcguuuuagacaagaauacaaguguugcugguucuggguggauuuucucagacauagacccuggcauguucauauucaugaccugugugcacgauggaugugcccagacaugcaccuaaaggcagagaugugcuguacacauacacauguguauagacauacucaagcacauauauaauaagcccaugcacauaacuucuugugaugcucccacaguagaaguggguugguuuggggggauuuuuuuguuuuuuuuuuguuuuuuuguuuuuuguuuuaguuacccuugaggguucuugcuagaugggcaucugucuaauuagcaaggucagugaaugguggaggacugggauccugggcuguccaaaaccuagagaggccuccuuugauccaggcuggaucccgcuauaggagcucagcagccucaggcuuauguuccuguuuuguuugcugggcauuauagcuguuacucucaguuggcagagaucagaauucuguaaagcagagcuacaggcccuggggguuaggaaccacauuggugcugcuauaaaggcugcuucugccucagcagguggggcagcucugaagccagucucuuaaugugugcuugccccggggucuacaucagaugugucugcauuggaguguaccagcuagagccccaagaaaguuggggauccucaggugggcagaagcauuccuggcuuagagcagcugcaaccuguuggcuugguuuuuguucucuuucugauccucaaaagcuuuuaacuuuaaugugacuucucagcaacuucugaaugaagagaauuuaaggaaacaagaggagucugugcagaagcaggaggccauacggcgagguaggacaucgccaaggaugggugccuuucuugggcaucuuaguccuuaagaaaugcccccacagagacucacuaagaucacaaauaaggacugcauuuacaguaugcgcuuugauaucagacacaguggauaccucggguucacagagcuaacucugaccccugaguagaaaggucuagaacuaguugauucagauaggaaaauugcccaugguuagcuccuguggcaggacuucauuuaucaucaggccgcccugccaccuuacacauaugggucccagcagggggagcaucuccugucuccaggagucugucaggaaggguuugaggcaguuuguuggugucucugugcagugacaauugacacauugcuggguguuugguucuuacuacugacaaauuauuucacuacugcacauuauuucaucucaugaccuuccugguauucugauagaugucaguacaaguagguuucuguccugauuauucacguuuuuuguuuguuuuuaaaauugucauccaaaaggugguccaggccauuucaggggucuucuagaaggguuugcugugaaguauggguuguucacugugacacaaugcugucccugguccaugcaguaucuaggucuaugugugcaugucagcagugcggacagaggcagguacaaugugggcugaagaccacugucuuugccuuuuugugggacagccacuguggagcgcgagauggagcugaggcauaaaaacgagauguugcggguggaagcugaagcccgagcacgggccaaggcugaucgagagaaugcagauaucauccgggaacagauucgacucaaggcugcugagcaccgccagaccaucuuggagucuaucagguaaggaucagccagaacuuagugcuugcuguccaucugccuuguaguuccuagcucaagcuagcgagucccugaaggucaugaagggccucuauccuuccuuauccuacagcucuggucugcucuuuaaaacucccaccuugguagacucgucuucugagacugaccugagagacuuuuguuaguuucuuucugcccuugcccagcaucucgucuagaaagucaugugacuuuuccucaugcaggacagcuggcaccuugcuuggugaaggauuccgugcauuugugacagacugggacaaagugacagcuacgguguguacuaccauauaucccuaggggugacacuagugggguagcucuagggcacagucuccagggacuucccugauaccugcuggcuguggggacaccugauaucuugcagauacacucaucucuguugugccagcucagauaagggacaugagcuguaauaacugucuuuaagaacuauagugagacuugauaaaguauuugggcuuaggggcauuucagacaauucagucuucucugaauccaauuuacguugcucuaacuuguuacccaaagcugacuaacauacaaaacaagaagguuaauugguguuggaaaggcuaaauagugccaccuaaugacuucuaggccccacucucuaauauuuuguaaacuacagcauugcauaagaccaaguacuuaucauauaaaucuuagaaggacaagucacaucuagucauggcaguaguagccuaccuccaggcaccgauauagggaacggcuagaagucacuuuccaguguccuugggagaagguagugauaacaauuuuuuuuuaagauuuauuuauuuauuuuauguaugugaguacacugcagcuguacagaugguugugagccuucaugugguugcugggaauugaauuuuuaagaccucugcucacucuggucaaucccgcuggcuccagauggcccugcucgcucugucccugauuccuccggcccagagauuuauuuauuaucauacauaaguacacuguugcugacuucaaacauaccagaagaaggcaucagauuucauuaugggugguugugagccaccaugugguugcugggauuugaacucaggaccuucagaagagcagucagugcucuuaaccgcugagccauugcuccagcccaggauaacuuucucuuuuuuuuuuuuuuuuuaaagauuuauuuauuuauuauauguaaguacacuguagcugucuucagacacuccagaagagggagucagaucuuguuacagaugguugugagccaccaugugguugcugggauuugaacucuggaucuucggaagagcagucgggugcucuuaccugcugagccaucucaccagcccacuuucuuuuuuuuuaaucugccuuuuucuuuucuuuuucuuucucucuuucucucuuuuuuccuuccuuuuuuuugagacaggcguucuaauucuacagcucugauuuauguaggguugggugucuggaacuugcucuguagaccaggaugaccucacacucacagagauccacccuccuuuaccuuccaagugcugggguuaaagguguucgccaucaugccuagccaaguccacaacuucaugaggcaggagguguugugcacuguaggagauggacucugauaccugaagcuucuucagggagucacuggagacuucaugccagcgaggugcagagguugauccacugacggggagugcugcgggcacacugguuuuuauuauauagcgugcugaggauuggaccugacgucuuaggcuugcuaggcgggaacucugguaaaccacaagcuagccuggaagaugccccucuuuauggaacugcuugacgugcuaauacauugacuuuuaaagggauuuaugguuugugguuagccuuguuuucuaagaaugaaguuuaauuuuuucauugguaagagaacaguggaagccaagacccuuagagagucucuagcccuguacagccagccacauuccaucucacugccucugcuuuugaggauucauguuauaaggcacaaagaaaaguguugugguguggagcgccagugauaaagcuuuuguuaucaccugaauugugcaagagcuuugguuggcugugguauagggucaggcauccaaccagggucaguauaggccaccauggguugccuuagcuguuuugggggcacaggaugaacuguggggcagagaugcaauguagacugcuguuuuucugucccagguggcuggguugacacuauuagcuguuggagucuauucugcaaagaaugcuacuucuguugcuggucgguauauugaggcccgauugggaaagccguccuuggugagagagaccucccgaaucucagugcuagaggcauugaggcaucccauccagguauggccacaguaaggguucaggguuacacuuccuugccaggucucuucccauaucacaaacaaguggugugcauuuucucugugguugauuucccugucaugcuggcauggguguuuucucacaacuauguuauaccaaugaggucuguuaaccaguguucucuaauuauaugacugccccuggguuugcuuuagcucuucauaaccugagcucagauucuguccugcauagaagguaugacuguaguguggcaucuagcgccucccuuaggcucggcugcucuuugcucucucugacaggcuuauucucuggcuuuagcugggucucuucagauaaucagcacaggugguuggaaagauaaagaucuguaguaaagagcuaaucaauugcucaagccccacacaggcacugucuuuucagcuuugacacugggguucuagucuuggucuguguggggcaguacuucaugguacuugagucuugccaacugugguggucuccccuaccaggucagcaggcgacuggucagcagaccccaggaugcauuggagggcgucauccucagugugaguugauguggcaucuguggcuuguggcccugugggucccaggggagggacaacagaguugagcuguuguguuuaugugauccuugugcucguggcuuugggacccugaaacgcauguuacugucaaccaaaccuauauucggauaccucauaggccagucuguauguacaaggaguaggcugcacuagaauaccugugguccuuccacucccuaaggcuguaggcugggagaccagguuccccaaaccucaucuugcucuggcagccuagccuggaggcacggguccgagauauugccaucgcaacaagaaauaccaagaagaacaaaagccuguauaggaacguucugauguaugggcccccggggacuggcaagacacuauuugccaagguaaaaauuccugacuaugaaggugggacugguuucagcugggcaucucacccucuggcagcguuugucacuuguucucagagcacugcagugcauuuagggggcacuggcucugaugguggaguugucuaugcuagacaggguuggcugguggagguguaggguugggacucugaagggaacaucugcucuguuuccccaccgcucucugccuagaaacuugcacugcauucaggcauggacuacgccaucaugacaggcggggacguggccccaauggggcgggagggugugacugccaugcacaaggucuucgacugggcaagcaccagccgacgagggugagcauauaaccccauguacguagguuucuacuccuauggauccaccagguaccuagcuaaggccucccuacuguccuguccuugaaguugugugggaguacauggguagccucuucugaagacagcuagggauggaugcuuaugcugaaggguccauuagagaagaugucaugccaaggguggacagaaggcuuccaguacaagggugcugccaaucagauauaauuacugccaggagugaagagccaacucaaauggggaaaggaauggcccgaggccuccuugacuguuggacccucugagaguuggcuaagaaugucauuccaacgcaugcaguguacauggcuagaagucccuggcacuguugcugugccuugguauguccuuuccuuugaacuuugccauuucaccuuagauaaucacuucuuucugaugcggaacacaggcucucagcucugaucuugucugaccgcuuugagugagaccuguagguagaaggaacaucagagcuacaguugggcuuuuaguguuggaguccuggaggcuuugagcucuggucuucacuggguuagcauguuaagaaacccagauaggaggcgcuggugagaugacucagcggguaggagcacugacugcucuuccaaagguccugaguucaaaucccagcaaccacaugguggcucacaaccaucugcaaugauaucugaugcccucuuguggugugucugaggacagcuacaguguacuuacauauaacaauaaauaaaucuuuuuaaaaaagaauccuugcuagggcgugaccuguggucuugguguggggcagcuccucucagggauauacacuguacuuccuguugcuucugcugauguuggcuuguggcauucaagcaucuucuuaaccugacuacucugguucacagccuccugcucuuuguggaugaagcagacgccuuccucaggaaacgagcgacugugaguguucuagaacccugucuggcuuugggaguuggucagagcugggugcucuaagccagucucgcaaaggacuggccuagagguugcuaugaccuagagcacagaaaggcgaggccuucaugaugcacaggccgaggcugcaguuuaguugcuuuucccucuaaguuugggaaguuugugauugagccggaguccuggagaugcguaacauaacauccuccucacggaccaccccgcccucuacagugaucccgaaucagcaggaaucccagguuuggcucucaggucaggccugugcuccuaaccccugccuuucucucccagcagugucuccuguggacacuuuaacucgggccguguacaaaacugcuccucaggcuggagagugaugcugaauauuuucuuucuguaggaaaagauaagugaagaccucagggcuacucugaaugccuuccuacacaggacaggacagcacaguaguaaguaagugcaguccggccccuagcucccugagcaggcuauuucugggcauuguuaguucuugguccucacaggggagcaaagauauaauugacaaaccaucaugaauucaugaguucaaugcauguaguauguaggugggcaacucucugggcugucuucauguucuuaccugggaagggcucuuaaaggcccauuaaggcaauaugagacaugggaaacucugcuagguuaguuccugucaacauggccacccgguuugaacaucaccccacgcaugccuuuugacauccagcuguccaugugcagcugaacuaagacacuccuguuacugaccauguccgaagacugcuuucagggcaccggcacccaggccugagcccagaauguguuugcucuuucugggagcugaucccaagugucauguguugaaagaauagagccuuggucuuuaucugcgauacggggacuaggguagcaucuaggccuugaaagagaccccaguaagagcugucucccaggauuuuguccaaaagccacuggcagggucggugccuauggucagacaagcuucucuuauccaaguccccuaauucuauucuuagcuugcucaucacuaggguaggacccagccuuuucguaaauaugaggccacuuuauccaucacaagccccuuacuugcuguggucauggacuggcacagggccugaggauaccaggcaaccuugaucaggguuguagaaaugaucuggugggcuugggguuuccugaguuaaaaagcugucaggaaugacagguacaucucagugacugaacaccugcccaacauucuuuaaucucuggauucaaacccccagacgaacaaaacaaacaaaaaacguggaagguaagggagcaaggaagaaagggagagcugccaaguuacauccaucuaucagguuuaccugaggaggcauaagaggcccuucugagcugggcgugguggcacaugccuuuaaucccagcacuugggaggcagaagcaggcagauuucugaauucgaggccagccuggucuacagagugaguuccaggacagccagagcuacacagagaaacccugucucgaaaaaccaaaaaaaaaaaaaaaaaaagaagaggcccuucugucucugagugacuggugauuggacaaaugcacuuuguggcugcagguucaugcugguccuggccaguaaccagccugagcaguuugauugggcuaucaaugaccgcauugacgagauggucugcuuugcccugccacagcgggaggagcgagagcgccuggugagaauguauuuugacaaguauguccuuaagccggccacagaaggaaagcaguaaguauccagccccgcgggguuccccuuauugaccuggaaccugucugagcgcuucauuucccugggguuuaggccaucuguguggggucacauucuguacaugugcccuggcaaagguggcucugucauggggacccugagcccuuccucucacugcucuuuacgggaggacagcugcaagcugccccaacagcucuuaagugccugagucacugaguccuggguaucaggagaauauaguauccuccacguggcacccaccacauuugcucugugccuauuguaccagguuugggaguugcaguucccgcccucagcuacugacuaagugugacauggcuuucuucugucuacuugcauacuugcccugccacuccucaaagcugcucugcagccguguggggagaagccaggcugugaugaggcggccuugguacaggcccucacugcugugucugguucacuuccccugucucccaucagcagaggcugcucugcuuucagcugucuccuggggcccaggcuccauggcauucagucuccauguccugaccugaaucucgccugcugccuguugccuuuuacuauauucuggagaaaacauggguggcccugcuguuuccuaugggcccauccuccacccggucuggucaaguccccugccuccugcuagccucauguccccaaccuucugcuuaggcaugcgaccucuauucauguuucauguauuucuguggcuuuuggucaaauguuaaugcugaaaauuugaauugcagguccuuuuacuuaacuguucuauuccuuaccuggaaaucgaccuucucuguuagaauuugauugcugagcauuuaaguaugccugcucuuugggugcuaaauauguaguuguaggcugggucuaguaaggaagagugaagacagauugggagaguauagcuccaucugccaacccuuccuggcuccaaccuggcaucuccugcaggucaggaaggaaggcugaggauaucuggcagaguuuaccucauccaacuucggcuguacaaaaaagcccacgcacuaaugguggaagcaucugauaagagugugauccugggcagccuugcucgccaaucuccccagccccguuuguauagagccauggaagcccagacccacuuaggaacuuuuccuccaggcgcuugaagguggcccaguuugacuauggaaagaaaugcucagagguugcccagcuaacggaggggaugucaggccgggagauugcucagcuugcuguggcguggcagguaaguuaagguccugggaucuaacccacucugaauauuauccuaaucccauagugagucuuauguuggaggauguucuaagcauggauagacagacauguggcccuugguucuacugagggcuaaugagucacucaugggaggaugggacgauaucacuagcucagcuuguucuggcccaaaucuggagcauugucacagucuuagggggaugacagguacuacagcagaugugcaggagucucugggggagccuagagggcugcuuugaguuaucuguuagacaauugcagacaaguucggaucaacagauuugcgcuucauggaugugugcucuuggguauccggcuuuuuaggacacguuuauguuaaaguugagcaagggggcaggaauguuccuucugaaacucgauaaagguguuguuggcucaaggcauaggccacaguggccuauugucauucccuaaaaucauguuuuguuuuuuuucuuugaagcugccuaguaacagcuccauggucuuguggcagggagcuccuacagccgggacagggcaauuuaggaauuucagccuuuaguguugucaagaaaauucauguugaugggggauggagagugcuauggccaucucaaacuuugcgccaacuuuaccaugucccuguagccaacuuucuguaaccaaaugacagccuagccacuuaaacuuggcagugcuuuuaaagguaugcgugggacaguccuauuuagguuuggauuuuguggccacuggguacaugagggacauacacgcucgcaacacauaucucagaagcagcacccuguuguggcccuuguucaagcucuguucccacaacuaaugguggaggacagggagcccagcacaguauagguggcuugcuuauaaaccaagaaguaauuuuuccacauuucuggaggcugaaguacaaaaguuagugccaacauggucagaccuuaaagaaggcucuuuucuggcuaauagaggucaggguuuugcuggguccucauaugauagacagcauccgugagcuuuuuuuucuugugcaugaauuccaaggaaccagggacucuuucugugcccucauuucaaggaaauuacuuccucugaagaaugaucucuaaauauauaccuaugagaaugucagaccuucgucacguuaaauauuauggggcaauacacugagcugaucucggcagguuaccuggcucacaaagcugucacccagauagcucaccucugucagagaguagaaaacagaucaagcaaggcuuuaaaagggagagcugggcaugcucccugaggguucuggcaaguggacagcgugacgaaggcagguucaccuaggcuguucucuggagaggaacaggugauacagagggacugucuaaggugcugccucgguccugccagccauggaauaacacagacccggaugcugcuguuguuuuuacccccauaggacuccugaauacuugcacaucacggauacuuccuuguucuacagccucuaucuuccaugcaucaggauaauacaagugcugccuuugcaaucaucccuucuagggacugacugugcacuccagcacacacacacacacaccccccaccccccuuaacacagaaugcugucuuaacuaccuuguucuuguuuuuugagacaaagucucucuagguaguuuugaguauccuagaacucuauagaacagguuagccuuaaaggugugcaucaccguaucuguuuugcuuuguuucacgugggguguuuuuguuuguauacauguccacauaccauuugagagucuggugccugcagaagaaaggaugccagagccccuggauuggaguuacagaugagguugugggccaccaugugguugcagggacuugacccuggguccuuuggaagagcagucagugcucuucacacugcccucuuccagccuugaaguuguggaguuuuaguuuuugaauuguaggggcucuucuccauacauaaugcugauauuaaccucuuaccagauaugugguuuacaaauauuuucuucuauuggauagacugucuuuuuauucuuuugguaauauucuuuuuugguuguugacguggaacuugcuguguagaccuggccagcuacaaauucauaagagaaccacucgccucugucuuguguacaaaacuuuuacauuuugauggagucugauuuaucuauuuuuucuuuuuguugucugucauaccauuuaauaaaccauuaccaagcaggacaugauggcacaccuaugaucccaguacuuuggaaaccgagccaagaggguugccaguuuaaaaucagccugggcaacacaaugaaauccuaucuuaacauuuaaaauugaagucaaggcuggggauguaguggugagaggagugucugccuaugugcguuccuggccuuaaucucccguaucacaacaauggugugcccucggggaauguguguguuuguuuguugagacgugaucucacucuguagcccacccaagcuagccuugaauucccuuaaaauucuccugccucagucucucaaguauugagauuacagauguguuccaccaggcugggcuuaggcuguuguuguuuauuuaagacaaaucuuauuuaagacugggcugcagcucucagugcuuaugcaucaggacugcuggucuauaaguuucacugcugucuucaucugccuuugaugucaaggggguggugauagugugugggauaacuacagcuaguguuucucucccuucccuucccuuccccuucauuguugaggguuuaaggaaaaucuauuucuugaaauauuuuaagauuuuuuuaguaugcauauguguaauauacuguauguguuuuaugugugugcaugagugcaugcauuuguuuaugugcacuauaugcaugccuggugucuacgaaggcuagaugaggacaugaggcuaggaaugguggcacacaccuuuagacccagcagggcagaagcaggcagaucuguaugagucuacagucagcauagucugcauagcgaguuccaagccagccaguuaucuagagaggcccugccuuaaaacaaaacacaaaagaguacauugauuccccuggaguuacaggugguugugagccaccccguguuggugcugggaaccgaaccugggucuuugcaagagcaguaagugcugugaacuccugagcaccuguuuacucauuucgagcuggagucuuacuacauugcucagccuggcuuugaccuacacagucaagcaauccugccccagcuucaggagaggcuaguacuauaggcaaaccacuacaccuaguuaaacuuaaaacauuugaauaguuuuagauuuacagaauaguuggaagauagaguugcaagaugcuugccaccagcagguugugagugaugcugcuucauagcauuguuuaccuccaccuuggcuugcuuguaacccaggguccagcccaggauacccauagcaugggcccucaugucugucugguuuguuccaccugaccugaguuccuggcuagcuggugggugagcucuccuccgcuaggccuuuggcaagguguagacacuuagagagagcugccacccuguccauccagccagggcuccuguguagcugccuaccuugcuuuuggccuuggugagcccaaacugggagagaguaucugugacgaccagacaacucucagaguugguggucuggcuguagggucaagacuuccuccacagugaaucauaguaagauaguggacccuaggcccaucuguuccuggcuguccugcuuguccagaugagacagaauaccauuauggucaucuccucccagguggcagugucuuggcagaauuguuacaugagacucugcaauccuguuccuuuacaguguguccuagugcccuggguggaaaauccucugcccggaguguucccuucauuucagauuucuccguaccuugugcugauggcuuucgggacagguucugcuucaagcagaaaaccagcaggaguguggucucgaccaccugugagcccuggucccuuuauaguaucuaaaagguacaacuugaccaguucaaacuccugcuggcugguccuagagugccauccuuggggaggauaaagaagugagaggggccauugucauccagugggaacagacaugaaaaggagcagccuauccagagaggaccacuugguucugauuggagcaaccucacacuuaacaccauacaccccgaagauaggggcccgccagcagcagccacuguucgggaggccuguaaaguauacaacugcauaaucuggccugaguaguugcuaugugaccugggguaugccugagcugggaaguggagccagaauaauuuagggguuuaugggggcucuguauuuguguccugcucagagggaguuagcuuaugugugcagaggggaaacagcucuguucaggcuuucuauuuuagaaacguauugggaaauuuagcacugggcaguagcacugggcuaugggcccgguacuaagcucaggugugcccacugugcuagugucuaaugugggucuagauugagggccuuggccucccugugcaagcaacuagcuucuccucugcacccucuuuucuaccaggccauggcauauucaucugaggauggaguccucacggaagcuaugauggaugcccgugugcaggaugcugugcagcagcaccagcagaagaugcaguggcuuaaaguagagagacccgauucccagaccaacaagccgccacauccuucacuccucagcugcugagcuggaccuggacaccuuguacaccugacuggggcagccagucucuaugaccacacugcucccuccuuuccugucuucuuugaccucuguaagaggucaacauugcuccaaaugccucugcggaguugugggauacuggaggugucagcuucucugccucccacaccuccucgucucugacucugagugcuggcagagggaggcauacugccuuccuuuaccucaguacacuggugagacaugucuacaagcccagagcagagcagagagugugcagagugccguaccacaagccaguggcuaugccagcgggacuggggccuacagggaccaggcuaaaggcacagggggcccucagcuuccuggacauuacuccuaccauauacacaucugugccaagaauuggcccagucuuuacucgguagaguggaucuggugcuagacagcgcuuggcccguggcauccaagcgucagaacuaccgccuucccucuacugaguccgggccuuuuaaauccagaaucgaauaaaacugugacugauuuucugau

SEQ ID NO: 2319 - RNA, 6552 nt, Mus musculus
cgggaccgcuauggcaugcaucaccgugcagucugugcagauuggccucugcgcgagcgacugagugcacgcgccucccaagcaggaguggccgcgaguggguguggcuucuccgagguggguggggccugacucacgguaggagggcaaguuagcagccagcuguggucgaucaagagcccgccacuccaggcgcgaugcuguucuggacugcguucagcauggcuuugagucugcgguuggcauuggcgcggagcagcauagagcgcgguaaguguggugaaacccggauuccaauucuucauagccgauccgcugcugcccacgcgggucaugaacuguccaggugcagccgccgaaccaguaggugggaaggccgggggagcggguggggcacacgccagcaccucagccaccugcggugggcgcucggagacauucuuggugacucaacugagcuagagcuggacuuggagcgccugaggcuacggucccccccacuccaucccccucccccgucccgucccaccccgcaccucagacauggauuguggagaaagauguuuaagaggucucccugacucaguuuccuuaccucugaaaggucccucaguagaaaggagguaagaauauuggaauggccacaccaugagggggaaaccccaaagccaggacuaaauccaggcacuugagagcuguugcguauuugagucuuagugauggaaggucucaucaguaccucagccggcugggcaggaagaaaaggggauaaaagggaaggcucgcuagacaaugguuggguccucaggcugcugcggauggguauauccugcuuucuugguacagaugaagcaggggaugggggccaggggaggggaggggugaugucaucuguaaccagucaggacuccagucuggcccucuuaugggcaggaagggcuguucaguguguggucuuccccaucucuucacuuuugcucucccauccucucuuguugucccaugggcucagaguccauugcuucaccuggaagaugaauaaccucacuuaacuucauccuagaggugucccuucugaaaaucaaguaucagggaagcauugcauguggcucaggccccuccugaauacagaauguucuaccugcaugcagugucuauugaggacaagggucagcauuuaccuacuaaaggagcacggggacagcccaggaugcccuggguacauggacauuguacaguugggaaccagaggagagugugggccuuuuguuggcauuuauagccccauucugaagauucucuaccuguaucuuugggcaaaggcaagcaagcaugugcuuaaagaaaguucagaccuuugggggugguucugcccugggcaagggggugccuggcagggcuaccuugacugaaccccuugucuuuuccucuagguuccacagcaucagacccccagggggaccuguuguuccuguuggacagcucagccagcgugucacacuaugaguucucaagaguucgggaauuuguggggcagcugguggcuacgaugucuuucggacccggggcucugcgugcuagucuggugcacgugggcagccagccucacacagaguuuacuuuugaccaguacaguucaggccaggcuauacaggaugccauccguguugcaccccaacguaugggugauaccaacacaggccuggcacuggcuuaugccaaagaacaauuguuugcugaggaagcaggugcccggccagggguucccaaggugcuggugugggugacagaugguggcuccagcgaccccgugggccccccuaugcaggagcucaaggaccugggugucaccaucuucauugucagcacuggccgaggcaaccuguuggagcuguuggcagcugccucggcuccugccgagaagcaccuacacuuuguggauguggaugaucuuccuaucauugcccgggagcugcggggcuccauaacugguaggugggaagaggcagguccugugaaucccuagcugacagcuugcugcagggagaggaucuguguggagaccagggagaacccaugagccuggugcccuugaguaugugauaguggcccacccagucucugcauaccauccaggcacguacuccuucugggugccuacauguacccugacaccuggguuauagagagaauguggcagaucugaguaaccacuucaagacaggacucccagacacgggaacucccaggccaacgaacugagggcuacuuugagugggcuguguguggaggggccaaguacagaggauaaaggagguccagggcucccccagguguaugccuauggcaucaugugccuuuguguauauccagggaccaaauggcuugccagucccauaauucccggagaagugaccaaacaggucagggaaugucuccuacaaagcuugggcccuaccuauuccaugcuugggaaccacagucagggagggguuggagguggcuuucaaucgugucuauugugggacugcugggaagauccgcuguaggaccuacgcaccugcuuucuccugggccuccuaucgucagucacccaaggagaaggaaggggcuggagacuaagggccugguguuuggcuuagccuguggagggcacugaagaaugcuaucacuucaggguagcauucuuaccaagucucuuucugcagguuaaucaucuacacuaaagaggaaggugugggucuauggguuggaaaggggugaaaggucugccucaagagaucuucugaggacaucuccugguagacccugggccaauaggcccagaugaaccuggaaggggcagaaggagaagagaauaucaccagagauaaacauuaggguggagacgucuguaacuaaggucagaaucuugagugggaggcugggcaggaaaaugagugcccagcugaccgaacuuagcaccuuggcaagaaagccaagaucuggauggccuaccaagacucagcugcaagcugaucagauggcuggcugaucauguguugguugucgcugcacaggagcccauucuggagccccccuaccacucucggauaggaagguccuacucucuccucacucuuagguccagcagguccagcagcuuuuaaaaggguuuugucacacuuuuacugcuccaggggccacuaacaugaagucucccagcuucuggucuguuuccuccuccagaacuguucagaauaugucagaauaugucugucucacgacacaucucguguuggccacacagucuuggaggacuggacuucuguucuuagauaacauugugagcauugccaccuuugagguaccuucauccagguuguuugucugggugaggaguagccacuauaucuuauaggucuggguuuguggugaaguaggcagggaagucuaugacggggcccagaguugggggcuauacuccucucuguccuucuaucagcccagucagaguuuccuagucauuagcaucugcuggugguauauaccuaccuggcucccgccucuccuuggcagaaggccucaccuguuuuauugggggcuccaaucuuaggguccucuccaaaucagugagagccccauuuggugacacggucacuucugcucccugacuccagcacuaaaccacccuuagaugcgaugcagccacaacagcuucaugccucggagguucuguccaguggcuuccgccuguccuggccgccccugcugacagcggacucugguuacuacgugcuggaauugguaccuagcggcaaacuggcaaccacaagacgccaacagcugcccgggaaugcuaccagcuggaccuggacagaucucgacccggacacagacuaugaaguaucacugcugccugaguccaacgugcaccuccugaggccgcagcacgugcgaguacgcacacugcaaggugaggcaggggcacucgugggagggcaggguggcaugggaagaccacuccuccacgcaacuauccucuuucuucgcagaggaggccgggccagaacgcaucgucaucucgcaugcgaggccgcgcagccuccgcguaagcugggcccccgcgcuuggcccggacuccgcucucggcuaccauguacagcucggaccucugcagggcgggucccuagagcgcguggaggugccagcaggccagaacagcacuaccguccagggccugacgcccugcaccacuuaccuggugacugugacugccgccuuccgcuccggccgccagagggcgcugucggcuaaggccuguacggccucuggcgcgcggacccgugcuccgcaguccaugcggccggaggcuggaccgcgggagcccugaacugccugccugcucguccacccgggggcccucuucccuagcccggagagagagacacugcugcucguggguuuucuuguggauggagucggguggggagaugggaugccgguccugccuuugaccagcguuaauuccuuucgucguuuccccacuggucaucgccgcccuugccugacuuccgggaaacccggguagccucacgcgcaauggcgguccucuccgguugccaguggaguugagcacacggugguccuugggcaacucuuggcgaggggauggacagugucugaggucagguugaggacauaagacccaggacaagccuucaggagaggaggccacagaguuuccaaccugugccaaaggcugggcccucugguggcagggacuacgcauggcuuugaggaggcguucaggaccauccagguccugccugggccuagaaaguggguaggagaaagggaagagagacuaguguagacaggauucccgaaaacuuccucaaggaaaggaaagauagggagguaugcugggaggcugaugauguggcauugguuuucaucaagauguccugccagccuagaggccgggaucugucagggucacugacucugccuuccugcccaggaccugcacugggcccucgaucagugccaaggaugcagucuuuucacaggaaugggacgagaccuuggcauuuagggccucagggauaggagagccgcacuaugacagauucuaagggagccuccugcuuuaguguagggagcaaggugucaugcaggugggcuaccuccugccaucaccauuacccuggggcaucugacagauaccuaaggguggucaggaacagguuuccucucaagucccuauguaggccucuccucuccucucagaaucauuugccuuaucccaagcuuacuccaucucuuccccacuaaugacccggacucuaacaacaauacagucagacagacauaaacugugccugcagucucauuaaaaugcuguauuuuucgucaaaacucuccccagcugugguacucgugugggcagcaugaaagguuggacguacaggguuuauuacguuuggggaguaggggaagcaggucugcagcauccguacacggaucauucaggcuccugucccuccauguucccugccagcuucauaccagggccucacuucugcagcccgcgagcgauccagugucugcaguaggucaaguuguugcugcuacaacucagagggcaggaggcuuuacagggguguccccaccaccgccugugcuguacuacacacugcucggcccucuucuuacauguuuuccuuacacuacuuuggcugcaagugagauccaggagcuaaguauugagagaggugggguagacuuuggguauggagagagcagagguggcuuuccugagacuuugcccucuaccauuucccgagaagcugaaggagcacgguagggcucauccuggacacccaaaggagcacuggccaugcaccgaacguguuguguuggugggagguggcuguuugugugacgauggcuugagauacaaggcccuagccggcucauggagcagaagccauugggguauguguguuugggaggggggggcccucuccauguguccuugucagggcaguaagccuaugugugcacuuacagguuucauguuucaccuguugaucaaaaguuggagcucagauacuuccugugaugucaguuuccaggccagaggcugaggccaucugcauccaggacagauguagguuugguauguuggccucacauuccccuaaaauauggaaguuccuccaagcaauuuguguuucccauucuguuugcucagaugacuguaggucaacuggccacuggagagagccacaaugagucccugugccugacauacagaacacuaagcagguggcagaagaguaccagagggguuguuauuaguguuuaugguagccucuguuaauggcuaaaacucacgagaaucaagccaggcguggaggcgcgcaccuuuaauccuagcacuugcgaggcagaggcaggcggauuucugaguucgaggccagccuggucuacagagugaguuccaggacagccagggcuacacagagaaacccugucucgaaaacaaacaaacaaaccaaaaaacca

SEQ ID NO: 2320 - RNA, 4293 nt, Mus musculus
cacauaggcgcugccugccuuugccugguaaagaggcccaacaagguagcaggggaaacuguggcagagguguagcccuggagacugauauucagugcuagauuaaacuggaugagagucuacucucugauggcgaggaucuagaugugaacugaaucuggggaggguaaaaggcucucuagucugggccuagggugguuggaggagggggauuaggccugcugccuaccacugugaucuugggggaacauccuucaagccccgcggcacgacaugagugagcaggaaagggagacagaagaggaugaaggcguugccucagacacagcacccaugcuaccccgaagaaggccuacugauuaccacaucucaguccuggcuccuauccuggccacccgaggccucgggacccuggugcugucuggccgggcucuaguuggguuccugcuucaucugcugcuaccuggaacagucuuccugcugguguugcuaccagcagcugccguugucuaccugggauuccugugucacucaagggugagcaguagccauugguuaguccccgggaaguggggaagugagaguucuguggagguucaaguccuugggguugaaggugaaucuacccccuucuagccuugccccuuuguaaccagagauauaugcauccuccuguuaugccaacaucccugccagcugcagucaaagaaagucucuuuguuacucggugaacagcugucuugcuuccccccccccgccccccccccccaggccucuuagcuuuguaccaggagguacuagggccuggucagugagguugauguggagauaggaaaagaaauugucagauucacccguccucagugcuucuccacuccucauacuccucccccccaccuccucccccccaccuccucccccccacagcccuucccugaacccucuugaccuugguuaggcuuccgcucaucuaaggcuugaccuauacauagacgaccccuauauccccuuucugaagcugauagagagaaacgaugcuagcugggugacaguccagauggagccauaucagcugucaacagguaaggggcauggaaggaagcucauauggggacaggaaaacuggguugggagagccagggagguucucuggccuuuccuuaaggaauccccgaacacacacucuugguucuguucucgcauuucuguccaggcuccaccuccaggcaggccucccagccuuacgcuuuucuuucuggacucugcccugagcucggggcccaggaccucccucaccccugcgcugcucuggggccuccccgccugacugcacgccuccacuguccacagguucauccggcuccggguccacggugccgagcgcugcucucggaccgcggcuccgcggcgcucauuguguucggauugcucucccugccgccgcucguggugcucgccgccgccgcgcgcucccuccugguccggcgacuacgcccugcgcugccugaucccgcgaggaccccggcuccgcgccgcccgcccaggagcagcggagaucuggccgacggccacccggacgaggacaaacaacucugugcuugggucugacgccucaaggucucugcgcgucaagagccucccaggucccucgacccccguaaaguggaugacucgggcggcugcuuuggggcucugagagcagugcucgaagucgccaggagauggcaacagggucccucagaagagggagaaagggugucccuucaagaaaagcagaaaagcauauuaugucuuccacccaauucuguggucagcagccgacuuggcagcuaucucugaauccccccccccaaccacgcauaauucuagaagcuccgguguagccaguagcaaccagacgucauggcucaacuugcgggaucagcugaguccuccaaggucuugaccuuguacaggacaaaagaucaguuggguccauggucaaacuauugcccggaucagguuugagauaggaucugggaucagugauucaguguaagugcaggaucggcgugucguuguuaauauguaauuuauuuuuauuuauuuauuuuugugcguguguguauugauguuuugccugcauguguaucuaugugggggugucacaagcccucgaacugcaguuaccggcaggugcgagcugcaauguggguucuaggacugcaaccuggguccucuggaagagcagccagcugucuucuaaaggacccugagccaucucuccagcuccuagcacucagcuugcauucggggucagguaucagcgcauaucuagaacuggagcucauucucugaccaggggucuuucuuuugagacaaguggcagaauacgagcucauuuuacaauguggguaauguuaagauuuaucuuuguauuuggcaugcuacaguuugacuaacauguuccuacuuacgcauaaauuaucauucuccuuucccucccugucuccuaucuucuccucuuccugggacucguacauacuagaacuagaauaucuuguuucuuuuuauuuuuauagaauaucuuauuucuuuuuauuuuuaguaguccugggauggacuuauaaauguuaggcaagcacucuaccacugagcuauagccuuagcuguggauauauuuuuaaaauuuaaaguauuuuuaaaauuauuauuuuugaauuuuauuuguagaccaggcuagccuugaacucagggaaucugccugucucugccccacuccccacccccaaguacuaggaauaaaggugugugcuaccauccaggguuaagccuugaacauuuuaauuuuaaaacagaaauucuacuacuucuacuacugagugagcccuccagaucuguuuugguuguaagguucugcuucaauuccugccuccagguucuugccuugaguucuugcccugacuacuuuuaguguagugagaucugggaaauguaagaugacauaaaccugucaugauggguugucuuuugucuguuugccggccugccuaucuaucuguuuuguuuuguuuuuaaagauguauuuauuuauuuauauggguacacuguagcugucaucagacacaccagaagagggcaucagaucucauuacaaaugguugugagccaccaugugguugcugggaauugaacucaggaccucuggaagagcagucagcacucuuaaccacugagccaucucuccagccccuaucuguuuauuuuuaagucaggguuucucuguguagccuuugcuaugcuggaacuuacucuguagaccaggcuggucuugaacucacaaaaaucuaccugccucugccucccaaaggcugagauuaaaugugugugccacugcucgguugguuggucuugaguuuuuuuuuauuuguuuguuuguuuuuaaauaauuuauuuuauuuaauauacauugguggcuuugccugcauucaugucugugugaaggugucagauccccuggaucuggaauuacagacaguuguaagcugccacgugagugaugggaauugaacccugguccucuggaagagcagcuacuaccgagcuaucucuccagcccuuugauccugauguuuuaucaaagcaauagaaaccuaaggcaggcacuaacuuuaauagucuuguccagagacaaaaacaaccagucaucuuagguucccuuauggcacuagcucauggcccucaauacagaguacucgccccuuccccucucugcaccccagcaugucucucuguccuguguucagagaacucuuuauuuuccuaucaguucccuucaauaugcugguugcuucuuauuguuguguuauuacuuuuuuuuuccaggacgaguuuucucuguguagcccuggcuauucuaaaacucacucuguagauuagucagaccuugaacucagagaucugccugccgcugccucccgaaugcuugaauuaaaggaguauaccaccacuuucuagcuuguugcuagauguguguguguguacauguauggaugugcaugugccacaauguauguguguugugacagucagagaggacaacuuuuaggaguugugggucccagggauggaacucagguugucaagguugguagcaagugccuuaacaccaugggucaucucucuggucccuugguuuauguuuuuguaauguuuaauuguugggggcgggggguuguuugagacauauuuucuuguaagcccagcaauauguuaaaaauaugcucauuauaauuuaccuggaaucuaauugua

SEQ ID NO: 2321 - RNA, 2340 nt, Mus musculus
ucugccuacagucaauaccuuuccuccacgcuccacaguuucaugaacuuucuuuaggaaaucucgcucucugcagcguuuggaaucucggaugguuguagcauauguggauucugugaugagcaaguuggggcgacacuugucaauccacgcagcccuagaacagagauaggaauggggaugauggguuacucacgacuacagaauuagcccccggcauaagcuccucuaccuggccugucaaacaucacgggagcauacuaggaggagacuacagggacgaugagccuguagcccagacuuccacacugcaugggaggacuuaggugaccaccaugacgucucuuagagcuaccaaaucccaggaagccuccgcagagugagucacagcccuacuuaccccaaaugccggucuggggucauguuauagucacccuggccaaaaaauaaaaaaauaaaaaaauccaauaaggaaguugucuuucuaccccuagcaauucacucaaaccaaauacuuccacugaccguguagaccacagacuccgagcccacuuuaaucuggaacauggcugcccccagcacguggccugcauaguaugccuugauuuccagcucaucauccaccugcagaggaaagaacgcucuuaggccugcagggcaggaaggcagcaggaaguaggugauuaccuuaaccccguccagccaauuccuguuucucagaagaagucuagggcuuaaggguuguagcauaguaaaaaacaaaacuggguuaaggaucuaaggaucuagaagagaagaagaaauucuagaacuaggagcuacaggaacccaacuuaagaauuuaauagaugaagcuggguaugguuguacaagccugucaucccaguacucuggaagcgaggcagggggaucacuauggguucaaggccagccugagguacaugguaaaguccuaucucaagaaagaaaagaaaagaaaagaaaagaaaagaaaagaaaagaaaagaaaagaaaagaaaagaaaagaaaagagaaaagaaagaaagaaaaaaaacccugagaauugagcauagugaauaaagucaagagaaggaaugcaggauuaaaauguugaagcacugcacauggcgacauuuaacuguuaucucaguucuugaguucuuggaauguugaagcaggaccagaguguuggaggccaaccugggcugugcuaccucaagggggaaaaaaaauccaguaugaacuauaacacaaaauggaaggccuacggugaaaagaucuaaaguuaagcccuucagagcccuaggaacauaggcaagaagaauuaaagaccucaaacuccaaagggagagcagccuaaacaaaaggagcagacaguauacaaaugauaaccaucauucuggaauugcgccucucaugagaagugaccauggaagagcuucaaggaagacaaguccacaggaagcaaaggaaggggccauguugugggcauguucuuuggaauugggaaauugccuccaaauugaaacaucugccccaagaaggauagggaggcccagagccuuggugguaaauaggagguaaacgaaagagcacacgcuggaagucccgagcguccccaccgacaguauaaaagguaauaguugccaguuagguacucuaaccagccaaauugugggaagaaaucagagguaagaaaugaucuggcuggaguguugagagccagacagaugcaaggcuuuuaucagaggcccugaugagagaaacaagagacuaguucuguguccuugcauagggacagacugcguaaggcccagucugaggcugggaugugaggccucaaagaaguucuugggaacuugguuuuucccccugaagagacgaugcagcaagacugcuguguucagucuacaaugcuuuuguguucuuuggccagagcacuggauuagcuuccugcugacuuccugcaauuguaugauaauuucagcuaacccuauccuggaaauaguauaagaugcuauucuucuggguaaguuugguuggcauaaaagagcuuauggaagaccuccagaguccaaacuuuccuaucuccuuaucuucugauuuccugauaaucucgcccaggaucuugucacugaagaauggccugcugguccaaauugguggagcugccuccaagcuggauagaaaucuccaaggaaguuucacauguguucuggugauguugcuauuuuugaguuuucccuguuccuugcaaguaaccccucacccauacccuguuaguaaccacaauaaaaaguucucauuggaucaauaaauuggacauuugugcauuguuau

SEQ ID NO: 2322 - RNA, 4259 nt, Mus musculus
gccugucgcugcgcucuguccucggucaccacggucugggagcugggccggccucggcgguugggcuucggagugguuuggcucggucgcgggacagggaagggcacggcucgcccacuucaggcaucacggcgguggugaacucggcuggaaugcugccgacggacacacuccgcgacggcggcggggagaucgggagugaacgaauuaaggucgcuugugcggaagcgacccaucaucgcgccccugugaggccgaggacaggaaacauagccggcucuagaggaccgcacuuugcacccgaucccuaagcuuggcuccgcccccgccucuccauucaggcggggcggaccgagucagugcgcaggcgccgucccugcugggcugggucgaccgcgggccacgugcaagcgccccgcccgcucaaauaugggcuccugcggggcggugggcucggugcgugcgcgcuaccuuguguucuugcaguacuugggcacugacuucaaguacguuuucccgcuguuacccccgcguucuccacucggccucgcgggaaguccgcgaggugaccaggacgggcgcgaucggucucgggaugcgggauuuuaggagccgaggaacacaguggccugcaccgaacccacgcgccugggcgccgagaccccuggcgggacagcguccacagacaccgcagauaauuccuuccuguuucucuccgcagugggguugcggccgugaggggcaauccgcgcgcuguuggggugcugaacuuccuggaggugaggaccgguuuggggaggaagaagcagucggcagcuccaaccccuacccacucuccuccuccuauuccacggacuccggccaucgauguggcagccgccuguacgguucccgcaggaggcugccaagcggcugaacucugucgacccggucagguucaccaucucuagccgcaccgaugccggggugcaugcccugagcaacgcggcgcaccuggacauccagcgccgcccagggcagucgccuuucuccccggaggucguggccaaggcccucaacacccaccugaagcacccggccauucggugagcccgggguuuugguaugguucugggcuuuuuuuuuugucuuuuaccauugcaccccacuguggugggaggcagagauuuccauagugcuguguggacaguugggcauacucauuccugggaugagccagaucugcuugccacaguguacugaaggccuuccgagugcccaacgacuuccacgcucgacacgcagccaccuccaggaccuaccaauaucgucuggccacaggcugcuccuggccuaaucaacugccuguguuugaacaaaauguaugcugggcucugcagacagagugagugagcuaagaaugggaagaaaauggcucaccauccaucugccugggcucuccucaauaaugcucauuuggcucugcagguaccuggauauggcggccaugcaggaggcugcccagcaccuccucgggacacaugauuuuagugccuuccagucugcuggcagcccagucacaaauacuguacgcacacuucgaagagucucagugucaccugguccagccagcccauuuguccuccccgaggggagcaggugagacgacuagccuuucacuaugccaggacuagaggccaccagggucauuacucauaauaccucaauaaaagugagaugaugcuaaauggguauauugcacauccauugggccuagaggguguaagaaggugagccagaaacuugugucuucuuccuguuggguggggucucugccagccuggggagcacaggguggaaaauguugccuuucugagggcccugccagacccauagcucuuuauagcagguaaguucuggcagucucugaaaagauuucacuagagcgaauaguuccauuccacuuugacagacuacguuaaguucucugcuucaaacaccaggaaucagccgcucaccuugagaacauaacaucuggaaccagcuccaaggguuugguaaaggggcuuuggugugaccaggcacaagagcacauggccuagguuccaucuugauaggugggcuggcuauguccugcuucagcacaaauacuuuagccccaaaacaugaaggcccaaagcaaucgcuauuucccgugcacaaacuaaccaaugcucuguuauauaauuguuuccuuucaugguauauguagagucgaguaagucaugcaaaacucgcucacccucuggaacugguggucaacuaggcaagaacccacccuggauggaagccuuuaaaccaguauauaaaucguugucuugucugaagccacauggugagcuagguuggcugagccugcccuuagcuuggaccucaaagcugucuguguuccuaggaggcugcaguucuggaccuuggaguuugagagccagucuuuccuuuauagacagguaggcugucuuaacccucacaggaugggcucggguagacacaccugugacaaccugagcucucugcugcaggugcggaggaugacagcuguguugguggcuguggggcuagggauccuggcacccacacaagugaaagugauucuggagagucaagaucccuugggcaaguaucaggcucgaguugcuccagcccguggccuguucuugaagucagugcuguaugacaacuuugguaagaggggaugggauuggaaagaaucuuucccaaagcuggguugucgcucagggaggggacuuuuggaugcagucaaagcccacauuguacuagaugaguacccaagcaccuaguggggaagccaaugacagugggggggaggacuaagggaucgaaucagcgauuccccagggugcguggaguaagugguccacugggucagauuuuggggauaaguggggucucuguaagaguucuauuuugaccuagagucuauccauagguccuacauccugaacccuaugguguccgcgguguggaaacuagaugacgguacacaguggagaugaaguggagauuguacaacauuuauugugcucggcagagauuaaucuacagcuauguagggcucuggcaguccugccuaccuuccagcagcuaccacuuccccgggcucucuacccuggacaucccuuugucacuaaagggaacaacaugggguaccaggcagucaaaagcuguaaaaaccccauuuuucugggaacccuguuuucuuggggcagagaguaggaauaaaagacauagagaacaaaaaggucuguuuauuacuuuagccagccuaugacucugaucuuaucccuagaacggggucuguaauccagucauggucucccauuuacucagggcacccgccucucggccgaagcccugguccugcugggagaacagcaagagacaagagcaguggauuccugguggauacaugucagcugggagccugaggaaggccauuuuugagcaauguugugaggaagcuucccagcucuucauccuguaaggaagggagccacaguuaaacacugcaaacaacacaauuccaaggaagugaggccuacaggaguaauagugaugcccaugcuccuuaccugguaaguccaggagaccaauagcaccuugguaccaggguccuccgaaugggcggcagccuggauuagaauggacuccacagucacagagccaucggggagaugcuguacacagugguccuugagggugcuaaggagaggcauaguuagaccccugccucacccugcuuguugaggguaggaaaaggccagggcgcaccucuugagauggcuguacacacguaaagcuguuucuuguucuuugcguguguccugcaggugcacacgacaggugaagcgaaguuggugcucugccaggcccagcuccuucagggcuugcucugaggauaccagccggaaauucuguggggcaaaggcaaacaggucacagaaaguaaugaacgcaauacccacccuaccacuguuuguacacuuacacugucuuucauaauuagggugccauguaaaagccuagguuuuuuggcuucaggcaacaguccugugaggaacagaauaaugcaaucaacacaagccaccaguuaccugccucccucggcccaugccccagagucugcccuucauacccugcaccaucucccgcuucagcaaucccagggagaugcccacagggaugcuagggcuugugggcagcgucacugucucaccauu

SEQ ID NO: 2323 - RNA, 2975 nt, Mus musculus
guugggagaggcauguagggguuaggagauguccagaaaggggauagcucugcucuacacuucacagaaggccuuuacaaacaccucagaugucugccggaaacuggagguggagcuggccugaagcccagucugagggguggggacagaggcagaggcagagacaaggcaaguuggagcgggaacuccugaaaucagccgacagaagacucaggagaagcacuaugggggcaugggccaugcuguauggagucucgaugcucugugugcuggaccuaggucagccgaguguaguugaggagccuggcuguggcccuggcaagguucagaacggaaguggcaacaacacucgcugcugcagccuguaugcuccagguaaggcaaggaggagagugggacucaggcuguagagcagcgcccuucccgacacucauaugaggaggcugggcacagggcacaugugaguugguagguaaaucuuugagucuggagcucugauaaggagguagagggacaacuuccucucagaaugugggagcagaggcaaaagaggcugggaacuucucccugaagaaggauuggggauccaagaugaaagaggaccaucuguuagguggaccaaaccuuagccaucacugaagauacucuuugucuggguuggagucucaacauuuccucugguuuguccacugacugugacuuacaauuguagguguaggacagucuguggaccaaagaagaauaucucagcaccucaccuugccacacuucugguauagaaaggggcagcucugaagccccaugucucugagauagagauguggauaucagugaaggcagcugaugagguuguucuagucccuugaggggcaauauggggugagaauggggcagcaugggcccagggcccauaggaagccccaggugacucccacauccaauggaacuuacgaaaccacaacuuuagagcagugggagguauauaugcuagcugucagccaacugaaaugaaacagugaacuagacaaagcuuagggucuugcaauugggguugauugagaauggagccauagcacccuaaauacuugaaggaucaguagaagcucuggagaaggggcucugucuaauggcugaggcucuuauucuuguccaggcaaggaggacuguccaaaagaaaggugcauaugugucacaccugaguaccacuguggagacccucagugcaagaucugcaagcacuaccccugccaaccaggccagaggguggagucucaagguauguuccuaggggacugauaaaagccacagacaaucaugaguuggaccuagggccaagcugauauacccagugagcauguguagacauguaagaauguuugcagauagagcucucacgggugcaucuucuagguaggcaaagaccuacauccuagauucuagaagggauaggugggucaaguggucucuggguacccgagcccuucuucuuaggcaggaaugguccaucgugaggguggggaugucuucucagggauguuggugagaggcuguggggagcugcccaggugcuggucugcucucagacuauuauuauucugacuauggucagaucuuaccaccaauccuguccgucuucauagggaccaauguaucaugccaguucuagaauaggcacacaugguaagcaauagcuuauucaggcccuagaccuguggacauuagaccuggugaauagauagacccuugucugacuccuucuucauuaacuucagggguccuaauauucugucuauccacaggggauauuguguuuggcuuccgguguguugccugugccaugggcaccuucuccgcaggucgugacggucacugcagacuuuggaccaaguaaguccuggaugaguagccuaggcccguucuaagaaagccuccccuaucccuuucuugcagugaccaccagagaacccccauucuucucccaaauggcuuaggggacagcaguccuucuaguguggucccuuugguaaccaauccugacagugucugucugugucccagcuguucucaguuuggauuucucaccauguucccugggaacaagacccacaaugcugugugcaucccggagccacugcccacugagcaauacggccauuugacugucaucuuccuggucauggcugcaugcauuuucuuccuaaccacaguccagcucggccugcacauauggcagcugaggaggcaacacauguguccucgaggucaguugugucccagggaaggggaaaaugugucucaggccccucacuuaccgcacgcaguuuuacuacagagacccagccauucgcggaggugcaguugucagcugaggaugcuugcagcuuccaguucccugaggaggaacgcggggagcagacagaagaaaagugucaucuggggggucgguggccaugaggccuggucuuccucugugccccaagccagacgcuacaagacuugcccagcuauacccuuggugagagcaggggccauguucugcacccuucccugggccuggcccugcuccccucaacaguggcggaaguggguguaugagagcggugaguuacgauugggcccuauggcugccuuucucauuugacagcucuguuggaguagggucuuugggcccaccaagagcaccacguuuagcacaagaucuuguacaagaauaaauacuugucuaguaaccugaguggcuguguccuaaggacggaggaaaggaaggagcccagaguugcauugagggacacccuuugucauccuaugcccacagucauuuccagagugaaauaucuuggcagacaaagaaagccuccugccucuaagccugaugaauugaguuggauuucugggaaccacaguaggagauucugcuaaugccaacaaauuauccucugauuucccacaugccuacacacacacacacacacaca

SEQ ID NO: 2324 - RNA, 718 nt, Mus musculus
uuucuuccuagauuucuuuggggguuuuguuuguuuguuuuugcuuuuguuuuucgaggcaagguuucucuguguagcucuggcuguccugaaacucacucuguagaccaggcuggccuugaacucagaaauccgccugccucugccucccgagugcugggauuaaaggcgugcgggcgccaccacgcccgguucuucagaugucugaaaaagaaauaguagguguuccaggauagugcuggcuagugcccggagagacaaaaauagcccacagacuguccacuacgagugaaggaaauaacaaccuuucccuagagcaacaggcaaucucaggucucccuccuccguguggcaaaaagccagaaacugagguaauagaguuggaucugccuggcuuaagcucccugguacagggcuuuaagauaggccuuacauaggucugguuagguaguucuuagcaucuacucacaucugcccagguguuggugugcaaguuagaagagcccaacgcuagugagaagguuucaugcucacacuggaacagaagucagaaauguuggcaggugucucugagcauaugacagagucagguaaacuugaagucugcuauugccuaagaaagaauccagggcucuccuuuccccucccagguugucccacagggcaggugagucucugccagcacauaggaccccuccucagcuuguucugggugcug

SEQ ID NO: 2325 - RNA, 1901 nt, Mus musculus
auuacuucccugagccccauuuuugguucuuaguacucauggaauuagguuccucacacuuauggaauuaggcaggggacccucuaccagagcuuagguccccucuucugauaggacauugucuacagguuccuauaaucacccauaucuuagcucuccugaaagcuggccuugaggauaaagauaucuaggagcaaauuuguggcaauuuccagagauuuagaccauugggugguuggguaccuauagguaguuggguacuuaaggcaaaccucccacaaugauacgguccuagcaacaugcccuccccacaggccugugugugagcucccaucucagggcccugcaguucucugugccagaaaacaacgaaaccuuagagguaggaaagauccuggacuaaccaaagugaguggggaaaagugcacuggggcucuugagucuggucaacaaggauaucucagcucgaugagccuggaguagaucaggggcugccugugcuauacuguucacacuccccaguccaucccauuccaguguggcucucccugccccaaccuuagcugcuaccagcccuuuagacuuaacauuuucuucuaugucaccucaucaaagcuucuugagaccccaucuuuucaagcauaggugaagacuaggggcuuccuuucugagguauaguagagaugguacccacaaccuauugugacuagccaggucccuaauauucuuaucugacccuaacaucuaggcuguggcccgagccugccuagcccugaccucgcaccccuacuuccuggacuucagaacaagaaguuccccaaaaggcaguagggugcugaagcagcagcagaugggagucuugcaugaagcaauugugagaauaugggugagauggaagaagaaagaacaggacaguggugggcacagagauggggcagaagagggcaaacugagcucucucugaaagugugcuagguucagggaagcgucccugcugagcacuuuggggucaggugucacacuugguuuccagaagagaggucuuugaguaccugaguaucuguucuuaaucugaaauccuaaaacaagagaccugugccugcuccuagaccuguccuggcucuaacccuuccucuggcuccccacccauucugagucugccagggaagagaagagccaaucgcugauguucggggccacacccccagccaccguguccuggagggaauaaauaaaccugcuucaaaacucauggccugagaauucacacccgucucagucagccaccuccuggaugaacacgggcuucauaccuccacucccacauacacacagaagaggugcgccggccagaccggugccaccggaaggcugccggcuaccagcccguggaggagcaccguggaggagcaccugccgggcggagcagaggcugagucggaccugaaggagggagaacaagcuggucagccuagagacaaaggguuugcugugaccaguggagaggaccaugcccaggaacugcugaccccaagcuaccagguaaggcaauccugaaaucugucaccucugcagucucggggugaggcugcuucauggaaggggaggccuggugccaaggagccagucccgggagcagcacaagucaggggaggauagauccgaggcucuguuggaccucgccaagaccacugcugcuuccagggaccggugacgucucacgcaagaaggcuggggcucucgugaugucgcaguaaugucagaugauucacagacccagugacgguucagcaaucucuaagccguuuuacucacucgccuacuuggggcugaccagugaggcagggagaugggucaucucugcuguagcugcugggcuccauggcuuauaagguccaggc

SEQ ID NO: 2326 - RNA, 1901 nt, Mus musculus
gccuggaccuuauaagccauggagcccagcagcuacagcagagaugacccaucucccugccucacuggucagccccaaguaggcgagugaguaaaacggcuuagagauugcugaaccgucacugggucugugaaucaucugacauuacugcgacaucacgagagccccagccuucuugcgugagacgucaccggucccuggaagcagcaguggucuuggcgagguccaacagagccucggaucuauccuccccugacuugugcugcucccgggacuggcuccuuggcaccaggccuccccuuccaugaagcagccucaccccgagacugcagaggugacagauuucaggauugccuuaccugguagcuuggggucagcaguuccugggcaugguccucuccacuggucacagcaaacccuuugucucuaggcugaccagcuuguucucccuccuucagguccgacucagccucugcuccgcccggcaggugcuccuccacggugcuccuccacgggcugguagccggcagccuuccgguggcaccggucuggccggcgcaccucuucuguguguaugugggaguggagguaugaagcccguguucauccaggagguggcugacugagacgggugugaauucucaggccaugaguuuugaagcagguuuauuuauucccuccaggacacgguggcuggggguguggccccgaacaucagcgauuggcucuucucuucccuggcagacucagaauggguggggagccagaggaaggguuagagccaggacaggucuaggagcaggcacaggucucuuguuuuaggauuucagauuaagaacagauacucagguacucaaagaccucucuucuggaaaccaagugugacaccugaccccaaagugcucagcagggacgcuucccugaaccuagcacacuuucagagagagcucaguuugcccucuucugccccaucucugugcccaccacuguccuguucuuucuucuuccaucucacccauauucucacaauugcuucaugcaagacucccaucugcugcugcuucagcacccuacugccuuuuggggaacuucuuguucugaaguccaggaaguaggggugcgaggucagggcuaggcaggcucgggccacagccuagauguuagggucagauaagaauauuagggaccuggcuagucacaauagguuguggguaccaucucuacuauaccucagaaaggaagccccuagucuucaccuaugcuugaaaagauggggucucaagaagcuuugaugaggugacauagaagaaaauguuaagucuaaagggcugguagcagcuaagguuggggcagggagagccacacuggaaugggauggacuggggagugugaacaguauagcacaggcagccccugaucuacuccaggcucaucgagcugagauauccuuguugaccagacucaagagccccagugcacuuuuccccacucacuuugguuaguccaggaucuuuccuaccucuaagguuucguuguuuucuggcacagagaacugcagggcccugagaugggagcucacacacaggccuguggggagggcauguugcuaggaccguaucauugugggagguuugccuuaaguacccaacuaccuauagguacccaaccacccaauggucuaaaucucuggaaauugccacaaauuugcuccuagauaucuuuauccucaaggccagcuuucaggagagcuaagauaugggugauuauaggaaccuguagacaauguccuaucagaagaggggaccuaagcucugguagaggguccccugccuaauuccauaagugugaggaaccuaauuccaugaguacuaagaaccaaaaauggggcucagggaaguaau

SEQ ID NO: 2327 - RNA, 1395 nt, Mus musculus
gagucgacccagucucugacucugagagucgauccagucucugacugugagagcaagcagccagaagcagacuccuuaauuccaggggaccuagagcuagagccugcagcaauggugaguccaauuugggacagaggcagauggguuucauuuuaguugacuuuacuccauuccuugauagggucuuccagagacagaauagucacaguaugagaacagaauauaauuguuuaaagcucacuccuggggggcggggggggggcagguucuuuugcucagauaccagcucuagaucccuuaaggcugggcccagaaggcuaucuuuaugggugaacugaaacaaugugaugguugugggacccuuuagaaccgaggccuccguaucauauaccuggaugguuccccuaauagaggagaggaugggguggggguggggggggacauggauggacgugggggcuggcccugugacuggugcuuugcauguaguaacucccagccaaaguugcuaagccggugguucucagccaaaggauucaggaaccuuuugggggccugaaugaccuucugacaggagucgcauaucagauauccugcauauagcaaaaccaguuaugaaguagugaugaaagcaguuuuaugguugggggucacuacaacuccaggagcuguauuaaagaauggaaacauuuuauuagagucauagcauuaggaggguugagaaccacuccuaaauccaugugaugcuugcaggccugggaccuaaaggugaagaugcugggggguaacgauuuccugguguccgugacuaacuccaugacggugucagaacugaagaagcagauugcccagaagauuggugugccggcuuuccagcagcgccuggcccaccaaacugcagugcuccaggacggucuuacccuuuccagucugggucugggucccagcagcacagugaugcuagugguacagaacugcagcgagccucugagcauccuggugaggaacgaaaggggccacagcaacaucuaugaggucuuucugacgcagacuguagacacgcuuaagaagaaggugucccagcgggaacaaguccacgaagaccaguucuggcugagcuucgagggaaggcccauggaggacaaggagcugcugggggaguauggccuaaagccccagugcacagugaucaagcauuugcgccugaggggugggggaggggaccagugugccuaaggcccccauccagagccaguguugguuauaaaagaugauggggggggggguauggaggacuuuugggauagcauuggaaauguaaacgaggaaaauaccuaauuagaaaaaauaucaaaaaaaaaaaaagaugaugcaauaaaaagcucugccucuugu

SEQ ID NO: 2328 - RNA, 1040 nt, Mus musculus
uaacagucaggaaggcagguagguguuuaucagguccuugaaacacauuguccagggagaggcuagaguaggguaagaggauacgguggaggggcaggggaugacccugaccaucugcuuguacguacgugugcucuuucaugcucugggaucuacacgaaggaagaauaaucucccacgcuaucccaggaaacauuuaagauugggcagcucaagccagacacuucagggguuugggccuugucacugaccacuguccuagaugccaucagggacuuuccucuagcuuuuaagggccuggcacuagaggcccacucacacucaggccaugcugcuugaggcagugugagaaaaagaucucuuucuccucuaugacccaugucacaggccagagagcagaagacccaaagggcaaaucucccuaguuguucugacucaacucucacaggcuacccagugucuuaaguaagagaagccauggggaagaucugacuccaaagauuugucugggacagguggucuucuaugggaggcaugucucagagaggagcaucuaauguccuucuuucuuaggggaacuacggagcccccucacuucauuuacguucagucaaaacgacaugugccugguguuuguugccuuugccacuugggcugugagaaccucagaucuacaagccccagaugcuuggaaaacagguuuggaggucuugggaugggggugcuaugccuagaagaccuaggggcuauaguuguuguuuaccguaucugcugggccagcagggaugcuggguacaugggaaagucaggcucucuuugacguugcuuuugucguugcuaaccuaccuccaacacacuguccuuugaagacugcguugugcaggcagaagucagugaaauagccagagcuggcacucgagauaucuucugcuuuucuuacagucuugcucgccaacauuggcaccaucucugcuauccgcuacuuccgccgucagguugggagaggccauaguggcagaccgagauccaguuccagcuca

SEQ ID NO: 2329 - RNA, 532 nt, Mus musculus
ccuugcaacccuucccaucgcucggaccccgaggcccccgucguguguuccuuaagcucaacccgcugcuccagcccacgacagcugcccguuuugcaaaaagacuuucuggagccccgcguaccguccugcggggcccggggaggugcgcgcgccccgccgcucccgguuccacgcggcuccucgcgcccugcgcuccuccgccgccgccuccgcggcgcccuccagcuccgacucggauccggacucgaagccggaagccaggaacucguccacacugagguccuccaggcgccugccagugacaccgcgucaggaucggaacggaccccgcgaccaggcgcccgcccggguccgcgcgcccgcccaggccacucaccugcggggagcgcgagacgcagccauggcgcgcccagccgcgugcgccgcacuuccgggcccagaaugccuugcgcccuccgacuuccucccgcgagccccgcccaugccaccccugcugcuggcuuucggguucucgagccgccgcggccgc

SEQ ID NO: 2330 - RNA, 854 nt, Mus musculus
cagugucuuggaugcucaggcauaacgaggcagcggcuucgacgugcacuggauauaaggguggggagacuguugucauggcugcagcagagcaagacgggccgggccgugagcugccucacgguugggacucuagcacauagucagcaugugggugcauggcucacggacgguaugcaccgagugugcaaagccaggugcacugcucugacgagugacagagcacacgugcgugccuacuaaacagaccacagggaagccaggaccuggcacuuagacccaauugcaggucuccgucagcccccacagcucuucuucuuugcuaagugugcccuguccugccccgccuuugaaggcagccugcagagaagguaagcugucaaacauacugccgggucuggcagcaggaacacggcaaauguuucccaguucguaguucuuuaaaauaaggauaaugacaagacuucugcucauuugcagagcagagugcuagcagggcuaggggacacaccauccauggguaggcucaagacuucuagucagguccuucuggcucgguauaacggcaucuaacucuuuucuuuuuuuuguuucucugucuugcugagucagcugaauccucauccacagagccccaucgaggagaggauguguaaguggggagaccuuacccugacggucuguaagaacacccacaucaguagcgaagggaaaaacaggaagccagagccagggcagggacagcggugcccggcacucagcacgcgcccugugacagcagccuguggcccaccugugacagcagcccuggauucuggcagagcgucuacgaagugaccuggguaucgacucua

SEQ ID NO: 2331 - RNA, 9958 nt, Mus musculus
cuuaaaauaacgaggcgaucagucugaaguuucgucuggucgaaugcuaggcuuuauuaugaacagagguuaaugaaugugcgccugcgcaucacucaaguggaacgugguagacaguuugcaccugacuuguguuuacagugugucagagauaaagcaaugucccugcuauggacgcugguagagcugaaguaagucuugccuaguuaucuucuuaggaccaauugccuuaaaaugccuacucugcuauuaaggccuaguuguuagcacgauaauagauaauaagcauguacagacaugcaguggaaaaagccuuguccaggcccucaggaaggaaucguaggaccucuuagggagcagugaguccaggaugcugguaccaugaaacugggucuugugggauaaauagaauuuccuuacauagaggaagaaaaggcuucccaagcuaagagaacagauugaacaaauuguggugguaggagcugaagcugugcuagguacaguagugcucagaccccgcgggacauucccucgagaacauuaaaauaaggaaguuaaggaaggggaaaacagacaguccaggacccccugauuuagugagguaccuuuaaaacaaggucucaaguauacagucuaggcugguuuuaaaacugaugauccuccugccucagccuccuaagugcuaagauuggauaugugccugcacaccugauacacucuccuccauuagcugucagucacgugucucuuaacgaaaacugaccccagggugaguugaagcaaaacggauuauaugagaugaagagacgagaacugucaggguugcuguauacucguccccaaaaguuaaaacacccacuguuuuauucuuucucauacucuuguacauugacuggacuccaucucauuugucuuuagacgccugggaacaagguagccuucauugucccauacugguggcuugcauagcuuucagcugagaauuuagcaggggcugucagagugucuucaugaacaccucacagcgucacuccuggguccccagaggaagcaucucaagagcaagcauucuaaagggcccaggucacaagacgucuuaugagcuagccuugauaaccucagacgucacugcuacguucuucaggucaggcaacuccugaucagcgaaagcugaguaaacuccguccugugaugaggacaggagggauguacauggagagaaggacaucgauggaagacauuuucagagaccugcuaccccaacugucaguguaccaaccaacacaggauugaaguacaugacaccaaauugaaggagcucuagauaguaacacagacaaaacaaugaggauaaagauaucuggaagaugcaaaaugugcguguaaaauaugugaaagguauugacugaguaucggacgacaaagaggccgcccuuacuucgaguguccguagaacuucugccuuuccucucuagaacagggaggcguucacuucccgacccucacaugagucugaagccuuggccuggucuuuuccucaaccuggaagaagucaucagaguugugcuucgaccgucugcucugugucgaauggguucucgucacugcggugcuccuccgugggaugacguccuuagacacagugcagauacuugcguuaggcauccugucuugcuuuuucucacuuucguuggcugggagcaccaggggaggggaguuuauuuugauuccccauaguuuuguaauaagagcaguuuugacuugucuugggaugcucuguacacuucagggucauccuccagcagccacuggaaucccccccuuuccaacagugaccugggaguugagccagcauuguuuccuguguguugucuugaagucucauaaguaggggagggcaguuuucugauaagaguuuugucuuugguuuuuuuuuuuuuuuuucuuugcucucugaagccuguguuauguguuaugugccauccuggucccacugggacagucugaaaugggagcccagggugugggaugaugcaauuuccuggccuguggaguccugugugcuucuugccucugucauguuguuaccacgagguauaggaguucuguaugaacuagaucuuguccucgggccacucgagauggguguguaauucaacagcuggcugccucaguaaugacuaggucccuuugcuguugcaggucgucacgcugugguaccgagccccagaaguccugcuccaguccagcuaugccaccccuguggaccucuggagugucgguugcaucuuugcagaaauguuucgcagaaaguaagaacuccauuuucucacggaaucguuggucuuuuacgugcccgccugccauuucuaucuugauugagggcuuggucagacccaccuguccuacaucuguguuccugguccuuacagcuucugauuugugguaacuucguuuggcgagugauucccccacuguccuaacugguaaacaugaagcaccucuuuagugaaggaagacccucgggguggacuuuauccccaggaggaucaggacuauggagaguuuuguuguugucguuuuggguuuuacuuuuuccucuauuaauuucuuuacuugugcauuguaaauccuggucacagcacuccccaacccgcggugggcuauggaguuuuuaacagaaauucugacgguggaaacaguuggugcaggguaucagguuaaaaaggagcaggccagggggaccugaguggugccuuagaguacuggcauagccccaccguacggggagggagccagcacaucugggcugcaggucguguggcgugcacacaagguaaaauaaacuauguccuugaaaagcagauuugcuuagaagggggaauaaaaugaucggaugaggcugccugcagucucccuuaguguccacgcgucucacacaucaaacauguuucugcaguuuucauggggcggugaucaggccauccugcuugucaaagugguaguucaccugauuuuuaggggacaaaaacaggcaaacagcauuaaucaaguuugguuuccuuucccuuauuuuuguuucccucagaagaggugagugagaagccaaguguaucccuauugagcauguucggagucuagcuccgcauagcuuuuuuucugaggaaagaaguggucagccauucuggcuugcugguuguucuaaccagaggaaguucauuccgugaauuuugugaacugcgucuacgacucagcaaaacuguagcucacaggaucauaggacuguggcagagacacgagaguacaaagacucuuuugugcugcccuacugugugugguguauauugccagagcuucugcaucguguuugcuucucuauuccuugaaguaggaggguacugugguugaaugguccccaagaacuagcaggaaucugaccugaaaggaagccucguaacuucuaauguaguacuguuugaaaaggggggaauaaaaauuagccaucaacugaacaucagagacaacgaaccaggcuaaaucaguaggaccuggaacaguugagggaguggaggggacuuguguggaugugugcaugugacgcccagaagucagccucaguguccuccacagucuuugacacaggguuucucacuggaaccuggggcuggcuguuuaagcucggccugccccagggaugccacuuguuuguaucuucccagcccugggacacaggaaugcgaccaugcccagcuuuguaugucagugcuagggauggaucuccagugccuauauuugaaaguguggucccugugcugcggcuucagccuuacuuggggccuucuuagaaaugugaauucuuaggacccauccuagaucggagguaguuccugagcuaggucugucucccuguguuuuggcaaggccuccacuugauccuaauaugguaagaacuacuggauuggaugaugguguuggcagaagugggcaguccuuaauggugcacauuucaggcacucccuugagguucagauucauuguugagucgagccaggaauuuuguuuuuuaaaagugccuuagguaauucuuucaucuaacaagaguggaagacauuagguugaagucuuacgaucagagaugagauuaagacccacaugaagagcaaggugagaguugggguaguuguuccaggcuauucggaauagcgccuauaauacuaagaguugauuagaaaacugcucauucagauuauauuuaugugucuguguuuugaguuuuccucuguguaaaaauggagucuguauuuuggggguagggaggucaguuauuuuucuacaguacaaauuagauuagcuaugauugauuuuuaaaaacuaguuuugaaaaaugcuaaaagaaagauaaaacuugagacauuagaauugagcauccucuaguuagauauuggcaguauuuuuaagucuaagugguacccaucuauggaacagcucaaccccaaguuuuauuuucaagccuuaaacuccuuuccaccuaguugaucaacugauugauaauuagguucucagccuagcuugaggguucucagaucauguggggaacguaugauauaccaguccaucaagcccauuuuccaaugggagaauuccauucuguauucuuaugacugagagaggaggcucaaggaaagacuuugguggcgauaguauggucuguugguuugccugcugggagagugggaacauagaagccuuuccuccugaaggcacugcauaaaggaguagaucaaggucugagugaaugaaggacaaagcaauaucagaaacuggauccuaaagcuaaagcagacuaagucucugccaaguacauauccuuccaggauauccuaucccuuccuagucccucgugcauacagucuuugauuguuucuacucaguucacauugauauuccugugauacuacccagauaucuggacauagcaugguucuuaauugaagcaaaagugucccaguauucuggcauuuccaggaucuagcuggacuccugauuccauggagagccuguugagaacugaaaggcccaggaccccgaaagcauguucuuucauuacuaaaggcuaauuauaauuccgggaauauuugacaccugucuauuuuucauuccuacuugcugcagaggcagugauuucugugucauacugucuguauugcugccauuguuuuugcucuuacagcagcuuuauauugguuacugacugauuuuuuucacuacccuaaaucagcuuacuuuauaauuuaaccucacccuacacaagaauacauaaaaccacagccuugguaaaccaguaauuuauuuagcugauagacauuagaaucuauauaaauaucaagauuauuagaaagcuccccauggccaggcguggugguacaugccuuuaaucccagcacucgggaggcagaggcagguggauuucugaguucgaggccagccuggccuacagagugaguuccaggacagccagggcuacacagagaaaccuuaucucggaaaaagaaagaaagaaaggaagaaagaaagaaaggaaggaaggaaggaaggaaggaaggaaggaaggaaggaaggaaggaaggaagaaagcugcccaugaccauccaccaaaauggccucauacaucaccagcugaguguaucuaaaauacaacuaaacccuaaaauacaacucccuguagaaugguugcuauaugagagggucacucccgagacaugaccauauaaauccuaguaaaaaagaaacucauugagugugugaugaguucguuaagcagaacuggcuggugagggaugggugcuguggguugguauaaaaacuguacggggggcugaagagauggcucagcgguuaagagcacugacugcucuuccagagguccugaguucaauucccagcaaccacaugguggcucacaaacaucuguaaugggauccgaugccucuucugaugugucugaagacagcuacaguguacucauauacauaaaauaaauaaaucuuuuaaaaagaagaaggagaagaagaagaauuucaaagaauucucagugaaagcccagaggucgcauccuacuuguuuguauaaaaucuuugaggaauaaucauuuuuguaugagcaauauuuggcauccuucccagaagcaaagaaggcaggugagugaaacacuucuggucuuccaagcccggggcugucuccuucaggaguuaccucaccaugccauauucagaggguagagacauggaaucuuccacaaguagggcaaauaacuuguucgggaacaccaacuauuacacagcagagccagguuugaauccaagucguccugauacuauagcugccaauugcucuacucuguuagguuuuugcucuugacaacaccaaacauacaagagcuuuuuuuucuauaguauuuuauguauugcuacaagagaacaacaaugacauuuuagaggcgaaagagcagaucacauagucaaugcccucgauuuccacuuuccccagcguucgaaaggcugauugauucucugucacauuaucaagaguuacaugcuuucuauucuaaaacugaugccuaggaaauacaaacucaauaaagagagucuuagggcagaugguugccaaauagccagaaaguuaaauaccaucugucaguauuaucugaguuuaauaauugccugcacugacccacagaagcauucuacagaguggauaacacggauuagagcuauauucuuuuuaaucucccuucucucuccuuuguaaguaaaccaucuugaugucacguugagauguguauugugcuaaaacagucagagaucuggucaguagccauguaguuaaagugaugggagggcuagggggagauguggggacaggaauagagugguauuuaacucugcggcaagaucaacuacucaucuccacucucuggguaccuaguaguugcuuugugguccuggccagaacuguuaguuucucguuugaaaguuaugggguuuuccagguuaaagcaaagguauaaaagagaguguacauugaaacagaauagaauaugcuacaaauucuuugaauauggagauuguggugagcagauaggaauucuuagaaauucuggguugccagcccugcugguccuuagcuacaaagugccaaaugccaccaagaaaaauauaacaaauacugucacuguucgcaggaaacaaacuucaugauaauauuacucguugucugguggcuucucuagacuugucgucauugauuucuaugaauuaaauacccacuagcagaagcuaacaguuuauaacuguccuuuguggcuugaaggccagugagcaaaugucuaaaauguuacugagcgccuugccaauuuuccccucccuugcuguguuggugggcauccauauuguacucuccuagugaccucaaggaaacgaagggcuugacuggcugucacagaugcccaggcaccaggaggugagaaaaccugccaccuccggcucggucagaacuugcgugcagagcuucaggcucuuacgcagcuaggcuuucugccuccugucuucuuggucuuuauuuaaagaacuuuaaaggagcauccuauuagauacggaacccagguaaaggggaccagucuugauagagcgauagacagauccaggauagcucagucugagaacaagcagauacuuucacacucuaaucaguguugaguuuucaacucuuuuuuuuuuaauuagguauuuuccucguuuacauuuccaaugcuaucccaaaagucccccauacccacccccccaauccccuacccacccacucccccuuuuuggcccuggcauuccccuguacuggggcauauaaaguuugcaaguccaaugggccucucuuuccacugauggccaacgagaccaucuuuugauacauaugcagcuagagacaagagcuccgggguacugguuaguucauauuguuguuccaccuauaggguugcaguucccuauagcuccuuggguacuuucucuagcuccuccauugggggcccugugacccauccaauagcugacugugagcauccacuucuguguuugcuaggucccggcauagucucacaagagacagcuauaucugggcaacucuuacugcguagcuuuacaugaauuugaaaaacaugcuuguccugagaagccguuggguguggacuuucagacggcuuugccacucugcaggcuccuaaggcucuccagccuggugcacuggcucugccuguccugugagcucggugcuuuuccuuucuuccuguguuuccaucucuguucucuguucucagcagccaacggcuccauucuggcucuuucuacaaaaccccaaguaugggaacucuauuucugcaacagaucacccucucuccugggcucauuuucauagugauccucaucacaccagguuuuccuguguaugugugcauaugucuauacugcccucucugagaaagaaauuguggcauuguuacccaucugccacugcagggagugauuuugcuggucucucugugccuucuuuuaaacaaucccagguucugaauugcaucaacuagagaaauuuggccuagagccacacaccaggguaagaagggaugucgccuguggugguggugguggugguuccacaaagugggagauagaacaauguaaaggucccaguugacucaacccagaaucacucaguuuauacauuuccuggccccaccagcuagcuguaaggauuccaugacucuugacaagaauuccaguuuuacacucauuucucagaaaaauaccccugaaguagcaucaucuaaaucagugguucucaaccuuccaaagacacacacacacacacacacacacacacacagacacacacacacacacccacacacacacacacacacacacacacagacacacacacacacacacacacacagacacacacacccacacccacacacacacacacacacacacagacacacacacacacacacacacacacacacacauacacacacacacacacacacacacauacacacacacauacacauacacacacauacacacacacacacacagacauacacacacacacacacacacacacacacacacacagacacacacacacacacacacacacacacacacacacccacacagacacacacacacacacacauacacacacacacacacacacacauacacacacacauacacauacacacacauacacacacacacagacauacacauacacacacacacacauacacacacacauacacauacacacacauacacacacacacacacacacacacauacacauacacacacauacacacacacacacacacauacacacacccacacacacacacacacacacccacacacacacagacacacacaccccaaucauaaaauuacuuuuuuugcuucuuugagacuguaguuuugcuacuguuaugaacuguaaugucaauauuuuuuggagauaaagguuugucagagggucuugaucgacauguugagaacugcacaugugcuugcucagugccugugccuggcucuucauaggccugcccauucuccuccagucccagcccuuggcagacucagucccgggcuaggauucccuucacuugagacuuguagcccuuuggacacaguugaucgccacacucccaguccugcauucugccuuaccuccgauuuguugaugggugaagccauccagugggcuccuccuuucagugcagaaauccuguuucucucuuccuucucuccguucccuccugucagggcaaaucucuagagcugugcucuucacacucugucugugaugcucuccugauugagcggugaaccaucug

SEQ ID NO: 2332 - RNA, 13665 nt, Mus musculus
acuagccgugguguggaugcacacgcugccacuccacgccaugcccgcagggggcccucgcucacgccucagcucggggucgguggcagacgaugucccugcaggaaaaggugucagcugacccuagucccacgagacgucagugguguccgcgucccgccagcgcguuaccugcagcaggugaagcugggccacgaggcgccgcggcagaugcaggaagcagucccgagcauucgugaaggccaccgucacgaccgccccaccagaccccgcacccgcuaagcgaucgcugcuccacauugucccaagguucaacucucaccggagagcggaguccaccggcuucucgucaggugagagcgucggaacccgagaacaucgaucaggcccgccccccucuucccacgcccggccgcugucacccucgggccaccuccgaagcucuagggggcggcacgucgcucgucgaauucucgcucucaggagaugaucgucgauggggucgauccuucagccaauccuagcacgccugguccauccugcucucuuauuggacucagaggagcgcggcuggcggauguuguucuggcgcgggggacuagagccggcaagauggcauccagugacgggaaaccugguggcguauucgaucaccacguccagacggcugugugugacucgcgggccaaauaccgggagggccgacgcccucgcgcggucaagguagagugacucggauucuucucuccccucggcagggacacuaaauuccugugagcacuagcuccccaaggccugccuccauaaaggcauggcagggauguugugagauccaucucuaaguggagggggcacgaagaacccgggccccgguaccaaagguuaucacuacccucgguuagcugcuuaccaaaccuccaacccacuauuuuuagcuuuguauccuauguguuuacaauagcgcuucucacagggcaagcccagggugagugaguguucaguggcuguuuacauuaaccucucuggagucagcuuuuggaaaagacgucuguuaagugguuuagucagauacccuuauguggagugugguagucuuuaggcagaagagugacaguuuaguguguauguuuugcagaccggauuguuucuuguuuucaaagcuccauuuaaaagggggugggaggaccgauuugccauaggcuuguuugaagaguacauuuaacgaggucuccuuugacuuuagguauauacaaucaauuuggagucucaguacuuacuaauacaaggaguuccugcagugggagccaugaaggaauuaguugagcguuuugcucuguauggugcgauugaacaguauaacgcucuagaugaauacccagcggaagauuuuacagaaguuuaucucauuaaauuugugaaauuacagagugcaagguauguacaaguuaagcagaacuccuguuaaaaucuuauuccuguugcugucauuuuggccccaacuguuucccaaauguacccaaagcacagaagcacuucuugcucucagucuuccugauuggggggaggaggggaggggacaggguuuauuuggauagccuuagcugugcuagaauuaguucuguagaccaggcuggccuugaacucaaagaucccuuugccuuugccucugacucucgagugcuggguuuaaagguaugcaccacuccaccucgccuuccaguuuguuuuucaccaggccucacaucugcgacuuaaucacucuaacagugagugacaucccagcucuuccuucaagcuuuuaaaaggcugacuuuacaacaauacucuucccauccucucauaccugugcuuggcaaauuuugaaccuguagugugguagauuaagaauuacguuugaaguaaauuaucaguccuguggauucaugacuguggagaauuuuaguccuccaagcaaauuuuuguucuuuuccuaaaauccauauggcaaaaaggacuacuucuugagguucacugagcaaggaugaaaugggacaauuuauguaaagggaguagacugguaccuccuauuaagaggaaauaguagagccgggcagagguggcacaugccuguaauccuagcaccagggaggcagaagcagguggaccucuugagguggagccagccuugucuacagagugaguuccaggagagccagggcuacacagagaaaacccuguuuccaaaaaacaagcaaacaaacaaaaaguaacuauuaguaaugacaguucuuauuuguauaguucuauguuaaucaacuuuguauuccaauaaggaaugcuuuauuuuauguuaaccccuuuuggcgggggggggggggggugcaugugugugcauauuccuguguguguauguguguguguguguaugugagugaacacuagccugaaacuggcuguguagaccagcugaccuagaacucaaaacuuccuccagacucugccuacccaucuccaccagguucaaaggcuugugugcacuacaguguacucuauccuauuuuuugagguugggccccucccucacugagcucauuggcuagauuggugacugucaaacucagugauccuucuaucucuacccugugagcacuggaauuacaggcacagugcggugccuggcuuucacgugcaugccaggggucugagccaaggcacuccagcaagggcuuuuccaccggagcagccuuccuagcucauguuagccauuuuuucauuuuaaucacuaaccuuaucuaaaccauaucuuuuucuggcuuuugcuauucauaaacuuuuuuuuuuuuuuugguauggaaaaagacuucaaauccccuggagcugaaguuacaggugguugugaaccacccaagauggaugcugggauuugacucugcucuucucaaagaucagcaagugcucuuuucgcccaccagauucucucuccagccccuauauuaucucuuuugugugcuacuaacagucuaccacaaaucacuugauuucaaaaggccaugugucuuuucucaucagcuggccaacucuucauagucuagaaagcauauucucuagagccccguaucuccacagacucugauacaguuggcuguggagucaagacaucugaauugaauccuaguuuuauaaaugaauguauaaauaugauccagaauuuccuggugccuugguuucaucaugagaugguuaugagauaccaauuuaagugacacacuuguggcuuugcaugggguaauagcucaauaaacauuagugauuaucuguagauacagaaguacuuaauuacuacagugcucgacucagcauaaguguucaguauuucuuauuuuaaacauuauuuauuucucuuuauguguaugugguaugguuaugugaacuuuuaugcccuaugcauucaggccccugcagagcagacgggggcauuuuccccugagacuggaguuacagacaguugugaaguugccaggcugggaacaaccuggacccucugggagagcagcagugcucuucaccccuuagcuauagcucuccagccccagaaggaacacacucuuuaucuuugcacugauuaguuguucuguauucaauauuuucauuuauucauauauguguaucuaggagggcaugccauggcuuguguacaagagauaguucuuuccuaccgugugaguuccagagacugaacucaggucaccagucuuggugacaagcccaaaguuacacauuuuacucaaguucuguaacucaggcuaaccaguaggaucccaaguuaguuaaaaaaaacaaaaagccuagguaaguguguccagcuuagcugaaaacguauuccauuauuaggagagggaaagggaagacucauuucuuggugcuggagagaugucucagugcuuaagauagcuugcugcucuuccagagaauuggaguucaugucuagcacccuuaucagguggcucacagcagccuauagcuccgcuggaucuaauggccucuucaggucucugugggcaccuggccccuggccccauauguauaaacacacuuacauaaaaauaaacaaacagauaaaucuuuuucuuaaagaguacuuucugggucaguggagucauucaaaaaaccaagcaucuuucccaggauucccaacacauacguacguacacacccuuugcuucuuaaaacaaacuaugcaucauuuguuaaucuuuuaucuuagguaaaucuuuauuuuaaaugccauggccggagagaugucucagcgauaagagcauauacuacuucucuacaggaccugagucaucccaucaaccaggccaagugucuaacucuagcuccaggcuagagccuccaaacauacuuauacauaacuaaaaauaauuuaaaaaaauaaauuuuucuggaugcagugguguaugcuuuuaauccuagcacuugggagccagaggcaggccucugaauuugaggccacccugaucuacagaguaaguuucagaacagccagaucuauauagugaggcccugucuugggguuggggugggugguggagccaugcaucugggggcuggagagaugacucaaaagcuaagagcacuuauugcuauucccgaggacucagauuuggagugugguucccagcacccaggucaggggacucaacugucugaaacuccagucccagggaaucuaucaccucuggcuuccucaggcaacuguacucauguacacacacccacauacagacacacacacagaaauaaaaguaguaaaaauaauuguguuuuuaagcaauauaacuuaugcauuucuuuagaguucucuugauguuauguauuucuuucuuucuaggguagcuaagaaaaagauggaugaacagagcuucuuuggaggguuacuucaugugugcuacgcuccagaauuugagacaguugaagaaacuagaaaaaaauuacaagaaagaaaggcuuauauuacaagaguuacuaaaaaccaagguauggaaaguguguguuaacaccuccuguguaucaggcacugcuaggaaugugugucacuguggaauuccugcccagucacagucuuugcucugugcaccccuguagaaucucggcugggaagggagagguguugcuucauugagauugccucugggaugugagagauaguugaauaguaguaaaugguauucagaagugggguuaaaaggauggcaagguaaggcaggcuacaugucaaacacuuagacagaugaaucgccaccauacgucuaaggagcugcaaguccuacagaguaaccaaggucccgagguuuuagugagugagauuaggaaaguagacaggcaacaaaucauggaacuuguggccaggcuuuaacauuaaggcagcaagaagcaguuaugguuuacagacugguucuacaugcugcucaucaugggaaacuuccaguuguuauaguuggguggcccacauguccaucugaguuucucuuggcacaaggaugaaguaaacaugguucuaguaggauacccuggaacuguagaagcuuucuaugcaauggcguggagacucuaagauuacaguuaguggaaaauguaaaaauauaaguuuuauugucucucaaguggcuccagaggaagagugaggcguucuagagugcugaggaggcgaagccuggugguagccugggaucuuuccgaaagccuugaagucuucccggugcagucccugcucuagaaguaccguuucgggaguagagggccuuagcauaguaagguuuguuuuuagaaucucaagauucugaaugaucaaagugauuaaugaacgauuucuuucccuuaacuuuuaaaacuugacuuuuaagauuguuacauggcgaagaagaaaccaguuccagagcagaaaggaacaaaagauucuagacaagguuuccauccaccuaugccuggauuugguacagcugcuuuaaacacaucuccugagaguccuccagagaacucgaguucuugucuuccuuauucuugugaauucccuuuaagcuguuuugcuuccaagagcacauguucacguggggaacauguggacagaguaucagacuccuguaauagugcuaggaaccauggugaacugucuaggcaucgugaccacagugccuuuucaccaaagcugcagaugaacacuuacaaaaacuccgucccuugcucuagugugcaagaggccauugcuaccucacaggcaguuggcagguucaugccuaggacaacacagcugcaggagaggaaacggcggcgagacugugaucgagaacugggaacucugcuugagacacacacaagcaguaacgagguuuugauuggaccuaaguuaccagguauccccacaguagaucugcaggacgacuccuugaauacaacggcaaccuuaauucggaggaaacuuaaagaggugaggucuuuuuuuuuuuucuuuuuuuuuuuuuaaauugagauaauuuaauugagagaccaacacuugauaggaaauuauuuggaggaacuaaaacuuuguaauuauuugguuuuguuguauuuuccuaccuuuauuuuccaaaauaacaaauuugaucaauaucugauuugacagucuuuuuuuaaagauauauuuauuuauuuuauauguaugugaguacacugucacucccuucagacacaccagagagggcauuggaucccauuacagaugguugugagccaccaugugguuggugggauuugaacucaggaccucuggaagagcaaucagugcucuuaaccacugagccaucucuccagcccccuuugacagucauucuugguuuaacagugaacaaauacauuuuaugucaguauagguaaaaaaaugcuaaauguuccagucagucauauuauaacaguugauuccagaaauugucucgccucccuucccuauuuaaagcuagcucccuagguaguaauagcauaagucaaaauugacagauauaauuauuucucuuaaagucaguuacugcagauuacaucagagucaaaauacuuuuaugauaaauauucauaaaaggaaugauuuugauuaacuaauuaaucauguaauuaauuuuguugggaacagcacucagggacguguguuaggcaaacgcuccaucccugccacacccccagcccacagagauuucuaaagacugagucugugguugccagcacucuacugcuuaugugggaaccucgaagcucugaacgaguuggagaugagauugucuuucccccauuauuuacaucauuaguuuucauuuccuaaacacacaagaaagcuaacaguuggaguagcuugugaaagcuuccuuuuuguggaguggagauggaccuugaaaucguacauggagggccaggagcauuuucuuuuucauuucagcgagcccugcucacgcgggcgcuccugcucugcagugugacuagagaaacuaagguggcuccuuuuuuuuuuuuuuuuuuuuuuccuuuaagaguuuuguuuuucccucaucgaaauuguaaguguauaaauguacuuuuuauguuuacgucuacuaaguuuuucaguauaugccagcaccuuacuuacugacucauggcugucucagucagggccaacugcacuuaaaauguaaagucuacauuucagaaaaauaagaagacagcagaaaaaauacuucauuuaacuuaccacaauuucuaguauuuucccauuucaaaucaagagauagucuuauacugcuuuugacuuacuauuaaguuauuuugguaauggaauaauaacaauguauucaggauccauugcagcggagaucucugaggagccagccuggucuaccuaguaaggcuggucaggccuuacugggacaggccaggcuaggccagucaaaguuacacugugauauccuguucaaaaauaagaccgaucaacuaguaaauccuggguacuuuaucuguauccuguugguuuucauuguagcuguuucuggagcgaggugaaaucccagugugguuuuaaucugcauuuguuucauugaggugggguaauuagcauccuaauauguucuuuugcauuucccugaugguaaugauguugaacauuuucaaacauguguuggcuauauguauuucuuccuuugagguccguucaacuccuuagccuauugauuggaugacguuuguuuguuucuuagugucuaacugagcaguucuuuguagcugcucagcauuaacucauuuguguaguugacacagacuccccauccugccggcucuuuucacuucacgcugcuguucaggagcucgucugcuccauuugaucccauuagucaguuugggcauugucaucuguuccauucgaauccauugcagaaaaucuuugccuaugucuugaagugcuuucucuuccuguuuuccucggauagucucagagauuguuacauacaguccucaauaaauugugaagccuguguguguguguguguguuuuccccauauguuuuugauacccuugucaaaaauguuguggcuguagcuguauaagauuauuucuggauccucuauucuuuguuuugguuuuuuucgagacaggguuucucuguauagcucagguuguccuggaacucacucuguggaccaggcuggccucgaacucagaaauccaccugccucugccucccaagugcugggacuaaaggugugcgccaccaccacccagcuggauccucuauucuguucccucagucugcauucuucuuuuuuuccaguaccuaggcugcuuuugugucuuaguuaggguuucuaacgccauaaccaaaaagcgaguuggggaaaaggguuuaauuggcuuauauuucuauuguuguucauuauugaaggaagucaggacaggaacuuaaacagggccggaaccuggaagcaggagcugauguagaggucauagaggguugcugcuuacauggucagccuacuuucuuauauaacccaggaccauuggcccaggagugcuaccacccacaaugggcuagacccucccucaucaaucacugauuaagaaaauacccuacagccagaucuuugaucugacauaagauacuguuucaucucuagucuuucccucacugcuugagauggcuuuaacuccuuauggggcauuccuacuuccauauggauuuuaggguaguuguuuuuugccuuuaugaagaaugucuuugauauuuuguuaagaauuguguuuguccuacagaucacuuuugaaaauauagucauuuucacaauuuaauucugcuagggccagugagauaguucaccagguaaagguacuuuccacaagccugacaacgugauuucaauccuggggacgagagcgccaauuuccacaaguuucuugugaccuucauauacacgcugugggcacauauguguucccuuguacaaauaaaugaauaaauguaguuuucaaauuuaauucugccagggguggugguacacgucuuuaauccuagaaguuggcaggcagagcuuugaauuucaggccauccuggucuacagagcuaggagagccaaggcuacacaaagaaaccuagaaacugugucacaaaaaaaacuuuaaaaauaauaauucugccagagucuggcaagacggcucaguggguagaggcacuugcucccuagcuugaugaccugugcccuacuccagcacccacuccaacacguaguucucgggcaucccugugugaacugugauguagggagaugaggcagcauaacagguauagauuguuaaaauccuacaauccaggaacacaagaagucuugccagucuaucuuuuuuaaacuguuuuuucuaugaguuuggcucuagaggucuuuggccuucugguaaaauuuauucguggguuuaaguaugugguauuaaauauguguauauauauucaugucugugugcacauggccuccucugucacuuuuaaccuuauuuuuugaaacaaggucucucauuuaaccuggagcucaccgaguuagcuagacugucugccggugccggcaugcuccugggaccauuuuguguccgaccacugucugucuccgaaguuggagauuauuggugugcuccacugcaccuggccguuuuacaagaggcuggagaucagagcucaaggcuucgugucugcauggcaagugcuucaccagcugagccauccucccaaacuauuugguuuuaguguuguuuuugugaaugagauuuucuuuucugauuuuuuuuuucuugauaaguuuauugcuuuauagaaaagcuauuguuuuguugguuuguugagcuaauauauuuugaugaaaguguuuaucauaguuaaagaguuuucuggucagaucuuuagagucuuuuaaguauggaguuguguagucugugaauagagaucauaugacuucucccuuuuuugucuguguuauuuuucuugucucguugcucuggcuuacacucacaauaccauauugaauaagaguggaaagaguggacacuuuugucucuauuccugauacuagcggagauacugugucuccucugauugucuacugagauagaauuucuguucuugaggcuguguccuguauuuauugauuuaccuaugugggaccuuccuggaaaucuuggaaugaaacugacuuaguuguguucuauucaacuuacaauauguauggagaauuuuuauuuucauguugaucagagggguugggcuaugguuuucauguuuguuguaugcuguaugacuuguuaucagggugaggcuggcuccccagaaugagucagguaguguuccuuccuuccucuucugcuguuuaaccuaguuugaggugcgcugguauuauuagccuuccuuuaagcauuagugggauucagcagugaauccauuggacuugacuauuccuggaacuuuuauugaugcuuuaaucauggauauauuuaaauuguaucuuauggaguuaauuuuaauagguuguauuguuaccuucauuguucaaccuuuucaaguuaagcaagcuuuauuuucugucagacagggcugucucccuaauuugggaauugaaagaauagcauugaacauagaaggaagcaggauuuauauaguuuacgaucugcaaggcuagauuacauaggaacuuggcagaaccucuagucaggguggagauagguguauaguguauggaacaugccaaauuccagaaacugagccaaggaauggucaaacccaaguuuacggaaaacaggaaugaauuuauuuugacuuuguuaacaagauggcuucuaaucuuaaaauggguuaggcugguccaucaauaugccuaggaaucuauccauuucuuuuagauuuuccagauuuuugaaauauguuuucaaagaauucccaaaugauucucuuaaguuuuaaucuuccugguuuuuuuuuuuuguuuuuugguuuuucgggacaggguuucucuguauagcccuggcuguccuggaacucacuuuguagaccacgcuggccucgaacucagaaauccucugccucgagugcugggauuaaaggugugugccaccacgcccgguucauuuuuuuuuuuguccuuccugguuuuuuguuuggucgguugacuggcugguuguuauuuguucuuucucccccucuuccuucccucccucccuuaguuuguuaaucuuauauuuaaaaggaaccaaauccuuauuugguugguucuauguguuguuuuuuaaucuaauuucauucauuucugucccaaauuuuacuaccuguugccuucaccugcuuagugauucuuuuuucuuuuaaaccaggugauuucaucugugccaaagccuccagaggacaauauaaaagacguguguacaagucacccaggaaaacaaagaagaagaauauagcuugccaguggggaguuagucuugccuuuucuuuuuuccuuugaaucagagucucacuggauagcucuggcuacucugggacucucuauguagaccaggcuggccugagugcugggacuaaagggugugugccacuacccccagcuaaauugguguguucuggagagauucuuuuuuauguuuggcccauuuuaauucuuucaggcaucuuacuacugcuguuuuaaaguuuuuuucuuuuaaaccaguugcaaauguuuccaucuuucuuggaucuacacgcaauguggcagagacuguucucuuuauacuguauuaguucuuauauuagaauacguaaauugauugaaacaaauguagaaauaugucauacaaauaaggcaaucagggucucauuuuaauucagguauugagcaaucuguguucagagacuggcagggggguuguuuuugaacaccagggcuucaaagugaaagcagaacuguagagaaaaaaaugccaacaaauguuacagcaacacugauauuagaaacacauuuuuaaaaaagcagcauacauaauguaacuucuaagacuaauuuaaauugacuauggugauggaaaaaacuaauuuuggaaauucuagauuucuacacugucagcauaucuguacuuuuucuucugucagcgggccacaguauaauuuuucaggcuauuuauauuucuuuucuuggaaaaaauaaagugagaaggcacaugcuacacugugugcuaucugcgugucauuucuccuccuuuguagccuccuucuguggguuauaucuggccguguggaguaagguuugcuucaguggccaugguguacccaucagcuuggccaguacggcuuuccagugcugaaaccugccaacaagggcuuagcuucugugugcaugagagcugaguacacagaccacugugcugaaaucucagguaaagacacauuaaccaauacauggagcugggcagaacaaacgucaugccagucaggccgcucagauaucaagugcuaagugugucucucuggaccucaggacccugaucuguucugugagugugaggagaguguuugaugacucaccuucaccaacauccacagaaauggucacgagaggaaagaagcaagcuuguaccaugucaggagggaaggagaaagaggaggcaggaagcaggcaucuugaggaguucccagcagugaagguacauggaccacacagcaguguaacugugggaccuggcacugccaauuagacuaagcuggcuagccuagaagccccaggauccuccugccucucugcccccucagugucgggacuauaagcacacuccaccauguccagcuuuuuacaugaguguugugaauugagaucagguucucugcuuacugggaagcccuuuaguaauggagcucucucccaucagacaucaaucuccucagauuaaaagcuguuuacacauuaguugguuaggagaggucaugguucuagcaccuuacauacuugcacaaccuauucguuauucaguguuccaucuuguaagugagauagggugcuccgguuuugguuugguuaagugugucuccauacuuacagaagacaggaauuauguagagccaaagaggcagaucaaagucuuuuggcuauaauaacugaaauagucagcaacgucauuucuagugc

SEQ ID NO: 2333 - RNA, 1776 nt, Mus musculus
auaaguuuauugcuuuauagaaaagcuauuguuuuguugguuuguugagcuaauauauuuugaugaaaguguuuaucauaguuaaagaguuuucuggucagaucuuuagagucuuuuaaguauggaguuguguagucugugaauagagaucauaugacuucucccuuuuuugucuguguuauuuuucuugucucguugcucuggcuuacacucacaauaccauauugaauaagaguggaaagaguggacacuuuugucucuauuccugauacuagcggagauacugugucuccucugauugucuacugagauagaauuucuguucuugaggcuguguccuguauuuauugauuuaccuaugugggaccuuccuggaaaucuuggaaugaaacugacuuaguuguguucuauucaacuuacaauauguauggagaauuuuuauuuucauguugaucagagggguugggcuaugguuuucauguuuguuguaugcuguaugacuuguuaucagggugaggcuggcuccccagaaugagucagguaguguuccuuccuuccucuucugcuguuuaaccuaguuugaggugcgcugguauuauuagccuuccuuuaagcauuagugggauucagcagugaauccauuggacuugacuauuccuggaacuuuuauugaugcuuuaaucauggauauauuuaaauuguaucuuauggaguuaauuuuaauagguuguauuguuaccuucauuguucaaccuuuucaaguuaagcaagcuuuauuuucugucagacagggcugucucccuaauuugggaauugaaagaauagcauugaacauagaaggaagcaggauuuauauaguuuacgaucugcaaggcuagauuacauaggaacuuggcagaaccucuagucaggguggagauagguguauaguguauggaacaugccaaauuccagaaacugagccaaggaauggucaaacccaaguuuacggaaaacaggaaugaauuuauuuugacuuuguuaacaagauggcuucuaaucuuaaaauggguuaggcugguccaucaauaugccuaggaaucuauccauuucuuuuagauuuuccagauuuuugaaauauguuuucaaagaauucccaaaugauucucuuaaguuuuaaucuuccugguuuuuuuuuuuuguuuuuugguuuuucgggacaggguuucucuguauagcccuggcuguccuggaacucacuuuguagaccacgcuggccucgaacucagaaauccucugccucgagugcugggauuaaaggugugugccaccacgcccgguucauuuuuuuuuuuguccuuccugguuuuuuguuuggucgguugacuggcugguuguuauuuguucuuucucccccucuuccuucccucccucccuuaguuuguuaaucuuauauuuaaaaggaaccaaauccuuauuugguugguucuauguguuguuuuuuaaucuaauuucauucauuucugucccaaauuuuacuaccuguugccuucaccugcuuagugauucuuuuuucuuuuaaaccaggugauuucaucugugccaaagccuccagaggacaauauaaaagacguguguacaagucacccaggaaaacaaagaagaagaauauagcuugccaguggggaguuagucuugccuuuucuuuuuuccuuugaaucagagucucacuggauagcucuggcuacucugggacucucuauguagaccaggcuggccugagugcugggacuaaag

SEQ ID NO: 2334 - RNA, 2106 nt, Mus musculus
aauucucugcaaaucccacauuccaauuuuaggcaaguuaaaguuaguacacagucuggcaguaaagugcucuuucccucagcgaccgcccuaauggccuaacaugcaacucacgggaagcccacugggcagcagccgucccugcaaggccuccagcugagcguuguacagcagagcuuucagauccgcuccagugaacgagucggugaccgacgccacgugcugaagguccacgucaucugccagagcuagagacuugcugaggacaguuaaaaucucaagacgggacaccugaaggaagaaaaccuaauuuacuaaacacacacgcacaauaacuguugugcaaauugugacuuuuuucacgaacugacacgucuaacaagcuaagcuuuccaagcagucuggacuagaaggaaaucaucguucuuagacugggaucccuaagaggagacacagguguaccuuugcuauuuuguggggguuuucuuccaccuuuuuccacccugucaacccccuaacacuagauaagaggacaaagaguagaggggaagggggcgacuuccugcugcuuagggauaccaagguccucggggcaaguuuaaucuuugcugucaggauauuuaauuucuucuuucuucuuugcacacgacuauuuaacaaacuguaaccaacaacccaaaagaaccaaauucucggggcccuaacauuuauguacccucugaaaaguucccagaauuccaaacaucacacaacugcagaaagucucugcagcuggcaaagccacgccccugcuagagcacaaggcaaaucauagucagcugcuguaacagucugaagcaccugggguuaaaaugaaagcacauucuuauuucucuguuucuuaaagaaacccaaaagccaacauucaaugugaauauaccuacucugguuauuuucuagauuuggacaugugugcuaacacaggaguaacaguaagaaacaaguacacauggccuacagacuugggaguuuuuggccaugcucuuucauucauucauuuauuccuuucuacauuugggagcaaggauuggcagaaugagacaagaagaguugaccaccuuucuccaugugaccuggccacauguucauuggcacacuugcuugcuugugaacugggggcuucuaacaagauaaggagugugggaucgcagaggacgauuuuuagguuuccugauuugcucauauagaucaacacagccauuccuggaacaggagugcauugaacgugccgcaccugacucaggauuauuuaugcuuugagcaaacagugaacaaagccuuugcuugcaaaacugucuucuuuugcuauuuaaggguuucacuguguagccuuggcuguccuagaacucacucuguagaccaggcuggccucuauuucacagagaucuuccuacccuugccucuugacugcugggguuaaaggcauacaccaccaccaccaccaccaaugagcuucaaagcuaucuuaggauaauugcuaccacaugaccaaaguaaagcucacaagcaaaggguguggcaucucuggaugcuccaggguuuugucaccugaucuggaggagggcaguauacacauuuauccagucugccaggccgcaacagggcagggucgaucaagucagggcgacuaguagcagccagcacauaaacuccugaggggaaaagacuuuuagcaugaucauguaguaacuucuuuuauaguguguuuuugugugaacagugauuuacccuguaagccuucuacuccgucuaacugugucagcaacugguugacuacucggucuguaaccccuguguugucauggccucuucgaggagcgauggacucaaacucaucaaagaaaagaaugcagggcuuugcagccugugcucugagaggggaaaaaugcuauauuuuaucagggcuccagaguuuucaaacucuucauauacagacacacauacacacagagacacacacacuagaauauaauauauaacauaacaaucuguguguacauaagcaaauuacaugcaauuauucuuauuuucuggcuauuucaauuaaaacugaguuuuuuguucaua

SEQ ID NO: 2335 - RNA, 24307 nt, Mus musculus
aaagguaggcuggagccaaggaacaccacaaaguuagcucauacaacagaucuagggcaagagguuuauugggaaaagggggaagagggaaaggccgacuuggaggggggacaugagagagaaagagagauagaaugagcuaggugauggggaacaagagaugagagagagagaucucgaucugggguggccaggccuuuuuaugugcggaaccuggccuugguaggugaugcuauaagcugcugcagcuucauggagccaauauacaaguuucuucuuuuucaaucccuaauucauaugaaugcuuuacaggguacacacauauacacacgugcacgcuaauuucacaguaaaaacaaaaaugagugaaaggcagagauggagaaauaaaaccucaauucuaaguucuaguuuugucaccauagggagagucaauggguuuucuucaucuuaauccuccuuuaugguaauaguuacguuuguacguucguauaguguaaggcugggcuuggagcucagcugguacagugcccagcacgcacaaagcucugauucaucccucagcaccagguaaaugagccaugcuggugugcaccuguaauccuaagaauaauaaaaccaagguccuccuaagcugcauggccaauguagagccggugugggcgacaugaaaucuugugucauaaaaauguuuuuauugcgcaccucaguccauagaggauuaagagcuguagaagcaggagcuccccgugccgcuuuauggagugaugucugcugcgaguugucguucuggaguauuuacgucuuaugacuggcccucuccguguguaauuuaggauggaggcuccagcucugacagugaccugagucugucuucaauggucuuucuuaaccacagcagugguuccgacgacuccgcuggagauggagaauguggcuuagagcaaucccugcuuucucucgagaugucugagauccuuccagacgaaucaaaauucaauauguaccggcucuacuuuggaagcucguaugaaucggagcuuggaaaugggaccccuucugacuugguaccuucagcacuuguaguugaugugauguggacugggguucaucuccuaaccugccccacauagucuuccugguuggcuugucugcaauaaaaguagucuuguuuuuuaaauuaugccaauuagucauuuuuuaguuuauauuaaacauuuauaacaggagcaagauugguuccacagggacccgguguggcucccucuuguggucacucgggaguuucucucccggugagugauuuuaaacccuuuuuacugugagaucuauuuaauaauacauguaaacuuuauugucacgaagugcuucuggauauuaggaaacuugcugccauaauaucuacaauucauaaaaaacaaaaaugaugccaauuugugaaucuucuggaaacccugaaaagaacaccaucuaucaccaagggaacaaaugcauuagauuaagcgagggcauccucauugguuuuucuuuaguuaacauguaugcccauucaaauuaauacugacuuacucuuuauaauauauaacauuuuuauguacaugguuacuuuuguauauuuguuuuuaauaauucguguuucuaaaaauauaaaaacaucuacuuuuccaagaaguaaagccuuaauuuuuuuuuauaaauuuaauuguuuucuauuuuuuaacuucucuccagaaauaccugggaacauuagcauaacuguuuucuacaaacuagaggaaaggcccagggaggucugccaguaaaguguauggcacagaccgacacaugaacugggcuucgauucccaggaccugcgcauagcuggacacagugacaaguaucugugaugccagcagggacaggcgugcaugcguaugcauucacacacacagagacauaugcauuuauacagaacaugaagaguaagguucacgcugaaccuguccuugccaucaauguaauauuaagagaaaauaaauguuucuguuaugggcgguaguuuguuuugcuauggagaucuuacaccacagcuaucagugaaccuuaguuuacagaauauugucuuuuaaacuuguuuaacuucagugaauuaaaauaugaacuuacuucagguuauuguuugagcuaugacccugagagucuggcuauauuccuaccaaguagaccaaggggcaccaagcacucaugaguuuagaagggaaagugggagggacuauggcaggggaggggggcaagaaagugggauggauuugaugaaaaucacauaugcacgugcgaaauucucaagcaaugaauuuuuaaaaggaaacaaaguuuucauuucuuaucuccagugaacaugacugucucccucucuucucucccaucugugucuuuggucuuuacucaucaugcagagcucacacugucugucugcaccaagcuccgugacucaggauuuaccugcagcuccugggaaagacccguuauuuacacaacauccuguguucaggacaccuucccaagaaggcugccaagaccucacccaggagcagagagaucagcugagggcagagaucagcaucaucaaaggcagauaccggagccaaaguggaguauggccuuuucccuucuucuuagaacuuagacaaguugcuuuucuuuguuugacauguguuucuuugcguuuuaaauguuuauuuacaagccaagugcugaagcacagggacucugcccacugacgguccuuguuccgugacugucucgugagaaagagaauguucgcuucucaggaaagaacuugacaagaaauaacacagggacugccacuuuaucucuugaauuccuaaguuaacaucugcuuaaucugcuuuguauuuaaggaggaugaaucccuuaaccagccuggaccaaucaaaaccacuuuugcuauuagccaggcacauuuaaugacugcacuugcccacacaagaccgucuauuagugaagaugaagggaaggaauuugcugagcuguaaguaaccuuaagaaacacauuguucacuucaguucugaagugauuacauuguuuuguuuuguuuuuuaaauuagaagcuaauuuaaaaauauauaugguuaaaauggggcuguaaaugagcgacagaacugccugggauaugugaaacccuguauuaucccauuaccuaaaaaaggaauuguaauaugcacuuaggacuuagugucaacauuuacugauagccucucuccuucguagcaagguuacuauacugggauuuacagucgucuucuguacuuuacacuggggcuacuuugcgugguggccuggccaguauuacacaugagugauucaacauaauucaaaaaauauuuguuccugguuuugucuaacaguaaauccuucaauucugguuuaacuuggcaguucuuuaagaaagaguguacauauacaagcaacauguauuuauuguacaacuaucaaaagcaaagauaaggaagaguaggagacaaauguccucaaucucaugugacuuuguguacuuacugaaagugcuuuaccugugcugguggccacuguccccucugagccaucuccaucuuaaacacuggguggcagauuaugcagguggccccuuuguuguguucccuaguuucuaguagguuucuauaacaauguccagguuuugacauuuacguugcugcaaggugcucacugcuauucuauaagcagcuuggagccaaauguuggcacuucucucauuaguucacagaaacaaagagaauuguucauuucuuaaaauauaaggcuauuuagaaaaaauccauuauuuguuuuguaauuaguauuauucacuaaauaucaucuuucuuuuuaagguaugagaacuuucaaaauccaaagaagagaaaaaaucaaaguggaacaguguuucgaacuggacagaaaguaacuuuagcauaaaauacacuucugauuuucuagauguguuuguuuuaauggucugucccuaaguuguaacuauaaaaaugauguaaaaauuuuuuaauuuaauaaauuugguuaaucuauaaaaucacagacuggaaagugcugugauucugcucaggacuaccugagauuaacagugcaggcuaaaggaagugauuuguaacagaucguuuauuuuauucccaagucuguauuaaauccuuaaugauauuacgucaaugguggaccucauuuguuuucuuuuagaggcacucacagacccagagucacugauuuucuggcuuuuggcagauuguaugccuuguaacuucuugauuguuuugggaaaagauacauucuauuaucgucuguuuuuuguuuguuuguuuuguuuuuaaaucggaacaugacauuuacacacaauccaaauaacuuuaaauguaaucccuucaaacaaaaaugccugauaauacuuuugauccagcucccaguccagaaucuuugauuuuuaucuugauauucucuucaucugugaacugcaugugcgcgcgugcacacgcaggaugccugccugucugcaguuucaaaaacuggcugccagauccuagacaacuuucuaucucuuccuuuuagaugcuggccgcaauuuacagcuugccugcccugcaguuucucuucuuuuuuuuuuuuuaauuaauuuacuuaucuauuaauuuuuuauuaaauauuuucucuauauacauuucaaaugcuaccccgaaaguucccuauacccucccuccacccugcuccccuacccacccaacucccacuucuuggccuuggcguuccccuauacuggggcauauaaaguuugcaauaucaaggggccucucuucccagugauggccaacuaggccaucucugcuacauacacagcuagagauaugagcucuggggguacagguuaguucauauuguuguuccaccuauaggguugcagaccccuucagcuccuugggugcuuucucuagcuucuccauugggggcccuguguuccaucuuauagaugacugugagcauccacuucuguauuugccaggcacuggcauagccucauacuagacagccauaacagggucggucccuucagcaaaaucaugcuggcauaugcaagugucugggucugguggcugauuauggaauggaucucugggugggguauucucuggauaguccauccuuucgucuuagcuccaaacuuugucucuguaacuccuuucauggguauuuuguucccuauucuaaggaggaaugaaguauccacccauuggucuucccucuucuugauuuucuuguguuuugcaaauuuuaucuugggugaucuauguuucugggcuaauauccacuuaucagugagugcauaucauguguguuauuuuauuggguuaccucacucaggaugauaucuuccagauacauccauuugccuaagaauuucaugaauucauuguuuuuaauugcugaguaguauaccauuguguaaauguaccauauuuuuuauauucauucuucuguugagggacaucuggguucuuuccagcuucuggcuauuauaaauaaggcugcuaugaacauaguggagcacguguucuuauuaccaguuggaacuucuucuggguauaugcccaggagagguauugcuggaucuucuaguaguacuauguccaauuuucugaggaaccuccagacugacuuccagagugguuguacaagcuugcaauucuacccgcaauggaggaguguuccucuuucuccacauccucaccaguaucugcugucaccugaauuuuugaucuuagccauucugacuggugugagauggaaucucaggauuguuuugauuugcauuucccugaugauuaaggauguugaacauuuuuucaggggcuucucagucauucgguauuccucuguugagaauucuuuguuuagcucugaaccccauuuuuaaugggguuauuugaauuucuggaguccagccucuugagcucagaaauugaagaucucagaagauggaaagaucucccaugcucauggaucggcaggaucaauauaguaaaaauggcuauccugccaaaagcaaucuacagauucaaagcaauccccaucaaaauuccaacucaauucuucacugagauagaaagggcaauuugcaaauucaucuggaaaaaugaaaaaccuaggauagcaaaaacuauucucaacaauaaaagaaccucugguggaaucaccaugccugacauuaagcuguacuacagagcaauugugauaaaaacugcaugguacugguacagugacagacagguagaccaauggaacagaauugaagacccagagaugaacccacacaccuauggucacuugaucuuugacaagggagcuaaaaccauccaguggaaaaaaaaaagacagcauuuucaacaaauagugcuggcacaacuggcgguuaucauguagaagaaugcgaauugauccauucuuaucuccuuguacaaagcucaagucuaaguggaucaaagaccuccacauaagaccagagacacugaaauuaauagaggagaaauugggagaaagccucaaagauagggcacaggggaaaaauuccuaaacagaacaucaauggcuugugcuguaagaucaagaauugacaaaugggaccucauaaaauugcaaagcuucuggaaggcaaaaaacacugucaauaagacaaaaaggccaccaacaaauugggaaaggaucuuuaccuauccuaaaucugauagggaacuaauaugcaguuucucuuucuaaacucuaaaaaaacuguccuccagccuaaaacagaaacccgagcagcacagccucccacagcacacgggaaauaugcugugccuugaggacagcaaaucuccccuaaaggucaaccgguuaauuuaaagccugugccccucgguagcacugugugacucuucacuguacgaugagccauguaaccaaaagauggauauuucuauuucauaccaucuugggggaagcaucccauuuccuuuuuaaguauuuaaaaauccaaaauaaacccacuguagaaauauuuuuuaaucaaaaacuggaauauuagcauuuagaaaaucauuuucaauaguauuuccaaugaacuuuauuauaccuuauguaagcacgaaggugcuuuuuuccaacuuugggacuaaagaaaaaggguaaaagaguuuugaugaaaaucauuaagaucaagucaaauucucauaaauuccuauaguuaaaacggucugucuggauagaugaggacagaggcagcaaguggguaccugcccacucccccaucauacaaccaaagcacaccauccaaauuuccagcacauggucuggguuugaguuuuuugacuaucaaaacuaaugaccuuucagucccugccuuagcaaucgucaggccacucucacagaggcugcugccucaguaagaggaggggaugcugcaugcagaucaaagaucuggcugaagcagcugaugcugacaggcaaaggcaggucuacagaaguggcugaccgcucuggugugagaucagugugaagagccagagcuaacccaucacccagcagcugcuuucuacaggacuaaagcagccaaggucugcuucgagagagaagacuguggcuuuguaagacauacugcucacauuuugguuuaguucuugaucagaaaucuaaaacuuaagccuggcauggcggcgcacaccuuuagucccaguacuugggaagcagaagcaagcagaucucuugaguucaaugccagucuggucuacagaaugaguaggacagccaggaguacagagugagauucuagguuaaaaaaaaaaaaaaaaaaaaaaacagaaaagaaaaguagagagagacagaggcagagagaagagagagaauaaaagagagaaaucuaaaacuuaguguuuuacaccaauaaaaauguaauucauuuuaugaguucauagaaauaaauuauaaagaaaaauagacacuacauguuuauaaugauuucccuggaaucugccacuuugccugggaaaauacauauuaaauuuauuauuucacuucaauucauucuuuuuucacccugugauuuucuaagcaacaggcacuaagcagguaauacaacuacuggguaguagguaacauuuuucucaaguccuguuuccagguaagaacuucaugaagaaguucuggcguuaacuaccuacauaacacaccugucacacaaggcagacgaggcagggaucucaaggccaagccaaccugaaccugggcuauacaugagacccuaucucaagaacuuagagaaaaagguuuauaaagagaaaugaguguggcauaucuuguuauauuauaaauagaaggaaacuggaaaccuggcuuuauuuugggauguguguguucuaggguuaaaacugaggcuuuauaccugcgaaguaaguaugucccagguuugguuuuguaacuacaagugguuggcaacuguuuccuuaauaguuaucgcaggaguagguccaacgugaguccauauguagcccuucuccggucgggugggaaccgugggaaauggugaggaccuugacuugaaauacucagaaggcgcguggcagacaaauuccagguacuccaucuuccuuggaagaucuuccucuggcccuaaggggcagccagggaaauguuaaguacaguuuugaacacagguaucuucuuuguaaaauguuagcaaucuuagacacuucagcagcagcacucuuagaugaccuagcugcuguuaccucggaacaugcacuacucugaaaucacacuccauuauuuacucuacuucaacugauuaaggcauucagcauccucccacagagugcucaacuaagaaaggauccuaagauauugaguauucgugucguuuaggaagugccuguacuguucuaagaacuguacauacacccacacuuggaguccucacaacuuccgcauggggcucuauuucuuccaauagcacauacaggcacgcugaggaaagacagauuaaggccuggugaaguuccuuaauuagcaggcaaguggaggggcuaugaaaccaguagucugguccagagcuugagcuccggcuggcacaccaucuagucagggaagcauccacacugaggaccaugaaacgggagaggggagccuagaaaucauucagagcaucauggccucugguguuccagacuuguagacacaagacagucaucuggucauacaacaagcuugacagugagugagaauaacaugggauauuggcuaucuuuaggguuaucacuaagaagaaaugccacuuccuuuuugaugcaaaacaaacgcaugcccaauucagaaagaaugacaguacaaaauaacugaacuuucaaaaugacacuaggccagucauuuuuacgagucugucaagaacuaguuguacucagucuuuugaaugccuugaaaugaguacaguaugccauuucaaccaucaacagugaaaugaguacaguaugccauuucaaccaucaacagugauuuuuuuuagacuaagauaucgcguaugcuguguagaaggauguauacugagaaagguuuuuauagaaauaauuaugaaaguucuuuuagaaauuguuuuugaaaauugaauagguccccuauauaaccuagguuccuaugugauucuugucauacaguuuaggcuugggacacgcaaacauuucuuacccauaucauguuagugggcauacacuguucuagcccauaguaacaaauggcauucaaauaucaacuauauaaaaugucuauuuccuacaaugcuuuuugcuuuuuuuguacauaaugauauuuaugucuuuuucuauucuggauugaacuuuguucuagccucacuucacauacggauggucuauauuuuauguuaugugcugggaaagggaccauuaggcagguaaucauggucaaauaaaagcaaaagagugggcucccucaauuucagauaaagaacuacaggcaacuaagaaacacugagaggaaauuggucaugguguuuucugaucgcaacagaacaguaacuaagaaggccccuauccccaagcugguuaucuauuaccaaguggucaacccugaaauuguaugcauaaaguaacauuaaauggacgcaguaacuuguauuuacauauuuaagaauauacaguaauauauacaauaauaaaacaauuaacaauaaaagaaguggaaccauaaauuuggaaaagaaugggguaggguacacaaagaggaucacaggaagaaaaggagaaaauauaauugcauuuuaauugaaaaacauaguggaccccuaaauggugagacugguguccuuauaagagacaauggaguacucucuuucagugugcacacagagaaaaaaagaccaugggagacacagcaaaaacccagccaucuguaagccaggaagcaagcccucacacauggccaucgucacagcacccagaucugacuuccgaccuugagaacagucuauugcucaagcccccagucucugacacuuugcucuuugacagcucacacagacuggcacauucauucauaaugcacugaagaaugaaguaaaucuaagaugcugggcuucaccuauuauauaugaugcaggaucaaacuggucucugggacuggcgaggguaggaaugagccaugucagcgcggcacucuucucacaguacugguccugaauaaagccccugaucugagcauaguacggcuucccaucuugcucaucaaucacagaaacaacgucaccaauuugguaauauacucccugggggaaacaggacaaucuuguauuuaaaauaguaacagccuacauucaucagcaagcaaaauuucaaaauaguaaaaaaaaaaaaagucugaauaucaauguuguuuguuucccuucugaaugaagaacaauuacauaauaccaauauaugacaauuuacaacuggagaaaagauuuuuuuauaucaugaaaguacuaucucuaccuuuaaaagaaaagacuucauuuuuaagaauaguuuugaauucacaauaagaucaugggaaguagacgggauuuuccuuaguuccuuuaccuggcacauauacagcauccucuccuauccgcgucucccacugucagagucaaacacucacggugacugcugaaccuacacgccacaucaugaugacucaagcaucaucaauuaacugaguaaucuuggugcucuauaaucugggggcuuggggcauguacaccauggauccacggugaucagaucacccaguagguccacuggccuaaaaacccucuacacugucccuacuuuguguuaacagccauuaagcuggagaaaguuaaaugacguguugcucagguccacacaaggaagcaacucuaaacuacacaccuacaguaacugccucaguggucucacuauauaccaccuuagaaauaaaaauaaaaaaaccagcaugugcuuggugagacuagauucuaaacacugcccuuuuccaguuguuuauucaaagagaauagauaugguaaguucaaaagaaacauugaaaccuuuuucuauuauaggcagcauucaggauguuaccacauuucccagacuccuugacaaccgucuccuccccggucuucugcuuuacaucuucucaacaacagaaugacauacucauucuuguucuauuuauaucaaauuaacuaagcugucugauuccaguacuguuucucccuaugcuucugauauccaucccagguccuccucccuggaucccgagauggaaaaaucucacuuuugaauauucguaauaguucaucuuuaugacauguaaaacuuccauaaaucggcagugguggugcaugccuuuaaucccagaucucugaguucaaggcccagcugcccuuucgaagugacuccagaggcuuaccuuguagaagauugacucugcagugacuaugguagaaacagauucaggcgcuuugauaggcuacaaaaaaacagacgcaaaaacauuugaguaccuauauaguauguauggccauuuuaccaucuacaugagaacuaucuaauuugaaaagaacaaaauacuauuuggugacagaaacuacacaacacacacacacacagaaugugaagcaggugaauauuuccacaauuuuugcuaccaguaacuuaaaagcgcagaaaaacaaaaggugaaguuucugauuaugcugcuaggagcuaacacaacacaaagcucucuagcacuccaguagacauuaauaguccaaguauagaaauacaguggcucuaaaagacugagcauggccagauggaaauuauaaaaaauauacagauaaauauaauuuuguugcaagccugaacucuuuaggguucuuaguaauuugccacauuguaccaccauuaaaaucccuuuuuagagcugcaacacaaagcuuaucacaacguaaaaauggccuuuccugacuuugugccauucucccaagaauggauaugcagagaaauugauaaugaaguaacugaauagaacacagucugaacucgccacgcaagccuaacagccugaguugacacugggaaccaaggcuccugaaaucuguccucugaucugaccuccacauaauguacccggcauaugcaccagcacucuuauguacacaauuaaaaacacauguaaaaagaaauuaagagggaacaauuaggccugggagaaggcucugcauuugagagcacuugcucuuucggaggacccagguucagcccgcagcauucacuggcagcuucuaauugucuguaacuccaauaccuagggagccagugccucugcuagccucugaggguaccuggugcacacaugcagcaaaacacucagacacaagaaauacaaauaaaucuuuaaacaagagucuacuaucuuuaugacacuucuccugggcccguuuuacaaaugaguaugccuacuuuagaaagguguuuacuggcaagugagguauuuuuguuccaaaaguaacaaccaagcugagauaaacaaaaacaucuacaauauccuucacugucccaaauguacaaauaaaacaaaacaaaacaaaaaacccuuaccacagcaggcauuaaacaaucuucauacaucagcuuuagaaaaaguuuugcauucauaaucaccaaacucaucaugaaccaauagauauuuuuuucugggucuaucauaacaaacaagguacugaugaauuauguuauuugccucguucuuuaaaagacauaaaaaaguuuuguucuuuuuuuuuuuuuuuuuccuuuccuucuguuuuucaagacaggguuucucuguguagccauggcuguucuaaaacucauuuuguagaucaggcuggcuucaaacucaagagaucugccuguaccugccuucugaguacaggaauuaaagguuaacaccaucacugcccagcaacaaauuuuucuuaauuaacuauguaucaagagucauaacuucauuaaauugucaaugaacaaauuuaaccaauuuauaaaaaaaaaaccauaauuucucuuugcauacagauacacugugcuaaauuauagaacauuccucuagauucauauuuuauaucuuucagaugagaaaaauaaaagcugaagaaaaaaaaacugagaaacugcuuuucuaaugucaaaaacugccaauuucuuccaggagagcugucuuuugggaaaccuugccuucccuccagaauacggccuaagugcaccugagagguacaccagccgugggaaggcccaccacacccacagugucccauuaggaagcacaauguccacaaccaucuuacauuuuuuaacuuaaaaauaugucuucucccuuuuccuuucguggaaacuuucuuuucagcagcuggagccgauuuguauuugguauuucugagccgggccgaccuucugugaauuucuugcuuacucuguuacacaauuuagagaaaaggaaauuaaaacugcagaagaaaagccaauacaauaaccucacaaagaucagaggauaauacacuuuguuaaaagaaauuaaaaacaaaaaacuuaaaagaccgagggcugagauguuaaacucuguagggccucccaagagauggcgcugcuuucaagcgggaagaggacagaaguggggggaggacaaggcaggaacuauuuauuauucguuugcugaacugaucuauuuuacgcccccccccaaguuuccugcauaucucagaacagaauucuaaugcugacauuuuuagcgaccuacuaauuuauuaacgugacaaggacuugaugggcaagagguccucgaccuacaagcaaauggccucguccggcugccccggugcgucccgcaccgcccggucuacggcaggaagcccuucucccgaggagggagaggccgagggcucaccugcuugccgccgccgcccccguugcucugcgaaggaccggccgaggugguggcgaaggugguggugccgaagccaccgccgccgccgccaccgcccccggucccgcccgccacucccgcgccgccgccgccccggcccgugcagugauggcagaggaucucgcccuguggacucuucuuccacauggaggacgacguagucuugcacaugcugcaggugggcuucaggcccagcggcaugcuggccggcucgggcggcccccgcgggcgcagcgacacgggaauggcggccgucugcacgggccgcccaggggucggccggccaccucggcgacuggaagagcaaggucggaggugcugggccgcccgcgccgggacccagcggccaccgcugaccccuggaggcgggaagcgggcucccgcagcccgggacccagcccuggagcugggccgcccgcggggcacgcaggcccgauacucggcgcggccucccgggaaagccagcuccgcccuaggggacgcuauccggggcggccgccgccgccgccgggguccccagggcgaccacgacccugccuccgcccaccggggcuuccggcgaugggcggagcucccggggcggggcggggcggggccgagugaaccagugugccugaccuaggcuuuggggcuccggaaaccccgccuacuggccggaaguggcccugccagacuuaccauugccugucacucuucugaguuuacaacuggcuggggggggggggggcuggggggggggaauggauguaaaauuucccguuaaaagugaauuucaaaugacuagugagaguggcccauguaauaguaguuauaugauacucauacuuauccuguguuuucauuugauaaauguagccuuauugaucaagacccuuuuaaaagucuuaauuaauuaauuugacuuuggaggcuagggaggugaccugaugguaaaguucuucuggcacaagcuuauggccugaguuugacccccaguacucacguaaaaagcuagguguguuagggcuggaaagacagcuaagacuagauccaguauuagcaccuacacugugaaacuuaauuuaacauucuugcuuggcauacuacuuaacauuagaauaaagugcucucgagcccccucccccccaaaaaaagaauugagggucuaagaaauucauauaauaagaacauucagacagaaaacagcagaaacaccaguguggacuggaugagauuaauuuauuagucaaugauuuauuuuaccugggucaauguaacagugcugugcacugaauacugaacgugagggguuuaugaguuaguuggguuagaaaugagcaaugugcagaagaauuccuaucaauuauuucucaugaguuauacuauaauuaaaacguuacaguuuuguauuacacaguuggguucagagcugggauauuuguaucuuauauggcuucacaucacuuauuugcauaaagaacaagcaauacauuauaccuuccuaacguuuaaaauaaaguauauuagcauaaaggcucccaaagaagauuccuggagacugcauugaacacugcuuuaacuaggggugauugcuggaagaauuuaucguuuucugugaacuuugguucgaggaacuggacacauuucaaccuggauuuaaaucacugcaaaacuaguaguucucugggaggaccauuagcaaagcagauacaauacacuuucaccuggaaaggagauguguauuauuugagagaauuaagccugaacauuggcuauguucguugaagucuaaagcucccagggaaacuagcccaaggaaugaaggaauuccuaaguacugguuacagguaaauaaauauuucuuuaauugaacaacuguaugcucaguggaguuuuaucuauauguggcauguguauacaugaucauaugugccuguauaugugucuaaggacacaugcgcgugugugugcagauaagcacauguguggaggcuagagguuggacauuaggggucucccucaaucacuuucuaccuuuuuuuuuuuuaaacaguuuuuuuccugaacuugcagcuuaccaauuaaccuagacugguuuaaccagcaagccccagaaaccccccguccaaguuccccagguccuaacguccaugugugaccuuuuacauagaugcugggaacucagacccccaagcacauuacagacucaacuaucucccuggccacguuuuaacuucuuugaaacaggaucuuacuccaucccaugcugcucugacacacacuauguaguccagacugcaagccagcagcgauuccauccucagccuccuaauuguggagacugcaggugggagccaccucaucuaacacaacugugucauuuaaaaagugaaguuauggcuuguguuuucucagaaacaagugauaagauguggauaucuacaugauuuggagacacaggguugaugcugagcauccaguacagaauuuuagaaaguccuuggagggucuggugagauggcucagugguuaagagcacugacugcuuuucuggaggucaugaguucaaaucccagcaaccacaugguggcucacaaccaucuguaaugagaaaccaguaaaaaaaaaaaaaaaaaacaugggccuugcuccuugcuccuagaccuggcuggagcaagagggagaagggaagggggagggggauaaguuguuuuaucgacuauaagagagaggggggagagggaagagagagagggggagagggagagccagucugucuuagucaggguuucuauuccugcacaaacaucaugaccaagaagcaaguuggggaggaaaggguuuauucggcuuacacuuccauacugcuguucaucaccaaaggaagucaggacuggaacucaagcaggucagaaagcaggagcugaugcagaagccauggagggauguucuuuauugccuugcuucuccuggcuugcucagccugcucucuuauaaaacccaagacuaccagcccagaaauggucccacccacaaggggcccucccccuugaucacuaauugaggaaaugccuuacaguuggaucucauggaggcauuuccucaacugaaguuccuuucucuguaauaacuccagcugugucaaguugacacaaaacuagccaguacacagucccuggaauaaaugugcacagugguucuaacagcagauaaaagaacgaugucccuggguagugguggcgcacgccuuuaaucccagcacuugggaggcagaggcagguggauuucugaguucaaggccagccuggccuacagagugaguucuaggauggccagggcuacacagugaaacacugucucgaaaaaacaaacaaaauaaccaaccaaacaaaaaaacccaacagaaugaagcucuguagagggcccagacucugugaccugccaguagauugcccagugucucagcuggagguuggguuuuuauuucuaugguuuauaucccguuacucacaccugacuucauagacaguaugucucuuucuuuuuccuuuuaauuuauucuucucucauacaguacaucugauccucagccucccuccuucacuccuuccaguucccuguccccaaccucugccccagauccauugcucuuccgguucccuaagcaaaagagcagaccuccccuugauaccaauugaaccuggaauaacgaguuacaaugggacaagcacagacccuccgaucaaggcagaggauugugaaaauguccuggggaagcuggagguggagagcaggcgugggucucuggcagucuaggggaguggggcugagaagauagaacuggaaggcacuaaacccugacuaagacacccucggauccacaguaaguugggcauauuggugcagguuuguaauaacaaugcagagggugguggugauggguggaucaccggggcucacugaccauccagccuagcccaucagccuaaaccagauuccggagaaagacccugccuuacaaaauaaggggccagcucccgaggaauuaaaacagguuggcuucucauuuccaaaugugaauguauguaggugaguguacgaugaugaacauaggcacacacaugcaugcuugugcauguguacccacaacacaaaugugcaucacacacauagaaacaugcacacacauaccuucacaugagcacauguacaucaaagaaagaaaggugaaaguaucacauggaaaacacauuuuucacccucaaacccucugccauuagggcgcaaggugcauuguggacaacacuucauucaggaguuggcaguuguaccuccuuucugagcccaguuccucuacagugaggaugcuguuauccagcucaauacuugcucgaucauugcugugcuuggcacacaggggcucuaacucaaccacgagcuuccccaugcagcagcaccucucuugcagagaccugagagcagugguucucaaccuguagguauccgccccuucggagguugagugacccuuucacaggggucaucuaagacuuccagaaaacacagcuauuuacaugauaauucauaacaguagcaaaguuacagcaauggaguaccaacaaaaauaauuuuauguuugggggucaccaugacaugaggaacugcauuaaagggucucagcauuagcaagguugagaaucacugccuaagaguauagcaacauuugccucuaggacagauaggaauuacuaggcaaagaugucagggaucaaaucaagaggugagggaggacagcuugugaagacucuuaucuaguccccuccuccccugagggaugcuucaggaagacaaugaggcugggggaagggggugggguggggcaggcauggcuccacaaggaaucaggaggagauaucucagacacaugucuuaauuugugcugcuguaacaaauuaccagagaugggguauuuauaagaaacagacauuuuccccacaguucugauugcugaaucccauucacuaggauuuuacccuccuuucuaagucuuacuuuuuuucuuuaaauauauuuuaauucgaauauaauuacuucacaucucccuuacgcuucuuccuuccaacaccucccauauaccuccuuccucccucucagauuaauggccucuuuuuuauuauuauuguauauauauguguguguguguguguguguguguauauauauauauauauauauaucaacaccauugugcauacauauauucacaaacauauaaauucaacuuacugagucuguuucuguuguuuauaugauuucaggacugacuaguuuguauuuaauauacaauuugggggcucaucccuggaaaggguaauucuuucucucucucucaauaucauuaaugaccuguagauauuugucuaggaguuggacccaugagauucccgcccccuuuccauauuagcauggcuauugauauugucauuguuuaggcuuaguuuauauagacauuucuaggaaacacagucacauuuauacauuaaacuuuccgcccuucugguuccuacaauuuuucugccuccucucccaugauuuuuccugagccuuuugugcaguuuuguguuuuagaugcauccuguggggacugacccccccuacagucguggauuucugcaauaugucuagccgugguuuccuguaauacucuccauuuucugugaaggggaguguugggagccgcgcccacauucgccguuacaagauggcgcugacagcuguguucuaagugguaaacaaauaaucugcgcaugugccgagggugguucuccacuccaugugcucugccuuccccgugacgucaacucggccgaugggcugcagccaaucagggagugacacguccuaggcgaaggauaauucuccuuaauagggacgggguuucguuuucucgcucucuugcuucuuacacucuugcuccugaagauguaagcaauaaaguuuugccgcagaagauucuggucuguugcgucuuuccuggccgggcgugagaacgcgucuaauaacaggggagcuuucuugaaugggagaagauggcuacacuuguguguguaaggauguuuuagaauuuaguuaggagucuugcuggacuagaaaauaggcaguaguaggaucucuuuuaagaccucaccccaccugggugguugacuagguuucuaauacuaagccuaauuucccuccuguggagugucuuaaguccaaucacacuacccaaaugugagggcugcucuugcaccuuagcaugcuggucauuguucugguucuuaggcaucacaacuauauaggauuauugaucgcauccugcccuugcagaauacuuucuacuauaccagcaauuaaguuuaagcauaagaauuagggaaauauauucaaacaauagcacacaaugagagaugcucagucuggagccaagggaaggguugaacuggaucacacagaaaaguuaguacauaugagauagaugagagaauuaggaugguccugcguguacauaaguugugaaagcagaaguaaaggccucuggaggccuuaaaaucuuacacuaacgggaaacucccuugguuguucuuagugucaguauguaagacuuacaguuagcaugauuuaaugucugccauaguucacuaauuaaaacucuuggcaaaaagggggagagcagauguauaaaauacaucccaggcuagcaucgaaagggauggucacauucugcugccugaugauuagaggccagcagaggauucgaagaucauguguaucugugcccuaccuguuaaacgggugguaucugcagugaguccuacuugguuuagucaccugucaaauggaaaggugacagaggcuauaaaucauagaguagauguuuuaaaugaguuaguucauaaagaaugcaaacgacugcuacaucugaaaaaauacuuacacaguguaggauaugaggcugaugagaagagagaggauuucuuuugaccaaauuguaguuaauucauuaguuacaauccugauguguaaacaaagaaaucuuauuaacuguguuuuggaaggaaaacauauaacuaacuuagguugauuguuuacaccaacgaaauagagacaccgaggacuggacagagauagugucaggggccugugagauucugagguuaaaggaagagagcagagggugauguugggacugacucuucuuuuuggccagggggguuugggggaguggccagcauaugucuuccacuguaggcaagccuucuggauguucuaugcuguaacucgagcaccauggaaccacguucuguguaagauauucuugcuucccggucucauucuuugcuugggguacuguucucuuugccugcauugugcuuccucccaaccuucauauucaacacaauuauuauucuaagaaccagccaacacuucaucucugacuccauaauucuaaacagcaauucccuucugaagccccugcuucucuuucucuuacaagcacacauugcgcaugucucuuccaacuacacagggaaggacucugucguuuucacaucucuuuugcuuccucacccucuguacacaguaaaccaacacugaguuuaaugacugggcuauugaaaagcuccauagaggacaagucccccacccccaccccugcagcccagagaucccagagaagaagaaggguucaagguacccgcucacuaccggcucaugggucuucccuuaccaaucagucugccuuagguguuucaugacuuccaacugguggugaaucucaaguaugacaguccacucuacguaauugacuuaaugcuuaggacccaaugcaaccuccuaccauuuggagacaccaaagucaucauggucgaucagaaagacugguuuauacuuuaugagaaaugagucuuacucaucugaaauaauggcacaggacaucugguugguguccuccgguggaguuugaugaccauccuucuucuugcugagaagaaagcgauggcaugauuggaaggaccccuuccucauaggcagagcaucuugcuccgugacauggaguugguuugaagaccugaguguaggucuucuugagacccaacagagagcgcaccugcuagcaugaagguugacugggcuuggcuuagaaccccucucuccaucaacaaaugggaccucauaaaauugcaaagcuucuguaaggcaaaaggcacugucaauaagacaaaaaggccaccaacagauugggaaaggaucuuuaccaauucuaaaucagauaggggacuaauaucuaauauauaugaagaacucaagaagauggacucuagaaaaucaaauaacccuauuaaaaaugggguacagcgcuaaacaauucucaacugaggaauacugaauggcugagaagcaccugaaaaauguucaacaaccuuaaucaucagggaaaugcaaaucaaaacaacccugaaauuucgccucacaccaaucagaauggcuaagauuaaaaauucaggugacagcagaugcuggcuagaauguggagaaagaggaacacuccuagauuguugguaggauugcaagcugauacacucgaaaucagucuggcaguuccucagaaaauuggacauacuacuaccggaagauccagcaauaccucuccugagcauauacccagaagaaguuccaacuuguaauaaggacacaugcuccacuauguucauagcagccuuauuuauaauagccagaagcuggaaagaacccaaaugucccucaacagaggaaugaauacagaaaaugugguacauuuacacaauggaguacuacucaacuauuaaaaacaaugaauucaugaaauucuuagguaaauggauggaucuggaagauaucauccugagugagguaacccaaucauaaaagaacacacaugauaugcacucgcugauaagcugauauuagcccagaaacuuagaauacccgagauacaauuugcaaaacacaugaaacucaagaagaaggaauaccaaaguguggauacuuuguuucuucuuagaauggggaacaaaauacccauggaaggaguuacagagacaaaguucggggcugagacagaaggaaggaccaaccagauacugccucaccgggggauccaucccauauacaaccaccaaacccagacacuauugcauaugccagaaagauuuugcugacaggauccugauauagcugucucuuaugaggcuaugucagugccuggcaaauacagaaguggaugcucacagucaucuauuggauggaaaacagggccccuaaugaaggagcuagagaaaguacccaaggagcugaaggggucagcaacccuauggguggagcaacaauaugaacuaaccaguaccccacagagcugugucucuagccgcauauguagcagaggauggccuagucggccaucaguggaaagagaggcccuuggucuugugaagauccuaugccccaguacaggggaaugccagggucaaaaagugggaguggguggguuggggugcagggcgggggugggggagcguauagggggcuuuggggauagcauuugaaauguaaaugaagaaaauaucuaauuuaaaaaugugaagaaaaagaaagaaaaggaaaaagaaagaaaaaggaaaaagaaaagaaccccucucucuuccugagaagaaagaucacucacccugugucccaacugccacucccuuaacugucguucagaaccug

SEQ ID NO: 2336 - RNA, 2671 nt, Mus musculus
cauggcuuucuuugugucagugccacucacucagcuugggaagaugcauguggugcaguuccugcaaucaggcaaagagaugacucaucagaaagaaauuaauucagcaagucacaaugacagcacgugauagcagguucucuuccauagaaauuuggugacuaaguuacccccauuugaauugaauuuugauucaugcuggauuucaguuugcuuacaaacaagcacacagugcuuggagcugucucagcccaauggccucccaaccauuuuuucauccugcaucagaaucuucagagggaaggccauaggccuuuaaaugggaaauacauuccuuaaagaaauacaggaaaauacaaucaaaugggugaaggaaaugaauaaaacuguucaaaaccugaaaauagaaauagaaacaacaaagaaaacacaaguggaggaaaccuuggugauggaaaaccuaggaaggaaaauaggaacuacaaucacaagcaucaacaacagaauacaagagauggaagagagaaucucagauguaaaagauacaauugaugaaauugauacaucugucaaagaaaaugccaaaucuaaaaagcauuuuuuuaaacaaaaaacauucaggaaauuugguacacuauaagacaaccaaaccuaagaauaaaaggaauagaagagagaggauucccaguucaaaaucccagaaaauaccuucaacaaaaucauagaagaaaacuucccuacucuaaagaaagagauggcuauaaacacacaagaagcuuagagaaacccaaauaaacuggaccagaaaagaaaaucuuccugccacauaauaaucaacacauuaaauccacagaacaaaguaugaagguuaaaacugaaaagaaaaaaggccaaguaacauaaagguagacauaucagaauaauacuugacuucucaagcagaaacucuaaaagccagaagguccugggcagaugucuuguagaccuuaagagacugcaaaugccagcccagacuacuauauccagcaaaauguucaaucaccauagauggauaaaccaagauauuccaugacaaaaccaaauuuaaaccuuuucccacuaauacagcccuaaagaggauacuagaaagaaaacuuccaacauaagaaauguaacuacauccaagaaauuagucaucucacagcaaaaccaaaagaagagaaacacaaacacacacacacacacacacagagagagagagagagagagagagagagagagagagacagagagagacagagagagacagagagaaagagagagacagagagagagaaccaccaccauuguccugucaugguuugaguaugcuuggcccauagggagugguccuguuaggagguguggccucguuggaggaagcaugucugggggggggggcuuugaagcuccacccaguguggaagagccaguuuuucuccugguugcacucugucaagauacagacuucucagcuccuucuacagcacugugccugccuagauacugcuaugcuuccugccaugaugucaaugacugaaccucuuaaacuguaagcuaaccccaaucaaauauugucccuuggcaacauggggucauuucacagcaauggaaaccuuaacuaagacaaccaccaacauugaaauaacaggaauuaauaaucauuggucauuaauaucucucaaaaucaauggacucaauuccccaauaaaaagauacaggcugcucuuucuguacccagcgcagccagggcucguggucccaagaaacaccugaagcgcguagcugcuccaaaacauuggaugcuggauaaguugacuggcauguuugcuccucauccauccacugguccucacaagcugagggaaugccugccucucaucauuuuccuaaggaacagacuuaaguaugcccugacuggagaugaaguaaaagagauuugcaugcagcgauucauuaagauugaugggaaagucaggaccgauauagccuacccugcuggguuuauggaugucaucagcauugacaagaacagagagaacuuccgucugaucuaagacaccaagggucgcuuugcuguucaucguauuacaccggaggaggccaaguacaaguugugcaaagugagaaagaucuuugugggcacaaaaggaaucccgcaccuggugacccaugaugcucguacuauucgguacccugauucccucaucaaggugaaugacaccauucagauugauuuggagacaggcaaaauaacugacuucaucaaguucgacacugggaaccuguguauggugacuggaggugcuaacuugggaagaauuguuguaaucaccaacagagagagacaucccggcucuuuugaugugguucaugugaaagaugccaguggcaacagcuuugccacucggcuguccaacauuuuuguuauuggcaaggguaacaaaccauggaucucucuuccccgaggaaaaggaauccgccucaccuuugcugaagagagagacaagaggcuagcggccaaacagagcagugggugaaauggucucuaggagacaugcuggaaaaguguuuguacaagccuuucuaggcaacauacaugcuagauuaaacagcauggugaaacuacaaaaaaaaaaaaaagauacaggcu

SEQ ID NO: 2337 - RNA, 3355 nt, Mus musculus
cacuccgcucccucccgggcguccagaggcggaagugaaaggugucuaccgggagcguugguaggagcgcggaugcagugugcgggcuggggcuggggagcugcuggagccuuugcgagcggcuugcgagucucugcuagacagggcgaugaauggcuaaaggccauugcagaacugcccgagggaaggcgagccuucgaugugggauuacggcgguucugaguuuagacucaucaagcccuccacacuucguacagcaaagagcucggcauuggcucggaauuuguaacuuuagggacagugcccacccuuagguuguuguauauauagggcauuacgaaauaauguauguguaacgugggguucugguauuaaagugcguuugcgauuccgcuaccuuccccccaugcguugccguuuucuuuuuauuaugacugagaaauguuuaguuugcgagagguugugcaucucacaaaaaugauuugaaggugucuagccuggaucucuuuauucucuacuacauugguuguauuuuugccuuuuucuuuuucggauuggcgguguggugguagaaacaucuggcccuuaccuuuucuggaaauauccaaagucucucaucuuaacgacaaauccgaugcugaaguguaguucuaaaacaaacaaacaaacaaacaaacaaaccaacaaacacucuccacuuaaaugcugcuucaaaaaauuagcugauugugguaccccaaugcgaaugauuaucaguuuucuuuaaaagccugugagcuuuccaacugugggacagaauaggacguauaucuuccuccuuggaccucacucauuacaaucauggagauuuuugugauauuugcuaaauuuaacauuccuuuuagaauguuguuuauuuuuagaguaagacuggagucaauucaauaucuaccuuuguuuuuuaaauugcauuaugcuguauaguuucccggcugaacaaucuguuuuuaaaugaagaguguguuuauacaaggccuugcaauacaacuaggauucaagaaaaugacccuuucugaaagaaaaggcaguuuaacaauaugugagacuuuaaaaaggugugugugaguacaggcacgugcacuugcuggugagucugauauaaauguaguuaguacugguaggaggaaggggugaccaagaaggugaugggaauaugagaauaaugaagacaaacaauaggacaugcuucuaauggagaauuuagguuuauauaaaaguuauauauguauaugcauguguaugugacaggaaagcaaggucagcuuugauauguuuaaugaacccuucagcuaguguucuuggcaaacucuugucccagguuuaaaaccuaacaacuuugaacuagaaaauuaauuccuccuucuucuuucugggguuggggaauugaacucaaguccucaugcgugcuauggacguaugcuguaccacugaccuaccucugauuuacaccacauucccucaacuauaucauuuugaagauggaaaagaguguagaauuauugcauuguaaccaagcaaacaauuugguaaacugagguagagauugauguugauagguguuguccagagauuuguguaagcauauacauauauaugcuuauauauaauauauaauguuuauauauaacauauguuauauaauagguaauguauaaguuauaguauguaauaaacauauaauuuauaacauauaguuauauauauguauauauauauauauacauguguaaucaaugugauccacuuaaaggauauuauaaauucaaaaaagacauuaaagauggaaaguagacaaucugaaguguguuuuuuuuucagagcuacauuuagagcuuuagauuaagguagccagaagcaaagaaauuagugucugugggcaggagagcuggagggcgggaugcuuucuccuggaaggccccuugcauuuaaaggaucuggauauugucauuaguuagucacauaauauuguauguuaacauuauauguuauuuuacacagcauuugaaaaacuuugggcuaccugaugauuauggcaucaagaaacaucuggugugugagaagaaacuuucucuuugauuuaagagacuggaugcuucaauauucagcagaaguuuuccucaagucgauuucauucaggccguuuagugcggaaugcgacaguaaggacaaggagucuuuggaggaggagagggaggaccugcugagcaacuuagucaccaugggcguugauaucgacauggcaaggaggcgacagccuggaguuuuuaacaaggcuguuacgaaugagcaggagcugaaguuauuccuucuguccaagggagcuagugacaaagugauugguagcaucauaucaagauauccacgagcuauaacacgcacuccugaaagucuuucaaaacggugggaucuguggagaaagauuauggcaucagaccuugaaauuguaaauauuuuggagcguucuccugaauccuuuuuucgaucuaauaacaaucuaaacuuagagaauaauauaaaguuccuuugcucuguuggauugacucauaaaugccucugcagacuguugaccaaugcucccagaaccuucuccaacagucugaauuugaauaagcaaaugguugaauuuuugcaggagacugguauguccuuaggucacaaugaucccagagauuuugucaggaagauaauuucuaaaaacccuuccaucuuaauucagagcaccaaacgugugaaaacuaacauugaauuuuuacaaucaacuuucaacuugaacaaacgggaccugcugcuucugauauguggcccaggagcuagaaucuuagaccuuuccaaugacuguaccaaaaaaaauuacacaaacauaagagagaggcugcuuucucuuggaugcagcgaggaggagguacagagguuuguccuaagcuaucugaauauggucuucuugucagagaaaaaguuuaaugauaaaauagacugccuuauagaagaaaaaaucagugcuucacaaauaauugaaaauccgaggauuuuagacuccagcauaaauacuuuaaaaacucgcauccgagagcugucccaugcuggguaugacuugagcacauccagcauugcucugcuguccuggagucagagaagauaugaagcuaaacugaagagauuauguggauaggacagugcaggaggagucgcaggcaaucggacagguguggcacugguuccaguuuggacuuuuaaaacaggagagguuuguuuuuguuuuuuaauuauuuuuuuauuuaaauuuuuuaaauaaaaauuuuaaaauauuuaagauuac

SEQ ID NO: 2338 - RNA, 24085 nt, Mus musculus
agagcgccuucgccucugccgcuguccgccaccaaucugguccugagaucccuccgccaggcucguccgugcccgcugccggggccgugcucguuaagcacgcgggaccucguggucugcgguucucggggcgcgaucauuugugcagccaucacuuucuucaccgaguccaagugccacgguagagccugcuuccucagguccccucgguggcgcaagaauccccgcaccuagacggaggcguggccaccagaagccccgccccgucugugacguccugguggcgcgcgagcugucugugggcgugugaagggcccgggccagacuaagccaucaggccggggccgccucccgacuucuaucugccggcuucuccugcuccaucuuuuccgagaagcggugugcgaccucggcccccagccuaccgggcggaucgaagcgacggucgggaugguacuucugggcuugcugcagucaggcggcugggugcucggacaggcgauggagcaggugacaggaggcaacuugcuuuccacgcugcucaucgccugcgccuucacucucagccucgucuaccuguuccgucucgccgugggccacaugguccagcugcccgcuggagcgguacgugcaccucgggguccucagucugugccccggcuaagcgggcgggcucggggggcgcuagcgguggcgggcgcgcgggaggcugggguggcggcugcagacgcccgugccugaucuuugcuguugugguggucuuucuggucuccuugcuggaaccugaacucgggggcugugcuggccgucgccguuucugcugugauagcggcuuugaacuucuggcuaggauccuacuuugcagcguuuguagucagugauggaugugcagacuggaggccuugcuggauggauuuggcuggucugauugccuuggccauccaugacucuuaagugcagagcacuguacugacuuuacuguugguugucagagguguuugggcucuuugugagggccuugauggcaaguuaaggguagcugcauccccgguggccaucacucuugauacugcccuguguguuuaguauacugugggcuauugggcauaacgaugauuaauagcagugucagggaaauugcagacaguucauaagugacuugagagugugggaagcgcuuuccugugaugcuguuaaaauacuguuucucuaguuuagcgcuacaccaaaccacuaauuucaagccuuccaaauauaguucaugaauacccuuguaaucaacauuugguagcuuugaaaaccaucccuucgaaacugacaaugggauguaaaaacuuaacccagcguuaaguuccaaccaaguugcuuuaaaacuaaucucugaacccaagggaucgauaggcaguuacuauuucuuacuuucauuagauacauuucaaaagcucacuaucaucaucaucauuucugagauauuuauuauaucccaggguggcuguagaacuuguuauguagccaaggcucaccuuggcauaucuuccagccuucaccccuugagugugcagugccuuccuguguagucauuucuguuuugaguucuuuugaggcuaaaccuugucuaacuauacugugugugugugugugguuuuuuuaaacauuauucuuaagcaggcuaucauaugaaacuuuccuauuaauaaaaugaaaacuaaaauuuucauuuucuuuuugcagaaaaguccaccacauauuuacucuccaauuccauuccuuggccaugcaauagcauuugggaaaaguccaauugaguuucuggaaaaugcauaugagaagguaagucuucggaacagacagaggcagagacucuaguguagagaagugcuuuucuuuaaauagaaagacauuuguaaaaagauugugcccucccugcuuauuggcaguauugaaaacauaaaaggaaaaggccuuguuggcucuuagcuucccagagugucuguccugggauauagucucugagaugugaggaaaccuguaguucuaacaauuacguuuuuaaaaauagucuuacauuuuauuuucguggauuauagucagaguugacagcuaguuucuuacugauauaucuuuggaauguugugucuuguaccccugguucuguccauccugugggaucucagccuccacuuggacgguguggguacucaagucuuugcuucuucccugugaaaacaguccuuuggcaucagaucagccguuuguuccaaagacuggcucugggguucuuguuaauuauuucacuucccaauauuauuuaacugaacucucuuuuguuuuaauaucguuuaaaauauucuuugagaguuuuauaaauguauacaauguauuucaaucguagucacaucccacuucccucuuccaguuccuccuuguucucccaugucucccucucaacuuuauaccguuuucuacaaaacaacacacugaguccaguuaguguccucuacauaugaauggaguagggccuccauuagagcauggucaaccuacuuagggucacauccuuaagaaacugacuccccauccuuuagcagccacggacuaucaucagcuccacagcuacaggguguugggucuucugugcaccuccugcauccuaagucuauucuugacacugaaggaaaaaaaaagauacaguuuuaaaauuguauaaaagucuuugugucucuauuaguaugugcaccuaaaugcaguugcuugccaaggccagaagagggcacuguauccccuagagauaaagcuauaaucagaugugagcugaccaguauggguucugggaaccaaacucagauccucugcaagaaaagagccauacaccaguuguuauaccacacuccuucugauauacuugugcaaauacuuaaugguagugauucuuugauguuauuugguucguggauucugcugaucaaauucaggucaccagacuugauggcaagagauuuuuaccuaccuggccaucccaccagccccguuaaauuaauuuuuaacaagagggaaaaaauauuuauauucuuauagauguugauuaaagaauucaauauagccaguauagaacaaaaccauacuuaaaaagguauauaucuaaugcugagagcaacggacuaaagcuaacagugacauuuaaugagcucugauguuuugcaugguagaaaauauuuucaggauaaguagugaaaaagaagaaaucauauuuauacugacuuugugaugaagacaggaggugggauaugaccagaugaaagcauuugcuucaaaguuuaugcauauuuggaacuuuucagcaaaguauuauucugugauguaagaaaugucuuuguaacagaacuuuggaucuuuuucucuuuaguauggaccuguguuuagcuuuaccauggugggcaagaccuucacuuaccuucuggggagugaugcagcugcgcugcucuucaauaguaaaaacgaagaccugaaugcagaagaagucuacggucggcugacaacaccuguguuugggaagggaguugcauaugaugugccaaaugcaguagguggcucuucuguccuggacaaaagucaaaucuaaacuacaguaguuccaacuaguuguguaauguuauacauguguaaugaagaauuaauuuauucccuagcuuaagaaaucugacaauuugugacacuuggaaagaaaccauggguuuguuuuauauugguuggcaaggcuuguucauaucuuauucauucacguguuaugaauagaauauagaugaggcagcagacucaagugccuggugaacuccgguaagggccauaauagacauagcccacacuguguuaagggucaauaucaguguuucuggggucgggagagguuggggaggugaaugucucccuuuacauucaaaggcaauagcuaucaaaaaguuuuguuuagacucaucucuauuaucuuaaacauguuuuaaucgacuuaaaauguuaugucucagagggcaguuaguuagcagacaaguuuuuauucaugcuguucuagacuucuagaagauggugucagugaugauggcauuuagcucuagaaugagaagaaaaggaggaggauaagauaacaguggaguagaguggacuuugggaaguguguugacuggauugcuuuggaggguugggagauagcaggagaggaaggugggucccugagugguggaguauuaggaggcaguaggugggguucccuccuccagggggagagcccuucuuaaauguguucuuucaaauacauggccuggaugccauauaugcuuaguucauaaaaauccuguuacuguuuuuauuuuuaaauuuaagaaaauuguuuccucuguuaugcaguaaggauaacaugauauacuucagaaugaaauaaaaguguccuuuaguguuauaaacacucaguauuuuuuguuuguuuguuuugaagauuuucuuggaacagaagaaaaucauaaaaaguggccuuaacauagcccacuuuaagcaguauguuccuaucauugaaaaagaagcaaaggaauacuuucaaaguuggggagaaagcggagaaagaaguaaguaaaaugcguuacauuugucucauucuuucugucuauguacagaacaaaauacaguaggugcggaagggccacgucucuaaugagaagggggugcugacuacugugcagugguaauggccaacccugccuuuacagagcacuucuaaguauugucuucagagagcaauuggcaugucuguaccagcagcaguaucugcuucuaggccaguacgaucucaggcagcagguugccaccuucccaggcuggccaucagccccuguagaagguguagacaaacacccacagcugauguaacuaauguguuuacuagucucaaaagaagcugaugcaugcauuagcacaccuaguaauuaacuuacuugugaagggcuugccgaguaguuagggaacuuccugcauccugggcuuacaggcaugaucuuaccuagauugacaaauaacugaggcacaugccuggaauucuagcacuugggaauuggaggcagaaggauuacagguucaaggacagccugugcuacgaagcacaacccacaucaagccacgagucuaaagcaaaacugugaagcgccaagaggaccagggugcuuuccaggugggaagcccgaugugacaguagagccagagagcaccauccagugggccuacccgcugcugucuccagugcuggugugcaauggugguuauaguacacacagacugaugaguuuaugccucugguuuuugggaccugcuauauauauucccacuccuuucaucacaauuuccuuauguuccagaaaaaaaaaacaauuaaaagcuuuuuggagagaguguugagacugaucuuuuccuccucuuagauguguuugaagcacugucugagcucauaauuuugacagcuagccauuguuuacauggaaaggaaauuagaagucaacucaacgagaagguggcucagcuguacgcagaccuggauggagguuuuacccacgcugccuggcuauugccagcuuggcugccucugccaaguuucagguauguauggauaaggaccacguugcagucacuggacugucugugugcuuccuaauuugggcacaucaggagcuuccauuuuaugagaauucaggccugguuuucuuuauuuacugagcucauuccuuuuuuucuuuauuuuuuauuagguauuuuccucauuuacauuuccaaugcuaucccaaaagucccccacacccuccccccccccccccacuccccuacccacccucucccacuucuuggccauggcuuucuccuguacugaagcaucuaaaguuugcaagaccaaugggccucucuuaccaaugacagccgacuaggccaucuuaugauucauaugcagcuaaagacacaagcuccuggguacugauuaguucauauugguguuccaccuauaggguugcagaucccuuuagcuccuuggguacuuucucuagcuccuccauuggggacccugugauucaucuaauagcugacucugagcauccacuucuguguuugcuaggccucggcguagccucacaagagacagcuauaucuggguccuuucagcaaagucuugcuaauguaugcaauggugucagcguuuggaggcugauuaugggauggauccccggguauggcagucucaaagacgguccauccuuuugucucagcuccaaacuuugucucuguaacucguucgauggguauuuuguucacaauucuaagaaggggcaaaguguccacacuuuugucuucguucuucuugaguuucauguguuucgcaaauugugucuuguaucuuggguauucuaaguuucugggcuaauauccacuuaucagugaguacauaucaugugaguucuuuugugauugggucaccucacucaggaugaugcccuccagguccaaccauuugccuaggaauuucauaaauucaucccuuuuaauaucugaguagugcuccauugucuaaauguaucacauuuucuguauccauuccucuguugcgggacaccuggauucuuuccagcuucuggcuauuauaaauaaggcugcuaugaacauaguggagcaugugucuuucuuacuaguuggaacaucuucuggauauaugcccaggagagguauuguaggauccuccgguaguacuauguccaauuuucugaggaaccgccagacugauuuccagagugguuguacaagcuugcaauccgaccaacaauggaggaguguuccucuuucuccacauccucgccagcaucugcugucaccugaacuuuugaucuuagccauucuuacugaugugaaauggaaucucaggguuguuuugauuugcauuucccugaugauuaaggaugcugaacauuuuuucaggugcuucucagccauuccauauuccucaggugagaauucuuuguuuagcucugagccccauuuuuuaaugggguuauuugauuuucuggaguccaccuucuugagguucuuuauauauauuggauauuauuccccuaucugauuuaggauagguaaagauccuuucccaaucuguugguggccuuuuugucuuauugacggugucuuuugccuuacagaagcuuugcaauuuuaugaggucccauuugucaguucuugcucuuaacagcacaagccauugcuguucuauucaggaguuuuuccccugugcccauaucuucgagguuuucccccacuuucuacucuauaaguuucagugucugguuuuaugugauccacuuagauuugaccuuaguacaaggagauaggaauggaucaauucgaauucuucuacaugauaacugccaguugugccagcaucauuuguugaaaauguugucuuuuuucccacuggaugguuuuagcucccuugucaaagaucaagugaccauaggugugugguugcauuucugggucuucaauucuauuucauuggucuacuugucugucgcuauaccaguaccaugcaguuuuuaucacaauugcucuguaguacagcuuuagcucaggcauggugauuccaccagaaauucuuuuauccuugagaagagauuuugcuauccuagguuuuuuguuauuccaaaugaauuugcagaaugcccuuucuaauucauuaaagaauugaguuggaauuuugauggggcuugcauuaaaucuauagauugcuuuuggcaagauagccauuuuuacuauauugauccugccaauccaugaucaugggagaucuuuccaucuucugagaucuucuuuaauuucuuucuucaaagacuugaaguucuuaucauacagaucuuucacuaccuuaguuagagucacaccaagguauuuuauauuauuugugacuauugagaaggguguuguuucccuaauuucuuucucagccauuuuauccuuuguguagagaaaggucauugacuuguuugaguuaauuuuauauccagcuacuucauugaaccuguuuaucagguuuaagaguucucugauggaauuuuuagggucacuuauauauacugucauaucaucugcaaaaagugauauuuugacuucuuccuuuccaauuuguauucccuuggucuccuuuuguugucgaauugcucuggcuaggacuucaaguacaauguugaauagguagggagaaagugggcagccuugucuagucccugauuuuagugggauuacuuccagcuucucaccauuuacuuugauguuggcuacugguuuguuguagauugcuuuuaucauguuuagguaugggccuuaaauuccugauauuuccaagacuuuuaucaugaauggcuguuggauuuugucaaaugcuuuuucugcaucuaacaagaugaucaugugguuuuugucuuugaguuuguuuauauaauggauuacguugauagauuuccguauauuaaaccaucccugcaucccuggaauaaaaccuacucggucaggauggaugauugcuuuaauguguucuuggauucgguuagcgagaauuguauugaggauuuuugcaucuauauucauaagggaaauuggucugaaguucucuaucuuuguugggucuuucugugguuuagguaucagaguaauuguggcuucauagaaugaguuggauagaguaccuucugcuucuauuuuguggaacaguugaugaauaacuggaauuagaucuucuuugaaugucugguagaacuuugcacuaaacccauuugguccugggcuuuuuuugguugggagacuauuaaugacugcuucuauuucuuuaggagauauaggacuguuuaaaucauuaaccugauccugauuuaacuuuaguaccuggaauuucuuuucugguccauucuacuuggaguucuguaggcuucuuguauguucaugggcaucuuuucuuuagguuugggaaguuuucuuuuaucauuuuguugaagauauuugccggcccuuuaaguugaaaaucuucauucucaucuacuccuauuauccguagguuuggucuucucauuguguccuguauuuccuggauguuuugaguuaggaucuuuuugcauuuuccauuuucuuugauuguuguguagauguucucuauggaaucuucugcaccugagauucuuccaucucuuguauucuguugcugauguucgcaucuaugguuccagauuucuuuccuaggguuucuaucuccagcguugccucacuuuggguuuucuuuauugugucuacuucccuuuuuaggucuaguaugguuuuguucauuuccaucaccuguuuggauguguuuuccuguuuuucuuuaaggacuuguaacucuuuagcaguguucuccuguauuucuuuaagugaguuauuaaaguccuucuugauguccucuaucaucaucaugagauaugcuuuuaaauccgguucuagcuuuucaguguguugaggugcccaggacugggcaaggugggagugcugcguuaugaugauggcaaguggucuucguuucugcuaguaagauucuuacauuugccuuucgccaucuggcauucucuggaguuaguuguuauaguugucucugguuaguguuuguucuucucgugauucuguuagccuuuaucagcagaccugggagacuagcucucuccugaguuucaguggucagagcacuauguacaggcaagcccuccucuuguagggaaggugcccagauaucuggcauuaggaccugccuucuggcagaaguugcguuccacucaccagagguccuaagaucgaguugagaauccucuagggaccuuagggguguccuccaacuccgcacccaaagugaccuggugcuggcgccaaccagaagguacuugugacccuggucaggccaaguuuucugcuucccuaauuaaugcugucucaggucucucaugauuggauuggaacagaaguuguguuccacucucagagguccuaagaucgcguggagaguccucuagggaccuuggcaguguccaccaacucugcgcccaaggugaccuggugcuggcacugacuggaagggacuugugacccuggucaggcuggagcucauuucaaguagguuugagugauaaguuaguucauggucucagugagaaguuugguuucuuuaaaaacacagaaaaauuuuaaguuuuccuuuuaaucccugcugugggaucuggggcugcuucacagcagcugacugacuugccucaugcucuagaaggggcaugguuuugacagcuucagauaguuucugcgaaugugugaugcuuggaauucuggggacuucucagaggauauauaaauguuagagcuccaguagaaugggcugguugguguuuggaugcucuugauugcuguuggaugcuguugguugcacuuugucaaauauuugugccaaagagacagaaagaagauauuagauaugcagacagcaaagaucaaauuugccccuauucagcaggauguagucuauuuucauugcccccuuuccccucuaucuuuuuuucucucuucccuaguauuaagagguugaaagagucaagggagaggggaggagaaguaucaaagagaaaagaccccacaacguagccuaaagucaggcaacaguggucuauuguaguauuuugcuugucuaauauaaucuugguauuccaagaagucucuaaucuguaauuagagauacgggguuaucaaagcauucauuugaaagucuuccaaggcuuuuuuuauuuuuuaguaccuauacugugaugugaccuuucuuguuaacauuucuuuagauuuuauuuuuauuagauuuucuuuauuuacauuucaaguguuauccccuuuccugguucccccuccaaaaacccccuaucccguucccugcccugcuucuaugaggguguuccccaacucacccacccacuuguacuucccuguccuagaguuccccuacacaggggcaucuagacuucaaaggaccaagggccucuccucucauugauguccgacaaggcuauccucuguuacauaugucccuccauuuguacucuuugguuugugguuuggugccugggagcucaggguggcgggggggggggguguucugcuugguugguauuguuguucuuccuauggggcugaaaaccccuucagcuccuucaguccuuucucuagcucauccauuggggacuccaugaucaguucaaugauuggcugccagaauccaccucuguauuugucaggcacuuauaaagccucucacaagacagcuauaucaggcuccugucagcaagcucuuguuggcauccacaauagugucuggauuugguaacuguauaugggauggauucucaagugaggcagucucuggauggccuuuccuucagucucugcucuacacuuugucucuguuaucuccucccauguguauuuuguucccucuucuaagaaggacugaaguauccacacuuuggucuuccuucuucuugagcuucauguggucuaugaauuguaucuuggguauuccaaacuuuugagcuaauaucuacuuauccgugacuacauaccaugaguguucuuuugugacuggguuaccucacucagggugauaucuucuaguuccauccauuuaccuaagaauuucauaaauucauuauuuuuaauagcugaguauuacuccauuguauaaauguaccacauuuucuauauccauucuguugaaggacaucuggguucuuuccacuuuccacuucuggcuauuauaaauaaggcugcuaugaacauaguggagaauguguccuuguuauauguuggagcaucuuuuggauauaugcccaggagugauauacccggguuuuccgguaguacuauguccaauuuucugaggaccugcaaacugauuuccagagugguuguaccagcuugcaaucccaccagcaauggaggcguguucauuaacagugugagccacauaugacaggacacuaugaauugucugaguucaugacuucuuucuuuccuaguucugaguuuuugucacuucacucauugaggugaauuguuguuuuauguuugguguugguuuugaaccuauaaaauauuacucuauugaaaauucccugguuuugaauuauaggcgcagggauagagcccaucgagagaucaagaauauuuucuauaaggccauccagaagcgcaggcugucaaaagaaccagcugaggacauucuucaaacuuuacuagauucuacauacaaguaagaacugucagaccccgugcuaagcuaaagcaagaaacccuauguuaaaauguagauuacugauauuuccaguuaaaauuuaaaggcagugcaacaauaaauuggaacuuguaaauuguugcagcauaaagcacugggcccugaugcucugcugugggggauauuugcaagucaccuggaaggcagucuuuuguaaucagucaugcuuucuccugguuggucucuuucuuaggaggagagccgguaccgaaugguguugguuaagaaaaguggcaauuaugucuagaaacuguguuucuauuaacugugucugcccagauguuaagugugugguucaucuccagggacgggcguccucuaacagaugaggagauaucagggaugcucaucggacugcugcuggcuggacagcacacauccuccaccaccagugccuggaugggcuucuuucuggccaaagauaaaccacuucaagaaaaaugcuacuuagaacagaaagcaguguguggcgaggaucugccuccuuuaacuuacgaccagguuuguuucucgggcacagcuggaggcuucugcucauucugucuucucauucugucuucaaguuuguuuuuagaauuucuacaagcuuagauaaaagaaagagcugauggcuccugcuucucuacaguuggucgggugguucuguacugaguacagaacagugguucucacagcucgaggcccuuguugcuucggagcuugacuuguaggucuggcuucuguacauggagaguaucuucuaaguguuguguuuugugaaguggaggagccgcuauaauauggaauucugaguucuguguccucaagugguaguaaugguaguauagacaugagacugauguaugcuccacacagcuugcuagaguugucuaaccaggcagcuacuucugaagcauacccuggucuuauccuuugcuuugauacuuuauuaaaaugguguguuauauucagauaccuuauaccccugggauaacacacauguguguguguguguguguggcgggggggggggguguuacucaauuuuguuugcuaaacaugaucauacauauuuacauauauauauauauauauauauauauauauauauauauauauauauaauaaaggacauguaucuauacuauuaucuaggcgacuuugagugguaauaugccaacugucucaagaauuaagucagaccuccuuccucaccaaugaccuuaguaccuucagagggccagcccuuaaugaccacccauuauuagucucuuaaaagugucccacuacuucuugccaucacuguaugaaacuucgggaaacaccuuuuuuuuuuccuuuugaggcgguuuuacuguguaaaaaaaaagcucuuggcuacuguagaaguuaguauauagaccaggcuggucucaaacucacaugcuaccuguauuggcuuccugagugccaguggcuagggaacauauuaaugauauccaaauuauaacaguaggguaaaguucaauccauguuagagcaugggucaguauuuccaucugucaccaauaauauucuacagcauggacauacugcauguuacccauucauucuucuuaguuuuuuagacauuugaauuaacuuuaugaucucauaaaaauaccauuuuaaauauuugucccaauuuugugacauuuguuuuucaauuuuauggaauacgugccuaaggagugggauugcugucucauacagcagcuucgcauuugauguauugaacugcuaaacauuagcuccauccuacccucauccaugguauuggcaugguucugggguauaugugugcuuguuaucucuuuuggcuguaaugcauucgagggcaucuuuuggacgggugugguguuucccugguggcugaguguuucaugauguuuuuucaguagagugucuguuccgauccugucccuuuauaauauagacugccuuuuacuguccugagcauucauguguaucuucaaaaggugggaagacuuagccucucuucuuaguuuccuccuuugggguguuugauuuguuuuuaauuaauuuugaauauaauacaaggugauagaccauuguaccugucuugcauguagauauccauuuaucccaguacuguuggaaagacuauuguuuucccacaaacauguuugugggaaacgguuugucaaaaaucuauuggccauaaauuuacggcuuuaugucuugacucugaauuccauuccaucaagcugcuguuuagcuuacguguuagcuguguucccuuuuauaacuuuugaguguuagaguguggcucuaaucuuuucaagacuguuuuaaauauuucugguuccuucaauuuucauaaaaauuuuagggucagcuugucaaguuuugcugcugcaacgcuacugacugcgcucugugcaaauuagcuuggaaguauugccagacauacacccugaccacggcaucagggcagagcuuuucuuaaccuuugcucuuuucauuucuuccaacacuuuauuuauugauugauugauugauugauuguuacuuuucugugaaaagguuuacaccauuuuuuguuaaggaacuuuccuauuuauugugugugguguguguaccuaugugccaugguacacagguagcaguuagacaacacagaggaggugcugcuuucugccauguggguucgggggguugaacucaggucaucaaauggcagcaucaauuggcagcaaaugcuguuuccugcugagccaucuugccagcccuuaguauucuuuuuacauugauucucaugccaguuuaaaccugcuauugcuucucuagugagaauuuuauuuauaucuuccagcuccaggauucuaauccuuuuaauaaucuauauucuccaucuggugagauauugucauauuguuucauauguuaauucuuugaauucuuuaauucauuuucauuuuagucuuugaaggucuuuguacuagucuguuuaaauugaccuaguaaguccaaaguucaguguguguccuuauuggaggguguagucauuguuacccauucccuucugggggcuccaugaugccaguuccacaaacccgggagcugcauggcuggcccccgagggcacuggauagcugcugugcuucuaggagagggagggucgacagaaagguggccagcaggaagaauggacaugucccacaugcuuucaagugccugugacugcugugcuguuggcgacuucuguucucucuuuuuguuacugaauugaaaugcccuguaaggagcuaauugcuuuagcuuuaaaaaaaaaaaaagucccauucagggacaguucccuugagcuuccuuucauucaggggccguuccguugaguuccauugaguuccauugaguuccguugaguuccguugagcuuccuuuugugcuguguaugagcuauaguucucauuuuucuuuuuuguaaauuuucuaauauuuuuguugaacuugcuacauugaacaucagcggcagcucuggaaaugagaucucuugcccuugggauuuauuguggcugcagguguuuguaagugugugugugacuuuguaugcucagugacuuucauaaacaggguuauaugaaguccauauccauucguagucacugaccucuaguuauuucgguggccaccaaaugauuagagacaucuuaaauugcuuguuugaucuuguuuaaagacaccuucucaguguguuacucuggcuggccuagaacucacuguguagaccuguagggcuuugaacucauggugaucugccucuuauagaaaauucucuauaagagauaauauagauauuucucuuucuuuuuguuaugguuguuguuguuuuaauacaaagucucaguguagcccaggcugccucagccucccacgugugggagggaggugcacuauaccaggccguuguugguauaucugcucuggccucucccacgugugggagggaggugcacuauaccaggcuguucuugguacaucuacucuggccucucagcaguagucaggcugcuggaguugccgugccuuugcuuucccagcucucguugaucugcaguggugugaguuacauccuaaagcuugcuuuucucaccaagaugcagcauuucuucuugaguggacucuugguacauuacuguaagccuucgucuaauuuaucaguuuugaaaaaauugacacagguuuuucauggugucaaguuuugaaaggaugaauuguauugguccuuaacuauaccauugacccucuuccuguugucuuggcccauucuuuuccuuuguugucaaugacagugauaaaacauggccuucccagcaccaugaaccagguccugcugcccuuuucucucacaugaaguaggaaaugagagacuauucccuccugcuguugaggucuggugaauauuuguugagggcaaaacgagaaauaaccgugaccuuuuuucuugguuuuaguugaaggaucugaauuuacuugauagaugcauaaaagaaacacuaagacugaggccuccaauaaugaccaugaugagaauggccaagaccccucaggugagucucuugcagagauuuauuucugcuucuggagcccaguuucagaaagaaugcuuuaaguuauuaaaguaaaagccaucaccgcuguaaauauaugacaguuauuauauaauuauagaauauuaaacaugaaaaucuaaugcuaauuauguuuuucauuuucauuuaacaauugcaguguuuaaaaguuagagguaccuauccccuucaaugccugaaauccuuccuccuauucuuguacaaguccccaagauccauccacuguuuggcugugggugucugcaucaucuccuagguggagccucucagaggacagccaugauagacuccugucugcaagccuaacagagucagucauuaaacagggucaacuaaccuggacccuuggggcucacagaggaccugggccucccugcacauguguagcagaggugcagcuuggucuucauguggguccugaacaacuggagugugggccauccuaagagcuauugcugggcugccucgucuggccuuacagagacuugaagugcuacgguugggggcuacccagggguccccacccgcacagaggagaaggggagggaggaugggggaggauggugggaacgggugaucaggagauaggcagugagcaggauguaaagugaauuaaguaaaagaaaagaaacacgcaaggcuccucuucucccgcauugacuuaagagcaucaucuccaagcuccaugggaaagugccugcccacagcuuguuagcuugaagucuccuccauagugugagaggagaauguuacaaccugcccugggcuuguauguacaaauuggcuuuagaaucuuuucaucuuuguuuaaaaaaaaaauuagagguauauuucuuggcuuuaaacacaaggugguaguuaguaaaauuuacaugaauuauauuauaaaucaaauuauaaaagauuuaauucuacucugccuuuagcaggcuuuaguucuaguugcacuguuggcccacuuguaaaucacuaagugaagacuuuuuagucgguuuaccaucuagacaguuuuuaaauguauguauagcucacagugacacugauugaugccuuauuguuugguagugaagcauucucuaauagaauguguucuuucuuacuucgcagacgguggcaggguacaccauuccuccaggacaucaggugugugucucuccuacugucaaucaaagacugaaagacuccugggcagagcgcuuggacuuuaauccugaccgcuacuuacaggauaacccagcaucaggagagaaguuugccuaugugccauuuggagcuggugagaugguugacugcauuuuaaguugaaguguuguuugccucuguaauguaucucuccuucauuaacugcccuggaauucaguucccagagagaggggguggggagggagagagggagggagggagggagagagagagagagagagagagagagagagagagagagagagagagagagagagagagaaaggaaagagagaagaaagagaaaaucuuuguccucuaaggaacauacuugcacuuuuuuuggggaaugcaaucuuugagaaauggaauaguuuguaagucucaggguaaauuuuuguauaaugcuccauugcccacagaccuacauccuuuuauuacuucuaaacauacuaaggccuugaacuucagaccauuguuuaauuaaauacacuuagaacauacaaaagauuguagauuaauaacuaaaagggccauuagcucaacaguugagauccugucacaaccagggaggagucgcagcuaaacuggugacugccuccgcuggcuuucugguacugguccguuccugugucuuacacagcagcucuuucccuuucuggacagcuuugaguauuauauccuuuuaacauccugccaaagauggucuugaucagucuuggcuuuucuucaucuccaucucucguuaguccuuuagaguuccuauagcucgggugccugaaaacaagccugccugucucuugcaguuucgagaggcugccugucugaaaccaagcaguaggcagggccaugcuccuucugaaggcuuugaagacuuuucccuacuuguggaaguuccuggcugcaucuccccucagucagugcucucuuuccuuguuacuuaucuauguauaauauauucuauguauaaauaauucuuacuuuacaugacuuucuaagucaucagacuauaucaauucuuuugauucagcuagggcacuuuuaguucaugacuauuaacucuaauguuuuccuuucagccagacuucccuuguauauggaccaauguaaauggcucccacagauaaaugcuuaaugagcuauaaaagcauagugauaagccauguuugauuuuuuuuucuuuaucaaaaauuauuuacaacaaaaugcccgucuuuuuucuuuuuuuucccauuuuuuacuagauaucuucuuuauuuauauuucaaauuuuauucccuuuccucauuuccccuccgaaaauuccccuaucccauccuccaucccgcuccucacuaagccacccauucccgcuucccuguccaggcauuccucuacacugcggaauccagccuucacaaaaccaagggccucgccucucacugaugucccacaaggccaucggcugaagccuugaguaccuccuuguguacucuuugguugaugauuuacucccugggagcucuggggguacugguugguucauauuauuguuccuccuauggggcugcaaacccuuucagcuccuuggguccuuucucuagcucauccauuggggacccugugcucaguccaauggaugacugugagcauccacuucuguauuugucaggcacuggcagagccucucaggagacagcuauaucaggcuccugucagcaagcacuuguuggcauccacaguagugucuggguuuggugauuguauaugggaugaauccccagguggggcagucucuggaugaccuuuccuucaguuucugcuccagacuuugucucuguaccuccuccauggguauuuuguuccccauucuaagaaggacugaagcauccacauuucauguggucugugaauucuaucuuggguauucugaacuucuaggcuaauauccacuuaucagggaguguauaccaugaguguucuuuugugacuggguuaccucacucaggaugauauauucuaguuccauccauuugccucagaacuucaugaauucaucauuuuaaauagcugaguaguacuccauuguguaaauguaccccauuuucuguauccauuccucuguugagggacaucuggguucuuugcagcuucuggcuauuauaaauaaggaagcuaugaacauaguggagcauguguccuuguuacauguugaagcaucuucuggguauaugcccaggagugguguagcuggucuuuuucuguuucuuuucuuuuuuuuuuucucucucuccuucauuccuuccuucaucuuuguuuuuguuuugagacaggaucucacuguguaacuuuagauggcuuggagcucaacaugcagaccaggcuggcuucuaauuuacggagauuagccugccugugcuuccugagugcuggcauuaaaggcaugcaccaccacacugggucagcccaauguuccuugcccagccucaugucauguaguuuccugaccuuuacuaagcaucagugacuuuagcugugcuucuuuggaauucucgaggauggugugugagagagaugaacuuugugguucucagaaucucccuaccaucaccuuugagugucuagcuaucucagcacuuucuugcucuaaguaccuuuguugagaaccugguaaaccaucggauuauuugguuuuuugcuacccagaucgccaucagauuauuucugggcucaguguugucucucugguuucuuuguugauccuugcccacugguuccugcaucuuuagucacauagucagguuugaaaccaaucuaaauucuucagaauccaugcugaagguugcucuggccuugcaucccugugcauuugaggauccgucagcuucuguguuuguagauuuugauuucaguacaaacauuauuuuggguuuauuaaauucccuuccauuaaugauuaaugggccucuggaauuuugacugacagguucacagugauauaagagaccuuuggaccuauaucucacacuuucccaagcuagaaucccgugucaugauuugaaccuucuaaaaauagcauccuagucacccauguuauccucuaacacuggacauaccuggacuuuuaaauaauuuagauucucaccuuaugugcaggcgucaccuuuuauacuguuacagauuuccuucauuuaagaugaguacuguuccaggcugaaagaaggaaugaagauuuuaaaacuuauucugaugaaaauuuauuuuaaaacagggcgucaucguuguguuggagaaaauuuugccuauguucaaauuaagacaauuuggucgacuaugcuucguuuauaugaauuugaccucaucaauggauauuuucccacugugaauuauacaacaaugauccacaccccagaaaacccaguaauccguuacaaacgacgaucaaaaugagaagaggaacaagaagccaguguggagagaggaccgcaagccgcagcuggcaaagaaugaagccucugagaagcucucgugcuguacuggguugaagagugugguucugagagccaguuuaugauuuuaauguuuuauuaacucggugauuuuugucagaccgaauggcauuugaaacaguuuauaguaguuuugauaggauuucagggaagccaaguuuauguuagaaaucauuugggggggugugucuuggaauuaagaagauauagaaugcagcauccagguaauuaacuccacacauugccacagggagauuuggaacugguguuugaaguuucaaagccuugucaaaugcuacaaagguaauggggucguguaguugggccacuucugugcguaaagauaugaaaggauaaagguuaaguuuacugcgaagcuugagguggaaguaaacgcuacuuagauggugugguguguccuuugaaauguuaacuggagcaccgcuccuggaagauggcagcgaucuugaaccuugccuugauaaccuuaauuccuaaaaguaauaaaaucuaaagagugcuuauguauguuacuggucccaaauggucacaguuuugugaaaaauccaaaaucaaauccuuguaagacuuuuuuauuuuaauuuggcuuaagguuuuuuguuguuguugggaaguuuaaauuuaccaggcuuuuaaaagugucugauuuugagauuagugaguucuggccuugagacuggggaaugggagaugguaucauugcccguauucugugcucaggagacaaccuaacagauuguaaccacggacccaacucugugacaugcccuuaaucuguguuaggaguaagaauagcucuguugcuggaguggugcugcacaccuguaaugcuguuauucaggaccugcggcaggauugagaauuugaggccaaccuaggcuacggagcaagacuaacacacuccccaaaauaaaaccucuuuucucuaaaaguauguguacuggcuggucuuaggcacuugacacaagcuagggucaucagagagaaaaggaagccucaguugaggaaaugccuccaugagauccagcuguaaggcauuuucuuaauaagugaucaaugggagaggcuccagcccacuguggugguuccaucccuacgcuagugauccuaugaaaggcugaccgugacaugaggagcaaaacaguaagcagcacucauuuauggccucugcaucagcuccugccuccagguuccugaccugcuugaguuccuguccucacuugaugauaaacagugauauggaaguguaagccaaauaacccaccuucacccucgggauuugcuuuuuggucaugguguuuccuuguagcaagaggaacugaaacuccguuacaguuuuaagaggcuuuugaagacucccagugaaggccuaaaucucugcuguuaaaggcuccacauuaaaauucucugagaaaguuuuacugguuuguauucaugaauuugaacuugugcuucaguaaguacaguucaugaaaucugggcauauggaagcuuacauccuauuugccugaaauagguuccuuuuaguauuaucuuugguuauuuagguaagucacucuuguuaucaaugccccaugagaaaucagguauuuucauaacaaguuacaaaaguugcucaccucucaaaagugugcuugucucuuacugagugguuguuagacuuuuaggucauagauguuacauuugacguguuagguuaaaaccuugauuaaaguuugaagacuguuuguuucuaaguaacagauuuucuuugccaguguagauguuuuguguuuauuauuccuagagggguucuagacuuugaucaagucccuccuuuuacugugugguuguuaagacuuuuaagucauagacguguuagguuaaaaccuugauuaaaguuugaugauuguuucuaaguaacagauuuucuuugccaauguagauguuuugucuuuauuauuccuagagggguucuagacuuugaucagauugguagauuccuggcagaguugugacuugaguaaggcuguccuguuuacugucuaguuuuagacuuugacauauuuucagugcugagauuuaaaagggcucaagcacuagaauuccagauugagauacugaccacagacgagcuauuaaguuauugugaacaacacagcagaggcugagggccauaggguguuaguaggguagacuagcaguaggguagauuggcuggcaagcaccuguccaucugccuuuucccgacugaacugucuugacuuggcaacuguauuaguuuuuuaaagaguuuaaugcacaacuuuccugcucaacuaguugcuuuagaauaguuuugauauuuuuagaaagccuaguugaaauuugggaaauaaaauuagaaauuccca

SEQ ID NO: 2339 - RNA, 4662 nt, Mus musculus
cccgacucucaagucaggggcacgcaaucagaacgcagcacucaaaguagcagucugugaccagagagucgaggguaggauuauaaaauaugaagacagauaaaaagcaagacagagcuaaauccccgcggccagccgacuccuauucauuaucuccugccgcauaugggaccauucucuuacuuguccucgcccuuucuucugcaaaagcaaaagcgaccuagccuguccggcuucauagcuacucuuugugccggagcggagucucugccaccgccaccacuacuuccuccaccuccuccggucugcugcgggcuccaguccgggcucggagggaaagggcucccuuugcgcugugaagcgggugcugcgauugggcgacggucccugagccgccagcuccgcgucgguuucaaggcuccucccucccggugaaagacagacuggggggcgccuagaaacccguuggagggcgcgcgagggagagcagaggcugcgaguugagggauugacacaaauggucaggcggcggcggagaaggaggaggcggaggcgcaggggggacccagggcggcuaggcugccgagaguugggcgcuccucugcccggcugcgaccacuaacgcggcgccgccugacaagagccacagccugccgcgggccagggaagagggacgcgaccccggcgcgccuggaccacucuugcucuccucgccgcccgcgcuucaugaaccgcaaguuuccgcggcggcggcggcggcugcgggacgcggagcagaaucccggggagcgggcagagagcggccgcaccccgacggagggcacgggcgaccagcucucccggaucacagugggagccaccacccgccgcgccgcugcccgucccagucaauccgcgccgaggagggagccgaaaaaguauggcugaggaggcggcgccuagcgagucccgggccgccggccggcugagcuuggaacuuugugccgaagcacucccgggccggcgggaggagguggggcacgaggacacggccagccaccgccgcccccgggcugauccccggcguugggcuagcgggcugcugcugcugcuuugguugcuggaggcuccucugcuuuuggggguccgagcgcaggcggcgggccagguauccgggccgggccagcaagccccgccgccgccccagccccagcagagcgggcagcaguacaacggcgaacggggcaucuccaucccggaccacggcuacugccagcccaucuccaucccgcugugcacggacaucgcguacaaccagaccaucaugcccaaccugcugggccacacgaaucaggaggacgccggucuggaggugcaccaguucuacccucuggugaaggugcagugcuccgccgagcucaaguucuuccugugcuccauguacgcgccugugugcaccguacuggagcaggcgcuaccgcccugccgcucccugugcgagcgcgcacgccagggcugcgaggcgcucaugaacaaguucggcuuccaguggccagacacacucaagugcgagaaguucccggugcacggcgcaggagagcugugcgugggccagaacacguccgacaaaggcaccccaacucccuccuugcuaccagaguucuggaccaguaauccgcagcacggcggcggugguuaccgcggcggcuacccggggggugccgggacgguggagcggggaaaguucuccugcccgcgcgcccucagggugcccuccuaccucaacuaccacuuucugggggagaaggacugcggcgcacccugcgaacccaccaagguuuacgggcucauguacuucgggccagaggagcugcgcuucucgcgcaccuggauaggcaucugguccgugcugugcugcgccuccacgcucuucacggugcucacguaccuaguggacaugcggcgcuucagcuacccggaacggcccaucauuuuccuguccggcuguuacacagcgguggcgguggccuacaucgcuggcuuucuguuggaggaccggguggugugcaacgacaaguuugcagaggacggggcgcgcacgguggcgcagggcacuaagaaagaaggcugcacuauacucuuuaugaugcucuacuucuucagcauggccagcuccaucuggugggugauccugucccucaccugguuccuggcagccggcaugaaguggggccacgaagccaucgaggccaacucacaguauuuccauuuagccgccugggcugugccagccaucaaaacuauaaccaucuuggcguugggccagguggauggcgacguacugagcggaguguguuuuguggggcucaacaacguggacgcacugcguggcuuugugcuggcgccucucuucguuuaucuguucauuggcacuucuuuccugcuggccgguuucgugucacucuuccgcauccgcaccaucaugaagcaugacggcaccaagacagagaagcuggagaagcucauggugcgcaucggagucuucaguguccucuacacugugccggccaccaucgucaucgccugcuacuucuaugaacaggccuuucgggaccagugggagcgcagcuggguggcccagagcugcaagaguuaugccaucccuugcccucaccuccagggagguggaggagucccaccacacccgcccaugagcccagacuuuacagucuucaugaucaaguaucucaugacgcugauugugggcaucacaucgggcuucuggaucugguccggcaagacacugaauuccuggaggaaguucuacacgaggcuuaccaacagcaaacagggggagacuaccgucugaaacccagacucuuaccuuacccuuuuuuggccugauccuagccaucgccuggaagcuggccccaaggaauuccugccaagccuggccacuccaggcuuccucgccagccacugacuuuugcaggccccuuucccaacaaacagcacagguucugcaaaagcuuccgucccugggguaaaggaacgagagggcccaacugaucgagguguauguguaugugcguguggaccgaucucucuagcccucucugauaccaggauuguacgcuuuuaugauuguaaauagccuguguaagauuuuuguacguauauuuguauuuaaagacuaucgaacacgcaguuuuuuuuucuuuuuaaaaauguuuaauuauuuagggcaauuuacguauuuggagcuuuucucacuugcccuuuucugcagauugcagaggagguaaaacagagcacacuugacuaagugcuuugcccugugcccucaucuuugucaagggagcaugggccugccucuccagggucauuuccuucagcaucucccgccccuccccuuccuugcuugcagugggaaauuuuaaggugcagaacucuguaaagcuuccagaucccgaggugggccccgcccauuccagauccuccccuuuucagcgguagaguguggauggcugucccugugacuuccugaugcugcuuauuugagauccaccuuccagcuuuauuagaggaccccaguaugggcucugccaguugacccagccucccuguaccccggugucccuugcccagugucuuucuccuugcaccuaaguuguucagagggagugcaguaaccgaccgauagcgaacuuuggagagucugacuuuuuauggaugagcucauuuuuacucucuaguaucuggaacuugcucugggucuggucaucaucauggaaagagcagcaagcuuuguggguugggagaggcuaaagagagagguuauaaaacauuaguucuaauugcauucugaugucuggcaaccuacuuucuucccccugugaugcugccugcuucuagauuuuacccuucuaugaaaugcagaccucgagguugccugggaagcuuggugaaggaaugguuuaccuuccuuaacaggauaguagaacauacacagaguauggaaaccuaaggagauuucagugaaguggaguuacuccaagugaaacgcuguuuucugguuuuagccaaacugcaauuagaugugucuuugcaaucuaaaaguuguacacaaucaacaauacacuuugcuuacuccucagcagcacauucugagggagaaacagucacacccccgcagaaagccugguuggacuuccgaagacagaggcgguggacugacggaugggugagagagacaaacacgaccuaggcaugcaugcugaaggggaaguguguccauuccuacugcaucccaucuugugugcuccugucuggauuuacggcagugugucaaauguaaaucucucaaagccauuuaaaaauacucacuuuaguuauggaugaagaagaggagaaaagcaguccuccugauuguaguguuuaaaccuuaagaguuuaucacaaaugccgauacauacauaggaccuaaauuuaucuaugucugucauacccuaaaaugacauugguuuuuggauuugguaugcauuauuauuguuauuauuguuauuauuauucucaccaccaugagaucaucuauauuuauagaggaauagaaguuuauauauauaaaaugccauauuuuuaauuucgcaaauaaaaaaaugaaaguuuuguacaaaauuacau

SEQ ID NO: 2340 - RNA, 23069 nt, Mus musculus
caguagugacgucaguacgcgcgcccgaccgaaguuuguccggauucugcgggcgggaguccugccccuuggagcucauggugcgcugcgguugcgcuuuguugagaaagguucgugacgggggucuccccagcuuuggugucuucgccgcucuccuccuggguugucguuccucgguucccgucuccugggagaagauugugucucagugacacgcugauggccguuugggguccagcuuuagggaauuccuguauuguucccaaagcacgugagaggauaauuggggaccugccugcgguuuagacccggcauugcggugcacgugccggcuuguuuguuuguuugguuugguucucauuguuuaaaagagaguccauaaccugcuuuuauacauuucuccuccuuuacacugcuuuugauaucuuucugaagacuuuucuggaagucagaauguguguuugcugugccucauauagagauuuuacgucaauuuuuauguagugccugucuuaaaauccacuuuuauaacaaucugcaaccaaccgcucaauuaaaaaagaaucucagugagcuuaacuggcaacggugugugaaagcuagaggucauguacauaagcuguuguuaggaacagccauuauaaaugagaguccuuaauaaauaugacaaaucuagaaaauaaagaaaaagucacauacugaacacagcuuuaaaagcccuuaccaggaauaucucaggguggucaaccuucaguuuguuuuuguuuuuuuuuaaacccacagauuuuuuugauacccaaaaguacugcagauuaccaaaaacgugaauauuaauuuaaacgauugcucuguaauuugaaagccugggauuaugacacacuggcuuuauaagaaguuaccuaccuagugagggaaacuaaauggaaaguaccagaggauauaauccaguguccgaggaagccugaaaagccagucagugagagugaugggccaaggaggccucagaucauacaaccauaagccauaguuuaguuguauuugaggauacauugaaacugacaccagaaaauggguuuaugauagaaagaacaaaugauaaucuaaacagaggagaaagcaugaauagaguggcagggagagugggcagcucagaaaagaacaggaaggcuccaacaaaugacagcugucccggugagauccggugagggcuuugaauccagcacuguaaacuuuauuauuucagaagcaguaaaaacccaaagucacgacuguuucugaguaaagagagacauagacaucggguucacuuaagggggaaagagaugcucuuggcucaugguggcggaugcauuaagaaggaaugaugagacccugaaagaccauuuggaguucacagucaagauucuaagaggacagagguccuggaaaggaguuaggcuucuuggaaugcaaaaauuuuggggaaaagccaucuguuuguucagucuuggugagcagauaagcuuugauaauuaacugaggggacagcuuuuugcuguugcugcugaugaugauuuuaaaauauuugggggcucagugguuaagagcacuaacugcucuugaguucaaggucuugaguucaaaucccagcaaccacaugguggcucacaaccaucugugaugagaucugacgcccucuucugguguguuugaagacagcuacaguguacuuauauauaaaaacauuuuguuuuggagggaacccaaaacaaaauuugaguggguacccaccagguuacuuauuuaaaggguuucaaauguaagugaaaggcacuucugcuuucaguuguuuuaaacuauuaauagcuuaacuuuucccggggauuggaggugggggcggggagaguuacuaguacccacugaggucagguuuggaaugaaaacaggggaaagggcagaaaccuuggggcuggguggaacaauugaucguugaggaagagagugggaaacgaaguaaugugagaaagggguacacagugcuaugcacacagcuuugauucuuuccugaacgaagccucaguagaaugaaauuagaaccuuuuaaguuaaaagaauaugugauguauauauauccucucuuucucucauuuucuuaaguauggaaauuucauugauaaccugagaaucuucaccaagggaggaagcgguggaauggguuacccucguuuagguggagaagguggaagagguggugacgucuggguuguggcccauaaaaauaugaccuuaaaacaacuuaaaaacaaauauccucagaaacgguuuguggccggaggaggagcaaacagucgguaagugccuaugggauggaugggugcucugagcuucguggaagucagacgcuucuggggaaaccagaauguagaacuuuacugauaaccaaguuacuuucuguuuucucaucaagcaaaagucuaacaugaaugacuauuuuggcgguuuugaccuuuguccauuuauucucccugugucccuuuuguauuucuuucuggaaauagauauuaauugaaucccuacuuuguuccaaacuuaccuugggcaaaauuuuaauaaugccccagcauuccccaccauggaaagccuuucucauuuauaauucuuccacccagauauaaccacuauuugcuuugacuugacuuuucuaauacagugugguuuuacaaauguaauuauauguuuguguauaagguccagcauaaagaaauaagauaacagagcaacaguaucuuacaaugcucuuuucauaccuaaaauuauucagaaaggcggguauuacaguaucagaguuaauauuuuaucacuuggcaaagcaguuuagacuaauguugguacuguccuuuuuuucuugccauagccacaauguuuuaaugauauccuauguagaugcucuuacauauuuaauuucuugauaaauuccuacaaguggaguuacuguuagaagauuauaacaacuuauuuuaauguaagcaacguuaaaguagccaauuagccucuuccaacuuaaguacuccaguuauggucagcuuuuuagaaaauugauacucauuagacuuguugggucucugcacuuuguauuguagaaaucaucuuuggauuucagauguauaauauauuaguucauuucagguugaaaugacuuaguguuaacuuaguaacaacuuauuaacaucuuuauaggacauguuaguauaaaaugugaaaaaauaggaauaaucuuuucuucuuaguauuuaaccuuuuaauaucuauuuuagugagaaggccugacuguuauguagcccuuacuuagcccuauuuacuguuacuguaaauaauuugauuuagugguguuuucuuuuguuuuguagaguuagcgcacugcagggcuccaagggaaaggacugugaagugccugcuccuguggguaucucaguaacugaugaaaacggccaagugcuaggugaggcucuggcuucucugucugugaaagaugagcauauuuuccaaaguuaaugcaggaaauagcaaacgagcucccuaacuugugaggaaaauguucuucaauauuaaaauuauaucauuuguuuugugcauugggagaccacacacauggaggucggaugacaauucacaagaaucaguucucuccccauccuguggguucuguggauaaacucaggucaucaagguugguggcagguaccuccacacacagccauuucucagaagaaagguuuuuaacauuuauaacuuuagcuauuggcuuauuaaaguuuuuuuuaauguauauaaacuguauucaacuuacugcuagauuuaagauggcuuuaaagaggugaggauacuuacuugguuuuaaaacauauaaucagcuuccuuuuaacuauguacaaaaguauuuuuucugggguauuuauuugccuuguguccaugauagacaaacacuuuaccuccaaggcagcccuagagaguugcucuuaaaaguguguuguuuuguuuuuguuuuguuuuguuuuaagaaauuuaauguuauaguuuagcccuuuagaguuuuaaauuggaauuucuugauauauuuaugcaacaaaacaaaacauauuauugguuuuauuuaguaguguuuguugucuuuccucuuaaaggagaacucaauaaagaagaagacagaguucugguugcuaaagguggccuugguggcaaauuacauacaaauuucuuaccuuugaaaggucagaagcgcauaguucaccuugaccuaaaagucauagcugauguaggccuaguagggugaguaucauuuauauucuuauaauauguccaucaguucaagacuacaaaauaaauguaaauaauaauuuugggcaguaaacauuccuaguuuacauaauuuguguauuaguacuuugugcuaaaaauauaguugaccguuaaaaauuuaagaguuaaggcacaaauuucaucacuauauuccuacaauaaaaagucuuaaaauugcuuuucuuuuuuucuuucuuccuuucuuccuucccuuccuccuuucguccgccucuccccuugcuugcuugcuugcuugcuuccuucuuggaucccuauguugcuccuguugguuuggaaacuccauacaguucuggccagcucauggaccugcugcugcagccucucgugcugguuuggugguuuuaaagagaacaguccucauaggugcguguauuugaaugcuugguccucaguugguggaacuguucaagaaggauuaggagauaaggcucuguuggaggaggugugucauugggcagccagcuuuuaagguuucaaaaggccauaccauuccuaguuaguucucuuugccucauguaaacucucagauacuccuacgggcugccugcugccaugcugccugccaugauggccauagacggccagucccaaggaauggugccacccacuuucagcauaugucuuucccuaucagccagcacaaucaagacagucccuaacagacuuccccacaggccaacguaauguagauaaucccucacugagacucuucucagcugacucuagauugugucagguugacaguuaaagguaaacaucacagucaccaugccugcaccuguauauaacuggauucccagaaaacuuaacuacuaauagccucuuacugaccucugaauucuuaguuugugguauuugcaugucacaugcuaugugaacuagauguaguaaaaauugcauacauucauuauccauuuuauaauuguauuguguguguguguguguguguguguguauuagucuguacuggagagcugaguugguuauuaaaagcauuugauguucuuacagaggaccuggguuaguuaguacuucccagacccucaugguugcucaauucauguucauuuauuugcaggaaauuauuuuucccuauuuauuuggcccauucaucauuuggugacuaguuguuuaaucuuuaugaguuuguguauuuacuagaaauuuguuugcuaugcauuuuaaauucauucauucauuuguucuuuggcuuuucaagacagggucucucuguguaacagcccuggcuguccuggacuugcuuuauauagaccaggcuagccucagucuuacaguaaucugccugccucuguuucccuagugcugggaucaaaggcacaugcuacuaugccuguccaaauuuuuuuuuuuuuuguacuuguuuuuuuuuuuucccauuuuuuauuagguauuuagcucauuuacauuuccaaugcuauaccaaaggucccccauacccacccacccccaauccccuacccacccacucccccuuuuuggcccuggcguuccccuguacuggggcauauaaaguuugcguguccaaugggccucucuuuccagugauagccgacuaggccaucuuuugauacauaugcagcuagagucaagagcuccgggguacugguuaguucauaauguuguuccgccuauaggguugcagaucccuuuagcuccuuggguacuuucucuagcuccuccauugggagcccugugauccauccauuagcugacugugagcauccacuucuguguuugcuaggccccggcauagucucgccuguccaaauuuuaaauguuauugcuuuaugaccaccuagaauacaaagaguuauuucagucucuuuggauuaguaaagauuuguuuugugucaagggauguggaauguuuuagaaaagcugugugcugcugaguaaaaugaacauuccuugguguuugaaugaaacacucagugaauaucuguuaaguccauuugaugcgugaugcgaauuaacucucauguuucuguuuaauguuuguccagaugaccuguagagagaaugggauauugagcucaucucguauuaauggauugguaucaaucugugucuucaaacccaguaguacauauuuuaugaaauuggguuccccggcgccuggugcaugcguauuuaggauaagagaugcgucuugguuagcucuuccccugaucagaaugaagugccacuuuucaucucuucugacuggguuuacguugaagucuauuuugucaggcaguaggcucgugacuccugcuugccuccuggucccguuugacugggguacguuuguccguccuuucagucugugcaguccuugucuuuaaagguaaggcgugucuccgguaagcuauggaaagauggcgaucaucucuucauccgcucaccuguguguguuggugaagaacuaagggcagugauaucuaaagccauuacugaaauguguguguccgguggucucugugugguugguuggcgcuuguuguguccucagugguguuucaugguuucguauuuccuucacagucucucugcugugcucauuccucucaucagccucuaguauuacuuccuguauuuauucucuuuaggcucaguuuguuggauguaauuuuaaaggcuguuuguaucauagaaagugucucuuuauccuucaauuaugacacacaguuuugcugggacuguaagucuuuuaggacuuggaaugcauagcuccaggcucuucuggccuucaguuuccacugagacaccaacuauuauucugaugaguuuuucuuuacguguggcuuguguuuuucucuugcagcuuucaauaugcuuucuuuguucuguacacuuaguguuuuauuguuguaaccaugauaugccauggagauuuccuuuucuggccuuguuuauuuguguucuguuucuuauauuucuauggccguaucuuuucuuaaucuggcaaaguuuuccucuauuaucuuauugaagcucuagccuaugccacugauuugggauucucuucccuuaucaauaucuacaguuuuuuaugaugucccacauuugcuguguuccuuuccucuguguguguguuuuaguuuuucuaucucuugccuauuuuguuuaauuccucaacguuaucuuccacuccugagucuucccucuguuugauucagucuacuuuaaaggcuuuccuuucagcuugcaggacccagggaguccuggauuggcaugagugucgguucccucagcuugauguuuguguugccucaggcgucacgcagaucuuuauuccccuuaaguucuuucuucuuaauuucacugagcuguuuguauuuucuuuaaacucaguugaauucuuugauaaaguuuaugguuguucuuuuaaauucuguguccuggaguucaccuacauaauucucauugguaaacauuucuaaaggacuagguuucagagagaagauacuggccugaucauuuuguaucguugauauguuugcaaugaaaucuacguauauggacuuuguugguuugggcauguggacuuugcuggugcuaagucugacauagacagagccgguugggguaaaaaagaggacugggccugaagacuggaaauggcuugagugaaauagagucagucaaaugaggagaguggacuggggcaguauacaagaugugccuuuugaugccuggauuaggggucgggggagcaggaguagauaggccuagaugggagaguuggagccagcaugggaaguugucaguugggagugggggagcaugucagaugacugcagaggagcacagacuagccugggccacugaguaugugacccaaacuacuguggcuggcuggggagaaggcaugaaugaggaagucagugaaaccaggcuuagaccuggagaaggaaggucuggcuguauagagaaguuagauaaaucacagaaggaaccugugggggguagcauguaggacagaucauuagaauacacuuuuuaaguaauccuuauuuuuaauuccuaugcuuaauguuuauauuuaauacuuaauacaagauggucccuuaagggaaauauaucaguaaagucaaaagccuuuaaagugaucacauauuuuaaacccauguuuacccauauagauauuuauuaaaauaaagagauuaaagauacaaagauuuaagauaaucaccauacuuacuaccuuuuguuuuucauuuuuuacuuuauguguggguguuuuuccuucagguauaucuguaccacuuguaugcuugauacccucagaagccagaagaaggcaucagacccccugggauugggaucauacauaauuuauauuuauuauuacaguuuuugcagaaaggaaaaaaaaagaacaauuuaacuauucuaccacuccaaauaucagugaaaaguaucuaucucucuaguuaugcacauauuuuuaucacauuuacuuguguuuguguauaugucuguggguaugcaguugccacagcacauguacagaaucagaauauuuuucaggaguuggcuuucuuccuuccccauguagaucugagggaucaaacacaaguguaaggcuuuacucacugagccaucucaauggcuucuccaaggcuuuuauauacauauuuuuccaaaguuauuuaucauugcaacaaauuagaagcaauaugaaugucauuagaaagcuggcuggauaaauuguguauuaaucauugaaaaguuguucuuaauaucauguaguuuaaaaaagaucaguaaauuaugaaauauucuucaaaagaaaucaaggcauauuuuauaagucaagcuucucuagcggaacaaaacuuauaaaauccagggcaaaggacuauguuaaaugaugcuaucuaucuauguacauggcaccagaaaagucuaaacuguacaaaagaagcucugugggacaaaugacccaguuucuuuaaaaauaaauugcaaaagagaagcaaaauggaagguaagcauauaugaaaaagagauuucagagacuuuccagcuaauuauaguuccaaugcuuuauuucaauuuguauccaaacaaccggauuuuuuaaaugggagaccccugaacuaaaacugaccagaaugcuuccucccugagggcuaguuuccauggaaacagaaaguacaauguaugcucccaaaggaggaaggcaacccagucucauccagcugugagacucaugagccuaucaauaaccggcaugacaucaugacccuaagggugcaauaauggcacauacacauuggcagcaaccaacagguuucuaacuggacuuaagacaaacucagcauguugacacuugggaggcagagguggguggaucucuaugaguuccaagacagccaaggcuacacagugagacccugucuuagggguuggggcagugggaggaaauaccauguaugguacuagaaaccuagcuaacuacuaucuguaugaaaacauaaauacaacaaauauuauauggauugagcauuauauuugguaauauguguaagcacacacacaugcaugcaauaacaaugaaauaagagacuaugaauuugaaagagaauuggggggagcaaaagcaaggaagaaaggucuuaaguuguauuauaaucucaaaagaaaaaggaaaaauuaaauaaaaacgguauugguaauauaguaauaguaauugaagcuaggugauuagcacaguaauuauuucucuauuuuugucuguguuuguaauguucaguuaaauaauguuuugucaguguuuggcuaaagauagugaauugcagggcuaaaagagcuggcucaucagugaggagcacuggcuguucuuccaggggaucugaguuaaauucucagcauccagaugguuacccaucacugucugcaacucccagggucuccaguucccucuucuguccucagcaggcaccagacacacauguggguggugcauaggcauacaagcaaaacucucauacacagaaagacaaauuaagauaaaagagagugaguuacaaggucuugagcuuuaagacuuauuuuuaauuauguguauacacaugugucuguaugggguggauccaguggcuauggagguuugaccugucagaucccuugaagcuggaauuacuacagcacuaguggguugagaauggacucugccucugcagaagcuguguagucucuucuuaacccuucagccauucucuccagcccugaauuuuuauuuguuuaccuaaauuuaaaaaaagagguacuuuacucucuuaaaucuuaaauccauacauuuacuuuauucauaaguauauuuuuuucucaaguauuccaaaauuauuuuagucuuacaaucuuguggagagagacuaaagaauugacuccuaugcuucuugaauauagagugcauauucuaguacugcagcguaaucccuggauucuagucauaguuccagaaauacucgagacaucaacauuugggaggggaaggguuugaaggcugaggcaagcaaaucucugaguuugaagucagucuggucuacagaguuccaggacagccagggcuacacagagaacccuguguuggaaacaaaacaagaggaguguucucuagguagcuuggugguccugaaacucuguagacuggcuggucuugaaccucccucugccgcccaagcgcugggauuaaaggugugugccaucaccaucuggcaagaaauccacuucuugucagaacaaaguccaagaauggagucgauugagaauucugagugcuugugagaaaacuccaagaaaacaugagucuugugaccccaguuucuuugaaacaaagaauuguucuuggaauguguuuucaugcuccuuccagguguagcggauaggagugaguuuucuucagcuguuguuacucacaugccucuauggaaaaacauguguuugaaacaugugacauagucuugugguugaacaccuugcucaugugauucuuuuuaucccccaaguagaaauuuccugaugcuuugaauaaaauuggcuauugauugagacuuuaguccaccuuauuuuuagccccugaucucccagguucacaucaccaacuagagucguaaacacuugaaacauacaacuaauucuguuaguuguuauaaugcacauauaucauguauuucagauucccaaaugcuggaaaauccuccuuacugagucggguuucccaugcuacaccugugauugcagauuaugcguguaaguaucaaugguguauuuuaaugugugagguaaguuuucuuugcauaagacuaauacaagucugaguuuagcuuuaauuugaaagcuuucggcaguuagaauccaugcauuucuuuuuaaccuuucagaccacuacaguccucacaaaagucucuuguccuugucaggaacaucacugcauuucuuucacaguugcacaucacuuccuugguuacuauaggauuuuaacgcuacuuagcauguguuauacauuaugauaaaaacugggaagacagagauaaacauuuuuacuaauuuuauaaggaauuuuuuucuaggaaccauauuaggcuaugccgcuaguaaaacugguaagcaauguugugagauuacuuauuacagacuagggagaaaggaaugugugugugugcacaucacugauaaauauaggggaaggaaaguguuaaagagcaaaaguaacugcuauagguagaccuuccugaggaacugugcuugggcagagauacgcacaauaauuaugauuaaucagagcuuuagacuagagauaacagaucuuuaagucaugaaaagagccuauacacagcucagcucaguaguuacaggaaauguguuugucuagagaaugugucggagggaggaagugagauuaaaaucugaucaaauuccauagacuacauggguggucuuucaucuuacuaagcaucuuaaacauaagacuguggaagggauaaaacaggcuucccaacguucucagccuauacuauagagacuggcugguacaaagcacuaaggaaucuggaaagaguaguuaggaugcuagugcaguagcucgaugagaugcagugaaagauugcgcuaaagggauugggugacagugauacaguauuugcuauuauuaaacaaaaccccacagaauggcagucaaguugacaagccagauuagccuugauagaaggaaagacaaaagguccuaggagagggcuaguauagaaauggaaggcauaagaauagcucagaugagaacuuuaccggguucugugugguggcuuaguagguaaagguacuugcugcuaagccggaccauucagcuuuacaugugguagaaggagagaacugaguccuguagguauucucugaccuccacaugcauaccacuccaugcacaaguccuucccccacauaaauaaauacauacauaaagguaaugaauucuucaaaagagaaguuuuaccgcagaaccagugaucgugaucagaaccuaaauucugagcccuaaacauucucaagcugcccuggccaugcaauaggacuucaggccaaagcacacgagucucugucuuucuaaaguacagugcgaaugacggagagaacuaacuguagggcccauuucaacaaauuaaaaugggauuaaacauucagcaaauacauauuauuuaaccuguauauaauacugacuuuuuuuucuagaaaguguagucuuuuauuccuuccuuaauuuacugccacuucuccuuucaguuacaacacuaaggccugaacucggaaagauuauguacaaugauuucaaacagguugguagaguuuuaaauugaaauacagaugguuuuguuuuggauuuuucuuuuuuuuuuuuuuaaagaacuuuuaaaaguauuucuuguuuaugaauauguauacguguaugucuuuguaugaagucaguugggugucagagucacuggagcuggaguuacaugcagguuuaagcuaucugauggugugcucgguauugaacuuagauucagucaagaaaacauaggcucuuauccacugcgcuaucucucaccugguaguaggacuugaauauuuacaugugacuauggccuugaaggaaaaacagagggguggugguuguugcugcugcugcuguuguuacuguuguuguuguuugauacguaaaacuaugaacaaaguaauucugcucaacauuguauaguaaaacaagaauuuaauuucuucuccuuccuaguguuaugcucacuucaucucuccagaauuauaucuuuauuauauguucccuagucgguaucuucucaguauauguccuuuuuuuacuaccccagugaauuguuaaucuccaguucuuaagaugacuuucuauagaaacuauaguacuucugugagaacugguuaauuccaaguuucuaauucugaaaaggaggaaggcaggcaguucauuguuguuuucuuuauauucuucuuaagaaagaucuauaguugcuuuauauacacagagaagccugcacaucaauguuucuagcaacuuuauucaaaauuacuagaacuuggaaauaaucaagauucuuaguaugugaauggauuaacuguuauaucuagagaacagaauagucaguuuuaaaaauuaauggauuaugaagccauaaaaagauaagaucuugaauacauaucgcucauggaagaagccaaaagacuaucuucucccagugucaacuguuaguacucuaguaaaggcaaacuauggcaaaaaaaaaaaacccaaaaggucaauuuugucaagauaaagagaaaugaggcaugcguagaggaagcccaggugauucuuaggauagaguccugaugcaucauucauuugucaaaacuuucaaaauauacaagaucagggaugaacucuguguaaaguguggcacuuaaaugguacuggauauuauagaguauuaaauguuaaauauacuuauacaguauauaguguauguugaacauaaagaccaauauuuagaagaaaagaacauuauuuauaccuaauguuuaagggagaucaauagagauuucugaaggagauuuuaggauaugagacccuugcugugcacacaccucugucauauagcgacagccuccuuucagacucaggaucccguucaacaugggggacagugcuucuccuuccuuacuggaucucaagucuucccgguggcuagggacuacaguggcaaaugauaccuggucuucagagacuucaaacuaaugucuuauggauugccuggcuauuuguuuguaauagauuuccucucggugaucccgaugacacagcaggugucuggugcacagcaaggcuugaaaaguguaaagugacuguuaauaauuaucacccauaggaggcuuaugggacacugcauugucucacuguguaagaauagacacucauccugcuggcauaucaugagcauauaugagcaauggugccauuuacaguuggaauguaaaacagaauauauaugaguguaucugcuaugugugaauguuaaugaauucugcuuauaaaaguuacaguuuuauaaaagaauucaugagcauacuacaggguuagaauuaaagacuaacagggcucggaaggagaggagcuuacaugccggaccucauggccugaguuuaaucccuggaucccacagauggcaagagaaaacugacuacugagaguuguccucuguccauaugcaaguucuaauucaugugcacacauucacacauauauacaugcuaguuaauuauuuacacuaacauuaguaacuguuaacuaaguacuaaacuaacccccaauaacuauaauuugguauacuaaugaguuaaaauaggaugcagauaucugauaacaaaagauuuuagcaaagaugucauagagugauuagaaacuauaugaaguuugaaaauuuggggaaaaauugaccuugauuuccguuuuuucuuucuuacuagauuucaguagcugaucucccagguuugauagaaggagcgcauaugaacaaaggcaugggccacaaguuccucaagcauuuagagagaaccagacaacugcuuuuuguuguaagucauaugucuaucagugauauucaaguggauuaauuuggcuuuccaaaaaacacuuuguaagauuaaagauaaugugucacaaaaucauguuucaucacuguugaaugcuguuccauaucuuauggugguaccaaagaucuuacaaccuggugaugccauagucaucuucgacauauggucacacugugaguucacacagugauagaaucauuggcugugucuucagaauggaguccugguauuaagcacuacaugacaguacgaguaacuauuacuccuguaugucuguugcaaugggcgaguacaguggaggaugcuuguuuauaauauagggaugcaaguccuguugcuguuguuuuguaugcacacuuggccagacuuaaccaaaacuuuaauuccuugagguuuuggcaugucuucuauagcaucucuuuucaaucuaguugguaugcuugagucaagcaugagauuaucaauauugguaucaguuaucuauucuaguuuuucaucaauggcugacuuucugguaaugcuuauaguuaucaugacagugcaguuuguuauuucauugaaugacugaauucccaauuaaauauagauugagaaauuauuccuuguugaaauuauugagagaaaacauuucuaagcacaaaacugaauaaccgauuuauguucuauguuuucuacuuagguugauauuucuggguuucagcuuucuucuguaacuccauauaggacugccuuugaaacuauaauacuucucacaaaaguaaguuuucugguucacuguguucuggauguaguccaccaaguaggcaugccacauaguaaugagaguaaccaccuuuguaaagauuuucugucaguugaaagauuaagguugcuguucccggucuucaguauucacccuucccuccaaccgugacgcuggcaacucccuccucugcuccacauccccucacucuuguaugccucugcccuggccucuuuccugaaacauuguccacuugggaacuuugcucugugggggguacugaugaccaaaccaugugcuacaccagcauucugccacggagcuguacucccacacuuuccuuaccauguaacaacuucgcugagagcgauugagcgagcuuaccguacugccauuguuucucauugcuuacaauuaaugugcccuugacugcucaaucuguaacucauaacccucuuuugcuugggcuuuagacuggauacuacuaggcaucugugacugaaugucauguuaaacacuaaaggaaggaggaggaaaaaacuggagccuuuucaguuuuaauucuguagcuaaucuccacuuuuaaguccauaugccuuuuccaagaacgccacagguauuaaguuguuauaaccagcguaugagucucaucccuguugacucugguuggcacuuggcucuaggcacaaaaucagcuguuucugggaaguccugugagcuaacauccuauucacugguuuagcaaaaagcauuguuaguuuuauaguuauugugauuuauugcguuguagugauaugaaugggcuguacaguuaccagguuauuaaagaaagaucgccguuaccuucauacuguuauuuguuuuuucuuguuauuuacaggaguuggaguuguacaaagaagaacuacagacaaaacccgcacucuuagcaauuaauaagauggacuugccggaugcccaaguuaaacuucaggaacugaugaagcagcuccugagcccugaagguaaagcggcuguccgcuuccaucuggugcgcagugcuggccgugcgcagagcaggucagggagcuuugguugcuuuuggugaggaguuaaguucuugagucaggguuuccuguagccuaggauggcuucaaguuuguuguuuaucuaaggaucaucuugaauuucugccucuaccucccaggugcuagaguuauaggcauauacuacuaugaccaaugguaguaaaaaucaaugggaaagaaaacuaguguuuucuaccuagaaacucuauuuuuaaagaaagaacacauaauguuugaugcacuagaauagcauugaccagucauuaucaggucucaaaacaaauuuguuaaguuagagaaagaaaagaaagacuaauguucaaaaaggucaaguuuuaaaaacaaaaaaaaacaaaaaaaaacuaaaacuaaacuguauaugaccuguaaagggugugagagggcccagagagaugcucaggcauugagagcacacacugaucuaauagaggaccagggccacucuccagcauucacaucaggugccucauagccaccucucaggaaaccccaugccuucuguggucacacacagcucugcacccugacacccacucauacauuuaacuaaagauaaaauauuuuauuuuguauuuucugauagucucguaauguagcucuggcuaucugaaaaucauuaugcagcccaggaugguauugaaaucauggcgauccaccugcucugcuccugggugcuggcauuaaaaccgugaaccaucgugaccagcuaaagauaaaguaaauguuuaaagagaaaaccaaaccaaaccacccaagauguguguaaaaggagagaagucagcagcguaacagcuucggucacggaaccuucaccagcccuagaucuuuguuucacugguacacacugcauuuuaacaaaccuaguaagguuuuacucuuguuuuuucuucuucuuguuuccuuuuuugagacuuuauguauguauggguuuuuguuugugugcaugucuguguaccgugugugugcccaguagaaggcaucagauuuucagggucuggaguuacagacagcuauuagcugccaugcuggaacagaaccuguucucuggaagagcagccaguguucuuaaccgcugagucagcucucccgcccccaaagcuaguaguuuuaaagagggauuuauuuuuacugauguuguuauuguuguuuuacuacuguuaacuugguaacucugaagaauaauaguccuuggaaaagaacauuuaguucuguguuuaugugacgcagaaaguaauauguguggcuaaugucugugacuaaaaggauaugucugaaauuucuuaaauggaaauauuuccacuguauaaagaaaccuagagggacugacuuagucacuauccuguugcuguaaagagacacccugacaaaggcaacucuuguaaaggcaagcauuugacugggggcuggcuuacaguuucagagucuuacauuaucaucaugauggggacauagcuucaugcauggcucuggagcaguagcugagagcugcauccugauuugcagacagagagaccgacagacacuuggcacaauaugggcuuuucaaaguauugaagcccagcuccagugacacacuuccuccaccaacaccuccuaauccuucuaauccuaucaaguagugcacuuccugaugacuaaggguucaaauauaugcgccuacaggggccauucuuauucaaaccaccacagggacucuucacaguguggcaaacugagugcuguagaacacuuuuauccuguggugauguguucuuuuagccuggagaagacgaccuccuggcaaguggccaugugcuuuugaagaauacugauuucauucuguuauuggaaagauaauugaggaaaacagacuuuaauauacuaagauuagcagacagcaccaacauuuuucuuuucuugaaaucauucuccuacauaauguacauguuaggacugucucuaauuuaguaaguuacuuuugggucauaaguauucccuaaaagucuucauucguuaauaucauuugccuuaucaggucaguaguucacuuugcuuaucgaucuugcagcuggugugaggagugaggguuagcucaaaaguguuuauguauucuggaccaccacaguucuugaguuuaucucucuggauuuucuuggagauuuauagcugagaagucaggaugauuucagucuacccauuuuauuguuuggcaguuggcccauccauucaguuugcuggccuccuccccagcugccuuagugugaggcagaagauaaggcuaggcaccauuguuauccccuacgugauuggcuagacaaugguaaacugaucugccugggagcaacucggccuccuacugcaauuuuuauuguggaugcuggccuccauuuaaauagugauaacacuaugccugaaagaaauuaaaacuuacaugcauauuaagguaagcuaaaauguuccacgugaugucauuguuuuuauagaaauauugccucauuuuauuuggccuccucaaguaauuuuucuuuuuccuuuaaguauugucaugacuuaccaguauuuauucuuuauuuuuuuaaaauaaauuuguccaacaguuauuuacuaaguacuuaccaugugcuacgagccaucauugucaguaaugaaacacagaucccaggagcaugugaggcagugcagacagggaaacaguaccagaugcuaaguugucagcuucauaguguugaauuaauuuuuuaaauuaauuuuuuuaaaggcaaugaaaaucaccuguucuuguuucagauuuucugcauuuauuugaaacaaagaugauuccagagaaggcucuagaguuccagcauaucguucccaucucaacagucacuggggaaggcauugcagaguugaagagcuguauaaggaaagcacuggaugaacaggauggcaaagaaagugaugcgcaucggagcaaacaguugcucaauuugcagaguuccaguugagcaucuuagacugagccacaucaaagugugcggcuacugucuccagaaaaggcagcauucaaaccuaguacagcguauugacgcaauacucuuucuucuaaggaucagaaaaucauguuuaaaacguggacgagccugaaaagcaugauguucaaagaagccaggcacgacagcaagacaaauaucaaugaucucacaugcggaaucuuagaaagacaaaucugaacugauagaaauccugaaaaaugauaauuuuguguaguauaaauaggagcuagaagauuaagagauguuggucaaaagauacaaaguuucaguuaagcuuuacagaucuguuauguaccuuguuuguagaauaauguaucauauuuaaaaauuuguaagaaaguaguuuuuaaguguucugaccacaauuuuugagaaaaauauauauuuuaaaauagauuugacucuguuuuaaaacaugcuguauaugauauagacacguguauaauuuuauaucaguuaaaaauaguauugaaauuacauuaauuugaaagcuuuuccacauuuuaaggauaguauuuaucgauauauguaucaucauucaggaaaauacauuuucaucuuccuuuccuucuucuggcuuuagcucagcaagaugguucacuuuuuugcauaacguguacagaagacccaggcuagcaagcacacagucuagcaaggcucuuguauuucauuccugauguggguacuaauuagguccuaucccuuuggugggagcuugaccucacagucugacuaauggauaacugggucaaagaguccucacuggcuaaccuacuuugauuuucaaguuucuuaaaauuaaccccuuuauuccauuauuuuucaaauuuagucaguuuauguuggccauuugaagucucuaggaagaauaaauuauauaaucagcggggaagcccaccuuccaagaagaaacagaauuuuuuuuccuuuaggugaaaugugaaauguacaugcuuacuucuaaaaaauacauccaagcagcacacaggagcaggaggcaacagaccuuagcuagagaaaguuacagucagcggcuuaagguuuuaugaaaauuuuacauuuuuuccacaaaugaguucacuguaauuuucuuucuuucuuuuuuuuuuucuuuuugcaaaguagcagcaaguuaaugagcuuuaaaaaauugcuuacuaagcgcgguagugugggccucugguggugugguaagcucugguaagcgugguggugugggccucucccacaccccuugggaaggagaagcuaggaguuuugaguaaaacacagccccuccugggugacauagcggguuguagguugcucuggauuucauaauggaaccagguuuaaaaauacugguuuuuaacaguauguguuuugauuauuguaugugguuuguuguuuuguccucaaguaagucugugugacugugugaaugaaguguccaugacagccagaagagggggucagauauccuggaacugaaauucucuacaguggaaagccaccaagcaagugucggaaaucagaaccagguccucugcaagagcagccaggguucuuaacuuccaagccuucuucuccagccccuuucuuuaauacuuuuuuaauuuguuaaaaauuauuuaauaauuuauuguuuaguaaaaguuaugguuauugaccccuuuuuaaaaauccuuuuuuuaauuauauguugauuguacuuaaauuucuucugacuuaauaauguguauaguuugauaaaauauuauuugaauuuuaaucuaguuucuguuccuaauguuuccuucucguucuagugcauggacuaguuuuucuuggaucucuuuuuucuucauuacaggggaauuuauugagcacugugcagggcucugugauacaaagaacagguagaacucuuauccugcuuguacugcacagcagaagcuguggggagcuggcauggccuacuucauaacaaagaagugaagcugaggaaaagcaugccgagcuuauacuggccagccuacaugauugaagcuggccuuguuagaugcuguauccuaucaguucccuuuucaaauguuuucuacccaccgacgaguagcagugaggacagcuucgugaggugaauucaagaguccgcacuuugaccugauuuugucuuagugcuggucuuaguuagguugucuuagguggguaucuuaguuaggguuucauugcugugaagaggccaugaccaagacaacucuuauaaaggacaacauuuacuuggagcuggcuuaaaaauucagaggaccaguccauuauugccaguguugggaaggaaagcaguaugcagacagauacggugcuggaagagcagagaguucuacaucuuaauuggaaggcagccagauggagacucuucuguggacagccaggaggggguguggggguagucucugcacuggguggagcuugagcauuggagauucaaagcccaccaccauggugacacacucccgacaaggacacaacuccuaauagugccauucccugggucacacauauccaaaccaccacuuuccacucucuggcccccauaggcuucuucaaauacaugagucaaacuaugggggccauaccuagccauaguguaauuuaaaauacauuuaguccaacuuccaaaguccaguaguuuaucaauaguaguaaucuuagcaauguuuaaaagugcaaagucucuucugagauucaugcaauuuuuuaacuaauccccug

SEQ ID NO: 2341 - RNA, 2144 nt, Mus musculus
auuuucuuuuuuuuuuuuuuuuuuuuuuuuuuuuuuggugccaauuuaaauaguuuuauuauuccauguuacuuguuuugggucccuguggaacaaagcuacaccuucuucuuggacugacuuaauccaccucuucaaugguggggccugaagaagcaccaccagaugggggagcuccuccaccugggaagccaccaggcauucccccaggcaugccaccugcacucugguacagcuugguaaugauaggguugcagacuuucuccaguucuuucugcugaugcucaaauucuuccuucucugcagucugguucuuauccagccagcugaugauuucauugcacuugucaagaaucuucuguuuguccucaucauugaucuugccuugaaguuucucaucuuccacaguugcuuucauguugaaggcauaggacuccagugaguucuuggaggaaaccuuaucucucugcuucucauccucagccuuguacuucucagcuucuuggaccaugcgcucaauaucuuccuuacucaagcggcccuugucauuggugauggugaucuuguucuccuuuccugugcucuuaucuacagcagaaacauugaggaugccauuggcaucaaugucaaaaguaaccucaaucugagggaccccacggggugcuggagggaugccugugagcucgaacuuuccaagcagguuguuguccuuggucauggcccuuucaccuucauacaccugaaugaguacaccaggcugguugucagaguagguggugaaagucugugucugcuugguggggauggugguauugcgcuugaugaggacagucaugacucugccagcaguuucaauaccaagggaaagaggagugacauccaagagcagcaaauccugaacguucucagacuugucuccagauagaauggcugccuggacagcugcaccauaggcaacagcuucaucgggguuaaugcucuuguucagcucuuuuccauugaagaagucuugcagaaguuucugaaucuuggggauucugguagaaccacccaccaagacaauaucauggaucugugacuuguccagcuuggcaucucgaagggccuucucuacaggguccagugugccacggaacaggucagcauucaacuccucaaaucgagcccggguaauggagguauagaagucaauucccucauagagagaaucaaucucaauacuggccugggugcuggaggagagggugcgcuuggcccgcucgcaggccgugcggagacggcggacagcucucuuguucucacugaugucuuucuugugcuuucgcuugaacucagcaaugaaaugauugaccauucgguugucaaaaucuucuccaccuaagugggugucuccagcuguugauuugaccucaaaaauuccauccucaauagugaggauugacacaucaaaagugccaccucccaagucaaaaaugagcacauuccuuucagcuccgaccuucuuaucuaagccauaagcaauagcagcagcaguugguucauugaugauucgaaguacauugaggccagcaauaguuccagcaucuuuuguugccugucgcugagagucauugaaguaagcgggcacugugaccacagcguugguaacagucuuuccgagguacgcuucugcaauuuccuucaucuuugucagaaccauggaggacacuuccucuggguagaaacuuuuugucuccccuuuguauuccacuuggaccuugggccugccugcaucauucaccaccaugaagggccagugcuucauaucagacugaacaacagcaucaucaaaccuacgcccgaucagacguuuggcaucaaaaacuguguuggugggguucauugcaaccugauucuuggccgcauccccaauuaaucucucuguguccgugaaagcaacauagcuugguguggugcgguuacccuggucauuggcaauaauuuccaccuuuccaugcuggaagacacccacacaggaguagguggugccgagaucaaugccaacugcaggucccuuagacaugguugcuugcguguaggcccagcugcgcugacgacgagaccacacgaaugcccggcagcugccucugcguucaaugagacca

SEQ ID NO: 2342 - RNA, 1296 nt, Mus musculus
ccagcaguuucaauaccaagggaaagaggagugacauccaagagcagcaaauccugaacguucucagacuugucuccagauagaauggcugccuggacagcugcaccauaggcaacagcuucaucgggguuaaugcucuuguucagcucuuuuccauugaagaagucuugcagaaguuucugaaucuuggggauucugguagaaccacccaccaagacaauaucauggaucugugacuuguccagcuuggcaucucgaagggccuucucuacaggguccagugugccacggaacaggucagcauucaacuccucaaaucgagcccggguaauggagguauagaagucaauucccucauagagagaaucaaucucaauacuggccugggugcuggaggagagggugcgcuuggcccgcucgcaggccgugcggagacggcggacagcucucuuguucucacugaugucuuucuugugcuuucgcuugaacucagcaaugaaaugauugaccauucgguugucaaaaucuucuccaccuaagugggugucuccagcuguugauuugaccucaaaaauuccauccucaauagugaggauugacacaucaaaagugccaccucccaagucaaaaaugagcacauuccuuucagcuccgaccuucuuaucuaagccauaagcaauagcagcagcaguugguucauugaugauucgaaguacauugaggccagcaauaguuccagcaucuuuuguugccugucgcugagagucauugaaguaagcgggcacugugaccacagcguugguaacagucuuuccgagguacgcuucugcaauuuccuucaucuuugucagaaccauggaggacacuuccucuggguagaaacuuuuugucuccccuuuguauuccacuuggaccuugggccugccugcaucauucaccaccaugaagggccagugcuucauaucagacugaacaacagcaucaucaaaccuacgcccgaucagacguuuggcaucaaaaacuguguuggugggguucauugcaaccugauucuuggccgcauccccaauuaaucucucuguguccgugaaagcaacauagcuugguguggugcgguuacccuggucauuggcaauaauuuccaccuuuccaugcuggaagacacccacacaggaguagguggugccgagaucaaugccaacugcaggucccuuagacaugguugcuugcguguaggcccagcugcgcugacgacgagaccacacgaaugcccggcagcugccucugcguucaaug

SEQ ID NO: 2343 - RNA, 4110 nt, Mus musculus
ggaggaaaggguuuauucggcuuacacuuccacauugcuguucaucaccaaggaagucaggacuggaacucaagcaagucagaaagcaggagcugaugcagagccauggagggauguuccuuacuggcuugccuccccuggcuugcucagccugcucucuuauagaaccaagacuaccagcccagagauggucccacccacaaggggccuuucucccuugaucacuaauugagaaaaugccccacagcuggaucucauggagucauuuccucaacugaaacuccucucucugugacaacuccagccugugucaaguugacacacaaaacgagccaguacaguuagugaaauaucaccuucacagaagacagacuucugugaaagauaugguggcuaaaaguccaucaugacuuugugucccagcuucucuuucugucuagaaugcaagacaaaauuaauuaaauuaaaauucaguuucauaacucaccacucuucuucauacagaagauagcuaucaauaaggcuaaaggauacaugagcaguaaguuauaauagguuaaugcuacuaauugcagaauucaaguuaguuucugcguuugacuuuucuccugacaauggacugucuuuuacagauugcuacggaagcaauugaaaacuuccgcacuguugucucuuugacucgggagcagaaguuugaaaccauguaugcccagagcuugcagauaccauacagguaagaugccuuaaagagugggccagggcucuaaggagauuuccaagcaggacuucaguuuuccggauugcuuuugccaaaggcagagugcacacgaagaaaguacuagaaggaacacuagagauuaccaagagauaaaugaagagaccugaguuuagucagaagcaucugugacuuaaaugcaugaaggcuggggacacauggggaggggagggaagagaacaacuguuaaugccucugguauccaguugggauaaugacucugcuauuugcuguauuggacauuacuguucucuauggaacaugaaauuagaggcauugugugauacaggaaggucuccugaggauauuuuuaguuccuuucuuuccuggguagaccuuuucuucucccuucaccccagcaguauccaugagggcuccaaagggugaccaggaaauuaacaaggucaaccaugagucccaguuucuccacuaggacaagggaagaacuggaccuuacuaaagugucuccaagcuccuuugucacagucauggcaggccccccuuucugggaaaaguuucuaaguggcaaagacaugaacaaaggugauguguuuaaacaggaguaggaaggucaaaagucugucccuguccccacccugucucugccuacaccuccacacccaagacccuugugguucagaaauuccuggaaugcuaauccuuuguagagccuucccuggcuccagacaggcaagugcuucuuucuucccacagcacaguccucaggaacucccuccacugcacugaucacaugcagcuccccuagguccucacaucaaggacaugcccgcugcccugucacccacagcuugagugugcuggguagauguguugggagguguccuacucuacagaucaccaguguugugugucccacaguguggaaaagggaauguaaaacaggcucuucucaggguuccaggccaguuaucuuccaucaacccacugagauguaauccuacauuaaagaugaagacagcacugagucucagagacgaggcaguuuccuaaauucacacagcuaauccaaaggggauccaccagcugaguuccuuagaacuggagugcacgguaucugucacgccugcgugccucacugacaagccacagcaagcugcuugaaugacugagcgauggacugaaucugcacugucuucuuuccagaaaugcgaugaagaaagcacacguguuugggaucacguucuccuucacccaggccaugauguauuuuucuuaugcugcuuguuuccgguucggugccuacuuggugacacaacaacucaugacuuuugaaaauguucuguuguaaguauuauguucacaugucuaauuuaacccugaaaguaaauugaggaugagaauuuguauggugaagugucauauagagcauuuaauaguuaagaaaguggcguuuuugcaucugaguguccauaugguaccaauaauauuccacacuucaucagaaacuuuucuaccucauaaguuauuugucugcugguaaaaaugagccaauuaaagccagauugaaguauacacaauagcagguuuauugggaagcuguucucuggugggcaaguucacuggccccaaucaaggaggccagagaaguugucauaggaagguagacagaggggagaauaaaguaaaagagagaaaaguacagaaaaggaaaaggggaggagagaagauguguguauguauguguguuuguguuugugugugugugugagugagagagagacagacagacagagacagagacacccagaaagagacagagagagaaugcaagcaaaauaucuggguuauaaagcaaagaacuucugggagaaggacagcccagacacugggcuggaaaguuaagggguagggcuggaguugggguaugcuagguagggacugagguauaaugggagaaccaggaagccaguucugcuuugguauuaaaauacauaccucagcuccuuguccccagagcccaaaaucaaacaccccagccuuuuguugauaauaaaugaauaaagauugucauaauugucuaugacuacuucaugcugacacccagguaugguucuggggguguaggcagaaaucuggaauguuggcccagucugggaagucuguuuguuucauugcugucuaucucgggcuaggaguaugcaggcacagguguagcagucugugaggcugggcuaaagcaucuguggguacaggcuuuggagcuguccuggaugcagguucugaggaaacauccagacuugucaggauucuggaaaagauauauauguuagggguagaagauaaaauuaaggagucuggggagcaaaacguuuuuccuauguguacauuugaaacuuuuaggcccauaguuuugguaguuggagaaugggggcauuccaggaccagggaaaggggaauagaucccacccucaggaacagaagugaggagggaaacaggcuguugauugacagcacucaccuguaguucauuugaccuggauuugaguggauucucugaagcuuacaagaaucuuauuaaguuuacaaaaagagaacuccuuugguacuugcauuuacuaaccucaaacaccuuccaucugaagcauuuuuaaaauuucucuuauauaccuuaaaucauguuccuaucaccagccaagguuuuuucccacguucucuaacuuucauaacuugaaguuaccaaccucaaacuccuuucuagauucucaaaugcuuucucauacucucaacccuuguauaaagucuacuuuuuccuaacuaaucauuuaccaugagacacaagugguugaucacgcagaguggucauuguaaaauggguuccuuaagacaaaguuacuucuuucaguaguuuagucuucaagcuccuuggagauuugagaaggauauauuauaaucuaaauggccuacguauuaauuaaaaugacagacuugcccaugaccuagacagccacucuacuagguuccuuugcuguggauggcuuaguuaaggacauagguccagggcaggaucagucuucggcugccauguccagcaaaucugagaggacuuccuguggaggaggaacuugggagacugaccuugcuuugucuuaaacaaugugaggcaugucagguauccuguuuguccacaguucaggcagggccauaggagcgggcaaggcaucggagcaguauuucucaauaguuaucauaccaugaucuagguggaguccuuucuuguugugucuguaucuccguggagaucuugauagagucggugcuaggauuugacaaucucugucuucuuaagcaucuuaaguuuaagcauccuaagugcc

SEQ ID NO: 2344 - RNA, 68217 nt, Mus musculus
gcggccgcuggcaucuauuuuaauccggggcccgaggaagcccucuggcuccuucccgcaguggcucuugaagccguaagaggcugaggccgcugcuuccaucuucugagguuccgcucaacucagagcuacuuccaaauucuacaucuuggcugacuuugcgaaggaaacccggagguggcacgugagguaggcaguucucggaagagugcggugcuccggaugccugaguccgguccgggugguagcguccucuugagucuguggggaccaaguggcgacagccacaagucgcuccaagagcacccgcagcagcagccuucaggacgguguuuuccgcgccagcccugugcuguggaucucgcugcccagcucgcagccgcgggcugguggaggagcgcgccagggcggaagggacccagcagggcgggguggcgggacccagagccgagcacccgguccacgcgggugacacagcuucccgggauuccccggggugaguuacccccaggcccggccccaggagcaucagggcggggcuccuccuccucucuuggcuccguggggcagugagcucugccuagguucugguccccgcggccacguguuuggcuaaugaacugguuucuccucagguggugauggaguuugaagagaaccuuaagggaagagcagacaagaacuucucgaagaugggcaaaaagagguagccaaauuauuucacguucgugcuuguacauucuggccaauuuguagccuccggcacuguuuuaaaugauuagugggcgugggcguuauuucagcccuuggaaggaacuccucugcuuggagcaguccuucagaugugugugacagauggaugcuucugugaauucagccucuacucacaucuuuuuaguuuuaugaccucggcuuuuuugagcgcuguugaucgcucaugccuugagccuuaugcugcuugggugcucacuguggcccauuaucuucugauaaacacguauacaaacacagaauguggcauaacaggugaaacagaacaauacaguuauaugguuuaagguugcuuaccuauacuuaaauuagaaaaauugaaacuguaauugcuaagagaaaauaguuacucucaauauauuuuuaucauaguggacugcgugucgccaguaauuaaaaacuuaccucaguggguucauuauauauagaaaauuguaaacuaagauaauaggaauuaguagcuauauuaauaguauucggaaacaagauuucaguauaaagagggaaaguacaaagugaaaguaaacuuuacauuuaauaaugugaaauuagaauaagaaacaucaguaugauuuuuuucagucacucauuuuuaguccacugaaaaggguaguacagaaagacacucuugaaguuuucuaguaaagaaagguacacggcauagaacaguuaacuucagccagaccuauugcagagaaaauacaaagugagccuggaguuuccaguacuaacaaacaaggaagcaggauuuaauggacuggucagaagacacaggaggaccagcaagauggucccaaaggccuccuuccaagacuggcaagccuaguuuugaauuccuuuuccagaacccaugugguagaaucagaaaccaacugcaagcuucaaguugaucuugaccugcacaggccguugccuugcuugucacgcuuguggaugcauccaaacacaauaaauaaaauacaaaaaaaaaaaaaaaaaaaaaaaaaaaaaaacaaaaaaaaaacaaaaaaaccccccaaaaccccacaaaccagacauaagagcaaucgagaaggguuugaacuucgaagaaaguaaaugcuauaagugauuucuagaagcauuacauuuaguggcccaccaauguucugagugcaaggaaacauaguaagagagaaauacaaagcauacaagagaggcuucguuacagaaaaaugcagcuaucacaccggaaagcacgccaccuguccaccggcgaggauaagcaaagggucugaaccauucagagaggaaaguacccuuuccugggagagaguuugcucugagcacuuucacagagggaucagaggcugucaagucacucagcacacagagggauuggggagacaagaguuucaucugaaggcagccgggcuucuggacuggugcuaagagagauaaauugugagacauauuugaaauuugaaauuccuuucugucaacacuaaaagguaaauaaaucaaguuuggaaaagcauugaguacaccaggcauaguaauuuucauauguaauaaaaauuaugaauaggaggacauucucuuccacucuaaauccauauuuuuauauuuaauauucauguccuauuuauguucagcucgaaacacauaugcccaacauguggaauguuuuaggagauaauugcuuagcauaauaucuuaacaaacuauguacacacacacacacacacauagacacacacacacacacacacacacacacacacacacacacacacgcaccuguguguacacaaggcuuguuuuguucuugagauagugccuugcuguggaguaauguggaugcuguccacaaacuuacuguguagccgaggcuggccugaacuuguaauuccuucuccucccuccucuguguccuaagagcuggaauuagcauguguacaccaacgcgccuaaguauauuguguacaaaaagcaagguaaagaaaacuaaugguuugguucuacaucuauccucaucuuguuauugguucuguugugauuacaaaguagagaaauuuccuuuuauguuuuguuuaguggcucuuauuaaaccacuaaauaaauugauuuuguuauuuaggguuuuuuuuuugugguucuaaaucuacucuaggaugguugccuggaugagcccugaagugcuuuuuaagcucuaguucugggagagagaauacacguugcuaccaguucuuacuccuaguagguaccacaaagcacccauggguucaaaauacagcgcuuuaaaagaccaacugauagucagucguguuguuauagaaugucccuaaauacacauuauagauagcaccucuucccuuuaguacuagggcccugugugugagagacguguucucuuacugaauuauaucucuagcucagugcgaggcaagugcuguaccacagagcuccaucucagaagccugcaucuccuaccucagcuugguggcccaguagcaggacuugggacaaguuaaagcuacucuucugcguggguuuuaucugucagaggcaaacaguaugcccuccucaaaguucuuaaugaguuacauguuuuuggcucaugccuggaacgucacaacuucuccuaaggagcucguagugucagagaaagagaaaguaaggaagaagcagagcugaagugguccagggcucucucuucccuugcauccuagcuccagggaugaugaagccuugccuuagacuaccagcacaggacuauccugaggcuguguauuuggguccauguugcacuauugcaaacuggauuuuuuucuccacuuacuguaugaacaaaauaugcuuuuaagcuucaaagucugggucaaaauaauguucuuucugaaauagucuuccauaugauuggcuugacacagcuagcucccuacccauauaggcaguuacauguggugacaaauguggguuaugagguagaguuauuugguuugcaacuuucaauaagaguugacauuuuuuggccuggcgugguggugcacaccuuuaauccuagcacucgagaggcagaggcaggcggauuucugaguucaaggccagccuggucuacaaagugagugccaggacagccagggcuacagagaaacccugucucgaaaaaccaaaaaaaaaaaaaaaaaaaaaaaaaaaaguugacauuuuuggauguaaggacagcuuuuugacaauuuauagaccuuuuuuuuucuauucacagauuuuuuuuucacauuucauacauguuuuuauucugacauuuauacaguaaaaaauaaauauaaauuaaaacaaugaauuuuaccagcaugcuuaaguuuuuuaaaaaucauuuacuaauuuauuuauuuauuuacuuauuagaaacuucagauuuuauuccccuacuggcccacucucccacuguuccacaucccauacuucucccugcccuccugccuacaugaggauauccccacuucccacucccaccccuuaucccaccagacaucuaaacucccuagggccucuaguuucuugaggguuagguacaucaucucugaaugaacacagacccggcaguucucuacuguauguguguugggggccuccuaucagcuggugcaugcugccuguuuggugguccagugucugagaggucucaggguccagauuaauuaagacugcugguccucuuacauuauugcccuucuccucagcuucuuucuaccuucucuaauucaacaacaggggucagcugcucugcccauuugggugcaaauaucugcaccugacucuuucagcugcuuguugggucuuuuggaaggcagucaugcuaggucccuuuuugugagcacuccauagcuucgguaauagugucagacuuuggggucucccauugagcuggaccccacuuugggccuguugguggaccuucuuuuccucagguuccucuccauuuccauccauguaauucuuucagacaggaacaauuaugggucagaguuuugacugugggauggcaaccccaucccucacuuggugcccugucuuucuuuuggaggugggcuuuacaaguucucuccucccaauuuagggcauuucauuuaaggucccucccuuugaguccugagagucucucaccucccaugucucugauacauucuggagaguccuccuacccccaaccuccuaccucccgagguuuccuguuuccauucuuucuccuggccuucagggcuucagcccuuuucccccacccaauaccauccccuuucccucacaggucccucccucccucuccccuugggguugcuuucuucucccucccaagugggacugaggcauccucacuugagcccuucagcuuauugaauuauuauuauuauuauuauuauuauuuuuuuuuuuuuuuuaguucuguggacuguauccuggcuauucuguacuuuuuuuuuuuuggcuaauauccacuuauuagugaguacauaccaugcauguccuuuuggaucugaguuaccucacucagaaugauauuuucuaguuccauccauuugccugcaaaacucaggaugucuucuuucuuagaagcuaaguaguauuccacuguguaaaugaaccauauuuucuguguccauucuucugucaugggacaucuggguuguuuccagcuucuggcuaucacaaacaagacugcuauaaacauaguggaacaugugccccuguggcauggugggcaucuuuuggguauauucucaagagugguauugcugggucugcaggcuggucuaauuggcugucaauauguagaaaaaugaaaauagacccauauuugucaccuugcacaaagcucaaguccaaguggaucaaggaccucaacauaaaaccagacacacugaaacuaaauagaagagaaagugggaaagagccuugaacuuauuggcacagggggaaauuucguaaacagaacuacaauggcucaugcucuaaaaucaaaaauuaauaaaugggaccucaugaaacuggaaagcuucuguaaggcaaaggacauaaucaauaagauaaaucagcagccuacagauugggaagaauucuucacuaacccacauccaauagagggauaauauccaaaauauauagagaucucaagaagcuaaucaccaagaaaaccaaauaacacaaucaaaaaaugagguauagaacuaaaccaaaaauucacaacagaggaaucucaaauggcugagaaacaccuaaagaaauguucaaaguccuuagugaucagagaaaugcaaaucaaaaugacccugagauuccaucuuacaccaaucagaauggcucagaucaaaaccucaggcuacagcacauguuggugaggauguggagaaagaggaacaccucuccauugcuggugggauuacagacggguacaaccacucuggaaaucaaucuggagauuccucagaaaauuggaaaaaucacagauuuuuaagcuugcauuuguuucuguuauaguccaccuaggaccucagacaugcucucagaauuagauuuucuguuaauuuaacuacuuuucaaguuaggagacuuauguucaacaugagcucacugcuuugccugguuaaguaaagagaaugauuccaaauacuauccagagugcgaguauaguaguaguaguaguaguaguaguaguaguaguaguaauaggaauagauuucuaaguagucauuaaaaacuacacuuagacuuaacaagaauguaaugggaagauuaauucaaaacaugauugguuuccuuuccuucuuucuuuuuccaauagaacaucacuauguagcccagguuuuccucuagcuuguaagcuuagcucuguuuagcaguacuggaauuauaaauauacuuugucauaccuagccauauuaucauaauuagaccgaaaguaauccaaaagagguaaaaaauagaaaacuuaauuguguuugaauguguaguguuuuacuuguaaaagauggguagcuauugaucauaaaaauuaggaacugucuagcacaugagcaaauaaauaguuauacaacuuccaacaccugggcaaggacagcagcucugcgggagaagcauuugaaagccagaccugguaacacauauuugugauauucuguuggggaaguaugaaguugaaucaggagguucacuggaagcuaaugggacagcuagccugauaaauccagugcugaauaacaagagacuuuaucuccacugguaggagucaaagaaugauacuccacguuucugcugaccuccauauaugcacuauugcauguuugugcucuuccuccaucccuacacauacucacaaguacauacauauaaagaguuaaaaauaggaauacaauacccagugauugucauauauuuaaauguguaaaauauaugaacauuuguauuuauacuucauaagugacaucagacuguuuuaaugaguacugugaagacauacuuguccugguuaucauuaguuguauaacuuuaaaguuuucauagcauuuuugaaguuuuguauaauuccuuuguuguuuuucucaguaaaaaggagaagaaagaaaagaaaccugcuguuggcguauuugggauggugaguuugggauguauucauuauuuaaaacacugcccucaaaaaggagacauuuccugcagcuuucuuaggaaguauggcaauguggauguagaguuaauugauuggcguuagcuuauuuccagaggaaugccaaucauacuuugccauguacugagccucagcagcuuucuccucaguuuuccauuuucuccaagucaguuauguugccagugaucuuuuaccuguauuuuucuucuugacagucauugccagcuagguagagaaagcuugcuguauucgauucuaucuuuuugcuguuauuugagacaaggucuugcuguguauguagaacaguuuggccucaaaaugccugauucuucuaccuccuaaguacugggauugccauggcauagcaccaugcuuugaacacagcagagggagagcacagccugguguuacacaguagcguggcaguccaaaguguuuuugaagugccauuuccaguuucaugugcucacugugcgcaugcccuguucucuucuaguuucgcuaugcagauuggcuggacaagcugugcaugauucugggaacucucgcugcuauuauccauggaacauuacuuccccucuugaugcugguguuuggaaacaugacagauaguuuuacaaaagcagaagccaguauucugccaagcauuacuaaucaaaguaagaaauauuuguggaaccaaauuuauuggaauuuugcaaguaacauucucuuaaugaaccauuugcagggccuuuaccaaaugugcaguguuguguuuugugcuguaaaaggcggagggucagcgcucucauucagguuuguaaugaguuugaggaaauaauguuuaugggcauuagagcaucuaggagaagugcuggcagagauaagucggaaaggaggaggcucuaugaagucagaaaugccuuugaaggcuucagaaggaaguacaggaucuaaccaggacugcaaugguuugagcguccauggcuaugagugugaguuucagaugauguccauggcucugaguguaagcgaggaguuugggauguuucuaacacuuuuagccuaagaaacuggaaggacaugguuucucuccauugagaaaaaggaagggagaggcaucugggcaguuuuggcugaaagcagauccuggaguggagagaagaaggcuaagacaguuguuuauagagagagggagaggggacagaauaagggagugagaggagaguaugugugaggauguuaguuaucgaugggaaaagugaugcuuuuguucuuauggaaauacgacaguggaaggugauaucugaaagagggugaagagauuuagagagauccucugugaaggacagcaugcaauggucaggaggaaaugcucaccaggguaauagcauggacagcucagcuacagugacagguggaaauaguguauccaugacaaaauccgaagauggauagaggaggaguugggaaucuauguguguuuucugcugguaaguaaaucuuccugucugccagggacauguuuaaaaaguguccugugaaugccugaaacugagaauacugaaccaugacuauauuuacaauguguuucuuauauaggcacaccaguuauaaaguuuauuuuauaaauuaggcaugacaagagauuaauggcaauaauuaauaaaacaacaaauacagcaaugcccugugcuaaaaguuauuuuagcguuuguuccuauuuucucucucucuaccaucuuacuguguacuccugauccuccuuuugauggcgucacaugauucaguuucaugagccacugcaggaaacugaagccacagagagucuaaauuuggauagcuaggggacuguuagaauuuaguuucuaucaguaagguucaaaggaagaaacacguuaauacagaaagacgcaaacaucagaagaguggagaaaccugugagcugcugaauuauguugucuuaaacacaaacguccuugacuugggagggacaggcugcuagcuccgagcuucaguuuucaggucacugucagucaugcagagauugaguugucauaaacuacuggaggacuuacagcucaguuuguacucagugaacauguuggcagguuccaguuauaaauucagguguguguguguguguguguguguguguguguguguguguaaaacaacaacuaaugaauaauaggucaugauuuuaaagagaaaguaauacaugggaggguuuggagagagagaaaagggaaggaaauuguagcugaaaccgauuaaucucuucuuuaaucaacccagcaguggccacguguguuccuaacugcucgccccaguguucuggguucucaagugaaagaugcacacaugcagccuuauauuuuaauaugucuuaagcaguucaaaggcugugccacucccaaacuuuuaggugguuaacacuuccccucccauauuccugaguuguuacuuacuaaaaucuguauuccaucuuuguugcccuagacccaguugugcgguuggaggggggccaggccacucuuccugacucuuuuuuuuuuuuuuauggguugagacaaugucucacuguauagcucuugcuggagcucagagaccugccugccacugccuccagauuaaaggucuacauagucaugccugauacuccagaucguaagucuuuuuuuuuccaguacagauuuuauuuuuuuuuuaauuuuuauuagguauuuuccucauuuacauuuccaaugcuaucccaaaagucccccauacccucccccucacuccccuacccacccacucucacuuuuuggcccuggcauuccccuguacuggggcguauaaaguuugcaaguccaaugggccucucuuuccauugauggucgacuaggccaucuuuugauaccagaggaucccacaauaccucuccugggcauauauccagaagaugucccaaccgguaagaaggacacaugcuccacuauguucauagcagccuuauuuauaauagccaaaagcuggaaagaacccagaugccccccaacagaggaauggauacagaaaaugugguacauuuacacaauggaguacuacucagcuacuaaaaagaauggauuuaugaaauuccuaggcaaauggauggaccugaaggguaucauccugagugagguaacccaaucacaaaggaacuuacacaauauguacucacugauaaguggauauuagcccagaaacuuaggauacccaagauauaagauacaauuugcuaaacgcaugaaacucuuccugacucuuacauguuggcugucucucuguccuccacuucucaagccuggucuuuacuucucucucagcaaaggggagucuuucuccuucuuccuccuuugguccccccugaccugguaauucucugguaagucccaccucugucuuccugcccagccauugacugccagcaacuuuauuuaccaaaaccaacugggggcagggacccucgugcaauuuuuggaaccagauuaacaugauacaaguguaaaaaaauuucaaaaauguuagcaaugccuauaugaaaauacucuugauaauucaaugauguacuuagcuuauaaggacccuuuguuuuucuuuuuuagaugugugugugugugugugugugugugugugugugugugcaaagcuuaaccgacuggaguuuucuguagucucugaauucauaucuucaugugaaccaagugcaucagauagaccuagaucaagaccucugugguuuuaaauguguuguacugauauugccaggacacccaaaagucuaagugacauccaggaaauuaaagaaaugacagugaguuggcauaagauaggacuagagacugauuugaagggaccuuaaauccagcauaggcuauggaccaaggucaaggggaucagaagcucacucagcuucacacauguccauaucauuuacaucguaaaucaucuguuuucuuucuuucccucccuucccauugaguuccacacauauuauaaucuaacauguugcaaugacuuuaagauuugaaguaugccuuuccuugacugagcacuccugauuaugguaauuuuuccuauacaauacuuaucauauguucauauauauguacacacauucuuaugcaguauuauuugucuguuuaugugguccuggaucaaaucuagggcauaguguuugcuagguaaguagauucucacugagcaauaaucccaguuuguaacaguaugauauuggaaacaacuauaaugaauggaaauuuuaaauugauauaggcauacacugaaagaaaaauuguuaaugaauguagaauaaaauucauuuuuaaauguuuugcauaagccgggcaguaguggcacaugccuuuagucccagcacuugggaggcagaggcagguggauuucugaguucgagaccaaccuugucuacagagugaguuccaggacagccagggcuauacagagaaacccagucuugagaaaaaacaaacaaacaaaaaaacccacaaaaaaaaacaaaaacaaaacaaaaaauguuuuguauauaggcacaucuauaaaagaaaaauuuuaaauacauaagaaugcugacugguaguuauuuuaauuuauguggauaguuaugguguugggguuucucauguauuugguucagacuguuagcacuucucaauaguguguuaugcucaauucuuaaugauaauuuucagguaagauaagaguaaagagauggaaugcuaggguuuaaguaugugcgcgaguguccagucauuuggugcuuacuugucacuguggguuucuucuugaaagucacuuuacauucuucuucuucaauguaggcaguguguaguugugcagggccagcaggaaaguguuugaaugaaugucaauaaagcuugaauuggaacugaauugaucacuugaauccugcuuuuguguaaaauuucaagugaaaugaguuuggcuuauuuuccauguguauuaucauuggagaucaaagaggcaucaaugggccagcucuguuuucugguugucuagguggacccaacaguacucugaucaucagcaacagcagucuggaggaagagauggccauguaauucugcacuuuauucuuucauuaaucuuuccugcaugaauccaguuagaaugaccuauacacauuuucacuuuuauaagaugauuugaagcggaaaaagaagcucgcuguccacagcuuugcaguuaauaccuugcuucuugcacaguuucccuaguaauaaugguaauaaggcuggccagugggaaaauguuaaacucagcuucuaauucuaaauaaugaaguaaaacaaccuagaauaaauaaauguuuaauuuugaccuuggguuaccuuggggaaacauuuuaauacuuuaugugcuuugaaguuuguugcucaauauccuuuaaccaguguguaaagaucuauaacaguaguagacgaugugauucuacauuguucuauagaugguuugcuuugacaugcuuaaaggaagcauagccacuggcuuauacuugaaagauaugaaguaaguccuuggauuacuauuauauagaggcuauauauauauauauauauauauauauauauauauauauauauauauacagccugauggggcccauugcugaguucucaugaugcucaugauguaguaagauuagagcuacaacagcaugucuuaccugauugccaguauauauauauuagagaaagagagagaggggggagggaacuuacaugccccauccgaccucacuauguagccaaggcuacucucaagcuuguggcauuccaucugccucagccauacaagugccagaauuacagguuuaagcaccagugcccaguuaacagcaauauauugacuguuuaaauaugcauuauuaaggaauuguggacccuccuuaggacugucagguauagacaggaggcuuuugagauugaggucagccugggcaacauagcaagauguuauuuuuaaaaaacuuuaaaaauguaaauaagugaacaauaacaacaacaacaacaaauuuauaggcuguccccuaagcauaaguuacauuuguuaaauguggcuacucuugcugucauuagcacaugaaaaauaauugacuauagacucaucuauuaaugagaagcauuguaguggcaccacaucuucuugcaaguuguaagagguaacagggcaugagcugcuagcaagauuccugauagguugagcacagaacugugcccaucacaucagacaaucucgugcuuuuauguaagcauuuugaugcuuccccacgacauacugcauuccucagaagauaaugaguagaacucuuuuuucuuuuaaguggggaaaucuguauccuguauuucauuucggaagguuugcguuuagucuaaacauaacuagauguugaugaagaagagaagcccaagggauucacuuuugugaaucugaagccucagaacaagucagcuucaaauucaucuuuuucuuaguuuaauuugaggacuuucacuucucauuguuucaauuuaaauaagaagggcugcacuuugauuccuuaaaacauuuugggguaguucaaaaugaccaguuggucagaugaccuacaaaugcuauuaguuuucagcugucaccagcaacugucugucgguaguucacuggcauggcaucacucccaucucuggguuccacuuucuaaaauuucugucacuugucccuugaaaagcagacagugugauggaggcucauuacugaguucucaugaugcucaugauguaguaagauuagggcuacaauggcaugucuuaccugauugccaggacucccucauaguaacuggcuccucugcgugcuuauuuuauguaaggcacuggcccaagcaccguuuucccagcuagaaaauugggacccaggaucuuaagcagccugccuguguuuacaagguauuuaagugaagagcagggauuuauuuaucccacugcaguguccaguacugaccauuucucuacauuagugcagacguagacagaugcugaccacuacagcuccuuacaacugcuucucaucuguuaaggaggaugggauauguggaaaugcaguguucuuguuuuucagauacgccuacuauuacaccgggauuggugcuggugugcucauaguugccuacauccagguuucacuuuggugccuggcagcuggaagacagauacacaagauuaggcagaaguuuuuccaugcuauaaugaaucaggagauaggcugguuugaugugcaugauguuggggagcucaacacccggcucacagagugaguacuucguuguaugcugaagucagauguggucuuguucuucgugcugugaagcagauaccaccagauaccacaucuguuaggugugccggugcauaacugagcagaguaaagcccuguggacaguaccugugucucacacaguuucuuguucacaacuggcaggggaugggagguagggaggggacuccugcuugccuggcacugaauaagggguuaagcuugcagaaucaagacugagcacagcaauagugcacaaugaaacaacaaccuggccugccugucccacugagcacuauccugccagggcuccauggcacccuuuggacaacgguggaaagaaggaaugggcuucugucuaucauccucugcuucaugaaagacaugaugaacucaaagauuguguucauagaggacagagccauaugcauacagcagaaaucucugagcaguuuggaauuucauagcgaauagucuuacacaucccauguuuguaaucugaggccauguggaccacagaauacuguuaaugacaaaucugcuggaaacaaucugucauguggaauauauauauauauauauauauauauauauauaauacacgcacauauauuuuucuucuagacauuaauuuaugucagacucagugaugcaauauaaaaaugaauaaauucuguguuugcaaaucugauauuauuuguaacacaauuucuuucuccuuuagugaugucuccaaaauuaaugacggaauuggugacaaaauugggauguuuuuucaguccauaaccacauuuuuagccgguuuuaucauaggauuuauaagugguuggaagcuaacccuugucauuuuggcugucagcccucuuauuggauugucaucugcuuugugggcaaagguaagugcacacauugcagagccguccccagacuccgaggaaggucuuuuaaccacaacaacugugaguuugguacuuguuuuuagacuucuguuugccaauaagugggauaggaugacucugccccacugagcuauuauuuguggacaggauaggaaggaaggggaccgccuaucucauucccccaccucuauaguaacuacaugcugagcuggaaagaucugugcucaguagaggacaacaccauaucauugugaggugucaggaacaggaguggcuuucccuggucuauaccacucuacaaugauuucugcaagacuuacugucacucuccagggagcaaucucagguagucaggcuugaauuguguguuuacccaaugagucaucuuacccagccuuugccuaaaagcuucuuuuucuuaauugauuuccaaacaauuaguaaaacauugaacaaguuauauuuaaauucaugucagaauuuaaucaauaaauuauuuuaaguauuuuaagauaucuuguagauagguaaggaaaagggagcacaauuuagucuuuaagaacuacacauugcuucaguuauuggggccuuuguuucacucccugcucugcauaucuuagaucccuagaguguuggcucauuuaaaagauaugugcacuagcuggaaaagcuguuucucacugugggcuugaggcugucuucccaacccaaacaggaagaacagaagggucccaggaacaggagucaucucacccagagucccuuuguguccccauucucuuccucgaacauucacuggagcagcuagaaggcaccgagagggaaaccauuauacuuuugcucucccacgagagucaaagaucuuguuuuguaugauuaauguacaagcaacaauuuuauaucuuuacuuuuuacuuugcgaaagauagaguuagcuaggcauucuuaaaugauaugagauugcacuucgacagguauugacuucauuuacuaauaaggaacuccaggcuuaugcaaaagcuggagcaguugcugaagaagucuuagcagccaucagaacugugauugccuuuggaggacaacagaaggaacuugaaagguuuggacuucugcuagaaaugaaaaauucugugccauugcugauguucugaaaaguugcaauucuaaguaugcuuuccuauugcaugucuucagaagaagggagcauauauguucuguuugcuuuuugcauugaaauauuugaaagccuguuuucauuccuaagaggaugggaugauacagaaacuacaaauaaggaaguugcugcuguacagauaaccauuaguuuaagaaguaaaagacuuuaaagagagucaugguaauauuuuuuuucuuuuuuuggaaagacuuugacauuugcuuugauggggguggagagcugccuagugauuaagaggguauaauguucuugugggcucagccaccuguaacuucugcuccagaggaucugacugaugcuuuuuuuuucuuuuuugccuucaaaggcaucuuugcucauaugcacauaugagcauauccacucaacacacauaaucuuuaaaauuacgcuuugauaagagaaauguacuaaggagcaggaggggggcacauuuaaacaugguguaggauaucucuuaggggagauuuuuaacaagccugaggccugagagaugugaauaaguuucccauagcuaggacagggauggggucugggauuaaagacaaugaaaaucuccuaagauggcaaacgcuccaggcugguguggaauauaucaucacagagcuucuaugucugaagcaaccaaucaugcccacuuuucccucaaaucaccagguguugaaagaaacuggcuuaucaauaauacaauacaauuauaaauacauuaaauuaaauguauuuaauugugaaugcauuuaauucacuagucagaauaguucuauuaacagguucuuuuuuucucauguuuuuucaagugcuaccuucuggaugcaauuuuuuuucuuuuguggaguacugucuggugauuguuggcucuauuuccugagugaccagaguguugagggaaauaucaaacaaacaaacaaacaaaacccugcaagcuucaggagcuacugcuagcaacucuccacccuggcccaguccugccaggcuacucucugccucuagcccuuccccacccucccacugcacccccacccacccccacagaccaauagcuaugcucccagcucugguucgcuugucucuguauaguucucucucugccauauaaaacccugucuguagucagaggucccacauuucaguaacccagcaaaucaaaacucuagaagcuuauaauugacaagucaaauuuauauaucaauaaauucucaauucacaagaugccauuacaauaauuucagaaccaauugauaaugauaaaaguagcucaccuagauuagacaaauuaucccaauuaaucuaaccuuuaugauaucauaacucccugugacuaguuaaagccaugcugguucagggucuucuuccuguccgucugccuccaucuuggcuuuucuuuuuucucucuccccugaugcucucugucucugcaacucuuagcucugccucccuuuucccuguccaaucacagaucuccugcugcacuaauauuuuaaugugauugcauagggaaaauccugacacaccagaguccuauucugaaaguccuuacuuacaucuaaauguucaaguaucugcccugcuuucucucuagcagauucagacugcuaggucuuuagacugcuuuguuauggaaaauguuuguuucucuuucaguuauggcagaugguuuuucuggguauaauagucuugguuauuagcuguguucuuucaaucauaucacuccaagcccuucugguuauaacagcuucuauuaaaaaaucggcuguuauuuugauugcccugccuuucuaugggauuugguucuuuucuccugcagcuuuuaguucccucccucccucccucccucccucccuuccucccuuccuuuuugugaucuuaguguuuuaacuauaagaugacacgggaauucuuuucugguccugucucuuaggugcucuguaugugucuuguaccuagacagacauuuauucucuuagauauggcaauuuuuuuuccuaugguuuuuguuagcaauauuuucugagccuuuggcaugaaguucuuguuuugugauggccaucauucauagauuuaaacuuucaugguauuucaaaguucuugcauguucuguuuaucuguuuuuuagaaaaaauuaucauugcucuugacugaaugauacaauucuuuuaccuugauccaagucuugcuagacuguccuccauguuauccagucucucaggaaguaaggcuuuccacacagcuuuugaucgauuuauugaguguugugcuuugagcaucauuuugguuugauuuuucuuugauacuucugucaguacugaaauauuuucauaucuugaauugacuuccauauuucauuuagaugcuuguaugcucuuugaguacauucaugauuuugaauucuguaaaugugacuauugucauaugcuuuaauucuuuguuuggaauuucagcuaugucacugucagugccaggccuuuugggagaauacguuuucuuggguuuucaucuaauuuuuuguuuuugaguugguguuguccaucgggaguuaguggguagcagaauuauuuuuuucugggucaucucuuuaaugaggaugacccagcauuauuaauuggaguguuguggcuccugucacuccuuaaggguacccuuuauaccaguuuguugagguaggaaagagaacuaguaggcuuaguagcuuagucaaaucuagccugugugucccucauaugcuggcagugugcaguuccauaguucagcucuuccauguaaauuuuucuccauuaaucacuuauuuauucacuuuacacccugauuguugccuccuugucuuggucccuugcucacacacucucucccccaucccuuauccccuucuucucugagagaguagagcccuuccuccccuccugauagauaucuccccacccuggcacauuaagucucugaagggcuaggugcauccucucccauggaaaccagacaagacagccaagguagaggaauggauuccauagacaggcaacagcuuuagggacagacccacucuaguuguugggggacccacauuaagacugagcugcacaucugcuacuuaugugcuugggagaggggugcuagguccagcauguguaugcuuuuugauugguggcucaguuucuaagagcccccaaugauccagguuaguugacucuguuggucuuccuauccucuuuggggccuucaauacuuccccccaacucuuccauaagauucuuugaacuccuuccaauguuuggcuaugggucccugcauguuucagugagcuguuaagcaggagcucucagaggagagccaggcuccugucugcaagcauaacagcauauuauuaaguggugcuugcccauggguuggauuucaaguugggcccacuauuguucggcuguucccucagugucuagcuacaggagauguuccauauccccacugcuaugagucagcuaaguucacccccaaagacuccugggaucuuuccccauuccaggucucuggcauguccuagagauguuccccaugccccccaaccccaccaggugucgacuuucauucauucuccuggcccucuggccuucugucugucucuccccauaccugaucuugagaccccacccccacccauuccccucccaauccccucucccacccuguacccucccuccaucugccuguuaggacuguuuuauuuccccuucuaagugagauucaagcauccucacuugggccuuccaucuuguuuagccucuuugagucuguggaauauaucauggguauccuguacuuugcgacuaauauacacuuagaagugaguauauaccaugcauguccuuuugggucugaguuauaucacucagggugauauuuucuaguuccaucaauuugccugcaaaauucaugauauccuuguuuuuuaguuguuuaauaguauuccacuguguaaauaaaccacauuuucuguauccauucuucaguugagggauaucugaguuguuuccaguuuucggcuaucaaaaaauuauuagcucuuacuucaaaagccuauacucuaaaaaauuggaaagucuaaaugaaaugggugguuuuccagauagauaacaauuuacaaaguuaaaucaagaucagguaaacuaucaaaauaguccuauaacuccuaagaaaauagaagcagucauuaaaagucuccgaaccaacaaaacaaaacaaaacccaaaacaaacaaacaaaaaaaaacaagcaaccaaccauccaaacaaaccaacaaacaaaacggggcgagaugguuuuagggcagauuuuaccagacuuucaaauaauagcuacuaacaauacuccucaaacuauuucccaaaauagaaacagaaggaacacugccaaauucauugaggccacagucaccuugauaucuaaaccauaugaagaccaauuucagacaaauuucucuuaugaacuuggaugcaaaaauacucaaugaaauacaagaugaauccaagaacacaucaaaaacauuuaccaugaacaaauaggcuucaucccagggaugcagggauguuucauagauuuccuuuauacaaaugacaaauaggcugagaaaguaauuagggaaacaagacccuuuacaauagccacaaauaauacaaaauaccuuggugugagucuacccaagcaagugaaagaccuauaagacaagaacuucaagccucugagaaagaaauugaagauaucuaaagauagaaaaaucucccaagcgcauggauuaacagugaacacugccaucuuaaaacauccauguaauuuaagccugacccaggguuuaucuccucaucucuuagagugugggaguuucucacugccucacucucagggcagucugugucuccacugucacaugucacagcuucccuggcuuguaccuacuauauauuaaugagccaaaacaauguuguagaucagugauuuuaaaauuuacagcuagagaaauaagauaaagcauagugcuuguuuucuaaggaagagcauuuugugugccugugugaccugaggcucucaguccuuuucccuggguugccuagguucuaggacuauuggcuccagacccacuuaguacagcuuauuuagauaucaaaaacauggcuaacacaccacaguucccaaagugcguauaaucucccaguuuguccuucuagcacccccaagggagcaagugaucuuuaaaucuuccuuaagguccagacuuuuaaauagcuuuuuuauguuaagauucucuggcauugugucuccauuucauuaaccauuugcuguuccucuuuccucggcuucccucuucuugcucuucaucgucuuucucuuuuucuaaauucuucauccuucccccuuuucaucuuccuucucugucugccuccuucugccucuuuacccuuccuucucuccucccccuuccccaguaggacgcugcagcccuccugauucaggcucccuccucccccuucccaguaagacguugcagcccuccugauucaggcucccuccucccccuucccaguaggacgcugcagcccuccugauucaggcucccuccucccccuucccaguaggacgcugcagcccuccugauucaggcucccuccucccccuucccaguaggacgcugcagcccuccugauucaggcucccuccucccccuucccaguaggacgcugcagcccuccugauucaggcucccuccucccccuucccaguaggacgcugcagcccuccugauucaggcucccaguacuacacggucaacuugucuucuccgugauuagugagauugcuuuacguuucucuccauuuaaucugauguuggcuauuggcuugcuguauauugccuuuauuguguuuaguauguguccuguaucccugaccucccccaagacuuuuaacaugaagggguguuggauuuugucaaaggauuuuucagcaucuauuccuaguacuaccugggaguacagacuagccaccaugaccaacuguuuuuuuauguguguggaauaauauuuggaauaauauccacuuuugauauuuuggauuauuucauuauuacuaaggccaaaaaacacauaagccccaguuuuuucuucaacaaagaaauaaaauaauaacaguacaccuuaggggcaauguauggagaaaagaagaaaaacccuugugugcuaucgggcugcaugcauucaaauuauucaaguagcuuuccuguuacauugagauaguuucuuaacauuuaagaagggaguguauguaauaauuucuguuuccuuucuuccagguacaauaaaaauuuagaagaagcuaaaaauguuggcauaaagaaagcuaucacagccagcauuucgauaggcauugccuaccuguuggucuaugcaucauaugcacuggcauucugguaugggacauccuugguccucucaaaugaauauucuauuggagaagugcuuacuguaaguaauaaaaggauucauuaaaaugauucauaaaaaggauuuauaaaaggauucauuaaaaugucaguucaauuuagugcuuuuaauuugacuuuagaauauguuuugaaaaacaauuaaauacuacaaagaaauauuuguucaaauauucacagguuagaaaguggaaaggaaauuacagguugguuacauugcuuucuuaaagauaaguuacaauaaacuggauucauacacaagagggaaacagaaugacuauacggucuuaaaugguuuuaaggcauauuauuaauuugguuauaucuaacuaaggucuggcaaaaacuuagucucugaagguaagacagaaaaggugauucugagacauuaacauuagcccucuuucuacuaugagcuuauguuuaaugagauggcuucauuuuguacuaagugcuucuuuuauuuucugaguuacuaaucaagcaaaaauaaauaauaaaaauauuuuaaauggcagcuaauauaucucacaaauuuguagaaauauaaauuguugcucuuugcuacagaaaauucugucuagagguuuucugccugaugaacugugcacaaggaugggagcuuuuucuuucauuugaagacaaugauauaauuuauuaaccaagcucaaucuguaauagugggcucauuuuuccuccccaaacacaaaugcauugaguucaugaccacagccaccuuuuuugaaucauuuaauguaauaccuuucuauauuuuuauacuuucacuauauauaguccagguuauccucaaacuggugacugucuugccuuagcuuuugaguuuggcagucauaggugggaaccacaugucugacaaacaguucuuuuuaucaaaauuuagauuuguaauacagaaauaauaauugccuuuauuuuucaaccacacuuaacaucauuuauagggcuauugguuaggaacagacuuuacugcccucucccccaauuuuuaagguaguuuaaauuuuuauuuuauuuuuaauuagggggggggagagagaaacuggaguuguaggcaguucuuaacugcagguuaugaacaucccgugauggggcuuggaaaugaacucguguccuuugcaagagcagugugaguuuuuaacgguugagacauuucuacaguuguuguuaggguagguuuucuuuuuaagaaguuaaguggauacuuuugguguguguguguguauguguguguguguguguguguguguguguguguguguguuuuagugagaggagcuugaguuguaauaaaaauguguccugcuuagugugauguagagaaaccauuuuguuuguuuuucauaugcugaggcuagaaccccggauuccuaaauguuagucugagcugcaacacuucuacuccugagccacacccccagcuuuggagaagcgaugugugugacagauguucauggaguacagaucugccuuacaaacagaaacacuagaguagugcauguaggauuucauaccagacuccccggguucaaauucuagcuggacuuuaccagcugugugauuuggagcagcugucuaaacuccucuggcuucucucaccucuuuugcaaaacagacaugacacagcaugugcccugacuuucaguguaguugugaagacuaaguaugauacacagucauguuccuguauggcuuagaaaugaguugugacauauguagucuuaaaccucaaucuaggaagccaagucuuuaguaacaagaagaaagugucuuuaauaaaacaaagaacaaagucccaaauaccucuucauuagauuucaaaaaggaaugcaguguaggaagaugaaucagaaacacggagucaugucuuaagcguguaccuaguaauugagagagcuuuugcacaggcgauauacagcauacacagugcaggccaccuugaaggccaaggauuugaagagaaugucccaaagauguacaguauuagucccaguauaauuaauuagaccuggucuucuuguguuuauuucauuuuacuccugugaaaaucuagguuaaaaaaugcuuagucucugaaaaaaguaaaaauuuucaauuuaauaugauuuaauauagaauuuaauauagaaauuuuacccuugugugaugaagugaguaagauucauuugaaauucuaaacacauuaaguguuuaaauuuaaaucuauaucaauugguuguuuugauuuuaaucaaagaaucaaacuauuuuacuuuuguugacuauaguguaauacuuugauguauggauaugcuguggagugguuagacauagcugauuacugggauuugaacgugaaucucuuagucauaagcuuaaaauauccaguacucaaucuucugauguuauuugugccauuuugaaaugaaauugguuguguuagaaggaaagggacccaugaggaagacuguucuugaguacuaaguaauuaugugccuugguccccuccucaggucuucuucucuauuuuguuggggacuuuuaguauuggacacuuggccccaaacauagaagccuuugcaaacgcacgaggggcagccuuugaaaucuucaagauaauugauaacguaagucugaccugcccauuuagccaucuaauuagaagaguuuucugauugagccaauuucaugauugcuuccucuccccaccaagcgucauuucagaguaguuauuguaacccggugaucuaaaauauuuuucugcccaggagccaagcauugacagcuucucaacaaagggcuacaaaccagacaguauaaugggaaacuuagaguuuaaaaauguucacuucaacuacccaucgagaagcgaaguucagguauggugcuacuaugguucaguaaucugcuggguagagauacucuuuuacauaugauaaaagaaaggaaaacaauauacauaaaucauauauucaccuuucagcucauagaacucaugugcauccaucuguccuggaaaccggccuaacauugacuucucacgugucuugguagaucuugaagggccucaaucugaaggugaagagcggacagacgguggcccugguuggcaacaguggcuguggaaaaagcacaacuguccagcugaugcagaggcucuacgacccccuggagggcguggugagugagcauguagccagcaccaguuaaugcugcucaccauucugcgucugugauuccaaagugugaacaccacaugcuuuguuccaggucaguaucgacggacaagacaucagaaccaucaaugugagguaucugagggagaucauugguguggugagucaggaaccugugcuguuugccaccacgaucgccgagaacauucgcuauggccgagaagaugucaccauggaugagauugagaaagcugucaaggaagccaaugccuaugacuucaucaugaaacugccccacgugaguugugccugagcucugucaugccaggcucagagaguagagcucugauuaaugcgguucaugggaacccaggaaccuucucugagguagaacaagugccuuagcugggaaauccauuuaccuuggauuuuacagcccacaccccaucaaauagugguagauauguuuauuuauuugcuauaucuuccuauuuuuuguuuguuuguucuaauuauagcaauuugacacccugguuggugagagaggggcgcagcugagugggggacagaaacagagaaucgccauugcccgggcccugguccgcaaucccaagauccuuuuguuggacgaggccaccucagcccuggauacagaaagugaagcuguggugcaggccgcacuggauaaggucugagcuauacuuacaaaggucugaauuauaagaauaauaguauuccaguuuuuuuuucuuguguguguaacugaguauaugcauauauauacguauauaugcauaauauauaugcauacauauguaugagugcauuugaacauguauauugaaaucauagacuauuuucuggagcuuacugauuuuauaaugucaaagcacuggcauuuaguaaacauaagacaaaugacugaauuuaaucaaaaaccagguuucucucucuaggcuagagaaggccggaccaccauugugauagcucaucgcuugucuacaguucguaaugcugacgucauugcugguuuugaugguggugucauuguggagcaaggaaaucaugaugagcucaugagagaaaagggcauuuacuucaaacuugucaugacacaggugcaguggaacuccagaaauguccuaauuuaucuugaugauaaucugucacuauauuuaaucuauagauaaguuugauuugguuaucuuaggagcgugaaaagagcuuagguauucaggaccaggcagugaucuauuuuacuuuuucugggaaagagagaagcuuaaaaagggauaauacaguuuaacuguuagcauucugucuaaacuccaccccacaguuuccuggcaacaaccagauaaaccugacccacuauaaaaggggcugcuugcccccuccucccucucuaacucucuuacucuugaucucuugcuucucucuuuccccuuccuauucccuccccacccccaugugcuuaugaccaaauuucuucucucucucucugccuuucucugccucuaccacccucguaacuuccuucccuccccaugcccugaauaaacucuauucuauacuauaccaucauguggcuggucccucgggggaagggaugucuuggcaugggccaccugagguacccccuucccccacagcucaucacacccccauagaacauacccccucucgauuuaucuuuuuagaaacacaucauuaacaagauuuagagauaacucaucucugcuagccauauauggcuacuuaaauauuuguuaaucuguauuuugaaauuuucucaaguucaaaaugaacacuugggauucugcaggccuaguauuaaaaaaugcaaaacaccccaauaacuauuuguauuguuacauguuaaauguauaauacuuuggguaacaguaauauauugaauuuauuaaauuaaauauauaauuuaaauugauuuuaaaaaucuauuuucacauuuuuuaaugugacugcuaggaaauuuuaaaugacagaugugacucacauagaaugaaccauauugucauugauaacacugguucaaaacaaacuuuauugacugagugccccagagggggaaaaaguuuuaguuagcuuucuguugcggugauaaaacaccaugaacaagcacaccguggggaggaaaggguauauuccauccuacagccuauagucagugcuucauccaaggaagucgggccaauaacucaaagcaggaaucaggaggcaggaacugauacagaugccauggagggauggauguugcuuacuggccugcucccuuuggcuugcuuagccuacuuucuuauacaaccgaggaucaacuacccagggauggcaccauuuacaaugggcugcauugucccacuuaaaucauaaaucgagaggauaccccacagacuugccuaaaagccaaucuuaagaggccauuuccuuaaauaagauucccucuuccuagcuaugucuagguuugugucaaguuuucaaacaaagcaacacagcaaugacuacaugagagccacuuuauuugguggcaguccuguucauucuguaguuuccacugccaauauagcaccugagaaagcauagcagcuuacucaucaguucccauaauaacgugaaacauuucauuauuuccauuaauguugauacucaaugagucacuucccccuuuaaaacuguguaaccaauuucugucuuuuuuuuaaauuuguuauagacuagaggaaaugaaauugaaccaggaaauaaugcuuauggaucccagagugacacugaugcuucugaacugacuucagaagaauccaaaucaccuuuaauaaggagaucaauuuacagaaguguccacagaaagcaagaccaagagagaagacuuaguaugaaagaggcugugguauggaugcagccuuagucuuaguuauaaauccuccccaccccacccccucguuguagcucuguuauuugggugaguuggggcugggaauagaaauggguacucuggaagaccagcaaguguccucaaccuuugggacauuucucuggcuccugaauuaucagucuuguaaacuaucuuucugugguggauguguuuuucaggaugaagaugugccucugguuuccuuuuggcggauccuaaaucuaaaucuaagugaauggccuuauuuacuuguuggcguacuuugcgcuguuauaaaugggugcauacaaccaguguuugccauaguauuuucaaggauuguagggguaagugcuagugucuguucuguguuuguguuuacugagaaagagcaaauaaauuguuucuguuagugccauugacaacaagccagaaaagcaugaaguuucauauggccuuuaaucggagaauagagcucuaaguuguaagaggaaaccuaauauuuuuauuuaaauuuuaaacuguuugagaauuucuuacaagaguacuguauuuacaucauuuucaucucccucaacccccgccaacuccucauguccccuuucuaccuguucucuuucguacuuauuauuguuuuacacacucacacacacucacacacucacacacccuacagaauccauuuagugaaaaaaaaaaauucaaagaaauaacaauaaaagacaguugacaaaaugagcugccucgggguggcagaaagaucguaagagccagagaaccaggauaccuggugcuggaugacaugggagcuacacccaugaaaucuugacaacauaauugccuaaauaagacucauagaauaacacaccagucaacaggucaaugggcggaggacauuucacaaggucccacaagggcugcugagagaaguagauuccauuuccuucaggaugagcuccguaaucuguuccucgguuccaaauggucaacagagacaucuuggggcacuuggaaaucuucacggaguaaaacaaagacuuguugaacacuaugguuccuuaccaacauuccaaguggagaguauuucuuacaauucucuacccaugauaggguaguacacauuaaucuauagggacccccucaguauuggaugagucuuugaaugguaggaccccucugucuugaaggaaggcagaaugcagaugcuuuggaggucugucuugucccccccaaacuguaugagaugaggaauggagaauucuccugcagaaugccuuccucagccauagaacuaagaaucugucaaauauuuugccgcagguuuuuucaagagaugaugaccaugaaacuaaacgacagaauuguaauuuguuuucccuguucuuucugguuauggggcugauuucuuuuguuacauauuucuuucagguaagucucuacauuauuucuguauucauuguggaagauuugcaaauauguauguaauuuuccugcuugugugguuccucucuccuuacccgggcugcgacagucugugggcuuugccuucaccucucuauccuuuccuccaguacagccuuugacgugaugaugggaaggggaugaucaauaugcugcagugauuggaacaaagacggaaacaugaggaagggagccagggagaaguuuggagcuaaguguugcuggucaguuuagcauuuagagaaaugucaaaacaaacaaacaaacaaacaaacaaacaaauaaauacaaaaaccaagaagcuaagagaacucugcaaaaguaucacauucauuuacaaagacguugagaccuuugucauugugcucuugcuacagagaaagaacucuuucgaugauaggagaaccauuaaccgccaaucauugaaaaagcacuuagacacaaccuuaacacuuuuuuuuuuuggcagcuuaaaaucauaugacuaaaauugaauugcaaagaaaugaaauguucucacaguaugguacagaaagacaugcagcguggacucugcuaggucuuucucucaugugcacacauagccaauuauguguucauggggaaaauuucucauuuuaccugucuuucccugagcucccuaucuccaaaagugagaaauguuaccuuguaaugauuaagagaaaauaugaccaagugagcaagcccaguuuugugagaagcauuaggaaaugaccuagucaaugagucagugauuacccacgugaaauacuucagcugaaacuccaaauagguuucuuuaaugcauucugggcuuuuugaauuuuaauuuuuguuuuauguguaugaauguuuugggugcauuuaugucugugcaccauauacauaccuugugccaccagaagucagaagagggagaucaguucccuggaacuagaguuacagaugguuaagaaccaccaugugggugcuuggaauguaaccaaugacaucuggaagagcagcuagugcucuuaacaacugaaccaucucuucagcccagaguaaacacauucuagacauguauuaauauuuuacuggacaagacauuguugguggguaaaaaaaaaaaaugaauaaagggguuauuugacuaagugcuuaaaagauuauagaacuccaucuugcuagaauaaaugggauguuuccaagaccaagaggaucacaaguguuuggagaagugucaguuguucuguguggaguagguaagauauugggagggaggcagcuuugagcuuuggcaguuggaauagcgaagugugaggagugaaaagcauucccucauagucuggcuggguuggggaaacugagucugccaugacucagaccugcaagauugccaaaccauccugagaaacagcccguggaucccuggacuucuguggauuuccaguccaugcugggaagcagggaaugcccagcugcucaucuuugaaauaggcagggagcucagugagagacagguagucagauugggucccauucugcucaggagucuacaguccuugcuguaaacccugauuauaaugcccgguugagcugugaagucuggaaaccugucaacuauucaaccccccccccaauuugguuuuaagcaugauggcuaugagguuaugugaucaugcauguagccuaccauguaacagaagguagcucucuauaaaaauaacuguaaccauuuccccacugcauauugcaggcagguaguagcccauuuaguguagcaaauuaaaaaugagaaagaccuuuccuaugcccuuugguccaacaacagaaaccuguuuguggcccccaucugaccuuacuuacacagucccucauuuccuuggugaucuugacuuguguacccuuuguacaguuuuccucccuuucuuucaguaacacccaggaugcaacuugggagcacaaaggaauauauggcuggccccucuucccacaccacuuuuccauggcuuagcucuggguugacgcuuccaguuucaggcaaaaaggggaauccuauugcuuccuagucuuugguccccauacucauuguagugaagacuugguuggcuuuuuucccagaugugaccuggcauagcagcacacucaugccucacuguucuuucuugguuccugucccuccuccagacagugaggugucuugaaggauggggagauagugaaaggcuuccucuuagugagccacauuccccagucaguuuugauagcaaaguuuugcuuuuucaguuccuccuuauggacaggugccugaaaagucuucuuuccagauuuuaccuuagguccuugggcagccauuaaccaugcuucuuuuccaucccacgaaguguuccaguuaguuaauaguuuauauuuacaacuugucuuaguuauggauuccauuguugugaagagacaccaugaccagcacaauucuuauaaaaacaaaagaaaagaaaagaaaagaaaagaaaagaaaagaaaagaaaagaaaagaaaagaaaagaaaagaaaagaaaaaccucacuacauuuaauuggagcuggcuuacaguuucagagguuuaauccauuaccgucauggugggaagcauggcacuguacaggcagacaugguacugaauuauccuagaguucuacaucuuuaucuauagacaacaaggaaauuguguuccacauuggacagagcuucagcaugggugaucucaaagccagcucucauagugacacacuuccuccaacaagaccacaccuccuaauagugucgcucgcuagccaugggccaagcauuaagacacaugagucuaugggggccauaccuauucaacccaccacauaacuugucuagacugccccagccuuugguauaacagcauuuuugaagugauugcuguugaacaauuggggaaauaaguaggguugggauggguugggcacauaaaugcauuuguaguauacuuguggauacccugucacuaacugggaaucauuggcagccucuguuggucacucauuacugaagcuacauaccugacacuauagcauagagucacagcaacacagcaaacccagaaacugaggcucugugacuucauagaucaucauauaucccuuuagcaguagcauuggccccucugaucgcucuuccugcuguguaauuggugucugagucucugaccagucuuccgugugacauguucuugugcuuuucagggcuucacauuuggcaaagccggagagauccucaccaagcgaguccgauacaugguuuucaaauccaugcugagacagguacggauguugagggguuguccccuggggugaguacgacuuuucccuugugccccauggacaaagauuguaggagcugugccacguuugucagguagagauccuguauggguucucagccucacucugucuguggaccuguagucugugugcugcaggugggcacgaggaaccacacugaguugagacaaacggacuguccugaguagauucuccuccagccuuugguccaucauugaaagauuacagaaacugaagucguugucaacuuugugcauuccccacuccuuccuucucucuccugugaaucugugagaacugugucgugaguccugcccucaggaaauacccuccauuccguucauucuacaaaucccaaucaucacgugccucaucuuuccucacugccuaguuucuuuccuccacggagacugacaugguaacccacaugcaguguuagcucagugacuuaguaggacagagugcuucucccacuuugugccuuuuacaugcucaaaacagagagcguaguuauuuuccuuaaagaagaaguaggaucugggaaagguaucccagggcagccagggugaaagacagugagaaaucuguguaugacuuuaaagcauuugugaugacuagucauuugauaugaauaaaaagauguccaagcggccuagcccagugaagccagagacacuggagcccacccagcucagaaacaucaguguuccauggggccggucacauaucccuugcugguguuuuguuauuuuaagauuuauguuauuuuuuaauuauauguauaugggcaaggauaucgugcacaugaggugucugcagagauucaaaggggcuuaagauccccugggagguaaaguuuuagcuuagugugugcugcuaacagaagugcuaggaaccaaauucuguaagagcaguaagcgauuuaagguccagaccagcacuccaguccucuacccagcuguugcuguugccacaguucuuucccagucuucucaccaauacuucaaaagguaaaggcaacuugguagcuccaugugguugcagccugaugugugagcaagcccugaguuuuauggugauccccaaccuugggcuuucugucaaacauugucaaccccaggcuucuccucugccuccuucagcaaauccuaccggcgugcaccaccacuaccggcucccaggcuucuccuuacacucucaugguagaccuuggcaugucugcagauacucgcuaucccaucauccuccaggccaacccccagcuccacuguucuucaagaguugaguggauggugaggauggcgcucuuuccaucaaccauucaguaaagcaagcgugagaggcacugcuuaugcaugaugguauuaagguauucaggauugaauggccucugucuucaaggaaguaacguucuaguggggaaacacuuuuuaguaccugaguacuuuuaguaccugagauacuaaaaagugcauuaguacaggcuacagugaagcauugcacuugggugauuuuuguuagauauuuucuaugaaaauccguuacuguuuugaaugucguugcuucagauauuuuccuugagacagacaugaauuccugcuucacggccacgucuuuccuguguuugcuuaaaaauaugagauagcacaaggaaaaucuucuuuugcuggugaacaucauuuuaauguacauggcuuuuggcauuucggccuccuucauuuauucugcccugacuagaguuaacuauuugugugcauggcuucuuuccuuugauauugauaaaucucucaaacugccauauuuccaaacuugaacuuugacuucugcuuccucagcagguuuacuccguaccuauucuuucucuucucuacccauuguucagacuaaacccuuaaugacuucccucacuguugagucguuuaccucuccaccaauuguucaucagacucguagaugguuucauuaccuccacccucaucccaguguggauguaacauguaucuaggaggggaaagguuguauagucucuacaguuuccaaagacugugcacugugccucaccuauccccaucacagguaaucuacgacgacauccuuacccaccacgugaugucuucccgacucuguagguaacugcacaaagguuguagcagagagguucaggggaauccgguaggacaaagagauccagaggaagucaugaggccuguucuguuuaggcugccacagccugguagcuuuugguaacugguuuagugugccuuggccuagagucucugccuguaccacaucgucuuucuuucaggcaaucucccccucuuuguuugcaugucugaucaccuuagauaagcgucccugucccuucucuacaucucccaucccuuacuuguuuguccuucuuugauauguuuauguccagaguguuaauuaccgucuagacaguguaaauucuucuacuugugccuucucucucuagagcugaggcucuauggugacagcagcauugauauucuuuacugcuuucuacuugggguuaugcuggagagaaguagaauuuuuuuuuuuguauaaaugaacaaguaaaacagucuacuuauguguuuguauauuagcucgcuucugucuauugaauauuaaauuuugaauguuaguugcagaggauaugugauacugaugcugucacuuucuccuagaucuaagaguuugauuuuuaaaaaauucccuuuguguuacaggauauaagcugguucgaugaccauaagaacagcacuggcucacugaccaccaggcucgccagugaugcuucuaguguuaaagggguaugugcagcaucuggguggugucuuccuuuuaucuugauccacugccugagaccuauuuucuccuuauaggugauagugacuaacuagcuuuaagaaaauguaaauaggggcuagaaggagaaaaauguaaauaucuauuuaacucccugggauaucauaagugcuauagcaaaaguauaaaauuagauacauauuucauaggauauaccuuaaaaucauucuuuuguuauugcugguuuucguacuauuaaugaggugcaccgagaauaguuuuagaaaagaaccacuuugugcagucuugugcccauuagacuuaccugaggugugacuguugcuaauagauuaacaugucucacagggucagucugucugucuuacugcuuaguuaauugacagacagucguacuugcuacugaagagaggacacauguacuuccugucaggauguuucuagguugucagagcagaaggaagagaaccuuccuuaaaaugacugcaggaaacaaagcacauauuaaaaaugauugucuucacagaaggaauagcuuugaauucucaagucaggagauuuugauuuccggcugaaagucagacaguuccuccuauacccaguccuuagcaauuaucuucaagaagauggugugaaaacucaaacauacaggguuguguccuccccaacccuggaccuuugcgucaaucguuguccuuccggcuucuucuacaacagaccuauaaauacugaugacauuucagguuacacauggugcuucuguuaaaauaaauuagaauaugacuccacacaggagaguugggaaagucuucaaaucugauaaaucucaagaauuauuuucauauucaucuuuuuuaaaugaauaaaucaaacacuaaaggcuuaugacaagguguauagcacaaaaauguacaaacaagacacaguuauguauuucauguaacagagaagacuugccuucauacaaucugcuugguaggucagacuaucaaaaagugcaaaaggaugacuaaaggcaggauguagaguuagagauugccugccuagcucuugggagggauggaggggggagggagguggcagguaggccaggcucaauaaguucauguaggcaggaggccagaagguagggaaagugccguuaucguagggauuggaggaauauucuaaugagaucaguaagugcuaagacccugauuuuguuaucauuaauuggccuugauucuuugaccuuggaccaccuaacagagcaagaucugccugugucauaaagguuacagccggagaagcaguacugcugagcccauagcagaugcucugggugcuucgguccauuagcaauugcugugggaaaugaguucuguguaggauuguagaugcugggcauccuagcgcauccccaucugcagaguuucccaggaugcuucacuuugaccuucacaugagaaaugugcagggagaacucuuuaaaggucacucugcuuuuugaccuguuuaugguuuagcagagggucucuucaguuuaugcuuaguuuacugcaccauauuuauauauacauacauauacguauaucauauauaaugcacacauacauguguguguguguauaacaaacacauacaugauggagcaugcauauauuucauaauuuuucaguuucuuuuuuuauaauuaaauucaaguaaaugaaaccuaauaaguaucucaaauaagcccagguauauuuaaauauccuuaauuuuucuaacuuaacaguagccuuauguuauaaacaacuggguaccaaacgcugacauuuccacuaaucuuggguuaguccaguggucucuuuugcaguacugauuugcauagcuuuguuuaguaauuaugcuucacauauuaauuucaguaccaagaaauuucuugguauugaaaagucagggcugaggagagggcucggucggucagagcacuuucuccacacgccugagguccugaguuugaaaccaugucacucacauuaaaaagaacagguacaguugcauaucccuauaaccucagcauugggagacagagauguguggacccuaggaguucaugagcaagcuugugguucgggagcagcaaacaauagaaaaagacacgcagaucuguucuagccuccacaugggugaauacgccaaccuccucauguacacggaccacauaaacacacauguauguauauacagcaauacaaacagccugaaaaaaagaaauuggaacagagagaaaagcuagcuaaaugcugaauauugaucuacuuucauauuuacguagaagucagggaaguccuggucuuagaaacacaauaaacuuagaagucaaccacuuuaguaacugggaagauaauuaguauauuuggaugaaaguaaauagccccaauucauaaacaugcauuuuaugguuaauuuuaaaauaugucucuaauuuguuguauuuuucaggcgaugggcgccaggcuugcuguaguuacccagaauguagcaaaccucgggacaggagucauccucuccuuagucuauggcuggcagcugacacuucuacuuguaguaauuauaccgcucauuguauugggcggaauuauugaaaugaagcuguugucuggccaagccuugaaggacaagaaacagcuugagaucucugggaaggugagucaaacuaaacgcagugcuuaccuggcacaaaacaaaacaaaacaaaacaaaacaaaacaaaacaaaacaaaacaaaaacgacccuugguggugauauuuagcaauucccugucugcucuggggagggccuucaaacaauucuuugagaagaaacguuagcucccugcagagcauagcugaggggaagugggcaaugcaucugugucucagagacugacugacagcugcuuuugacagcuuuucugguuucagucauugucuccacuuucuccuggguccccauccaaccugcuccuucuuucucuccuucugucuuuucucucccccuuuccuucucucccccaucuucucuguuguucuuucucuaaaccauuccuuucucaggaauguagaccugcuuuguuaugaaugacgcgggacacucauuaugggaccguccaccuaguguuauucuuucugucuuagauuaucuaccguucuuuccccuuuguaugccucuuccucccucccacauaguuccccuucacucaucccucauugaugugcacacucagcuaaauuuuguuccacaguuugacaaaugcuuuugagggacuuacuggguuuccuggcaaauguuuuauuucuugcaaugagacccugagagauauguucuguuagaaccucauuuuuuuucuaggugaggcugacagauauguaagugugccuuucaugccuuagagcccaucacuccuggagccagaauucaaacucaggcugcgguacuccaauuagcuaggaaucuacauucuguuaugauagagguagucguauagcacacacucugcagaaaugagauuuuggaagagcugacccccuucucccccccccagcccccaaaaugagcccagugucuacuggggcuauaucugcugaaggacaguccacauucccaagacuuagugccagguccccagggggugggaaagguuuggauacaagccaaccuauccuucagaucuuucaguggcuucuaaccagcugcaugcaaucugagcuuugugcccuagugcuugaugacuguucuucuccugcacuccacuuccuucuccacacugcuguggccagcaggggcuuuuugccccuuucugauucccuuggaccucacggauggccucuuuacaucauccagguuucugaacugcauuuucaaaggcccuucacacugccugagugugugcuuccuccccucggccucgagguuucucuuuucuuucuuuauuaaugaauggugugacuuccuugcuaaaaccuaaguuccaugaagcacgaggcugucucugaugcuuucccucuaaaggaaugagguaagcuugagguuucugagcaguucuguguaauguagaagaacacguauacucaagcauaugauguuaagagcugcuuguaucccagcaacgcagugucagggccuucuuaccuagugacaguaugacgucacagacuguucauguuuccuguguuugaugucagagccucacucacagcgucugugaaguaugggccugcucaucauuuucugucuaugaugucagaagaugcucauagccuucacccugucaaaggcuugugccuguguucagucauguugcuaagaacuaaugaguauuuguugaaaaacaauguaguuucuuuuuuucagucuugaaagccauaauuaaauuugaauucuguugaaggcagaaggaggauggugaagaggcuuauucuuuuuuuuuucaaaaucacacauuuuuuuuccugcaaaauuauuuuguaaacaauacuuucugaaagaaaccgcuauuuuuacucuuucagcuaaaaguucuuuuugugugggggaggaucacuuaguuuuaaaaacuuguagagaaugaagccuaauuaagaguccacauuuaaggcuuuuccuaauugcuucauugugccuugaaaugaagagauugucccaugaagucugugcuguaaagccucacuuucaucagcaguaugcacacugagaaaacaugacauucucagacucaccgcagccacggcauccuugccucagaaagugaugugcaggaaaucuuuaucuuuguugaucugaccauggaucuuguuuucugucacacauugcugugguuuguacagugguccuucuaaccccgaaagcucuucuauuauuugaacaguuauaauuacaaauacuuguaacguaucuuacuaagauaaucugaauaaauucuuuucucuagcaucuuuuccuuacugucaggauuuuuaaaaaaaauacauauauauuuggugugugaguaugcaguuguaugugagcaugggugccugugcauauguauaggagguaagaggucagcaucagggguguacuggcuaguuuugugucaacuugacacagcuggaguuaucacagagaaagaagcuucaguuggggaaaugccucuaugagauccaacuguaaggcauuuucucaauuagugaucaagggggaaaggccccuugugggugggaccaucacuggccugguagucuuggguucuauaagagagcaggcugagcaagccaggggaagcaagccaguaaagaacaucccuccauggccucugcgucagcuccugcuuccugaccugcuugaguuccaguccugacuuccuuuggugaugaaaagcaauguggaaguguaagccgaauaagcccuuuccuccccaacuugcuucuuggucaugauauuugugcaggaauagaaacccugacuaagacaaggggucauuucucaaaagccaucugccuugucuuugaguuggagaccuugagcccacugauuaggcuacgcuggccgggcagcaaggauccccugucuccuucucuagugcugagauugcaaguaaagugagagaggaaguguguguguguguguguguguguguguguguguguguguguguguguguugaacacauccagagaauggucugcuauagccacaccuucagauuuaaaugaacuuauaaaguguacagcuaacaaaccaaaguaaaagaacaguagcgaauaguagacagguggaagcaacagauaauugacagaguguaucuaauaagguacugagaacauacagccauagugauugauaggccgagagagcaaauggagguaacaucaaaucgggacguagaauacugagcuucugcugucaacuguggaagaagcagccacgcuggaguugccagcugagucucuguaaaugagcuucguccagaggacuggguuagaucugaugcccucuucugguuucccugggcacugcauacaaguggugcauggacauacaugcaggcaaaacacacaccaauacacauggaaugauuucuuuuuaaauuuacuuuucaaacuuagauaauuuguauaggauucagugaaaaauaaggggaguuaauacuuuguggauuauucuaugacuuauuauaguuaguuggauguauccuuauuaacauaaguucugaccuaugaaagagcccgugagaaaaacaugugagccuguaagagcuggugagaaaacuugcugucuuacaguuuuagaguuaaagagauccucgagaccauccauccuuccccugucauuucacagaugagaagugugagaguuucguggcugagaaauugaaaucucauuagagauauuuguauuuuuaacaucuccacuuuccauuguccacacuauaaaagguggcaaggaauguacauucuaaacagauauccuugcuagaguuauauguuacucaaacauaauggggugacagaaacuuggggaaaguaugucugccacauuccucaaaaauaguuuauuuucaaauaccacuaaugguguuaaugaaaaacagcaaagaaucgaacagcaaugcaguaagccauaaaacuuuaaacaugaugaguuugaggccagccuagucuacaaagugaguuccaggauagccagagcuauacagagaaacccugucucggaaaacaaaaacaaaaacaaaaacaaaaacaaaaacaaacaaaaaaccuuuaaagaugaauaagaggaaacaaaauguaacaagauuauagacucuaguauaugucuuuuaauaauaacucuaaauguaaauggucuuaauucuacaauuaaaagacagacuggaugaauggauuuagaagcaagaugcaacaauauguaagcaaaacaaaacaaaaaccucacugacaaagucugcaagugaaagguuaaaaaacaauaguccaagcaaauggaauaggaaaccaagaagguuuagccacacucauagcuaagaaaaauagguuaaggaaaaucacaauacuuaaagaagauugcuauuuauuaagagaauaauuugucaaaguauaagcuuauaugcaccauguaucagaacauggacccaaaaggagauuugaaccuccaaugcacuaguaguuuguccccucucucugauacauuaucuagauuuaaaagaauuaaccaguugguauucuuugaucacagcaggagaaacuccaaaagcaaugcuaagaagaacacuuauugcagugaguuccuaugccauaaagagauagaaaugagagcaaaccaaaccaaaacaaaagaaugaugaucaggacgcaagccaguggaagagacuauaaaagagaaccauaaagggacaaugaggaaagauggcauaaagggacaaugaggaaagauggcucuguggguaagagcacucacugccuuuccaaagacccaaguuugguucccaauccugacauccgacagcucacaacugccuguaacuccagcuccaggggauccaacacccguuccuggccuccacgggaaccagcacacacauaacacgcauagacacauacauaaaaauaaaucauuaaagauuaaacuaauuaaacaaagagauaguguuuaaaaaaggucaaauugcaaaacacucaauuagucaaaagaaagauccaaauaaauagaacuuaaaaaggaaagaguaugcauaauacuacuggaaacuuggaggaucauugagggguuuuuaaguauuuaagcuuuaaauguuuuuauuacuuaaaguuugugugugugugucugugucuguguuuguguguguaugugugugucacggaguccauggugucaguuaccucgggagcuggaguuacaagugguugugagccaccuggugagauuauugggaauugaauuugaguguucuggaagagcaauacgugcaauugacugcugagccauuucuccagcccugucagagcauauuuuuagugaggaaaaaaaugcuuauaauguagcaaauuuagaagaaguggaauaguuucugggcaaauauggccaacugaaauugaaucuaaaaaaaaaaauuaagaaacuaaguauaaugaaaaaaugagauuuaaugauaauaagucucccaacaaaaaguucucuguacaauguaugagaaagggaagaaaccucuguacucauucugugaagcuaagaagcuagcauuacccaacuacuaaaaccugauaagaacaaaacagacagaacaaaaacaaccccacagaacagcaaccuccccuaccuuccaaaaccugcaaaaaucccucccaagcuauaugaaugcauaguaaauacgaaugcuggguaagaaaagccucugccgacaacaggcacagcgaaugcuugugauccggacuuuucugauacaggaagacugauagcugucaaucucugcuaacaaguuaaagacacucuaggcacauagucagaugcugucucaagaaaucaaaacaggaaauguggucugugauagaguuaggaucaucccuaggaugcaagaguaacucagcaugcaccacugagaagugacggacaugaguaaucacagaguuguccaaggacauccagacacagcagucaagagaaucccacauaccuucucaaugaaaggcuuuaauuaguauagaagaaucauaucucaacauacaaaugauuguacaaggcaaauauaauagcuaauacagauaccuaauagcuaauauauaaauauauaauaguauacaaauauauaauaggugauaauauaauaauggaaaaaacaagauguuucuuaaaaaucaggaguaaaauaaggauaacuaauauauuacuguucaauuuuagcuauagagaucacaccugagaaaaaauauaggaaagaaguguaagaggaaaaaauagggaagaauugaaauccugcuuuccacauauauagaacagaaaaagacuuugcugaaagaccagaacuggcgaauuuacuagagaagcauuuacgaacacaagauauguugcaaauauaaguaucaguucuucacaguaaccaaaacuucaugaagacaaauuaggagucccauuccuaauagauacaacaaagucccuaauaacucugauucuuaagaauuuuaacgcuguagugaaaauuaaugaaagaagucaaagacaguaccaggaaaaacagcugccuguguccaugcaucaagggaaaugauauucagaguccauauuacucaaagaaauuugcaaauuuauuuucugcagccaugauacagaagggaugaaagguuaauauaugguauauguguauuauagaauaucauucagccacaacgaaaguucuguuacucgcaggaaaguaaaauuggaggaugucguguuaaaagagacaucaagcaaauguaugcuuucuuuccugugcaaaauauaugaaaagaugagagaggggaacugugggacugggaggggugaggagggacgguaggagaguggacacacucgaucugugaauauaugaaaaagccauaggauccugcucauuucuacauuaauuuaauggcaagcagcacuugcucucuuugaccuaguguuuguacauuccagaaaauuuccuaaguaaauuauuuaauauugauaacugcucacauucaaagauaucuauggaaaugcugauuuuaauaagaauugaaagcaauguugagguugucuauuauaccaacucuacauggauuuaauaaccuuggaaaaugcucuuuauuuuuaucaaaaacaguauagaaugcagaauguauuuuauuauuaaagauguguauaauuggagggaaucaagguuuaaguuaauguguaaaaugauaauauguaacauuuucuuuuguaacauauccaagauauuauuuuuuaaaacaaugggauuuaugaagagaaaauauuacauuaaaaaaauaaagcugggagugguggcgcaugccuuuaagagguaggcugauuucugaauuugagaccagccuggucuacaaagugaguuccaggacagccagggcuauacagagaaaccuagucucgaaaaaccaaaaaugaauaaacaaacaaacaaacaaacaagcaaauaaauaaaucuucuaaaaaaaauaaguaaagcgaggugucauggugcauggcuguauccaagcacugagacggaagugggaaauucucacuuuaggcccaucucgcauauugugcaagacccuaugucaaauaaaugaauaagcaaacuaaaacaauuguaagguuagauagagcaugucuguuguagaagaaagagcaacauaaagggcauacugaauucucaaguuaccuuuucuaaagccaacuaaagacagugguuuagacagucugucagcuuuagucucuaugggggugggguggggugcaggaaauuuguggaucuuccuuacagauuucaaguccaguuugaaaaauuacuuaauauucuuuuucaguaaagaagauacuacuaaaugcuaaauauauuauaauaaauugcuuuuauuaauaugauuuacacacuucaaauuaacugccgauuggaccuugugucuguuguguugcagauugcuacagaagcaauugaaaacuuccgcacuauugucucuuugacucgggagcagaaguuugaaaccauguaugcccagagcuugcagguaccauacagguaagaugccuuaaagagugggccaggacucuaaggagauuuccaagcaggacuucaguuuuccagauugauuuugccaaaggcagagugcacaugaagaaaguacuagaaggaacacuagagauuaccaagagagaaaugaagagaccugaguuuagucagaagcaucugugacauaaaugcaugaaggcuggugacacauggggaggggagggaagagaacaacuguuaaugccucugguauccaguugggacaaugacucugcuauuugcuguauuggacgugacuguucucuauggaacaugaaauuggagauguugugugauacagaaggaucuccugaggaaauuuccuguuccuuuguuuccucaggagaccuucuuuuuucccuuuaccccagcaguauccaugagggcucuaaaggguuacaggacaugagcaaggccaaccuugagucccagcuucucuaggacaaggugauagguuaucaccaauucaagacaaguuaaaguauaaaagcagcuuuauugggaccaucucuugggugaguucaucgaccccaagggaugaggccaaggagguugaaaugcagagggagagagagagagagagagagagagagagagaggagagggaaagggagggagagaaacaaaaugucuagauuauauagugaagagcugggccuagaagaaucccagguccuuggcuccauaguucaguuuagagggaaggaguaugcaagccauguccuguaacaggcagagaucaagggaugcagggagagccuagaggccaggucugcuuuggucugcuaaguaggcaccucagucacuugucuugggucuaaaucccaacaucuuagccuuuuguugauaauaaaugaauaacggguuauguaaucauauauaaauacuuucugcugauauuggggcaucguuaguuggaguccaaaagcuggaauguuggcugggucugggaagagcaggcuccugugcaaguuuugcaggaccauauggggguagggacaugaaggcccaguugaaggagucugugaggcuagacaggagcaccuguagguagccauuucagagcuguccuggaucugacuuugaugaauauaccaacauauguguauauauaaguauauauauauauaugugauauauacauauauauacauauacacacacacacauauauauguguguauauauguauauauauauggcagacaauaaugcuaaggaguuuaaaaacauuuuuucuuggguauauauuugaaacuuuuagaaccaugaucuuggcauuugagaugagggagagucugaaaccaggaaaagggggcgggauuccauccucaggaauaggcagguggggaaaccagcuguugauugacaguaacuaucuggagucccuuugacuugugagagguggauucaaguggcuucccugaagaucuccauaaucuuuuuaaauuuacaagaagagaugcauuuuagguauguugguauuaccacuguuuguacucuguacugaaauccacauuguagaaagagcagcagacucacgccuucgaguaagaggaacacuaggaugguuuugguuaaaagguuuaacacucuggaagucuuaauacaacagcagcauaaugaggggaagaaaucagaagcauuuucauuccuuguauguaccaugaaccacucuguuaucaccauuuaaguuuuuauguccucaacccuucauaacuugucuuuacccacaaacacuuuguaaccucagaccuuacauaaacaucacacuuuuuccuaucgagucauucaccgggagacauaggugguuaacuacugggagcagucacuguaaacugaguuccuuuagauaaaggaaaaguaaaaaguuacuucuuucacuagucuagucuucaaacgcucagagaccugagaagacacauuuuacaugagucagcaaggagugcagaucaagcagcuuccaagucuauugaaaaaacagagaacuaccagcuaccuggucccuaggcuccucuguaguugguagggcgucuuucuuuagcuaucaggccuuggcagacuuuuccaugaagcaggaacuuuggaaggcugucccaucuuugucuaggcaaaaugaggcagucaguuuuccaauguccugccuguccauaggcaaucaggagucuacuguccaguggccagcuuugacacauuugaagcaagugucaggagcgucuucuguguccaucuuuggaggaggaggaaaggagauuaagggugcugucaggagcugacaugccuacaugaaaagcuuuuuauuaaacauuuuaaaaugccauauucugcaagucucuaaagucagaggaccaucugucuaucuaaauagacaaacuuuguguguuucuaguuauccguccuaggcucaaccuugaagacauauacaggaggcaaaaaggcuuauuccuguuaucaauugcauucguucuuagcaucacuucaaauauauuucugaacacuuuaaaguguaugaucauuuauaagguggcugacuaccaacuugcauuucuuaauuaucauuaauaguuugcaauaauuuacuaacuuuuauaagucuaggacuuuauguuuuaucucuuagguuuagauuuaaaauaacaauuuuaaauuggagccuucucaacaucaaaacaaaacuuuuuaauccauaaacauaaaaauaucuauagcuuaauguuagcaaaaaagaggauaaacagauuuucagucagugauuuauagccuauuuaauguuguaaaccuccaaaaccuuucuaaaaagaaguuuaaagucucucaauuguguuuuuguaauauagaaauaaagugccuuuuuaaaugugaagagagagccauaauuuucagaaggcaaaaacccacauucugacacaagggaagaacuggaccuuaaugaagugucuccaagcuccuuugucacaaucauggcaggccccccuuucugggaaaaguuucuaaguggcaaagacaugaacaaaggugauguguuuaaacaggaguaggaaggucaaaagucugucccuguccccacccugucucugccuacaccuccacacccaagacccuugugguucagaaauuccuggaaugcuaauccuuuguagagccuucccuggcuccagacaggcaagugcuucuuucuucccacagcacaguccucaggaacucccuccacugcacugaucacaugcagcuccccuagguccucacaucaaggacaugcccgcugcccugucacccacagcuugagugugcuggguagauguguugggagguguccuacucuacagaucaccaguguugugugucccacaguguggaaaagggaauguaaaacaggcucuucucaggguuccaggccaguucucuuccaucaacccacugagauguaauccuacauuaaagaugaagacagcacugagucucagagacgaggcaguuucccaaauucacacagcuaauccaaaggggauccagcugaguuccuuagaacuggagugcacgguaucugucacgccugcgugccucacugacaagccacagcaagcugcuugaaugacugagcgauggacugaaucugcacugucuucuuuccagaaaugcgaugaagaaagcacacguguuugggaucacguucuccuucacccaggccaugauguauuuuucuuaugcugcuuguuuccgguucggugccuacuugguggcacaacaacucaugacuuuugaaaauguuauguuguaaguauugauuuucuaaauagauaaauauuugauauauugauuuauuccaagucuuugaagcaaugaaauuugcugacacaccauucauagauuuaaaaaucuuagauguaaaaaucuauuuaauuaggaaccgccaaaggaaacuuaugaaaaguggccacuuucuaaaaaaaaaaaaaaaaaaaaaaaaaaagucccacacauuuaaauguuacauaaggagagaaaaccaucaugugguuuuuuuaguuguaauuuuaaaaauugcaguauauuccuuuagcauauguguguguguguguguguguguguguguguguaggcccaagaaaaggaagugguggguuccuaguguucuggaauauucuucagcauuaugcugguuugagugguuacucugacacaaugugauguauguggagaaaagcaagggccuuugaaugguguucuggggcaugaugggaaaggaagacaaagauuuccccuguuuuagaaauaguuuagcaauagaguuaaugaaacauggcacccacuaaagcagagcuacaagccaauuuaggagaagguccaggcauaaacaugacaacuauacuugguaucucuaagguccuuuccaaucuaugcugugaaggccacgucacaaaugcaaauguaucuuaauagcugcauggcaugcuaaguagggagacgcucgucacauacuucauaggcuuugugagaauauguucccacaaccagccaugaggccucagugacacagaauuaaaaacauuuauuuugugcauaagucaguuguacugaucugaguuaguguuacaggacaggguagguggcuagugugugagggguguccucugcgcaugcuuuaucuuguaguagaaggagggagggaaggaggugagggggacgggagagagagagaacauagaaaugaaaaugaagaaaccuacuaagcauacaagacucuuagacaccuagcugacgacagcaacucugcugcaccuugccaauagaaauaagucacaaagcaaaccuacauucgaaggguuggaaacacacuucaucuuuuaaacagaaguguuugcaaaagucagagagagaugaaagaacuggcuauuuuguauccagccacacugcuaugcauuucaggaacaguauuucauuuaaaaucgaacaaacucuugaacacauaaagagaacagaacacuuacagcauuuugacaaagaaugugagcaguuugucacaucuauguugcaagggacaaaaaugagaaaccucaggcauggcaucugggagucuggaguggaguguugucuggucugugaggggagcauguaagggaauccuuccauugcuuugucugaaacccacagccauugguccagugauucuaauccaccccugggaaagaggaguucucagggaagccccguagcuucuuucuaaaggguuccuaacgacaguaaagcagagaacagaaaguugccaaggacugcaggaaacgccauucucuuucuguagagaacuagacauugggugaaucaggccagcuccuaguuguugcccuucaucuucugcuguacccgaagccuuaccaguggagcaguguggcuggugagagcuaucaagucuaggcuggcucagagaggggccaccauggugguuggugucuucauaguucucugcaugauuuuucucuauucagaucaguggucacccagccacuuggguauagaccugaccgcuugcuuccacgguagccgagacugucugcgcaugcuugcuucucuuguuuuucaggguauuuucugcuguugucuuuggugccauggcagcugggaauacuaguucauuugcuccugacuaugcgaaagccaaaguaucagcaucucauaucaucaggaucauugagaaaaccccugagauugacagcuacagcacagagggcuugaagccugugaguuuguuuauucacuuacaugaccugcuagccccauggauaaaaguaguccaagaagaaaguaaacagaauugugcuuuugcuuauuuugauugugauaugaauuucuaggccuuggguuuguuucagcaaguaccaauguauauuaaaaccuaguacuuuuacaugacaguuacagcgcaauaagaauacuaucaucuucguaggcaaauucuggaggaaaagcuccaaauuauugcauuuguguuaugcauuagaugguacuaaggccaccacguaaacaaguggacucucucuuuuucuuaagaauuuuuaaaauuucauuuuuaucuaguuauuuauguguguguaaauguucccucaccgcagugcacagguggaggccagaggacaauuuuaggacuugguucucugcuccaccacguggauccugggaacugaagucaaguuguacugcucaguagcagggucccuacccacugaagcauauugucggccaaggcacugauucuuuuagagucuauuaaguucuagcuuugugaaaugaagguuagcuucauuucagagcucauaguagaauuucacuacauuuguuacuaaccaccuggcugagaucuuuuugcucuucauggauagaauccaugagcguggucguuagaacucuuucaugguuaggaguccuaagcccuuuugugccugagucacaggggacugaacuagcaggcucugcgccuugagaacuaggaagccuacuccagaauuuagaagccagagacuauggcuuuuacguguuauguuaaagguuuauugcuugaagcuuuaaugaccaacugcccugauaauuagaaaccauuauuguucucacugaccaacagcauugagcagcagcuggcaucacuggcuccaguauuagggcccuuagcucccagagcaguuaguauuauaggucuugagucuagggugucagaacuuuggucuuuaaagcuuugcaguucuuccaacaacuggagacuagaguuucucaucuauagcucuuugcaaucuuuauuaucucuaccuccaguucccaugcaugucacugacuggaacucucuucaguuacccuucccuggcaugccagacauugcucuacuauugcugcuguugucucuucuuuucguggucagcuuaguccacuguauugaugagagagaggaaaaguagcaagcaaaggcuuauauauuaagacaaauguaucaagacuauauugacacuaauuacgggccuucugcugguccgcugugagcccaucaacagggagcaugccaucagcagugauccccugcguucuggaugauaaugcuugcuggagguccuugugacuuccacagcaagcuauuauaacagucacaauagaaguaaugcucucccccauugaagugugcuuuugccaaaaguggcuguaguugcaaauaccauuuucuucagacauuuggcaugagagcaucaagcagcugucaaaagggcugcuuagcagacagcauucugcucaaggaagccagauauuaagaggaugaucuaucacagcccauuuuuugaacucuuuuagucauucaugcaaaggaugaguacaguaaagacuuagugaguacucagcacagagcuaauagcacuuaauaguauuuaacagugcuuaagaauugcccuggcagccaggaaaagguguguccuuuugaucugacucaccugacagcuggagguagcuaggcucaguucuacuccauguuuccaauauugccauuaucaaaguaacuaucacuauucucuuuuuagacucuguuagaaggaaauguaaaauuuaauggaguccaguuuaacuaucccacccgacccaacaucccagugcuucaggggcugagccucgaggugaagaagggccagacguuggcccuggugggcagcaguggcugugggaagagcacagugguccagcugcucgagcgcuucuacgaccccauggcuggaucaguggugagcacguuuuuauauucagaucaucuuaaggccuggauauuauuaacucuugauuauaagccauguuuggugucuaagcugcccugucugccccagauaccuucuccaucaacagugcaccucuguuuuccuucacagaagccuacuuaccaccuggcucccuugcaugagaaaggcauaaaaaguuagaguagcuugagaaauagaaagugggucuaggagugacaaggagauuacagccgauuacuauguuuugaggaggaaaagaugacaaugaggauggguggcauggauuuggaggaggugagaacugagaagacauggugaccugagggagcaaaucaauggaccguuugcaacauuuccucuuaguaaacagcucugcacgucugaaggaagcuugggaggaaacauggagauucagggagugugaacugugaagcaguugacaguggaagagguaggaguagcagcagaauaggggacauuugagguaacauguucaaaagaaggaaucuggaggucugugcagaggacucggcagucagaaguacucacugccuugcagaggaccuugguucaguucucagcaaccacuuggugccuuagaccuccacuuccaggggaaucugacuccaacuuaugaccuguguuauccuucugugugcucauggugcacauauauacacugagauacgugcuuacauaaaaacaaauuaacuaaaaaaaaaaaaaaaucuuuuuuuuuuuguuuuuuuuguuuuugcaauaggguuccuuuguguagccuuggcuguccaggaacuagcucuguagaccacacuggccuucaacucacagauauacaucugucuuuuccucccaagugcugggauuaaaggcaugugccuacacucuccagcuccaauaaaaucaauauuuuuaaaagggggaaacugaagcaugcuuuggcuaugaguuuaaauaaauguagugguauacagcaaaaagagugcaaagaugcagcuuagagcagaaaaguguuacucuguaugcacagagccacauagccacacagcaauaagacaaugacccaaacauucgauucccaucagcucuaagggauccuggcugccaucaaugaugaagaugaguggagacuuuucaaucugaucccauggcuuuuagaauugcuacacaauaacuauucaaaaacaaucauauuuuacucagugucuuaguuaggguuuuuauugcugcaaugaaacaccaugaccgaaaaaaaaaaaaaaagaccaaguuggggaggaaaagguuuauucagcuuacacaugcauagcacuguucaccacugaaggaagucaggacaggacaguaaacagcacaggauccuggaagcgagagcucaugaacaggccauggagggguacugcuuacugucuugcuucccacggcuugcucaguuugauuucuuauagaaccccagggauagcaccgcccaccguggccugggcccuccuccauuggucacugagagaaugccuuauagcuggaucucaugacacauuuccuuaguugaggcuucuucucucugaugacucuaguuugugucaaguugacacaaaaccaaccaguguacucaguuuuuuuuuuuaaguuauaaaugcuuuacaccuuuuuaccuuauuaaaagagcaguucucaaccugugggguugaacaucauauuuagauuuauuuuaugacuuauaucauucauaauagcagcaauauuacaguuaugaaguagcaaugaaguaauuuuaugauuggggucaccacagcaugaggaacuguauuaaaggguugcagcauuaggaaaguugagaaccacucuucuaaaaggucuuugcuacauucaaagcaauuagaggagauagugucagccgccagaauuuugaguaauguccucaauaagcuuuuauuaagccacauguaaacugugcaauuaaaagaaauagcauauggugacuuuaacugggacgauggaaaaauaugcuugugcaaauuugauuagagaagggagaccuggagcuagcucucaauggcuguguaugauuugcauagugaagagccauauagcugauacuuauugcaagagguaauguggguucugcuugguagcacaggguagcaagcaggccaguuaaaguggaaccuagcagaauuaauacuuucccaaacuauguuguuauauuuuaagaaagauuuuaaaaucucauagcaucuuauuauagucacaauaacuuccuaguggggcagggcauugucccaagguaagcaagcuuaaauuugcagcuucuccgagaaggaaguuggagaagagaaagaggaaaaagccaugccacuugaguuaacccagcauagaagucagcccauggcagacaagaagccacaagauagguggagagcuaaaacauacuuaggcucuggacauacuagacaguauuugaaaaaaaaaacaauuauaaaugaagaaagaguacacguuagacauuucugagucaaaagguagcccugaagcaacugcaccaaagucagagagaaaggaaaggaaggaaaaauauacauuaucauucacagauacuuauuccucccaucuuuuuagcauggcuuaacaugaacucagcuuccucagggguggucucuuggcugggugauuccuuccaggaggaaacagugacauguccucaggcaccauagaccccauucuuuacuguaacuuuacuaaacaacggcaaaaccauuacauaaggaacagugaugguucuguaaaaacaacaauagcaggagagcauaaucuacaacauggacaaaaaucauuucagcucaguacaggaaacagaaagauuuaauaaaaggaguuaggugcucacucuuugcugagcuaaaugaauaagagcaaugaauuggaauaagagauuggauucugaucucagcacugcugcugcggucuaugacccagaaguuacagggacuucugucagcauuauagcuguuccuaguguacaagagcaagcuuguuccagcuguuggaggaacugccaucuuccaccacaccaccagccuacuccugcuaaaugagaauugguaucuaccucucaauuuuacccaguaacauucacagauggaaucaagugugucucccaaaaacagggagucaaggaaggaguuuugagccuguuugcuuguuuguuuguuuguuuccagacuuauuuauguauuuuauguauauggguacuuuaacauguacaucugcacuccagaagauggccucagacaggugugagcugccaugagagugaggagugagaauugaauucaggaccuucugaagagcagugagugcucuuaaccacugagccaccucuccaaccuuuugguucuuaguauguaaagguagacacaaaugcacugaagcuaacguauucuuguucauuccagaaauaccuguugucuucuucugugaauuguacuagagcuuuaaaaugucaggacaugguucauagcagccagccuccuuucagaagcauucccaguaaauuaauguguuaaauuuuguuucuaaguaucagcuagugaccuguugggaacuacaaaggguggggggcgggggguagguaggggaggcccuggcgaagaaagggaagggaaaaggggcccaauguccggccagaguuccuguacucugggcaggcagacacaggcagaugcucaggugggcaugcaagccucugacccaugcaacaggggguggacaaggggcagcccccaacugggaccccaaggcaacacccugucaccccgggguuauaggagagagggaugagaggagagguucccaacacuggcgaguuugcacagcggaucuugauggagcagagacucuaugauuuaagagcuuuauuauagaaaugcagggggaaagagaagggggagagagagagagggagagagagaacgcuagagagaaagcuagagagaaagagaaaaagagagaaagagaggagaggauaggagaagacaaagagaaaggagagaggagagaagacagagaggagagagagggggcgagagugaggaguaagaagugagagcauaagagaaagagagugaggugggggcugaacagcccuuuuuauggucuuuacuguugcuagguaacuggggaggaguuuagccuaaagguuagaagcuugggccauugcuuaagugacuacugaccaugcuucccuugugaggccuguggaaggugguaacuuaggcagggaccagaguuccaggagcaugagggaacgccuaccgugucauguaggugaauuaugaccaucgggguccagaccucagcuagacuggagaccagccugcaauuccccacagugacccuuagugacucuguuagugguaauagguaucucaaagguauuucuuacugccguggaaaaugauuguccacuugagcaucauuuggucuuuuuguggggggcaagggggaguucuuguaauuuauuguuagauaauuuucuuugcauuuuauuggguauuuucuuuauuuacauuucaaauguuauccccuuucccaguuccccucccucccagaaacacccuaccacguccucccucccccuacuucuaugauggucuuaagaaaugaaagccuuggaaucaggaaacucuuauggcugacaauaagcuuuguaccgugcugcuugggaccuugaccuaagugguggcuuucaaacuuuaauguauauuacaauugcaauguccuagaaagcuaguaagggauaccgccuguaucauauagcuuuagcuaccccaccuaagcaccaggaacagaccgugcuaccagccucugcccagagaauauuggaugaaaaacacagacacacacaguuguucaauuucaacuugccuuuuuggcacaguugcugggaguuacuuaucucccgccuggagaagcgugccuuuagcuccacaccucuucaccugcccucaacuuugguugcucaguuacaucucgucccagcuaaacaucccuaauggcacaccuguaggagcgcccuguggagagcaaaguguuacguuauauaaauuggauuuucucuuguauguagacguuagauauaauauuaaaaauaacgucaaaguagaagauggacaaaagaaagagggacaguaguuuuauagauuaauacauucuaauaaaaaagggaauauuuuaaaagcaacaacaacaacaauaauaauaacaaaaucuagauacccaagucuuagauugcagagucuuccuuucucagcaacugacuuaagagggagagcuuccugacugcagccuggccucccucccucccucccucccucccucccucccucccucccagaacgcuguucaggugccaggacauacauauacuugaaagcccuagcagccuagcuuuuuaagucugcuccuggccugcauuuuuccaccucuagucugucccagacaccacagucagggucuuuuguccccuuuaggucuuagugacccuacgagauguugugaagagaaagaagagagugugugcauugugcuuaucucagaaauuaaaaucuuuucaguccuugacauuuuuucuuuauuucagaguacauacauaugcaaauaauacauaugcugcacuuaauuacuguacuagggagcaguaaauguagcaggcuaucguagaaagagcuaauuaucuucauuagccuugcauuauuccuuaccaaguuuuacuuuccuagauaggccuucccuugggcuuggaucuugugagcaauuuucaugaguucugcagaauuucugggucucccaucagaccgcuggugugccucuaccacgggagcuguaccugaaagcauuuuacauucuggguuuccaaacauguguuucuuagaagaaggauucuuuggccaauauggguuuaaauaguuuacaaaccuguguguuuuacagucauaauuagggccaagaguuuuauuguauuuggugaaauguacaaacuucuuaaaacuuauaggaaccauucagacuugccugugauucuaugcgauaacguauuuugcuuccagggauauaaacauagaauaagcuucuuuaaggauuauuucuucuaauuuccacuucuaaguugugauccuuccucauucuaacaagaucauauagcuaugcuccaaaauggauaccuugcuugugugcuuguuuugagauagaacuuugcuacauaguucacaguggucuagaacuuggcauguagcucagaaugacuugaucuuacaguggucugccuccgcugccguagcguugggcuaguaggcuugugccugucacaugauauucccugccucuccccauccuuuauuuugcacuuugacuuauuaaaauguuuagaaagcuaggagaguagaugcacacagugguucccaugguaacagagcuugguacuagcaaggucaugguaugccuucuauccauguaacugccaggcucacaaguagaaauggauuccuguggcauuccuaguuuuggccagugcuauaccagaagcccagagaacauagaugaaccauuucacacuuaggaccauuguuugacucuccaaagcugggauacuggagucuucuuuagaagccaucaacaccucccucauuugaaggccauuuguuuuugaaaaagagaucuguuuaguuggcauaucuguaucagaaaaggauuuuaucaacaagucuaugcaggggucuccccagcuccucuccugcacaucuaacucauugguucccagacuuccuaauguuaugacccuuuaauacaguccuucucguugugguaaccccaaccacaaaauuauuuuguuacuacuucaugucuguaauuuugcuacuuuuaugaaucauaauguaaauauuuguguuuucugauggccuuacacaaccccugugaaggaguuguucaaccacagaugguugugacccauaggugauguaggggaaagguggccuuuucuuucuuacucuuggcucaguauugaauauaccacgaauccuucuauacacuugucuaucuguccauucuguaucacacacacacacacacacacuguuauaagccuuugagccucuagcauagcucucacuguguuaaaauacaaaugacaguacuguaguauaccuucuugagaucacaagagacaggcuucucugcuuugccuaagucauggauccuuucuccaucuucaaagcuagcaguagcuggccaaggcuuuucaugccacacaccucaggauagucugcuccuguccccuuuccauaguuaagaaccucaggaauacauuggcugcaccaagauaaucugaacaaucauuguauuauagaguuagccaauuacuagcaaucuaauguaugcacaugauacaaugugcuacucuaauaccucuuugacaaaaugcauucacaguuuccaggaauugagacauggauauuuuuggaaggagggucaauuuucugcuuauuacuauguaaaucaaaaagaaagaaaaugaacaaaaaacaggguuaaaacaugagaaauggguacuuccucaaaauguacaguuaugguauucuugaacaaaccuugaaaauccaaaguaaaauaaguaggacuucuuucaucucaugacaaccccacagucuuaaaguaugaaguaaugguggugauuuugguaggucugaauugugcugguccugaagucaaucuaugaacccuugcuuucaguuucuagauggcaaagaaauaaagcaacugaauguccaguggcuccgagcucaccuuggcauugugucccaggagcccauucucuuugacugcagcauugcagagaacaucgccuauggagacaacagccgggccgugucucaugaggagauugugagggcagccaaggaggccaacauccaccaguucaucgacucacugccugauguacgucucucuccagauuaagacuacccaaaaaaguuagcagccaaaacacauccacauguguacacagaucuggccacaucucccuugccugcaagguguuaaguauacugauccugugaguccuggugaggcagaagcagugugacauccauucaggaacuguauaggaggaggccugguauagaccuacagcuucaggguuggaggccccacccuuucagggggauagugcucuuucuucaagucugagugaaggaccaggaguccauaucuguaucuccuaauucugacaaagugguccucagcauucuccauuucuguuucauccaucacuuugcagcucuuucacaaacuucaagccuccuucuggaauuaggccaggcugaugacuggacccagggcagaaacaggccucucuaauuagagcugagucguugagaagaccaugcuauuguacaauuucuuaccauugagagugucauugaccccagguuauacuuaauguugguuauuaaaauguuuccuagguuuaauccuaugcuggcucuaucuuaagcucucaguuaucuuaauuuuauuguuuuuaaucuuauguguaugggucuguuaccugcaugugugccuguauaccacauucaggucuggugucuacagaagacagaaggcaucagaaaccacgggaugggaguuauagacaguugugaacuacuguacguucuggaaauugguccucugaaagaguagccaguacuuuaaaccucugagcuaucucuccagccccaaguuuuacccaaauaauauacccucuuucauuaucaccuguaaaguugcuauuacaggaaaugcccucuauagaauaggcuuuaauagccucagaccugccaggauggcagaggccuuguaggcaaggagagcaagaacaaauggcccuagcucuucccauguuaucccuugucauguggcccuuucacagauaacggcuccuucugagcacaugaccuggaaggagaucgguccccuugcucuccucaauguaguccagccaugggugacugacuuuugaggcugagacacucaaaguacaagccuacagaccccuuuacuaaaugagguucacuucuugucaaagccugaauccucacccuagaaauugguagaaaagcagauuuuuuuuucguuccuauauuagcucuucugaagaaaaaagaaagaaagaaagaaagaaagaaagaaagaaagaaagaaagaaagaaagaaagaaagaaagaacaaaaacaggucagccaaguccagcaauuuguuauuuaaacugcaggugacagugauacagaguagccggcucccaagggaccugcuuuucuggacucccaucacucugacacuaagcccuaucucuaagcaucuccugcugagugguuaguccuagacuccaccuuacuaugcuccagccuguguccuccuccuucccacagaguuaacugcaccaucuucucugcucccuaaggaucacuggucaguguggucuggcccugcacucaccugaggcaggacacaucagagcgcuggaugcuggggcagcuuuagcucaagagccuguuccaagcauccuucuguccucaccagagcccaucuccuccacagauguaggccuugcucugccaaccacagaacuggaauuaccaaaaaaaaauaaauaagaauagcacccuuauagugagcauggguuuuauagucaagucacaagaaucagagcugugugugugacuaauucuaaccugccacaggccuacaaauaauaaggcaguuugcuuucugcuuaaacaugcuguaacagccucuccugcuuucugauguuacaccaucuuuaggccaugucuuugucauuguguauaauaauuugugacaguucucuauuguugagaugauagggaaaugguuugacucuagacuuugauauagaaggaucuguuuuaagcuuaguggaauuccucgacacauuaaaauuguuuaaaucuugaagauaauuuaauagaaacacacacacagagacggggcagggguuauuuccuaaggauuucuuugccugguuuaaucaugcagaggugucacgugcuggugacaagauguuucuguuuuugugagcagcuguucaaaucauuuccuuucuccuaccaaucuuuguuacaaguuaaaaaaaacacacacacacaggaaaugaaagauaauggacuugccauauucucgaauagaggaagcugaacuuauuuacacuaaagcauauaauuuuggagcccagauauuuguuuucaaaaagaaacauuaaacuacccaaguagagcuuuucccuaauuuguuuagcuuucugggaaccuauuuuuagccucuaaauaauuuaucuaauuauccuauuugcugugcucaaacuguguuuugugcuucgccaucagcucuguuucuguaacgaccaaauuccauucacagaaauacaacaccagaguaggagacaaaggcacucagcugucgggugggcagaagcagcgcaucgccaucgcacgugcccucgucagacagccucacauuuuacuucuggacgaagcaacaucagcucuggauacagaaagugaaaagguaguaauuuaaguugggcuuuuucucugccuuagaagcgaacacagcuccagauagcugauuguugcugaugguggcucccagugcaguuuaacgugucugcagcugggacuuaggaggccuucagugauaagaggcagguuagucauggacccuguuuuccacagugcucugccuacaagcugcaugcuggcugcagccuaugaggcgcuguaggugagaguuggaggcugacagugcccuaagacagccacugcugcugccuugcagccugagaaagguuaagaguugagcuaucugauggucaagagauguuuucuaccugcugugauggcuuugguuggugcucuggccuccugcaugugcuggagagcugggcuggaggacugccuugagggauguuguguggaaaggcacaugaguguuuuuaaauggcuggauagaguguacuuacugcccuugccuuaauauuagauaccuccugucuuagaacucauucuuuuuuuuuuuuuucuaaugugguaaacuccuuagucucuaaaguucauguuguaguucaguuuuuuguuuuguuuuuuacaguuuguuaauuuuuuauuguacaaaauaauugacuuuguuauacuuuauguuuuuaucauuuauuuuccucauauuuacuuccugauuuccuuucuccauccaucaucccacagaauggcucccuuucuauuuucgcacuaaaaauauauguguuauuaauguaaagcaugcaguuacuguuacgccuagaaagaaaacacaguauuuugucuuucuuacaccuccguguccucugcucuucuccucuucucccugugaacccuuacaaguaccaccgagucucccuucuauguuuauaucauauaucccuuuaaauggaaauucugcauacgggaauccacgcggcauuggucucccugggucugguucaucucuuuuaacauggucucuccaacuccacuuuccuucaaauggcaccauuuacuucucccuauggcaaaauaaagcaucauuguguauguguuccacacuaucuuuauucauucaucuguucaggggcaucuagccuguuuuuauaugguagcugugacagauaauguauaugcucagauaugcugauauccaugguauuguggcuuggagucuaguuacauacccaggcacagguacagccgauuaugauucugucuuuguuuggaggaucuuccacacugauuuccauaguugauguucaguucucauucccgccagcugcccgagggcucuuucuccuccccagggccagcaugugcugcccucuguucucuuggcaucaggcauucuggcuuccaugagauagaauuuguguaguuuuaacaacacaauugaagaggacauaguagauaaaucccaggucugguuauggagggggaauuauaggaagaggccuguuuuuaucauuaauucuuuggugcaauugugaaacagguuguccaggaagcgcuggacaaagccagggaaggccgcaccugcauugugaucgcucaccgccuguccaccauccagaacgcggacuugaucguggugauugagaacggcaaagucaaggagcacggcacccaccagcagcugcuggcgcagaagggcaucuacuucucaaugguccaggcuggagcaaagcgcucaugagcugugacuaucugaggugcuaaguauuuuuaauauugguguuuaaacauggcaccaaaccaaaguuaaaaggcaagggcuguuaaagguaacuccaucaagaugagaagccuuccgagacuuuguaauuaaaugaaccaaaaucggaaacaaacaaacaaacaaacaaacaagccauaguuaaacagggccauguuuuuaauugcauuacgugauucauaagagaacauauaguuuuuuaaaauaaaauguauaauuuuguuucaguuuuuaauuucuacccuacuuucuuaaaugauuauaaagauuguaaaaagcacuauuucuuaaauugccuauaaaaauuaaauuuucauauaauuggagc

SEQ ID NO: 2345 - RNA, 1564 nt, Mus musculus
uucaugacuuuguuuaaaacuuagcagacaagacugcagaaaaacauccaugugucagggucuaaagcugcaucuuagauuuuaguuggcaaagaccacauuuagcaaaucaacucuuuagucuuccacguacaagccagagacguacuaaaacuguaaaaaagagaaaaaaauaguuucuuauuguucaaaaauaccacuuuauguguaaguguagaaaaaaaugcauagaucuucaucgaaagagcuggcuguccuggggaaucauucacccuuuccacaguacugaggcgaguuacuggcuaugcaguagggcucccuugcuacagcacuagaaggcagcuauuuagggaggaggcaggaaaaggagaaaggaauguacguaaggcauacuguaaaggaacaagcguaauaguguuucaggaagaggagagaagaauuauucaaggcuagcuugggucucacuggauaaaacaauggacuaaauacugcgcuccugugugugacucuaauaaucaaugcccuggucaucgccauacugguacccucgaggguagucgucuggguacucgccgugcuauucauugggguauucugccugauaaucgcuaucacugauuuccgacccauuggugcccgugcccuggcuuccgcugugaaugacagguucugugggugcggcacaguacuuggggucauacacuugccgcccaagccaauacacacucauuccuuucugggaagcaacuuuguuggugcccaucuguagagaaauggucaaguuguccacuggcuguaaugucagcuucuggucauagaugucucuucugguaccuggugcuaacaucccagccuggcuggccccuuuguuggugcccaucugcaggcuaaucguggucuggucaaaggguuucuccgucugcaucuugggaccauaaagaugccuccgagucccauaggcugucaugcccgccuggcuggcacauuuguuguacccaucuguaaaccaauuacacucuggucagccuuuaauuugccuucaucaaaacgucuuguuuguuuuucugcauacuuaacgccaaugucaaugguuguuuggaaucuuucuguuuucgccagacuugcuagagccaccagcguagccuggaucauguugccauucucaaagaggucguuugcuucaaauauaucauggggcuucauaccguaagccuggauagcuuuaaugaaguugccgauauucuccaacugcggccaauuuagugaggauucguugacuuucuucacagagccuggcuguagcuuguuuaugaguucgcacaggaugaugcuguccuucagccccagcuggaaguuguugccaaugucuaucuaugccugucaccucuucuuuucaguugugcagaucuuccucagccugcuguucauacuuggaugcgaucuuguucuuaacuucggcggagagcccguaggaagggcccuuguugaagugggcugcgcucggguucuaguggucagucaccuucggugucccugcucuuggccccagcgguggccgcguggg

SEQ ID NO: 2346 - RNA, 1270 nt, Mus musculus
ccuucacuguuuuugugaguuugguaaucucaccaaaccaggccuuuaugcagggucuuuaacacugagcuacauucaagcccugcugcaaguuucucuucuuccugguuuuguuaagcagaaacggugucuccaugaagaucuuggcuucucauaaaaagaaaacaaccucgggacugaaaaaaaucaguagaaccuggagaaugugagaaaaaugaccaucucuguaaaacuguaauuaagcagaguccugaaaauguuuucuaccaaauguauaauagauauuuuaaugucaaauuuaaaaucgguagcacucagauuaaauuugaacaagcuuguauuucuuagcucaggauagacagaucuugauggcugaggaagauauugcaagcuuuuggaguaugucuuauagcaacaacuugucccaagucuuaaaauugacuauuaaaguuauauaaaaaaucauucgggcuggagagauggcucagcagguaagagcaccaacugcucuuccagaggaccugaguucaaaucccaacaacuacaugcuggcucacaaccacccauaaugagaucugacucccucuucuggaguauccaaccggagugagcagaggucuaaaaauucaauucgcaacagccacaugaaggcucacaaccaucuguacaguguacucauauacauaaaauaaauaaaucuuuaaaaaaucauucauuuauguguaugaagggauccauauggacccaggaccccagggcaaggggcuaccucuggcuagagaggaggcagauguggcacauaggcaaaugacagugucaagucaagggcaagcccugagcuaggaugagguguugacuuucauuagacagauuaggucagucaaaggagcggaggguugauagcugaaccgcaauacuuugauaacuagacuuugguaguccgccucaggagagggaaaugaccaaauaagggaauagaccuuguuggcuaguuauaggaauaaaaucuaauaguuuccagcaagacagugggaaucagggagaaaggcaaugccuaccagagccaugugugacaugcucgggcuggcuagaguccauucaguguagcucuuucuccauacacuaccaaauuaaaaggaagacuuuuacagacugccgcagacccucuaagucccuuugucugcauggaacgggucucuggggcagauggacaaagcguuagagggugacagacagaccaacacaugagauuguguagaaucugaaugua

SEQ ID NO: 2347 - RNA, 1076 nt, Mus musculus
agcuagcaagucuauuacuucccuggcacuacagacuccuuguguguaauuccaucuucuacugaagaccaaguagagacauccauccucaggaacugagaacuucugaauucuuggacuuugcuucccauccagcuguuguggaauaagcucaacuacacucuguaaguaauucuaauaaauccccuuccaggauuuuugggaucagauugggcagaaucuugccucuuuaggcaaugcaaauaggugcuaggauuguggguuuaaaaugcagcuuccuacagugucaugguuggguggggucaaggaguauagaguacaauuaauuaacuggauucuucucugaaucagaaggucgaggacuuaaccucagugauccauggaaaaagguaagaagaugaugcaguccuucccugguuuugucaaggauacaucagauauugaagaaaaugcacugcagaguccacuugucuugccagcccagaauacaagguguuccaagucugagacacuuuguuuaagcaaagagcaaagccacugcucugaggauggcuggguuuuagaaugggaaauuuguguguuugagagugugaacuaccuggauuucuaccacaaauuuaauugugccaugaagaagagcacagaagucuuccagagugagugucagaggaaaucacaaguguccccaggagauguggaaaaugacaaagacaaagauacagaggagcuagaccaacccucaccaagcuugcucagggagaaaggcuggaaguugagaccugugaugguggagacugcccugacaaggauccugcuucuuacagugccaggcaccuaggcugcugggcauggcuucaaagagcuuuucgccagaagaagugagaaagccacccagaacuguuuggagcccagaugccuguuaagacuuacaauuagggaauuuucugucagcuccugcuguuacagcauaggcacacaaaggcaguugugucuucgcagccaucugguuuguguuuguuuguuuguuuacagcuuucuuaauaaaauuguuaaaaagcugaaaaaaaaaaaaaaag

SEQ ID NO: 2348 - RNA, 974 nt, Mus musculus
caucuuuuuuuuuuuaaguguuaaauacucuuuauuugauaucauacauaaaccacagcaaaugccuuucaauaguaaaaggcagcauccuugauguagggaauucuaauuaaaacugcacugucacgaauagauaguugccuccuggugguuagccaugaccugaaagaggccagugaacacaaacugaaacacauuugagucuucuuguuucugagacagugauagaauuuucccaguguuuaagcauauucauaugcccaguuauauaaaucuaaguauaaaaccauuuaguagguuugaggugacaugccccuauuuauggaaaguaaaacauugcuaauuaaguccaaucuuaucuugagaaagggagagccgugguagcauguauacaacuggaacuguugcuuuaauaaagaccguacccacuuuaugacaagucaguuuuacuuaaaucaggacuguccaacaaaaacauugcuagccauucaugaucugaauuuggugugugaauuaaauuaugguguacauuaaaagccaugagacauuuguuuuguaauaaauaaggcaguggaauuacucauuaguagccuuuuuaagauaagcuauuaggucugcccuuucucccuucuucuuaauuccagcgaagaucauuuuuguuccagggauguacuuuuugggauucuccaaauacuccaucaggguauccucuccccaggugaugccuuuguucuuguuggcaucuguguaagagaauccagcagccuggccugucuuccgcccgaacagaccguggagauuugguccagucuuaugcuugccucccuuuuccacaguguggcacugggcauacuucugaacaaaaaucuucuugccuuuuucaacaucacucauuuuuaauucguuccgggcuggucaacaccgcgaacguucggacucgaagacagacgucccgcgcugguaaacaacaucuu

SEQ ID NO: 2349 - RNA, 8881 nt, Mus musculus
ucuugcucuugcucucuugcucuugcuccugaagauguaagcaauaacgcuuuugccgcagaugauuccgguuuguugagucuuuccuggccgguugcgaacguguguaagagaaaggauuugugauucuauaagaaugauaccucagauucaaauaauaugcaacaguagagagcauuuacucuguagagaaccugugaucggggaucuacgguauguugggauggacgacggagggguggacuuugcagggucaauuuaaagucuguuuggguaggcgugagugacuuuuaccuuucuuuuccuagauugguugguucuauugccaugguuauaggugccuucaugauugguuaaggcucugggggauuuuggaaaguuuugcugauuaaauguacuuggcucaagacagguagcggggcagugucuauagcuccugauuggcugcccaugagguuagcucaggcuagguggugggguugcuuccugauuggcuguccaugaaguguuuuuuccaggaauugacuuguuuuggacuuuuccaguucugggaaacagaaacuaagaccaugucucccaaacugcuaguuugcagccugacauagacagucuaacucugacuaacucuguccucuccguuuaaugaucaacuuuaucugacacuugaaaaugcauaauguuuuacauagucauuuccagaaaggagacucaaauggcacacuucucaaaaaguuuacgacucccaaauauuacccaaaccaaacacauuauaugaaaacuucaaaccaauaucuuucacagauauaggaaaagucacuaaaaauuaguaaaccuaacaauuuaguuaguaagacuaaugaugcauacacaacauaaaacauaagaacuuguaaaauugucucagcacuggaaaaucugucagucaauuugaucauauugagugccuagagagacuagaugaucaucccauagauacagagaagguauaaggcagaaggacgcuucuauuuauguuggaaacucagaggcaacuucaguagaaaacgaaauauuuaacuuaguauagaguaccccuguagucauacugcaauucaaaauauuauaacuuaaauaauaauaauuacuuuauuauaagaauuagaacgaggaaaggguaucaucccgucucuuaucucuccucaguaacaugcuugaagaagagagaaagauaagaaaaauaagaauaauagaaaagaagagacacgauuucuuccuuuguagaaaucaaauuaauguaaaaaaaaaaaaaaucccaaagaauccagagucccacagaugucaucaugucaagauugaaagauacaaaguuggccagacggagguuguuagcauucuguauaaacuccaccucacaguuaucuggcaacaggaaggcaggccugacccacuauaaaagggcuucuuaccuccuccucucucucucucucucucucucuuguuaccuucuugcucuccugggcucuugcuuccuugcucuucccuucgcccccucucucgccauuccucccccccccccuucaaugugcuuguagcuggccucuacuucucuccuccucuuccuccucuuccuccucuuccuccucuuccuccuccuccuuuucuucucccuccuccuccuccuccuucuucuucuuccucucucucucucucucucucuuucucucucucucucucucucucucccucucguucucccucuaccucccucuuaucuccccuccccaugcccugaaucaacucuguucuauaguauacugucaugugguugguccuucaggggaacgggauacguuggcaugagcccccugagacguucccuucccucauacuuaaucacgcaccccuuagaacauauucuuucaccuuauauuuuauaaacacaucaguggugacccacaccuuuauuccuagugcuucagaggcagaggcaggcauaucucugaguuccaggccaaccuggucuacaaagugauuuuuagggcagccagagcuacacagagaaaccaugucuugcaaacaaagugcacagaaagaaagacagaaaguuaacuuucaaaauguuaauuuuaguaaaccaaaaauuaaaauguaggaaguaaaauaaaauaaaccacaauauugugugagcuucaaaaugaauuucaucuguguuaaucaaacuaaucauuuucaauauauauuuguaaaaacuauaaaacaauaauagaguaauaaaguuaauaaauugaaagagaucucaaguuagcaaaaaucuaaccaggacagugaugaucaguuaaugaacaacagauuagcaauguugaaaggaaaguuuuuuaguccugcuacuaagaaacuugucacuuauaaucacugauaucugacucuuggcuuaaacuguauaaaaaacaacuugaaaugcauaacauuucauuuaggauuggaagcuaaaauuuaaaucaaauaaaagcaaagaaaaauuucaugauauuguucuugauaauaaauuugauauaaaauuacaggaacuaaaagaaaaguaaaugagauuacacugaaugcaaagcaucuacugagcaaucaacaaaaugaaaagcuugccucucugauggcagagggcaaucagaaccauagaucugaucaauaauuacauaaacauaggugguaugaggaacacauagaauucgguaguaaaugaacaagaagucucacugauugguucaaauugauuuguuuuauaaaaccaaguauauguucuguaggguaugguaagguguggugggagggaguaccucagcaggcccaugcugagacaucccuaccuccuagguaccagccauaugaugggucuaguaaagaauagaguuuauuugggcacaugggaagggauguugagagggaauagaggcgggggggggggacauaaaggcggggggagggggagagagagaggaacacguggugagaaagggggcagaggaaggggaaagagggagaggggugagagagagagcaaagagagggucagagagagaaaaaauggcagaaagucauaguuagagagagagggagaggccaagcagucccuuuuauagcaagccaggccuaccuggcuguagcuagguaacuuuuaggaagagcauagaaggaaugcugacacaaaugaacuaaagguaucucuuaaagcuauaaaaaugagaaacaaguauauauaauaauuacucaacaucacauguuaucuaagaagaccaauucaaccacagcagcagcaucccacaaacaaugagugaaguguuggugagcuuauagacaaaagagaccuccacagaacagugauggcgaugugaccuuguacagacaucuugguaaacaguaaugaaauacuuaaaaacaaacaaacaacuacaguaugcauaauuaauucccauuucugauguuuaugaaaugaaacgaaguucccaucuuucaucccagcucaggauuauggugaaaauaagagaaaccacuaucucaaagaaacaucuguaccucuugcucacuguagcuuuauguuuuuguuuuuuuguuuguguguuuuuguuuuuguuuuguuuuguucuguaauaucagaaaugugauaacaacccagauauucaugauaacaaccucaguggagacucuaaauagaaaauaucguauacauguagaguaaaauaguguucagucauaaaagaagaaaaucuuaucauuugugucauagagauguaccuagaagacuuuagaguaaguggugcaugccuuagucccagcacuuagacaacacaggcagggagaucuuugcagauuugaggccagcaagcuccacagagcuaauuuuaaggcagcuaucgcuguuacacagagaaaucuucuuuugaaagaccaaaguuaaaaaaagaaagaaagaaagaaagaaaaagagagagagagagagagagagagagagagagagagagagagagaaaggaaggaagaaagaaagaaagaaagaaagaaagaaagaaagaaagaaagaaggaaaaagaaagaauaccagaagugagugucgcaauauaauuuuuaaaaugccauagauuggaaguccauuguuucagacagcaaugcugaccggaugaggauuucugaagcaccugugaggccuugggcucaaccccuagcacugaaaaccaaccaacaaccaaaauaaucgugucagguccaaaagaaagugggggcccauggcuaacugcauugucuauuagcauacugaaucacugcacauguccaggcuuucucaaagucacaaugagcuguggcucuuuuuaccccacccccacccuaagcuuuuccauccucugggcuucccuuccuaggaaauucugccuuuccacauuguggccaugucuucucuuguuccucuucuagcuucuucucuuucucucuuaucgcugcccucacucccucuccucucauugccaccuauugcuuucucucccugcuuucugcucuuugagauguuucuggcuguauguucccucguagcuacaaugaaaacauucccaucaccauaacuuggaguuucaauggucauggauuugccuuauacaaauugugagcacuuccucuaugcaauaaaacucaugucagagaaacccugaacuaucagugaccaaacucucaaguucaggaacaaggaaauaguauauuaucucaugaauuuuauuccaauuaaguugugguucuuuuuacaccuaaaacaaaugugaaccagaggaaauuggauagugaaggcuucugaaucuacacuucucucucugccuuucucugucucuaccccuucaacuccccaccccaugcucugaauacucuauucuauacuauaccucauggggaaaggaugccucagcaugggccugcagagggacccccuuccuccacaucuuacugcaccuccacuacacauguuccuucucuccuucucuuuuuaugaaacacaacaaccucuauacagaugugaauuauuauuuagucaacaagaaugaaauccuguuauuuucaagaaaauggauagaacuagaggaacauccaguauaaaccaacauaugcugugcauuuggaaauacaacaugaaaugucauucauagguacaaaaaucacacaugcuaauaccuuaaauaauaauaugcauaaaauucuuauuugaaguuauaggagggauuuuguggacaugauuggacaguguguugucuuuuauaaaaauaaagagaucagagauauguucgauggagaugugguaaguuguggggucaggggucgccucuuggacacaugcugaggcuucccuucccccugagauaccagucacagaaugguacaguauagacuagagcuuauucagggcauagggaggggaguuaaaagaaaggcagagaaagaaaagaggaggaaagaaagggaaagagagagaguagaggaguagagaccugccaggagcauguggagagagagggggaggggaauggggagagugggagaagaggguaagggagcaagggcaggagagcaagagaaggaggaggaggcaagcagccccuuuuuagugauucaagcacaccuggcaguugccagggaacugugcgguggagcacccaaugcagacacaguggguaagggggugugacuccaaccuggaccugaguuugaucccuguaacucacagaaucuaaggaaaaaacuccaauaagauuucaaauaaugaaucauuauccacaaauuacaaguacuaacuccacuguauuucaaaguaaacuguagucuuuauguuaaaagccaaauggcagcaagcauauaccuucuagaaagagaaaacuggaauuuuguuuaaaauucauguaaaaucaguuaaaauagggaauagaaaaccagagcacauacaaugagaaggguucaggaagccgauaaacgcagggagaaacugggaaaacuauuaccaacagauguguauguggaagacacaaaagaguggugucagaaauguguuuuuaaaguaccaaaaauaugcaaauacuauaaaaacgugcugaccaguccaucuaaacuaaaacuacuuaaagaauucauaaaugugucccaaauuuguaaauuaaaaauauacuuccuuggacaaaauggcagccuacagaaugggaaaagaucuucaccaaccccacaugugauagccaauauauauaacucaagcaacuagacaucaacaaaccaaauaauucaauuauagaaugugguacagaucuaagcagaauuuuugacagaggaaucucuaauggccaagaagcacuuacagaaauguuuaacauccuuagucauaggaaaaaugcaaauuaaaacaacucugagauuuaaucuuacauccaucagaaugacuaugaucaaaaacucaagugacagacuucucaugccugugaggauguggaauaaggggagcauuucuuuauugcuggugggagugcagacuuguauagccaaauuggaaaucaauuuguuaguuguucagaaaauuggaaguaguucuaccucaagacugaucuauaccacucucuggcuuauaaggaugcuccaucaccacaagaacacuugcucaacuauguucauagaaauguuuuuaaauaauugccagaaacuggaaacgaucuagaugcuccuaaucugaagaauggauaaagaaaaugugguacauuuauacaauggaguauuacugagcuacaaaaaccaaugaaccaugaaauuuggaggcaaaugaauggaacuagaaaaguuuauccuuagugaguuaacccagacccagaaagacaaacaugguauguacucacuuauaagugaauaguagcuauauaguaaaaaaaauacgaagcuauuuggucuauaaucuacagaccaaagagucuaaguaacaaggagggcucaagggaggacauuguugguggaugggggagaggggacugaagugggagugcagaugcggacaggaagggucagguaggggagaggaugggaagagagggacaacugggagaaacaacuggaauggggggcaucucuaggaggauggaagcucccagaaauccacgagagugaacuaguuaaaacugcuagcaaugggggauauggaacccaaaccagucaucaauugcaaccagggaagacuuccaauggaaggacugugacaccaaccaagguauaaaacuuuggacugacaauuuguucugacuaaaagacaugcugggguaaagauggagcagaaauugagggaguggcuaaccaaugacugguccagcuugagaccuaugccaugaggagcccaccucugccccuacaaaugauauucuuuuauacaugcagacaggagccuagcauaauugucaucagagaggcuucacccagcaacugauggaaauagaugcauagacccauagccaaacuuuagguggagcuuggugaauccuguugaugagggagaugagggguuggaagggccaaagggcucaaggacacgacagaaaaaaacccagagucaacuaaccugcguucacauggggaucauagagacugagccacccaucagggagccuccaugggccugaccuaggcccuuggcagauauguuacaguuguguaguuugacuuucuuguuggacuccuaaaaauagaaucagauccugucuccgacuucuuugccugccuuugugaccaguuucuucuacuuggcugccucuucuaucugcaauagaagaggauauauuuugucuuaacugcaaauugauguggcauggaagguuuauauccauagguugucuacccuuuucugaagauaaguggaagaggaauaagcauggagugggauaaggggaggggacugugaguagaggagggagggaaaacuauuguuaggauauuaaacuaauaaauguauaaacuaguuaaaaauauauacuuccuuaacagaacaaggaaaucuuaaaauugucuugccaaaauuaaauguuucucauuaauuacugcucuuuuugggggguggugugaucagaaucucauguagcccaggcuagacuccaauuucauagguagaugaggccuuaaacuuugaauucuccucccuucauaccuagagugcuagaacuaaaggccugccaagcaagccuuuaugcgguguugauagcuaaccuggcguuuuauauaugcacacuaggcaagagcucuaccaauugaucuauuugccuaacuguuacuguaagacccccuuuuuaaaauuucuuuuauuauuucacuugaaaaauggaaugaaguuaaagguguccuaauggauguuuaacucugcccugugugauucacuaugaauaggaauucuauggauaggaauaacaguguucauucaaaggacaaccagcaugucacuauugacaagucacuuacuucgacuauuuucuguuugagaacagauuguggaaaacccaggaccacauggaaauaugcuaucaaaaaggcauucccauggcuguuccuacagauagaagaaggcuuacuuggagaaaacccagaguucucuggacauuucuuugaaaucaagucaaaucuuuucuuuugucuucaaggcugaggucaucuuuggcaagguaaccugggcugguguuuucuauguguagugacaagagcugaauaggaauccaugaauaggaauuccugagauugccaggaagaagccaaggugcuuuggguuccugcuugugauaacuugaguucagucccugggacccacaugguagaagaaucauuucugaagaguuauccucugaccuccauaugagcucuaugg

SEQ ID NO: 2350 - RNA, 1520 nt, Mus musculus
acaaugauugaacucgaguuggaagaggccaguccggucucaaaauggagggccaugauccaaaggaaccagagcagcugaggaagcuauuuauugguggucugagcuuugaaaccacagaugauagcuuaagagaacauuuugagaaauggggcacacuuacagacugugugguaaugagagauccccaaacaaaacguuccagaggcuuugguuuugugaccuacucuuguguugaagagguggaugcugcaaugugugcucggccacacaagguugaugggcgugugguggaaccaaagagagcuguuucuagagaggauucuguaaagccuggugcccauuuaacggugaagaaaaucuuuguuggugguauuaaagaggauacggaagaauauaaccugagagacuacuuugaaaaguauggcaagauugaaaccauagagguuauggaagacaggcauaaagaaaaagaaaggauuugggaaaaagagaggauuugcuuuuguaacuuuugaugaucaugacacaguugauaaaauuguuguucagaaauaccacacuauuaaugggcauaauugugaagugaaaaaggcccuuucuaaacaagagaugcagucugcuggaucacagagaggucguggagguggaucuggcaacuuuaugggucguggaggaaacuuuggaggugguggaggaaacuuuggucguggaggaaacuuuggugaaagagguggcuauggugguggaggugguggcagcagagguaguuauggaugguggauauaauggauuuggaggugaugguggcaacuaugguggugguccugguuacaguaguagaggagguuauggaggugguggaccaggauauggaaaccagggugguggauauggugguggaggaggaggcuaugaugguuacaaugaaggaggaaauuuugguggagguaacuaugguggugguggaaacuauaaugacuuuggaaauuauaguggacagcaacaaucaaauuauggacccaugaaggggggcaguuuugguggaagaagcucaggcagucccuauggugguggcuauggaucuggagguggaagugguggauaugguagcagaagguuuuaaaauaaaacagaaacggcuacaguucuuagcaggagagagagugaggaguugucaggaaagcugcagguuacuuugagacagucgucccaaaugcauuagaggaacuguaaaaaucugccacagaaggaacgaugauccauagucagaaaaguuacugcagcuuaaacaggaaacccuucuuguucaggacugucauagccacaguuugcaaaaagugcagcuauugauuaaugcaauguagugucaauuagauguacauuccugaggucuuuuaucuguuguagcuuugucuuuuucuuuuucuuuucauuacaucagguauauugcccuguaaauugugguagugguaccaggaauaaaaaauuaaggaauuuuuaacuuuucaaaaaaaaau

SEQ ID NO: 2351 - RNA, 1615 nt, Mus musculus
uguaugaaugagucugggguuucuauagagucaaaagaauauguccgauuuacccuuuuuacauguaucccaugauuuagggcacucauuagcaaauuaagggagugaaagcuuucaccacaaagccacguucugggagcacaaauacacgacacuccuguaauccccugcaguaaaguggagccacauugcucauucuuagcaacgaaaugugucauuacuaagauguacucuucggaaguauuucucuguucuauauucucccuuaauucuaccuguagggccagaagaucgaaaagucacaaauguuaggaaauccauggacgagaucaggccaugaaucacuaaggaguggggugcuugcuuaaggguaaugaauaaauaucaaccugacuagagagagaagagcugcaguguuuucaugcucaaaaguucaaccacucggauaaguucucaauggaggaaagguuuccuggggagggaaaguuggcuccaugccauugcaugaaacuucugaugaccacauaucacucaagugggaaagugggaguuaaucuuuguucucuaguuaaaaccuuaaaugucccuaugcauuuggaaaacaugggggagaaauugucaaauucuccagaacaugggguuccacagucaugagcagaauuuggaacaaaugguauaacuacucucaggccuaauggagauuacuuugaaaagucuuauuauucacggaaauauucccaugacucuuaaaucaucuaccugaagaucacauuuacucaaugaaacuuuuucaagauuaaucuuuuaaguguccuucaaaagaaguaguaagaauuuugaagacauagaaauuauggggcaaaauaaaauuauuucuccuaaauauguaaauaaacugcuagcucugcaagcuauauucuaccuuaucuaauuaauuuugauuguaaugcaccacacacacauacacacacacacacacagagccuauaaggccugaauguguuauagccuauauaauaauauuauguuggauacucaguaauaucugaaauaaaauaaaauaguaccagcauuagauaauuguacuuuuuuauuugugugugggcaauaugcauacaugugaaggguggauaugcuugugcacaaagccaauguguauguauguauaaauauauaaaaacaaauauguguauuuacauaaauuaaauauauguaaauauauuuacacaaugcuuuaauaaaaagaacauaaaggaaacuaucucauuuuaugaugucauuuguuguauuuuauuuuauaaaguaauuuuauuuuuagauaaucaaaauuauuugaacuucuuccaggccuuuguucaauggucacaucuuucuauugaaggaggauaugauuauucuugcacaucuacauccaugagcuuuucaauuuuguucguauguaguuucuuuaaaacaagcauuuaaguauaagaauucuucauguguguaucacuucuugcaguuuaaaaguugcauugugguuuuaaagggacauaaaaacaaucacaacaaauuaggcauggcuaccacacacauccuugaugcaggaaaacuacuaggcaagcacuuaaauguu
